United States Patent 8,067,671 (METHODS FOR GENETIC CONTROL OF PLANT PEST INFESTATION AND COMPOSITIONS THEREOF) - sequence listing, part 31

SEQ ID NO: 50878 - DNA, 3524 bp, Heterodera glycines
  Genomic contig location: Contig_ID=SeqID_3564; Location=127..3650; Strand=-
  SCN-specific regions: Sequence locations=1-630,657-692,715-1141,1164 -1335,1357-1425,1447-1456,1479-1570,1600-1794,1816-2055,2079 -2643,2672-2758,2780-3200,3222-3498,3520-3524
atgtcgagagtcttgacacgacaattccctgtcgctcaggcggacaaaccggcggttgacctggaacagttgcgccaacagttgcgccagcaacacgcgctgaaccaggaaattgttgcggagaagaacggactgcgcgacatggtcgtcgaggcgacaaaagttgcgcgagaactcagcagcaccctcggcggccaagagggccaagacgcgatgatggccaaggtggagcgagccaagcgcctggctgacgagacgatggagctgggcacggagcgggtggccgagttggagcaggtaaatgccgtgccctgtgtatgtcaagccgtagaattaattttgttacaaaaaacatggatttagcagggtttccatataatttttaaggcattttgccttctttctcatagttgctgattactgtatcactgataccccgatacagtatgctttaatggctttaattgctagcttttcatcagtgtcacgatagttaggagacggtttgaaatgtttacaattttatgacgggtttttatgaagacgtatctgacatgacagtttatgggcccactgataagaatataaattaaacactacgaattgatagatttttttggtccttgcaaaacttgtgaatttttaaaaatttcaaacgaaccctttggaaaacgaataaatgggggtaggggttataaaaaattttttaaatttcatccctaaatttgcttaggctttcgcgctgtgcaaagagttggacgccgaatacacggaactgaacgaatggatggacggggtggagaaggaactgcaggcatgcgaaccgatcacacttggcattgcagcgaaagcattgttggcacagcagcaacacaacaatgtgagggaattgtggaggttttgatctgatcaccactcaatgtgggggtacggtagaccaaacaaaattcattgttgatcaaattctcaaaaataggacgacaacctttatagacactccaataattagacactcaattggtatacatagtagactaaaaattgattgatcaaacactcaaaacagggagggatacgatagcgacttgaacaatttgggcaataatattcgccagtttaatttgctatttttctccattggcaccaaattttgaataaatttattgagaacaaattttatgatcaagagaacatagtctctggactcccctccctgaattttttctagtctcattttgaatgatcactgatcaattgatcataaaatgatcaaatttctttgttggtgcatattccagaaaaataatttgatcatttcattgtctaatgctcagacaataagtaatttgattataatttgctgattagtgtctaattgaaccactgtacggtgtttgttggagatgttaaattggcgttttgacctttttacttattttcatatctgtactttgttctccacgccccaaccctcctctttgtgtttataaggagaccattcccctcctttttttgactcttccctcattcattcgtttttattattatttgcatttgtccaccgaccgatcaataaatatttttattctttgtgtgttcaattggaggaacacaacaaattggcgcagtcagcagccatcttctctactgaagacactgcaattcatcgaaaaccaatagcacccaggtggtgtgaggtctgctaatatagcagttcaattcaactaaaaaccaaaagacacaattgtggtgaggttccgcaatacgcggttttatcttcaaatcttcaaaaatccttaacactcagcaagtgtagggagccaccaggtgtggttatttggatttcaacaatttggcaatggacgcggaccaactgaagcaaattctcgatgcagttttggcaaaatccgaaaagcggattcaacaaatgatgaatgcgcagcaaaatgttggaccttctgagagcctaagccatgcaaatttggcgagctcaatcgatggacgaatttcaaaatttcattacgactctgagtcgggaaatacctttgagcaatggtttaaaaggtttggaatcctgatagaagaggacggaaaggatttaccggagtcagcaaaagttagacttttgctcggaaaattggctgacggcgagtacgccaaatatagggacagcattagtccaactcaaccggacacagtcaattggaaagattccattgacaaattgaagggtttgttttcagaaacccggtcattatttgtccgccggtatgaatgtttccagattcgtcagcagccaaaccaagacgtgtcgacattaattgctcacatcaatgcatcatgcgagaatgctaatttgtcattgacaaaagagcagttaaaatgcatgattttggtaatcgcattgagcgatgaccaccatgacatgagacaaaaatgtttgaaaatgttggaggaggcagagaaaagtggcacacggatttctctcggacaaattgaagaagagttgaaagccatgcagcttattaaggacagtgcattggctcttctttcaccgccaatctcaacaaatgccatccaacttcgtccacaacaatggagagagcccaaatcaaagaaaggcaattacaattctgggaaaacgacagcaaaccagcacacaacgggaggcaaagcaaatcaaagaaagccgatctacccatgtggcgcttgtggaaattctgatcattggcgatctgattgcagatttttcagtgcaatttgtcataaatgccaaaaacagggacacatagcaaagatgtgtccccaaagatcagcttcgacatcaaattcaagacgtcaaaatcgggctgtgcacacagtcaaagtgacaagccattgcttgaatgtcggactgaatcgcggtcattggtggaagcttcaagtgaagataaatgacaatgattgtgagatgaatggggacaccggagcccaagcaacaatcatcacaatccaaacatggattaaattgggaagaccaaaattggaactgtcggacattgaaatgcataattgtaatgaggaaccatttcccaccgaaggaatgtttcaatgtgtcgtcagttgctttgacaagccgccaaaaaggctaactgcatatgttagcagtgctgtcaattacaatctctttggattgccatggattatggcttttgatctgatcccaagggaagtcatgtttcctaaggttcagcaaaaagagatgtgcgagccaatcagcatccatgccacattggcaccaatgccaaaggcaaacatcaaggatgaagcatcactgattgaggctttgaaaacggatttatctgatcctgaaacaggatgccaagccaattttctgcaaggcacggccaattccacacggtgcaactgaagccgtaaacgctgaattgtaccgacttttggaaatcggtgccattaagccaattgatttcagccattgggctgcaccaatactcgcagtgaaaaagaagaatggcaaaacaagg

SEQ ID NO: 50879 - DNA, 1106 bp, Heterodera glycines
  Genomic contig location: Contig_ID=SeqID_20357; Location=166..1271; Strand=-
  SCN-specific regions: Sequence locations=1-623,648-1106
atgacacattccgaaatgaacctcgaggatgttcttcaggtataattggatgtatgtaccaaaaagtaaaaagcacctgtttttcagtaagccaatggatttaacattagggagggatctattaatttttgttctaatcagggttcgaatttatcatgagggatgtcaaataaaattctccgataatacttgctttttcagttgttagaaaaggccagctcgcaatcatcaaaattggaaaaatcactaattgaaacacccaaaatcagcggcctttttgctgaaattttggacttgtttttggttgagctgacgaaccttttcacctccatgtgttttgacttgaacaaaagccgtacattgaattcggacgaccaagcaactctttgttccatcgtcagatgtgtcccttatttaatcacagtcatttggaaattactgagcagttccaacctttgcaaaatctgtgcgtccattcaaaaaagtgcacaattgtgcacaaagtaacgttgtagcctttattctctttaatttcctattttagtaaattgtccgccaggcgttccaaaattattcaaacggcggtggaatttgttgtctgcttttaccaatctttcgcttctttggagtttaaattcaaatttgttcaagacaacgttgacagaagcgagtaagcaaactgttaaaaaaagaagaaaaccatataaatttctgtaagatttattgtccgtttggatgaccgaattaaattagaagacgaattcgacaaatttgttgctggtcgtatttgtacagactttcaacgtatgtcaatgaaaagagcattggagacggcgtacgaagtgaaaaggcattgcataagggacacattggccaaacagcgaatgtttgaggcaaagttttgcccacttattctttttttctttataattcatttgcaattaactaaaattttcggatatttttcagtttattggtcacccgaaggagcgcgtaatagcagaccaattgcaagaattagccgatattatgcccgacctatccaagcagcagttgcacgtattgcgaattgtctttcgttgttccgttgcatttcgtccttttag

SEQ ID NO: 50880 - DNA, 102 bp, Heterodera glycines
  misc_feature (4)..(4): n is a, c, g, or t
  Genomic contig location: Contig_ID=SeqID_20357; Location=2003..2104; Strand=+
  SCN-specific regions: Sequence locations=1-11,34-102
ttanaggaattctatttgttttttattcaatttcgacctgaatgtcagctgcggtttcttcttcgcgtccgatggaagattggaaatctgagttagctatgc

SEQ ID NO: 50881 - DNA, 1042 bp, Heterodera glycines
  Genomic contig location: Contig_ID=SeqID_20362; Location=369..1410; Strand=+
  SCN-specific regions: Sequence locations=1-641,671-682,721-976,998 -1042
atgcccaaatgcacgtagggcgtctttacacattattttaagtatttccagtgtaaaaaattcatcataattacccatcaacccctcagaatccctgcgtatcccccctaacaaaaaaagtaggcaaaaaaaattgtcaatcagatccctttttagggtatttcccgaacccggaccaaaacctgccttataccatctgaaagagcaaagtctgtagaagtgtcatcaactcttcttttttcgattgcaccgattttaaggcaggatatgagccatcaaacacaaactgtcaaaaatttttgaaaaaattttcaaaaattttctgaagaaacttttttttacgctaaaattgcaaaaaacgctttccaccaatcgatagagaatccttaaaaaatagttgtactcttttgttcggagccaatccgaccaacttgaagagagttattcaaaaaatttgccttcaggtgctagattcctcttatatagagaatatgtaaaaacaattttagctgtcttctccagtcaattatcactggtaaaaattaccatcgaaaagaagttgaggaattcatgaacatcattagatatgacgttctgcaactggtaattaatgaactttatataattaatcatttttcaacaaaaaatattcaaaaagcaaattttgtgtatcggaattctgttttttaaattttaaattaaatagaataacaataaattcgaaagttagatcggtaatattttatgaacaaatttttcagttgactttcggttccatttgcgccaacatcacatttgaaggtgaaaaagcaagaatggagtggtatttggggcgtctttccaaaaatgctcaaatgatactcgacaacgtggagccttatgtgtcaggcgaacttgtaagatgattcttttacattaatttaaaagtagtgacaaatttgtagtgacctttatttctacttaaacaatttatcactttttaaaaaattttatatttcctacaaacctagatcagccctattatggcacctttaaccaatta

SEQ ID NO: 50882 - DNA, 293 bp, Heterodera glycines
  Genomic contig location: Contig_ID=SeqID_20362; Location=1581..1873; Strand=+
  SCN-specific regions: Sequence locations=1-21,63-293
atgaaacttttcatttttcccttttacatacattcatttatagtatgaagtaaatgtttaccattttttaaattccatagaaacttttttgtgaatttttactgaatttgttgtttaattttaagctaaaatcattccccaaaattgaaaccgcgatggctaagcaagttattgatgatatgtcgtttactcaacccgttactgacaacgcgacaatcttccagatagctacaaatgtgttcgagattcttgatgaatatggcaataaaaagtcagcttgtatatttaaatag

SEQ ID NO: 50883 - DNA, 1246 bp, Heterodera glycines
  Genomic contig location: Contig_ID=SeqID_20364; Location=377..1622; Strand=+
  SCN-specific regions: Sequence locations=1-539,564-567,609-692,714 -1034,1069-1246
atgaacactttcactttggccaaaaccgtgaggaaacgattactttgaatgatgtgcatgagcaacagaaacagagcgatgaagtaattgacagtggttatcgtgatgaggaggcaaaacggcagtttggaatcacttcccggatcgaaatcccggtttcgcttcaaaaattcaacaaattaattgataaggtgcgagtttttgcacgaattcatatgctaaccaacaaaccttgtattatgtattactagtatttaatctttcccgacatgggcttttacgaactgtttgcaaacttagtaaactaccgttttactctgttcaaatcctccgtttttacaatattttagctctctgaacaacaggagaagcccccctatgatgacagcattgaccaacttgaacgccaattgcgtctgggaaagcgtttgctgagccaatttaaccgcaaaaagacaccaaaattggctgatgaacacggagaagagcacaaagaaggggaggaagatgagcaacagctaaactcatcggaagaaaacaatgacgacgaattggacaatgaccagccccaaacatcaacagcaaatgccaaaaagaaacgtggaacaaaacgaaggcacatgcccagcagagttgccaaggtcagtccaacagacagaggggaaaagggatcgcactttttgattgatttgaaataaatggatttcccatgtcagaagagactttcatccaaaacgaatgcaaatcgggaaaagaagcaagacgggggagaatggttatcaaaagagagtgcaagtcgccgcgtttcatctgcggaccaaatcgaagaatcacacaaaacgacggaccatttgcgcgactctgaaaacgacagcgaatcaaccggcggcagtgaaaacattccgccgccaccgaaaatgacgagggcccagcaccagaaaaacttggtaattccatgtcattttattgttcaactaatggcgtatttaaattaaggagatcaaaaagcttttccgccaagcaaaccgtgcaatgattgaggacgacgacgaggaagaggatgaagagaatggacaaagtgatcggaagtcaattaagtcggaaagtgacggcgagaaaaaagcaaccggaagacaaattaaaaggtttttaaaatgttttggtctttttgaaaaatgatttaacaggcgagaatctctgaactcatcgagttccgaaattgttctcgacagtgaagaggatggaa

SEQ ID NO: 50884 - DNA, 402 bp, Heterodera glycines
  Genomic contig location: Contig_ID=SeqID_20365; Location=203..604; Strand=+
  SCN-specific regions: Sequence locations=1-135,177-402
atgccgtcttcgtctgacctttcgcgacagccgatcagcagcacaccgttccgtttccggctgaatttcgacgatccgtctgcatacagtgacaatggtacggattggatgtcctttctaacaacccttctaattttgatttggaattcagagaatcggccctctccagccaaccaaacttccgtctctctgcctgacaacggctgcaacgtttctccgtacgcgcgttacacgggcagcggagactcaccgaccagcagtcggtccggcaacggacggaagcggcgcccgcgcagaggcgacgaattgttcatggacagacggcacttgcgcaagagtcgagaggtggaggaggatgaactggacgaagtggaaaatgactacacaatgggcgacgactga

SEQ ID NO: 50885 - DNA, 624 bp, Heterodera glycines
  Genomic contig location: Contig_ID=SeqID_20366; Location=12..635; Strand=-
  SCN-specific regions: Sequence locations=1-332,354-497,519-624
  Gene Ontology: Mol. function=structural constituent of cytoskeleton; Cellular component=Arp2/3 protein complex; Biological process=cell motility
ataatgcaatttctattattaaattgtttcaaattttccttgtagatttattgaggcaaaatcggaccgggtgactgtcattttcagcacgttgttcaaagacccggacgatgtggtaatcggcaaagtgttccttcaggtttgatgttgctgatttggatattcaaaattggtttttgtaattacatttaggagttccgtgaggggagaagggcaagtcaaactgcgccacaagtgctctattcggtgggcgaacctccgttagaactgaggaataaccccgaggcaagggttggggacaacgtcggatacatcacatttggtcagtcagttctctcattttcattgctgctcaatcatgcgcattcaaaagcacaccgaaagttaagttttgttcccgcgacatacgaacaaaaaagcgcgcgacaacacaatcagtttgatccacacatttcgagattatctccattatcacatcaaatgctctaaggttgcttttttcttaagaattaaaaaagaagtttaaaacaatcaatttccagcagtttttatggtaatagtgcagtttgtccccccatttttcgaaaaaaaataaaaattttaacaaagtcgtgtaaaacactt

SEQ ID NO: 50886 - DNA, 733 bp, Heterodera glycines
  Genomic contig location: Contig_ID=SeqID_20368; Location=1161..1893; Strand=+
  SCN-specific regions: Sequence locations=1-104,128-359,381-493,515 -538,561-641,678-733
atggtatataaaaagagcaaatacggtaagttgtttgtttaagcaaatgtttcggaaattaaaacataaaatacaatgagaaatcaatttacagtaaaatccaatattaaacttaataagtaattttggttcataaaatactgaaaacttccatatacgtaattgagttatgtcctgatcggatctaacttttaaatgtccaagctgtgcgagtttttggcttccagcaggttaagcaaaaacttcaggttgtaagcaattctttcgtcgtgtcgtccacgaaacaacaattgttcgttcacctgtccaaagcgagatggagttggaagttgggactacttttttttgatacggaaaagtccaagcttttcttggccaatttggagaagcgtaaaaggagcgcaatgctacaatttaatttcactgatggagaagcgaagaaaacaaatgataatttaaatccataattgtggagaaattttaatggaaattcaaatgaatgaaatttaaaaatcatttttttaaacttcagttaaaatgtttctcagcctttttatttcttcaattttccgaaggcttggctcaaattttgaagaaatcaagaaaattaaactaataaatgttaacgattgatcataatgatatttttgtaattaatttttaaaaaatcaaattaagctagaatagggtatttaaagactaattttaatcgtttcttaataccgtagttata

SEQ ID NO: 50887 - DNA, 179 bp, Heterodera glycines
  Genomic contig location: Contig_ID=SeqID_3565; Location=770..948; Strand=+
  SCN-specific regions: Sequence locations=1-37,59-76,98-104,134-179
atgcaacaaaaccaacagcatcagcagggcaataccatggaggatggaaatgacaatacggtagtggtggtgatgggacagcagggcgggactacggtagactgggacagcagggaggagcagcaacagcacttggacatggagacggcacgcacatcgcgcaccgaggacattatcca

SEQ ID NO: 50888 - DNA, 2332 bp, Heterodera glycines
  Genomic contig location: Contig_ID=SeqID_3566; Location=82..2413; Strand=-
  SCN-specific regions: Sequence locations=1-106,128-433,461-919,941 -1084,1111-1680,1705-1771,1793-2231,2267-2279
atggccggaacattggacaacaagctgtactcgtggggaatgcacaaatgggcggctgaggggcagcagcccaaggaaaatgatggcggtgccgatcagagcgcaaaggcggcggaggacggcgccggcggcaccagcgattgctcctatctgtcctccaccgccacctcattgaccaacagcgacgggaatacggtagggagggcatccattcaatcgagcttatgcgaattttaaaattaaaaaaaacacaattagatactgtacttacggaataaaactcgggactctatttttcaacctccctcaaaatgggggcttttctggggggggggggcttctaattcagggggtgggttctatttcagtaaatatgataaaacaaaaaaagtgaatttgcctcaggcaacacccgtcgaacaaccaaaacagcagaaggagaggaagaagaggaagaagagtaagagcacaaaaacgacggtgaggcatttgttccgcgaaccactgcagtacgaaatgtcgcaaacgcgcgaaggccaattagtgcggttgaaaaacagagacgacctaatggacaagccaaaaccgtttatgatgcagccccatttggtgctcaggttggcacttctcttctgtgctgtagttttgttggtttggaccattagacggtcgatcggaaggactgatcagtgattctatcaaattgatagtgatctgctggtccgttaatccgattgtctgaactgaactctctccaagccgttgcttttgtcatcccctgtccaggttggatatctgtcgcaaatcgttcggcagcgtttcgtcccccacggcgacttcgtcggcaccggacccttccggtcagctgagtccgccctcaccgtcggcacattccaccacttctgtcgcgggcaaatcacagcagccgcggctcgcactgtccgcgctggtcggcacgcactcgcgcgttttctgcgtggtcgacgtgtcaacggaacctttcccgccggcaacggcacaaagcggcgaaagcgacaaaaaagtggcggaaaacagtgacagaaggtcgattgctgcaatattctaaattatttataattaatttttaaagcagaaaagtggcgccggtcccaaaagtaattgacatcagacgaagttcggcgcccgaccaaagcgcaatggcacaagggacggccacttggattcgggaagagttggaaagtgccgaagtcatcccataccgaaaaatcgtaaagtcatttgaatttcaattatggcatgccattagcgacaacataaaaactctcgatgcggaaatgcaaatcatttcccggcatttttatagcacagagtctcattcatttccatgtttagtgcaattttcggtggcatttttttctgttttatggcgaaacttccgacaatcactcgcaacttttgaatttaaacttttggaatcgaatgtttatttcctcaatttccaggctaattccgattccatttgtaactcatcggctttgcacagaaagtaaaaaaaaaacaaatggccaaaaagtgccattttttgtcttaagtttgcccaaaaatgcgcaaagactgcgcgaggaaattgccgcgctgagaagtcaattggcggagcacaaaaacactgtccgggggcatcaaagccaaatgagccaactgcaggtggaggaggaggcgagaaacaatttggaaaggatgccaaagccaaaaaagcggcaaaaatgccgagttccgggaaatacgagtccaaattaaaatttggaaaactccttcggtcccaatctcatggatgcataatccggtcaaatcccgactctcggctttgtagacaaaattggccgagttggagtcgctgctgcggcgccagcacaattcacccggcggtctgccgcccgtcaacggtcctccgccgcccgcttactcttccgctgtttccgtcccatcgccgcggtcgaaaagcatcgccagcagcggaggagaacaatgcggacaagaacggcaaaagctgcagtcaaactcgaccacatgtgccattctgtgacttcaaaaaaatcgccgggacggcactttgacggagagacaaaaagcggcggaaaatattgtggacaattctgtggtgccaaacacccactaattagcagtaattagtgaaaaatgaaaacatcagcagacaaaaagagttcgacactttatttggcacaattttcatttcaatgttagaaaatttaatgttttataaaattgttgctttcttgattaattaaaacaattattatttttttgtttttgcattttaatttaaaataaa

SEQ ID NO: 50889 - DNA, 2732 bp, Heterodera glycines
  misc_feature (618)..(618): n is a, c, g, or t
  misc_feature (629)..(629): n is a, c, g, or t
  misc_feature (652)..(652): n is a, c, g, or t
  Genomic contig location: Contig_ID=SeqID_3567; Location=354..3085; Strand=-
  SCN-specific regions: Sequence locations=1-680,702-718,740-1058,1081 -1137,1220-1560,1583-1603,1625-1810,1855-2732
  Gene Ontology: Mol. function=protein serine/threonine kinase activity; Cellular component=centrosome; Biological process=protein amino acid phosphorylation
agtgggactcacccatccttccctttaaaatatgatatgatttttctgtccgaatttgcggcatggacattttgcacttgcccccttttttaccggaattttttgtctataattaataacaaatcccccaaattcagcaacacattcgcacttctcggctgtacgctcgtctggtcggccttttgttggatgtgctcctttttgtcgagttgggtgccgacccgtacaatcacatcaccaaatacaggcaaatcagcgagaaattgcgcaatttgctgcgcaaagtgcgcaaacaaaacaatggtaatgcgcgaaatgctcaattttaaattttaaatcccattttcagaagaggaatggtccatttttgtggatttggcgggcgtcccgtgggtcaaagagtccgccgatgcgattgagtcgccgaaaaaaccgctcaaaaatgtgacggaaacgccgagaaatgccaagaaaatcaaattcaaatgatctcacactttcatatccttttttgaactttggtgccataccataaatccattgatcaactgactttttgacatttgccttgaattgtccctcaaatttcagactcattttcggtttaaaatttcgtanaaagcgaattntctcgagaattccaatgtcttanagccaatgcctcttctgacccatggcttacaattttatgaattttttgtagggaaacaatggcatttctgtgccctcctcacattcccattaaatgtcacatttctttttttgtcgggtcacacaaattatgtgtgccattgccattattggaggagcagcaaaataataatatgtgtaatattatgtattatgttgttgttcacatggaaacaaaaacagcggcggagagtcgcggcagtcaaatgaaatgcggcgggcacagctcaaaatgagcgacgaatgccgaaatgggaagggcatcaaaagttggcacatttcgcttgaaccctcggcgcggcacaatgcgtgagaaactcgggctttccttccccgcccccacccccaatttgccatcgttcggcccctcttttgctatttttctttgctcccggacaatccgtcagcaaaattttattgttaaaacgtgaaaaagaatttaaatcgttaaaaaaaaattaatttaatttgttttattttaaaaaagtaatgaagaagcattaaaaaaaattaaaatataatttatatagaattgatagtaccgtatatgctctaattatagcccagtctctattaatcccgcagtctcaattatcccccagtctacgaggtgttttgaaaaataatccctctatcataatcccccagtctctaattatccccccttttctgaggaggttgaaaaataatcccccatgggctataattagagcatatacggtaattaggaatattgtaaattccatccaatttttttttacataataattgcaaaattttgatcattgctcaagcaaataaatttgctgacgaattgtgacggattgtctgtccttcactgaagaattgtccattgacggattgtctggaccccatttttcttgttaaatatcaaagcaagaattcgaattttcaaaattacaaatgcacaaaaattcgttgccgtcggccgccctttccaacacggcgcccctttattcctcctatacgccgtcgcctcacgcgtcgcccgtggccaaaacttttgccgaaggcggcggcagcgaatgtcgcgcattggcaaaacacagttcggcagcatatgagcgaattcgaacggttggcaaaggtcggaagggagaaaaattagaaaaaacaaaaatttaaaaaaaacaaataaaaaaaggcaaaatggccaaagatgaaattggcacttttccaggctcttttggcatcgcggttctctaccggcgcaaagacgacgattcatttgttatcctcaaggaaataaatttgcacgagctgacgccaaccgaacgcaatgtctgtcggtgatcggggagaaaacactctgatcaagttctttaatcgctctcatcagtattccattcattaggcattcattgagccgattaatgtggttaatcactgacggaccttagcaatcaaatggttgcttgtgattacataaagcccgcttgaccattaacatacctaatttggtctctgatcaacttaatttgactagatcgctttttaatcgcttaattagaaatcacattgatcaattggtgatcacctgactgaatcaattgtcagatgagcattgtctgatcagtaacagccaccagttttgatagatcaaatctgtctgatctggtcagtagggtcagagccatcttatcactcgattcgattagatcaccattctgatcaaaaaaatttgtctgcttttcaaattggtcaatcagccgatacattgtctgatctgcaacagtcctttgctcatttgccttgtcagatgtcgctgaatgaggtggcgctgctgtcccggctcgaccacccgcacatcatccactacttcgactcgttcgaggaggacggcactctgatgattgagatggaatacgctgacggcggcactctcgcgcaactgttggcccaccgcgacgacgcgcagccgttgcccgagggcgaagtggtggacattttcgagcagatgaccagcgcagtttcatacttgcacgacaacaacattttgcacaggcaaagccaatcgatca

SEQ ID NO: 50890 - DNA, 944 bp, Heterodera glycines
  Genomic contig location: Contig_ID=SeqID_3568; Location=102..1045; Strand=+
  SCN-specific regions: Sequence locations=1-116,141-275,302-318,340 -534,556-832,854-859,882-944
atggcacagcagcaaatagacgagagggtggtcgtccaagtcggcaacactgttcaacagcacgttgcgcttgtgggccgacgcggaggaaacggaagcggaggtcaaccgcaacagcgcggaggaggaggaggcggaaggcggtgccaacgcggagcaggaagacacattcgcggcggcggaggaacaactgctgatgttgccgatgccgtggtttgccgccgcccctcgctcttcgtcaccgtcgctgcccaacaacggcgcctcggtgcggtggcgtcggcgcgcggcggtggcggcgtaatcgtactccaacagagtcaacaggaacagtttgtactggtcggaacggacgtcatttctgcgaaaaagcaaaaatgggagtcgtgtagattcaaaaaattaaaagaaaattgtaaaatcgagcggagagatttgcccggaacaacttttttttttttactaaaaaaggacaacccaatttattttattgggattaaactcggaaaaggctgaaatggcgaaaaactttcaattttaaataaaacccaaagtaattggatttttggggtcgatttgcatgaatccataataaatttgaatgccatatgtgcaactcattacctgaaaatgttgcagcatttgtcaataaatttgcgcacattgtcccgcacttggccatcatcattttggtccgcctggtcaccggtgacgacgcaaatccaaagccagcggaggtcggcactgatcggcggtcgaagctcaaggcaatccatcagaaaatcgtacacatccaacacgtgctgttcaatgtcctttggctgattctataaaaaacagaatttaaaaaattcgctcgtttttcttttaaatttttaaaattcggggagggaatgaaagcaattcccccccccccagaattcaattttcacttcccctcaaaa

SEQ ID NO: 50891 - DNA, 496 bp, Heterodera glycines
  Genomic contig location: Contig_ID=SeqID_3568; Location=434..929; Strand=-
  SCN-specific regions: Sequence locations=1-273,295-496
gaatcagccaaaggacattgaacagcacgtgttggatgtgtacgattttctgatggattgccttgagcttcgaccgccgatcagtgccgacctccgctggctttggatttgcgtcgtcaccggtgaccaggcggaccaaaatgatgatggccaagtgcgggacaatgtgcgcaaatttattgacaaatgctgcaacattttcaggtaatgagttgcacatatggcattcaaatttattatggattcatgcaaatcgaccccaaaaatccaattactttgggttttatttaaaattgaaagtttttcgccatttcagccttttccgagtttaatcccaataaaataaattgggttgtccttttttagtaaaaaaaaaaaagttgttccgggcaaatctctccgctcgattttacaattttcttttaattttttgaatctacacgactcccatttttgctttttcgcagaaatgacgtccgttccgaccagtacaaac

SEQ ID NO: 50892 - DNA, 449 bp, Heterodera glycines
  Genomic contig location: Contig_ID=SeqID_20370; Location=470..918; Strand=-
  SCN-specific regions: Sequence locations=1-23,220-223,246-256,282 -301,323-449
atgggaggacggcgagcagaaaaaggaagaaaagaaggaggaggaagaggaggagaaaaaggagaaggaataggaggaggaagagaaagaaggaggaggaagagtaggagcaataggaatgggaggaggaataggaggagaaagagaggaataggagaagagaaagaggaggaacaggaggatgaggaggaagaggaataggagaagagaaagaggaggttggatgcttaatgaagcaaaaagaaatgccattaccatttcaacagaaaacaaaaaacacattaattattttatctcagccatatttttttattataaatttggtgccaacttttgcatagttttatatatagcaatgaaaatatttcagaatgagcttgcaaatttggcatgccaatcaccgatttggaaagaataatgccctgacattggcaatgctaaaaaataaa

SEQ ID NO: 50893 - DNA, 447 bp, Heterodera glycines
  Genomic contig location: Contig_ID=SeqID_20370; Location=1103..1549; Strand=-
  SCN-specific regions: Sequence locations=1-447
atgaaagttggatcgactattaccaagggagcgcatgaggtcaatcaattagttgtgtccccggcacggcaaaaggcggggcagggcgcaaagttcgtgtacgaaaaagcaacaaaagtattgaagccgaaagcgaccgctgaaagtgccgaagcgaaaggtgaaagtgccaacagcagcagaagcgaaaatggtgacgagaagcaaagttgcccggacaaagcaaacgcagcagaacggcaaggcgaacaaagtgttgatgagcagccaaaggagagacactcatcagctggtgatgatgagagtgccagcgaggaaaagccattgaacggagagagcagtggtgccaatgttgcaggcacagctaacgcaagaagaaaatgtccagtcccagcgatagcaaagaaatttgtctcaatgactgtgcaagtttcaaaaaaaaattaa

SEQ ID NO: 50894 - DNA, 697 bp, Heterodera glycines
  Genomic contig location: Contig_ID=SeqID_20371; Location=108..804; Strand=+
  SCN-specific regions: Sequence locations=1-169,191-268,290-697
atgcgtttttactacagtaccctactgtcccttgcttttgtcctatctctgtgcttacggtgtcccactgtttggtcagtgcacagtaagaacaagaatgactccatgtctaatcaccaaagtgaccacgattcgatggcacaacactcggaaacggaaggcggcggcaaattaaaaatgccagaatttattaagaaacttatgcgtagcaaacaaacgaaaaaagacaaaaaagcggcgcaaaatgacgcccgaggggaacaaagtgaaagtgaaagtgtacagaatgggcaaaatgacaactcagcagaaatagcgaatatgctaaacgaaatgcctaggtggacgacgagtgccgggacgagtcgaaacatagccgaaaacaattcgccactccatggatcatcccccaattattacaacacggtcagaggcagcaggcaccaacggacaaaaagcagcaaccctaatcaacaaccaggggccgtagtcaaagaaggtggttatttgaccagggcattaaccatggtcatttgacctggtcaaataacgaccaaccatgtgaaaaacggcagtaaaagaagatggtaaattttctgctggagcaaccaccgttttttaaccgccaaccgtcttcttttactttaccaccaactttctaccatgaactgattaaaatttgcacttgtcatattaa

SEQ ID NO: 50895 - DNA, 229 bp, Heterodera glycines
  Genomic contig location: Contig_ID=SeqID_20373; Location=228..456; Strand=-
  SCN-specific regions: Sequence locations=1-3,25-194,217-229
atgggagagacagcaaaagacgaggaagggatgaggaagagcgaagagaccgagaggaaaagcaagccaatggaagaaaacaaacaaggaacggctgaagcaacaacaacgtgggcaagtacagaaagacctggttcaactgctgctgaaggaacgcagagaatgaacgggacaaaaaaaggcattccggaggcggaggaggaggaccaacaccaacagcagcaaatcg

SEQ ID NO: 50896 - DNA, 289 bp, Heterodera glycines
  Genomic contig location: Contig_ID=SeqID_20375; Location=406..694; Strand=-
  SCN-specific regions: Sequence locations=1-242,265-289
atgcaaaaggaggagatgcatgtgatacgaaatggacgaaatgggaccaaacatgacgaagtgcactccgttgacgaggcacatgaccatgtcagtggtgcaggtggcggtgcgcatcatgatgaagtaaattaattattattatggtgatggaatttatggaatttgaaaaatggacgaataaaatccaaaaagaaaaaaaagaaaaataattgataatgtaaaatgaccatctattttatgattttattttcagatgtcaattaatatttagaatgaaacaaataaa

SEQ ID NO: 50897 - DNA, 89 bp, Heterodera glycines
  Genomic contig location: Contig_ID=SeqID_20376; Location=342..430; Strand=-
  SCN-specific regions: Sequence locations=1-89
tgttgtacctcttctaatcacttttgtacctcttctaatcacttttgtacctcttttatcacttttgtacctcttctcatcactgttgt

SEQ ID NO: 50898 - DNA, 1112 bp, Heterodera glycines
  Genomic contig location: Contig_ID=SeqID_20378; Location=894..2005; Strand=+
  SCN-specific regions: Sequence locations=1-110,134-452,476-510,553 -639,662-901,928-935,975-1112
atgtcagttggcgagatgactagttggcgaaatgtcataattatggttagttggcgaaacgtccgaatttggcttagttggcgaaatgtcgtcgtgcccttattttaggctaaatattaattttttttttaaacgacaaagtctccgcgtggtcatgaaaatgaatcatcgaactttgaggaaaatgtgagccgaattttccaattctatggcaaatgataagggctttttgcatttcagctggatctgtacggatgtttggatggacattttccctcattttgaccgtcctcaaattggcactgatttcgccacgtttcaatgcgttggtggacaaacatttcgatggcaaaagcgaattgacaatttggaacaaatctccaaaaggtgctatggcgttagtcaaaaaaccgccaaatgagaccctttatttttttctcatgtcttttactgattattttgtataaaattatctagcaataaattttaatatttgcctttaccaatttcaaatatatttttataataatatttttatatatatttttttttgtctacgtttaacaaacaaactacggtcatttttactgatttttgtgttttaaatttgaaagtattaatgcaaatttccctacagaatatgtaacaaattatttttaacaaggtcttgcttaaggactaacaagcattacgaatcaaattattttcaacacatcgaaatacgaaaatcgtcttttttcgtcgcgtattaaagcaatatttctatttgtccacttcgactatgtctttttctgttgccatggtgatctattaaaaacttttagttcgacatttaatttgtattaaccataaaaacaaatctcctcaaggtttggtgttttatcaagccaagatttcagacaaagatgtttaaaaatggaaatgaaattgtttagttaaaattaatctttattttataattaattaaatttttagatgtcttgcttaaggactaacaagctttataaaattcatagaaaagttgatattccttataaatatctcataatttctgaattgctgtagggcttgggttaataattgcttcaaaatctccaaatccgtcgtagtaa

SEQ ID NO: 50899 - DNA, 1922 bp, Heterodera glycines
  Genomic contig location: Contig_ID=SeqID_20379; Location=1..1922; Strand=+
  SCN-specific regions: Sequence locations=1-21,44-417,441-797,819 -973,996-1878,1901-1922
  Gene Ontology: Mol. function=ATP dependent DNA helicase activity; Cellular component=nuclear telomeric heterochromatin; Biological process=DNA replication
ttatcatcagatacctgaaaagttttgttttaagaaaggactttggacagacgagaaagacatattttaacacaattggtcgaatggtgaaggatcaccggctgagccggagcgataccacctgaggctgttgctgttgaatgtgaagggagcatgctcctatgatgatttgaaaacagttattgatattaatggtattgcaaaagtttgtgaaactttttcagccgcatgtttagaaaaaggttttattagaaatgatgaagagtggaaaagagcattagaagaagcagagagttttgaaatgcaatggaaattgagagagttctttgcattgattttagtacattgcaatccggccaaaccggaagagctttggaatatgtttaaagactcattgtctgaagatttttgcaggagttttagaaaagttggcttatgctaaagcatataaagagattgcacttagcattatgaaggctggaaagacgcttgccgattttccaaccatggaacagataaatgttgatgatgatgttgaacaactgtttgacctagccgaaaaattggatttgggacaaagaattattctttgatgtatgataaacagaggaatgtttgtgatgccattttgcatagaatatggaatcctgtaaatgaaccccccttctactttcttagtggaccgggtggaacaggaaagacacatgtgaacaagacaattgtacatatgctgagaggtcaaaagaagaaagtttgtacaatggcttttactggcatcgcagcaactttgctgcctgctgggagaacattgcacaatagatttggactgactttggatatgagtaattcgagtattagtccgagatcaaaggcttggcatgaggtgaaagacacagatttgtttatttgtgatgaggcgcctatgataaataagcgcgcaatgagaactttggatgagaattgagagaaattatgaataatggaattgcatttggtggcaaagttatgctttggacgggagactttcgtcaaacccttccaattcagaaacatgccacgagagctgagatggttaattcgactataaagagagtgagtattggagattagctaaaagatacaaattggcaaagaatatgagagctcttgaaacagagcaagaatttgcgagagatttgttagaaattggcagtggaaaattgaacaatgaaaatgatgagataattttgcccgagaattgtattagcaatggtgatttagcagaagagatttttgcaaattgtattgcttctgagaattggaatgaaatggccaaaagtgccattttagcaccgaagaatattgatgttagtgaaatgaataatagagttttagaaatgttgccaggagaagaagttgtgtatacgagtatagacttagctcaagatgagaatagacagagagcagatgaatatttggatgagtatttgaatgctttgaacccttcggggtttccacggcataagctgaaactgaagaaaaatgctattgttttgttaatgcgaaatttgactatagaaatgggactttgtaacggttcgagaatgaaagttgagcaaatgcaaccgaatttgattgtgtgtaaacttttgactggagataaggcaggtcagactgtgtacattcctcggatcacgctttgctgttctgaggattatccttttgacctgcataggcaccaattcccgttggtgttagcttttgcaatgacaattaacaaggcccaaggtcgaacccttgagcaagttggaattgatctgaggaaagatgtttttagccatggtcaattgtatgtggctctttcgagagcaagagcttggaataagctgagaattagattagatgatagtaatttagagagaaaggtgatgaatgttgtttac

SEQ ID NO: 50900 - DNA, 1125 bp, Heterodera glycines
  Genomic contig location: Contig_ID=SeqID_20380; Location=509..1633; Strand=+
  SCN-specific regions: Sequence locations=1-265,303-532,555-857,879 -1027,1049-1125
attgatctagttcccggttctttaccatttcattttcgaccctacagatacccacccgaaacgcagaaagaaattgaaagacaaattaaaataatgttggaccagaatatcataagagagagcgaatccgagttcgcatcccctatcgtaatggtccccaaggcagataaaaaatcttggcgttttgccattgattaccggtcgctaaataaaatgacaaaaaagcgagttttccatttaccgaacattcaagaattgttagacttaatgggctctaaaaaatattacacatcaatggacatgcaaagtggtttcatgcaaattccaatgtccacagaagacatagacaaaacggcatttatttcacaccttggcatttatgaattcataacaatgccatttggtcttactgctgcccccgatacatttcaaagagtgatgaattcacttcggaggcgtctaacagcagcaatgttaatttatctggacgatattataatcggaagcgaaaccgaagagatgcatttaattgacattgaaaactttttaaaattattaaaagaagtgggacttaaattgaaaatggacaaatgccattggggaatggcagaaattcgatatttgggatttttgctaagtgaaagaggcattcggatggacccaagacaagttcaaacggttcaaaattttaagccaccaaaaagtctaacggaacttaagtcattactcggtgcgctcacatattttagacgttttataaaaaattttgcacatattgcccgcccgctacaaactttaacacaggataaattcgagggcaaaattgaagagaattggggaaaggaacaggatgaatcattaaatttattaaaaaatttgctaacatcggcaccagtattacagtcgccgagatttggtaaaccctttacaattgagtgcgacgcgtcaaaaaaagccattggcgcggttttattccaagaaaaaggtcctgttgcatatgcctcgagagcattaaacagacacgagacaaattatccatccattgaaagagaggcactagcattggtatatgctgttaaagagttttccccctatattattggctcaggggtaaccaaaattatt

SEQ ID NO: 50901 - DNA, 770 bp, Heterodera glycines
  Genomic contig location: Contig_ID=SeqID_20381; Location=8..777; Strand=+
  SCN-specific regions: Sequence locations=1-303,327-577,599-770
atgggtaaaattttggaaaatgaaaaagaggaaaattcggtaaaaattttgagtacaaaaaatgagggtgaggaaaaccaattggaaataaaaggagcaaatatttctatagaagaagtggtgaaagagcaacgaaaagtgaaagaactcgcacaaatttattacattttgaactcaggaaaaattcccccggaattgaaatggaaaagagtcccaacggattattgtctgataaatggcgcaatatattacaaaaaaggaaaagaaaattcggaacaaccaaaattaatcattccataccagttaagggaaaaattttttcacaatattcatgatgagggacattttggttttgaaaagacatggccagaaataaaaaatcgattttattgggaagaaatgaaaaaggatgtccgattattaaccgagacttgtgaattatgtcaaaaaagaaaaatatacccaggacaagcaaaatcggcaccaagtgttccaattgtgccagccgaagcaccatttcaaagagtacattgtgacctaatgggtccacttaaaaagacgagacttggaaatctatacataattttaacaattgacagtttctctaaatgggtaacggccaaggctataccaaaccaaaaagccgatacagtatctgaggcatttatagaaacggttatccatcagcactcggtaccagaaattgtcattacggaccaaggaagacaattcacatcacaaatttttgcagaactttcaaaaatatatgg

SEQ ID NO: 50902 - DNA, 1062 bp, Heterodera glycines
  Genomic contig location: Contig_ID=SeqID_3569; Location=54..1115; Strand=-
  SCN-specific regions: Sequence locations=1-71,95-227,265-289,673 -980,1002-1062
  Gene Ontology: Mol. function=cytoskeletal protein binding; Cellular component=cell-cell adherens junction; Biological process=N-linked glycosylation
atgattgccgaagtggaacggctgttgactcgaaaaaggtcctcaccggtgcatgaaagttttgggaacattgacgacgacgatgaggaggagggcgagattcttgacgtctcgtttgttgaggaggaagaagacaatacgggcgaagcgcccttaaacccactttcatatttggccaagcaatcagcggctcaacaagaaacgttgcggcatgaaaaatgggcacaagaagagagaaagcgaagggaagaggagcagagaaagcagcgagaaaatgaacgtagacggcgagaagaagaggagaggcgtcgtaagacagaagaagaagatagaaggaagactgcagagaaagcagccaaggaaaagaaggcaaaggaagagaaagaggcaagtgaaaagaaggcaagggaggaaaaattggcacgggaaaagaaggaagagcaaagaatagcaaaggaaaagaaaggcgagaaagagaccaaggataaaaaggctgaggaggagagagtagcaaaggaaagaaaggcagaggatgagagagtggcaaaagaaagaaaggcagaggaagagagagtggcaaaagcggaagcggagagagcggcaaaggcggaagcggagagagcggaaaacgagaccaagaaaaagcaagaggaggaaaagcagttggaagagcttaaacgacagcaacaggccataagaaagcaaaaagagttggagctgctcaaagagttcagaccgtggcgaggcgggtacatgaggctggtgcacggcaaagacccaacccccgacgtacactatctgcacgaaacggatgattaccactttgtgaatgctgtacacaagtaccgtgtccggcactcagagctaccctgggaggcgcccgagtttaacccatccgcgcacatccaacagaatattggggagttccgtgagctgtttgagcaagaggtgtacgatgaaaactatgcggtgaaaacgcgagaggaaaaggaggagctgatcgagctggtcaaagggttccgcttttacttcaccgagcaaattggcagatttgagctcaaa

SEQ ID NO: 50903 - DNA, 712 bp, Heterodera glycines
  Genomic contig location: Contig_ID=SeqID_3569; Location=1384..2095; Strand=-
  SCN-specific regions: Sequence locations=1-293,316-453,475-712
atggatgatgatgacgtcatcacaattggagacaacaacaacactcaaacactgcttgacctgcaaccggggccctcaaaaaggggacgcaagcctcgcttggacaaaatccatgaggaaattgcttccgcaatgaagaaagcaaaagccatggaagctgaaggtttggcttttttatgcaaatttctttaaattagccaaattttagtagatgaatcgcccaaaaaacaaccgaccaatgtgtttgagtacccgaccatattttggaaattggcccgcccaaaggttttggctaatatttaatttgaaaaaataggaaaatttcttaagtacggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgattgcaccgatctgatcatgaagcacctaaagaaggatgaaccggcaacgacgacgacgacgacgatggcaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaa

SEQ ID NO: 50904 - DNA, 2896 bp, Heterodera glycines
  Genomic contig location: Contig_ID=SeqID_3569; Location=3473..6368; Strand=+
  SCN-specific regions: Sequence locations=1-65,87-251,276-638,660 -863,885-2404,2426-2896
atggactacccaagaataaatgaaagtgaactcgcttttcccatctcttcggggattattgtcagcggtccgtcctcatcgggcaagacccagctggtccttcgcctgttacggcatgccaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacccaggtgccccgtctgacgagatgctgaaaaagctgccaaagccttgtctgattgtttacgatgacttgatgggtgacattgaggccaagaaattggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagatgacgaagagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgaacacccaggaccaataagaaagcggctaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggtgcgagtgccctgtacgcggcggtgaagaagaagcacccaaagttgaagcgtaccgagtttgaagactttttgcagaggaacaccacctacacgctgttcaagccaaagagggagaagttccgacgcctacgcactgtgcctacgggtttcatgaccggtaaattgtaccggggcttattgcgcacaattcagggttcagacgttcaggcggacttggccgatttccaagccctttcgcgcaagaacagcggctaccggtacctgctgttggcggtggatgttctatcgaggcgaatgttcggcgcccccgtaaagagtaagcgcccagtggacatgaaaagggcgtttgaggagctatttgagcaaatgccaagggtgccggacacactgtacaccgatcgcgggttagaatttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccatcaacaactcggtgtgccgcgcgaccggccttagacccaacgaaatcagcgacgccaatgcgagggaggtgtggaagagggtgtacggcgaaggactcgcacaattggacaagtcatcaaagatcagagctggggaaacggtcagaattcccgagcctaagcacattttcgaaaagggtactgtaatacacacactttctgacctatttattttaatttttaaggttatatccccaattactctgatcacgtttacactgtggatgaggcccgctcaaccaacccccagcactatttgctcaaagactattatggcacaaagttgaagagaaaattttatttaccagaattaacaaaagtacaagtggatgaaaacacaatgtatcgaattgaaaagaaatacaaggaacgagtgagagatg

SEQ ID NO: 50905 - DNA, 1632 bp, Heterodera glycines
  Genomic contig location: Contig_ID=SeqID_20384; Location=309..1940; Strand=+
  SCN-specific regions: Sequence locations=1-356,384-1632
atgcagcatacaaagcgctatttgctagtccccgaagagatttatcagagtttggcagcaccgccaccatctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatctcaaggttgggcgtgcgcgaaaagaaaatgttgaacaattagaagatactgatgatgatgatgattatcaaaacccacggtcgtcaagtgcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggccaatccggcaaaggaatttataaaaacaccccacttaagtttaagccatcattatggatttgaaaaagcttcgtttgctcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggcgaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcgctaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcatttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgagcattggaatgcgcccagtagacgtgaactttaaaaacgcagaagcattgcgacaaaaattacatgatgcagctgaaaatgttgtacgacgcaagccaaaataccgtgtgggagatcgcgtgcgcattgaaaagtacaagcacgtgttccaaaagggttacctcccacgcttcaccaatgaacctttcacggtggcagaggtacactctgagcgttcgccagttgtttatcggttacgtgatgacaataatgaaattattagtg

SEQ ID NO: 50906 - DNA, 1593 bp, Heterodera glycines
  misc_feature (721)..(721): n is a, c, g, or t
  misc_feature (790)..(790): n is a, c, g, or t
  Genomic contig location: Contig_ID=SeqID_20385; Location=502..2094; Strand=-
  SCN-specific regions: Sequence locations=1-41,64-160,182-325,353 -364,386-511,533-567,596-615,666-836,908-1259,1308-1446,1468 -1555,1586-1593
atgtcgcccatgaatttgttcagtcacatcgcaatttttatagccaaaaatgtaaaaatgcctacgaacattaattttaggctataattcgagctccgcagatgacatgttcaataatgctaatggcgctctttcaacagcccatcaacgaagaaacaatttcaatgtgttcattcatccaagctataggcccgacccaaaacggattggacatgcgcaatacgaccaggccataattaaggtggcaaaaaacaatgattgggttcgggttaatactttttaaattcggttgaatattgcaaagcaattaagatacaatcataggtaaaaaattttaaatttaaatataataccaataacaactaaaaaatgtaatgtcaaaaaacttggattggggccggaaatacagactacttcattctatacaataaacaactatagtccataaaatttaataatttatgattactttttagcttaattgcgtcctcagtgggccaatttatcccgtatgcatccattgtggagacgcaaatgatttccgtgccggaaaagcatttgtttcgggatggggacaagaagaaggttaaaacccaaaaaatcagaaatgaaatgtttattaattattaattgtaaaaatgtttatctttttaatttttttaaaagtcgaagaaaccttaatgctctaatgaattaattattgtcattaagatgattgcanagagaaaggacatggcgcaacaatgcttatgggccgattcgttcagctagcagagtgccattctgcctntagacattcgaacaatatttgtgtcaagggcgctgcagcgcaaaagataaaaatttaaaaaaataaatttacttaaaagtataatagcaaaaattcaaataaaaaaatcattttttagtaaaaaccgaaaaatccaaatttagggtgatagcggcggagctctgttggccagcaatggcacacactttgttcaagttggagtgctttcggctggcttatgcgattggtgggcaaaaaggggtaaatgctgatgaattttcaaatctgataagactttaaaaatcaaaaattcggtccaaaaataagtgaattattaatgaaagaatggattccactaatttatttattaagtaaattttcattagccatttttattttaaaaagttgtctgattgagttcaattaatctcacaaaatattctattctattttttaagcatattaattaatattgtaatttcagtccctcaaataaaattatgttgtaaatttttattaaatttaaattttataattagcaaagtttatgtgtttgtaaattcatttttaggtcattcaagcatttattcacttttggatggcgcgtggattgaagaaattactggattaaaatgttctgttggttagcaaacaaacatcagagttaaactttgtgaacttaattcatttaattaaaaattattgtttcaatgaatgaatttgtgattgtaaatattttcattaaaatttattgatgtgtaaggcaattatgacagacgcagtcggaatttatttaaaaatttaatgtacataatttgaataaa

SEQ ID NO: 50907 - DNA, 420 bp, Heterodera glycines
  Genomic contig location: Contig_ID=SeqID_20386; Location=1545..1964; Strand=-
  SCN-specific regions: Sequence locations=1-131,155-205,243-257,281 -316,367-399
atggcacaatccacgtccccagcaagcgtccctccacccaccgagtatcgacgcgaaaattcaaatttgaatttagcgccaaaaattgtaacaaaagtacacgggtcactactagagtgctcacgcactcctaaattaaaaaaaattaaaaaaaggtagagtgctcatgcactccattaaaaataaagcttaataaaatctagagtttaattaaaaatataattttaaaaataacatttattcattttcagacacgtaccagaacgaacaaacaaaaaatggcatcgaggatgtacaaagaagagatgtattatggaaattttttctttaaaagataaattttttttgaatttcaaatttaaatttgattgttcacatttttttttttatattacaaacactttaatttttcaaaataaa

SEQ ID NO: 50908 - DNA, 1623 bp, Heterodera glycines
  Genomic contig location: Contig_ID=SeqID_20386; Location=803..2425; Strand=+
  SCN-specific regions: Sequence locations=1-325,358-448,483-529,562 -726,847-882,906-920,958-1008,1032-1226,1268-1472,1494-1623
atggacttcgctggtggaaaaagagcgacaaagggcacagcggatcgcaacacaaagttctgcggtgattggtcagctgatggaggcaaaggtaacgaagagaaagaaaataaaaaagagggggaggaggagaaaaaaataattaaaagcggtcattgtcgatgtgtttgagtaagggtccagttacgtatggggttacgaaatgtggtcactttttttgctgtccccaatgctcagtcccgataattgccagtgatgaacccaaatgtttgatttgttcgagaatgtcacccaattggaatatttaggatcttaataaacaaatgaaaaatttcagatttaaaaattttgaaatatgatcccaaaaaaccattgatctcagatatacccaaatgcttatgtatgcttcaaaacttttcgctttgtaatgcgaaataatctttaataaattaacaccaaattcatttttatagtacccaaatctttgaatcaatatatttttattcaaattcaatgtatttgatttcgctaaccttttattttaattttcaccttctgtttgctattcaaatgtataacaattaatcaaatattgtttaataacttcattaatttaacactaatattgctctacacggtttaattatttcaattaaaaggatgttagaaaagtatatggatatgggggggggggcgtacaaaggatatgcgagaaaaagtggtagcaaaattatgtaaaaaatttattttgaaaaattaaagtgtttgtaatataaaaaaaaaaatgtgaacaatcaaatttaaatttgaaattcaaaaaaaatttatcttttaaagaaaaaatttccataatacatctcttctttgtacatcctcgatgccattttttgtttgttcgttctggtacgtgtctgaaaatgaataaatgttatttttaaaattatatttttaattaaactctagattttattaagctttatttttaatggagtgcatgagcactctacctttttttaattttttttaatttaggagtgcgtgagcactctagtagtgacccgtgtacttttgttacaatttttggcgctaaattcaaatttgaattttcgcgtcgatactcggtgggtggagggacgcttgctggggacgtggattgtgccatagggagaggagggattgtaaatcaattaaattgagtaaagacagaaacgggtttattcctcggcatataaaaatattaacatttaattaattaaatttttatttagcattagaatgattatgttttttcactttgtcctcttcattgtctactcggcaaaaacgcattgtgtcaaacaggtttatacattttgtattaaaatatgcaaaaagggggtgtgataaagaaaattaaatatggatttgttttactgaccctgtctaaatcgggtttcccttttcaagatggacctgaacacactgcgcatggacatgatggaattggccagcagtgccggggacgagggcaccgtcggcaaagccaacgcactattggaacgtgcgggcgacaaattggacctgtccatggagcacatcgtaatattaaagcgccgggtaccgctcaacaaccacgtgcaaagg

SEQ ID NO: 50909 - DNA, 1003 bp, Heterodera glycines
  Genomic contig location: Contig_ID=SeqID_20387; Location=177..1179; Strand=-
  SCN-specific regions: Sequence locations=1-217,242-283,319-772,794 -830,852-978,1000-1003
atgccaatggcttccgcctgtggaatgcctccgccgtacgcaatgcaaacgcagcagcagcaatcggctgccacgatctcagcgaaagcgaaccaccatgcaaccgaagcggaagaacctccaaaaaagcggaaacgaatttcgaaaaagcagcaacaaaaggtaggcggttttaggtatttaaatggttgttaattattttgcaaattgtaaggaggagaaggaacgagaacagcagcagaaacagttgcgagtgcagcaggaagcagcgctggtgcaaattcagcaacgacaacagcagcagatgttcttccagcaaaggcaaatggccatgcaacagcagggaatggtgccgctcacttcgccggcactcatcggagcaccgcaacagaattaccaacagcacgtggcacaggtgaacatcctccaatcattgtattttgtgagtttgtccgattgtagtaccatcagcagcagcattatgccaaccacaatcaatcgcaacaaagtaaccaatccaacatgttcaattcgcctccgcatggcaattcactcggtggacattacgctaatcaacaaagcacgcctccacaaccgtcaccgcaacaatatccgcatttgggtgccgtgcagtctgccatgcattacatgtccccgccgggcatgtggggcacatcgccgcaacagcaaaatgtaaaaatgatcgacaccaaaagaccttgtgtttcacttttttacccgaacgatttttgctcacagccaaaagaagacctattaaaattaaaaaaaataacatatgaaaagaagggtttgtaggtgtcgaaaatataaaataggattgttttcttgatagatttagcccaagcctggcgatgttttgaatttgtaaagcattgattaagagcttgagaaattatttactttttagatgacacaatatcacacagcaccagtcccagatggcggttgctgcacaaaaccctgcccatcccctgcccactga

SEQ ID NO: 50910 - DNA, 914 bp, Heterodera glycines
  misc_feature (108)..(108): n is a, c, g, or t
  Genomic contig location: Contig_ID=SeqID_20391; Location=288..1201; Strand=-
  SCN-specific regions: Sequence locations=1-589,611-914
atggtacggtttgttcgaaaccgggtacggtgggtgatcggaataactaaatcgttgtcatatttgtaattcttcagaagtttcttaaatcgccaagaaacatatttntaagactcgtgaaatattattagaattccaaaatttctgtactgtcgctgatcacgaatcaagatccgtttcggcccatttcgaaccctaacccgaattcgaacaattttccggtacaaaaatcgaaaattcaaaatttacttttatgttcgtgcctgtacacaatgaccatttttgatgtttcaatggtttttgactaaatttagcttatttagatcaatttaggaccaaaagtaagaatttcaaaaattttgaattttcgatttttgttcgaattcgggtccgggattcgaaattggtcaaaatgaatgtcagattcgtgatcagcggccctaaaaaccccataaaacgtgttttcacgactttttagaacagaaaaaacttttttcaaaaaggggggggggcatcggcagtattacgaattttccttttcattcgctatgaatttggtgcattcgaattgatttgggcaataaatatgaatttcgtttaaaatgaaattttgactttttgttcgaactaggattaggggttcgaaatgagtcgaaacggatgctgctgaaaacctatagttgacttcttttattctgaaatttaaaaaaatttgtgtatggggcctaaactcttagaatggcgaggatattgaaaaaagaacgagtcaaaaacaaatcgatattccaactatgattagagaaaaataaatttcagttataagagaacaagcaattcgttccacttcttacaagggaatattccaagctatgattcggaaaatgcttataaataggttttttttgaaaaataaa

SEQ ID NO: 50911 - DNA, 626 bp, Heterodera glycines
  Genomic contig location: Contig_ID=SeqID_20391; Location=1335..1960; Strand=+
  SCN-specific regions: Sequence locations=1-168,196-394,420-548,579-626
atggcatcgtcttcaaatttgagtccgtccgaagaattgcgtcttcttcgggacagaagcaaagaattggagcaaatgaaaaaggacgggcaaagtgagggaaattgtgccaattcagtcgctgaacagcaaaaggaaatgaaggtggacggaacacaaaacattaattaatgaaaaatgacatatttttattatttcaggaattgcgtaaaaaatttgccaaaatggaaatgcgggaagcaaaacatttgagcaagattgatgaacttgagaaggtgggcttttgcttttgaaacttagcgaatttttagtagcatcaatgttccgggcttgctataatgagataatagcaaaattgaatttgtttattaaagaagagttattaaagtaattcaatattttattttaagatttttgagtgacgtcagagcatcaaaaaacagccaaatttcattattaaaatttttcagataacccatgaagccgagtcggagcagcagaagctgatcgccgatcgaaacgttttgcaggcgaagatggccaaaatggagaagaagcgaaaagaagaaaaggaaaaatacagtaagcgaattgcgagtgaatggttactgtggtttttccattaa

SEQ ID NO: 50912 - DNA, 376 bp, Heterodera glycines
  Genomic contig location: Contig_ID=SeqID_20392; Location=1027..1402; Strand=+
  SCN-specific regions: Sequence locations=1-215,237-249,276-376
atgatgggtcggtgttcagctgtgtggacggctgaaaatgttcctaatttcatggaaatgtacggtaactaagactgtcgggaactcagcgcccaaaaggattaatgcgcaacaaatcatacggtaggagacatgtctggtcatgatgatgtacggtaatgcttggtacccatgtggtagtgttgtgcacgatgactaatttctgacaaaatgggtttttaattccgaatctgtcccatagatggtcagaaattaaaaaatctaaattttttaaggataagtttttgggaaaatgcttatatgcgcgttaaataggagctttctctgctcattcccagccgattggtggcggctgttactctaaaaaacgaccaaa

SEQ ID NO: 50913 - DNA, 443 bp, Heterodera glycines
  Genomic contig location: Contig_ID=SeqID_20392; Location=1883..2325; Strand=-
  SCN-specific regions: Sequence locations=1-161,186-443
atgcgtcgggtgttcgccatcaatggcctcgtgaaaagagaaatgacgtaagaaaatgaaaacacgacccaaattgaaaagaatgtttgagtagggaccaattcttagttgtaatgtagtaatagctgtgtattttaaagaaaatgttccgaatgaattcgaaaaattaaatcaaattaaaatttgttgatgagataaatatttaggttcaaggtcggactttcactccaacacggcttttgagcttttagagcaatttaaatttaagatttcaacaacccacaatgcgtaaattttaaatcttaatttattcatttctctagaattgaaaaaaaaattttttttaaacattggggattttgttttttacggccaacgttttattggccgtctatgagctgtctgcataaaaggcctttttttgcattacgtatgcaaataaa

SEQ ID NO: 50914 - DNA, 239 bp, Heterodera glycines
  Genomic contig location: Contig_ID=SeqID_20394; Location=265..503; Strand=-
  SCN-specific regions: Sequence locations=1-239
atggttttcgagtccctgaaaattttcaatccatgtaaatcttcgatgcaaaaaaattttcgacccagagaaattcttggacttgagaaatggcggcactatgaattatgcgcttggacagcagcagaagcagttgatcggttcgtggaaaaagtgatcattgtgaacagttggagcagtgcttccaatgtcaccagcacaaattcgatgccggccccaatttgttcaacaaaagcaac

SEQ ID NO: 50915 - DNA, 984 bp, Heterodera glycines
  Genomic contig location: Contig_ID=SeqID_3571; Location=1173..2156; Strand=+
  SCN-specific regions: Sequence locations=1-335,491-566,588-984
  Gene Ontology: Mol. function=coreceptor activity; Cellular component =integral to plasma membrane; Biological process=motor axon guidance
ctgctttagtgccgccccaaacgccgcaaatcactgcccaaccgacggaagcggtgcgcgagggcgaattcgtcactgttcgctgtgagtcgcaggacggaaatcctttgccgcgcttccaatggcttttcgacaaccgcacgcgggtgccggacgcgtggttccacgaacggcacgaaggtggcggtggaagcggaacaaagccacgcgcgataagcacgttacaatggcatttgacacgcagcgacaacggcgcctatttaacatgccaaacttggaacaaagcactgcgagagggcgaagtgatcaatgcggagacgaacagacttaacgtgagaaagggcgagagaagagagcgagagagtgaaagggaaacaaaatagtgtaaccaggaagagagaagacaatgaaacaaacgaaatacaagggcaaagagagaaacagacgaaataagaaaagagtgacagaacacaaaaggatcgaacagaaagtacggcatttgttgaacaggttttgtacgcgccacgggtgaaggttgtcccaacagtgcccgaattgaacatcgaggagggcgagctggccgagctaaagtgcaccgctgatgcgaatccacccgcgacaaatttcgcctggacgcatttgccgtcgggcgaaacgcacgccgaccgcgagtggcgcgtacacgtgcgacgcgcacacgcgggcgaattccgttgcactgccgtcaattcgttagactcggcttctgatcgcatccgtctcaatgttctttacgggccaaccgtacgcattcgaacagtcgccgggggcgcatcgggcggttcggtggtgagcccggcggagggcgatcggctggtggtcgactgcgaggcggacgccaacccaaaggcggacgctatcgcatggagcggacctgggggcttccaacgtaccgggtcgcggttggtgatcgaagcggtcaatcgggttggcctttttttgatt

SEQ ID NO: 50916 - DNA, 72 bp, Heterodera glycines
  Genomic contig location: Contig_ID=SeqID_3572; Location=581..652; Strand=-
  SCN-specific regions: Sequence locations=1-72
atggacagaatggaacggacgcaactctcatcggaaggacaactgaaaaagggaaaggcaacgactaatcaa

SEQ ID NO: 50917 - DNA, 92 bp, Heterodera glycines
  Genomic contig location: Contig_ID=SeqID_3573; Location=1596..1687; Strand=+
  SCN-specific regions: Sequence locations=1-47,69-92
cctacgggtaatttacccctcactttcctttccgtcactccacagatattttgttatttaataattgtccatttttaaacactgagtttccc

SEQ ID NO: 50918 - DNA, 2346 bp, Heterodera glycines
  Genomic contig location: Contig_ID=SeqID_3574; Location=451..2796; Strand=-
  SCN-specific regions: Sequence locations=1-122,145-254,279-469,491 -613,635-1026,1071-1122,1151-1202,1224-1431,1454-1615,1638-1889,1911 -1944,1976-2223,2249-2346
  Gene Ontology: Mol. function=GTP binding; Cellular component =cytoplasm; Biological process=rRNA processing
gtcagggaatccataaaagactcgtgggttactggaaaatgggcttctgacggcgagggggaggacgatgaaagtgacggtgaacggaaaaacgacgaaggacaaagccaacgcaataagaaagaggaaaaatggaaggccaaagaagaggaaaatggagacgaactgtcggattggagtggggacgaattcgaaccgaacgaactgagagaggcgggggaagcgatgacgaaaagggaagagggggaatcatcggaagacgacgaggatgaggaagaagcagaggacgggacgaaggcggaaaagggacaaaacgccgaaaaaggcgatggagtggcgaaaggggcaaaaaaggaacgccttcggaagctttttgatgctgagtttgaccaaaccaacgaacaatacaacgcattagtggaggaaatggacaaacagtcgaaagtgagtgaaaaagcgggaaactttcatttttaaatgaatgttttcctttcagttgaacaaaagtgtcttcgacgatttggacgaagaacaacggcagaaactcgaagggttccgtcccggtctgtatatacgtgtcgaagttgaggacgttcctgcggcgtttgttgactgtttcaacccaacctttccttacattgtcggaggacttttgccggtcgaacaaaacgacggatacgttcaggtatctctatctatgtttggttatttcttgaatcatttcttttattcgtttaggttcgcattaaaaagcaccgctggtacgaccgtttgctgaagtcgcgtgatccgctgatcatttcgtgcggttggcggcgcttccaatcgatggtcgtttactctgttcttgaccataaccaccggctgcgcttcttcaaatacacgccgaaagaagccttttgtcacggcgctttttgggcaccttttgtgacgcaaaacaccggctttctttgcctccaatcggtcgacgaggaaaaggcaagtttaggaggcgcagaatttgggtccatttgaaatgagtgccaatttctaattgtttaaaaataaaattttgtccaaagtttagaagggttttcgcattgctgccaccggcgttgtgttgggaatggacaaaagcacaaacattgtgaagaagctcaaactgattggacagccgttggaagtgttcaaaaagaccgcctttgtcaaagtgccaaagccccattttttaatttattatttttgttgtatcttcagggaatgttcaacagtgcgcttgaagtgactcctttccaaggggtggcaattcggacgatcagcggaattcggggactgattaaaaaggcgttgagggagcccgagggggcgttcagagcgacgtttgaggacaaaattaagccaaacggtaactgaaagacacatatttaattggtgatttctcttttttgtcctttgttttcagatgtcattttccttcgctcttgggtcgatgtgccggtgcctaaattttgtgtgtcaatgacggacaaattgctgccgtcgggtgaaaattggctgggcatgaaaacgacagggcgtttgaggcacgaattgggcattaagccggagcaaaaggccgactcgggctaccatcggcacatgaaaaatgtgaagcatttcatttactcggtgaatcaaatgcttattttgaaggaagcgactgagaaattctttgtgtctgccccgttggttatcccaaagaaattgcaaaaggatttgccgtacaaattgaagcccaaagtcggccgactctgtttggaggacgccgaagaggggagggactcggaattggtgcggaatcacacggccgaactgctgatggagccggaggagaatcgggtgaacgcaatgatggaactgctgaggacagtgaaggaggaaaagcggcagagggacaaagcgcagacgaaggaacgctgggaaaagcaccaaaaggtggggaggagagaatggggagaaaaattacacacacaccttttaaatgtgcaggaactgtcggagattgaggcgagaagaaaacgcaaaatgatggcaaccaaaaagacggtttgcagaaatatgtcgagaagagaagccaaacggaagcgaggggacaacacgaccgaaatggaaacaatcggggcgtgatcaaactctgttttccacctttttcatcatgttatttgatatttatcggcaaaaaatttatactttttaagagatcacaacaaaaaataataattaaatatgcgtaattaaaagagaattgggcggagatggcggtttcttaaaatgggaagaacaatgagaaaatggaaaatgaaatcgccatttacaaaaacgaataaa

SEQ ID NO: 50919 - DNA, 97 bp, Heterodera glycines
  Genomic contig location: Contig_ID=SeqID_3574; Location=244..340; Strand=+
  SCN-specific regions: Sequence locations=1-97
cctacgggtaatttacccctcactttcctttccgtcactccacagatattttgttatttaattattataattgtccattttaaacactgagtttccc

SEQ ID NO: 50920 - DNA, 661 bp, Heterodera glycines
  Genomic contig location: Contig_ID=SeqID_20395; Location=999..1659; Strand=-
  SCN-specific regions: Sequence locations=1-356,379-386,418-661
atagaagaagatttaagtgatacatgcttttatcgagagcccaattggtcctcttattatatctaaaaaaaagtgctcgggacccttgatcagcggttgctcctttgagaaacaataaaaaatagtgatcagaaggcgtctgattggcgtctgtctaaaatattttgttctatgttaaacgcaccatcatgatcgggtccattgtggcaccaatccaactcagtgtgccaagcgtgccgacaatgatcgacccaattgtggtgccggccatgaggacggtgcgccaatcgtggcccatgaacacggcacaaatgaagcacctaggcaacaaaatcattggtttcgtgcccaatgattgttaaatttctatatattttttctcagagaatttaacaaaatgaaaataaataaaattacggttttttccatttcagttagccatttttgccggaaatttttagggcttttcataaaaaaattcaattttttaaatttctaagtctctcagtctgtacacgtacatgcacaacagtgtggccagcccggattgccacgcgtcggttggcatattgtcgatcaggtcgaggaaaatggactcgtcatggaacacggaggcgttcagatcagcgtaacggtccacaacagaacgccagtccattag

SEQ ID NO: 50921 - DNA, 1878 bp, Heterodera glycines
  misc_feature (83)..(83): n is a, c, g, or t
  Genomic contig location: Contig_ID=SeqID_20395; Location=1..1878; Strand=+
  SCN-specific regions: Sequence locations=1-78,153-715,737-1242,1274 -1281,1304-1755,1778-1848,1870-1878
  Gene Ontology: Biological process=growth
accattctttaacattaaatgaaaaaaacttttaaacattattaaagacacttcattaaataccactaaaaatccttcttaanaattaaaaaaaaaattaaacattaattatagttatttaataaataaaataaattcattttacatttaatgtcaatttaggaatttcatactaatttttcgaggaatttggtaccgcgggaggagggctggctattcattacatatttaatgcctgtctattctcaatttctagattgacgctgatcagttggagcagttcctggactggcccgagaaccgttattggaagtcattgatccatcttccggcaacggtggcggaggaccgacaaaatcaaagtgtaagcagtgccaatgcaaatgccaatgccgttgtgaacagcttctacttcaccacgggttaccatggacagcgtttgcgcaaatgggccgagtaagtgctataggatcaatgatcattgatcactgatctcaagcacattgcgacatccaatcaacaaacagtttcatttacatgagtgcactaatcgtttctcaaccgcctcccctccaaaaattttccaaaagaaaatttcaagaaaatttttcgaaaattcttgaaaaatgtttcagtatttttttgaatttttttttgcaaaaaattactagttcatcatactattgaaaaaccgctagcaaaaagttttcaaaacaaatttttttttaaattttttcttggtttttttctaagattttttcctaaaatttctataaaaaactaagttttactggggaacggcggtggcaagatttttttctttaaaagaatttaggtaatctgctcattttctaagattgattttgatttttttgcttcttattgttagcacaaatgaaatgttgtgggcctttttgtccttgaatttttgggcctgaattgaccctcccgaatttttttttttttgactgttttaaattatcagacgcacccatttgctaatggactggcgttctgttgtggaccgttacgctgatctgaacgcctccgtgttccatgacgagtccattttcctcgacctgatcgacaatatgccaaccgacgcgtggcaatccgggctggccacactgttgtgcatgtacgtgtacagactgagagacttagaaatttaaaaaattgaatttttttatgaaaagccctaaaaatttccggcaaaaatggctaactgaaatggaaaaaaccgtaattttatttattttcattttgttaaattctctgagaaaaaatatatagaaatttaacaatcattgggcacgaaaccaatgattttgttgcctaggtgcttcatttgtgccgtgttcatgggccacgattggcgcaccgtcctcatggccggcaccacaattgggtcgatcattgtcggcacgcttggcacactgagttggattggtgccacaatggacccgatcatgatggtgcgtttaacatagaacaaaatattttagacagacgccaatcagacgccttctgatcactattttttattgtttctcaaaggagcaaccgctgatcaagggtcccgagcacttttttttagatataataagaggaccaattgggctctcgataaaagcatgtatcacttaaatcttcttctataaatatctccgatcaccaaaccaagagcttctccgtttcagtccgatcaatttgaccaacggcactgatcaaactttattgacttgaaaataggactcaataaaattcctattattcattgtgtttattaattgttttttttccaggccgctcttatcatttcgattggcttcagtgtcgacattccggcacatttttcttatcattttcacagtgcag

SEQ ID NO: 50922 - DNA, 983 bp, Heterodera glycines
  Genomic contig location: Contig_ID=SeqID_20396; Location=163..1145; Strand=+
  SCN-specific regions: Sequence locations=1-234,256-983
atgtgcaacaacgcgacgggcccaagcgccactgcggcgctgggcgcggacgggcgcaagcggcgtattccgtcccgggaacggttgtcccgcgcacgaacgggcgcaattgcgtcactgatggtcaacaccaactgttccatcatgcaaaatgcgatgactgttgaattggtgcacaataccaacaacaaacgatcaacgagggcgaagaaaaatgccgtcgatggaggcggtcaaaaaggggaggaaaaagctgatgatgatggcaacaaaatgccaaaaaatgatgatgatgatgagtggaaacagcgcaaaattgtgctgttgaatggcagtgccacctccacgttggcggagcagcgagacggtaccaagcgcattgctgctgttgatcagcaacagcccaagcgatcgatgatcatgttgggcgaaaatttgaacaaaatggcacaaaagtttgcccgacggcgctcctcactggacgagcaggacacgcgcaaacactcagacagcggtggcgagctgttcaaccgcagcgggctggtcaccaccacactgttgttggccacatcgaagagtttgtgcggtgaggaacagctacggcacgaggagtacaacggtgacaccaccatgtgcaacaacaacagtttctatcacggcattagacaaggggcggtgccgaaaaatgaaaatgttgccaaacggagtgcatcaacgacggggggtggagagcgtacgggctcattgcccatgtctacgtcattttcctcgtcagaggacagcgatttgactgcagagcattcccagtacagtgtacgaatgccgtgcaaattgccggtgaagaaatggcagaaggaaaagcaacaacggggaggacgaggacgaagacggcactccatgcatggcattccgtcaaaaggcagcaacagtgccgaacagcagaaaatggcaccggcggcaacgacagcggaagaggggaaaag

SEQ ID NO: 50923 - DNA, 2466 bp, Heterodera glycines
  Genomic contig location: Contig_ID=SeqID_20397; Location=437..2902; Strand=+
  SCN-specific regions: Sequence locations=1-243,272-279,301-301,323 -459,495-757,780-789,811-890,912-939,964-974,996-1041,1063-1110,1138 -1141,1173-1345,1370-1833,1859-2248,2275-2284,2324-2421,2451-2466
cgtcagcaccaaacccggtcgttcccacctcgtttggcccatcggtagcgtccaactttggccaaatggcaccgccgctgagtgcgccgccgatcatctccgtcccatcacaaagccagcaacaacaacaacaacacatggtaatgatgatgcagcagcattatgctggtggagctggtggtgttgctgcaccgtcctccgctggaccatacagctccatgtcgtcgtcgtcgtcgtcttcaatgtcacaacaacagcaccagcaacaatacggggtcacttttcttaacaaatttgactaaatttccaaaaaactatgaagcttgttcgcaccgctggaccccccattttactacacatatttttttaaattgacttcaaaattgttcgagtctttgatgagagtgtctcgtaatgatgttgttgcacagatcatgatgagcaacaatcagctgttttatcaccaacaacagcagcaacaacaacagcctcagtaccatcaactgcagcgtccacagcccaacggggacccgtcctacaaggagacattggactgctgggaacagatcaagtcgggcgtggacactttgtacgttttatatggagtatctcgtccaccccccccccccgtatcattctagtgctgttcgagaccgaaaatttcccgagactcgagaccgagaccaaaaaaacccaagacttttctcgagtcgcgaaacagcattaatcgtttcctccaagaaaagtttttttttttaaatttaaacacttagaaaacatgctttgagataaaactataaataattttcagcatgtcgacgagtgatgcggatgctgttgagatggttggtttatcacatattccggggaaaattttaaaaacattttcgaaattattatttatttttgcctaatccaatgaatttaactttaaaaaacaattccaaattttgaaaaaattttcgagtgggaaatgaaatattttctattgtaataaatgcgattgtgaactgcttgtcaggctcgaattgtggaagacctgaagcgcagcgaggaggacaccgccgagttcagtcagcaacggtcacgcgttgatcaacagtcacaatcgcaacaacaacagcaacaacaccagagtcggcaaagcgggggtggtggtggtggtgccaccaactttttcacatttggccctgtgccagcagctgcttccacgtccgccggcaaatcgaatgccatcacaacgccaaaaaatgataataatgccaacgccagcagtacaaattgcttccaaccaccggcggcggcgacaacgtcggtggtggtggaggagcagggcacggtgggacaacaacggcaccagcagcagcagaggaaggcagttgaaaaggcggaggccgataccacgtaggtggacaagaatgattgggtgtggctggcactgtgcttaatgcccgaagaatttctcgagactgaatgctaattttccatcccccaaatttttttaaaaaactgaaatttttctaattttctgagaaattttttctaagaaaaaatcaaaaaaaaaaagaataatttctcacataatttatcttacagtagcaaacaatgttgggtcaaaaaaatgcggtattttttgttttgtcaggttctcaccaccttcccagtccgacgaggccacctcagtcgccgctgctgccaatcgtcgtcgaatgtccatgtcagtgatgcaacagcaacagccgcaacaacaacaacaattcgcacaacgcacatattccgtctcttcagcaaccgccggcggttcatcaaatatggcgagtggaggggagatacaattaattaattaattaattgactactctggtcactaattatgatagagtatggaattatcacgaaacactgattgtgagactttgagaaacgccttgggactaagacccagcgattgagggggaggggctgcacgaaattttcgcttgtcctttccgtttcgtccaatggcaaaattggagtccggcggtgccgttaggcgccatcaggaaattttttttagaaattttgtacagtcagggacacagttggcccgaatcgaaaatcattgattgattggctttgccaatcgtgtttgattttttgcgcctcttttacaggacgagcgtgtacaccaccaacttcaccacccttttggtgtccatgccggcggtgatggcacaatgttaatgagagtagcaggtgcaaatgtgggaagccagcagcagcagcaaatgccaatgccaatgttcaaccaccatcaccagcaacagcagcagcaactgtactcatatggcaacgtccaactcccgcatcacaaccatccgcaacatgttgggacgacgaattatcctccacctccgcccaataatattgctgttggtgatgatcaacatcatcatcatcttcctcatcacaacagatttcaccgtg

SEQ ID NO: 50924 - DNA, 67 bp, Heterodera glycines
  Genomic contig location: Contig_ID=SeqID_20398; Location=1349..1415; Strand=+
  SCN-specific regions: Sequence locations=1-17,44-67
atgtcgacttcatcgaccctatttttggttgttgttgttttggcatctttgctgatctcggctaaca

SEQ ID NO: 50925 - DNA, 904 bp, Heterodera glycines
  Genomic contig location: Contig_ID=SeqID_20401; Location=481..1384; Strand=+
  SCN-specific regions: Sequence locations=1-281,303-671,693-804,831 -850,876-904
ctacattgaccattccgtcattgaatttctccgttcaaacaagcacatttgggacagaagaggcaccaatttggaagtgtttgtggatgcaattgatatgggtgttcaaccgatttgggatgtttttatccgtcaaatttggcctatttttgcgacaaacattcgccatttgagctttaccagtggcgatgctttggacaacttgcgcagtcgcacttcgccaacatttctcactgatcttgatcaattgaattcaattgattccggttatctgtgccccgatggaattgctgatgatgggccaaatgcaactgctggccaagcgttgaccaaatggctgcacactccgacaaaaaatgggcaaccgaagcaattacgtttccgtgcttatgtgggtccaccaaatttcgaatgggtcaacaacttcaaagaggtcgtctcgccagaattttcgtcaaattgtttttattttaccaattttgtttagacatttcgccgtgccaccacttctgtcagttacaaaattcaactttatttttgggtggaaccaatgccaattgaaccatttgaattgatgaacgaagtgacgaaagaaaagctgacactgaaacaggagatcgacgaattcgacttaaatgtgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcaacagcatttgaattttatcgaaaaataaaatatttaattaattttaggccattggcgccaccagcggaagaaaaagaaggagaagaagaagcggatcaaagcaacaaaaatgtcgtctga

SEQ ID NO: 50926 - DNA, 868 bp, Heterodera glycines
  Genomic contig location: Contig_ID=SeqID_20401; Location=2137..3004; Strand=-
  SCN-specific regions: Sequence locations=1-449,471-780,807-868
gtacattgaccattctgtgctcgcatttatccgttccaacaaacaaatttgggacagaatgggcaccaaatttgagttgaaagtgtattcatacgaaacggatcaaatttgggatgttttggcccgagaaatttggccaatttttgcgccaaacattcgccattttggctttcactgtggcgatcatttggacaatttgcttcgtttggtttcaccgacacttctcactgattgcgaccaattgaattcaatcgattccggttatctgtcttccagtgcgatcgctgttgatgggccaaatacaatttctgcttggcaggcgttggccaaatggttacacacgccgagcaaagacggacaaccgaagcgattgcgttgcgatgatttttcaaagtccatcaactatttcaaggaggtgaccgaccataatttcattaaactactaattaattgattgccttttgttttgtttaggcatttctccatgccaccacttctgtcagttacaaaattcgatttaatttatttttggtaccaatgccaattgagccatttgaattggtgaatgaacggacaaatgagaagctgacactgacgaaagatggcactggtctattcagtgattggctgttggagagatgcccaattattggggagacggcggcggaccaatgggaaaacgacggaaattcggatgccaatttgaacaatatccaattttttttttggcacggcagtaattgctttgggtgagcagcaacatcaattttgaaattgtcgaaatttaaaaaataaaaattattttagcccattgtcgccaccatcggaagaagcagacgaagaagcggatcaaagcaacggaaattaa

SEQ ID NO: 50927 - DNA, 1359 bp, Heterodera glycines
  Genomic contig location: Contig_ID=SeqID_20404; Location=619..1977; Strand=-
  SCN-specific regions: Sequence locations=1-125,149-533,563-872,907 -1359
  Gene Ontology: Mol. function=ligand-dependent thyroid hormone receptor interactor activity; Cellular component=cytosol; Biological process=protein ubiquitination
cccaccgtttaccgctcgttgcgtagcatatgcgcaaccagaaactgcggaagaatttgacgaattgcaattggtgagtgacacctgctgggcacactcattttgtttgttaataaaaagtgatgtcgatgctgttctgttgatgaaagcagttcgccttccccctctataaaatgtttttagatttcctaaaaaatttttttagcatttaaaaaaaaattcaaacgtcgaaaatttaaaaaaaactgaaatcaatgcgagcgggaaacgtagtgcacctattctgacaatgagtgacaccatcgtagttttaatagtttaccatgtttataaataagtgcttttttaaatccgtttttaattccagtatttcacatatcctggtgatcttacactggagctggtcaagggcggaaagaatgtccaagtcacgaaggcaaactgcaaacaatttatggaggtgatttgtgtagtttttaatttattcaatttcccattttaattcaaacaaaataataatcgtatttaatttttgaaacatttacaaattttatttttgtaaaagtggctcttttcagctcgtgtttaattggcgtcttgttgagggcgttcgtgccgaaatggaggcccttcggcgcggctttcagctgatcattggcagcgaatctcttcaaattttcacacccgacgaaatctccgagttgttctgcggcaccgacgacgcggacgacaaagtgtggagcaaatcggtgctgcagcattgcatccgcccggtaaaccacacaattgatttcactcattggcaccaactaatggcttaattaatatgccagccaatttattgtttttttccatgttgcgcttttgattccttttttaaatttaattttttattattcataatttcacttttttccccataactttaattttccaggaccacggctatacatacgattcacagcaaatcaaatggctgatcgacatgttgcacggatttcccaaagagaaggtggttaaatatttgcgggatattttttgctggttctttgggctcgttgccttggtttcattcatttgaatttttttctgtttagcgtcgccgtttcctccaattttgcaccggttcgcctcgtttgcccgtcggcggttttaagggtctgtcgcctccgctgactgtcgtcaagaaaaccgcatcattcgtcggcaacgaaaacgaactgccgtccgcgatgacttgctacaacgtatggggaggggaaacccttcattttgcataattatgtataaatttttctttttcagtatctgaaaatacctccgtacgaaagctacaacacatttttggaccgttttgaa

SEQ ID NO: 50928 - DNA, 201 bp, Heterodera glycines
  Genomic contig location: Contig_ID=SeqID_20404; Location=48..248; Strand=-
  SCN-specific regions: Sequence locations=1-162,190-201
gtggctcttcaacatgtgtacagcttcttcttgacctaaagaaactgcgatggcacaatttttaatatgtgatggagagacaacaaattaagagagattttttgtttgattgatatatgtgcaactaaaggaaaatgactctataaaaatagttcgaaaattgtatcatgttttcttttttaaatataatcagtgtgaaga

SEQ ID NO: 50929 - DNA, 826 bp, Heterodera glycines
  Genomic contig location: Contig_ID=SeqID_3577; Location=2701..3526; Strand=+
  SCN-specific regions: Sequence locations=1-628,661-826
atggcggcgtcatcggactcatccaacgggcactcagtcgtgcgtcgtcccacatttggtttgaacgctcgaggcaaaggaccgctcgttggtgcggaatcggtgggtgtttgttgttaaatgtcatgttgttcatattgtttattcaacgggattgaaaaaaaattgctttctcagcgtatactccaccacaggcgtctgcatttggtggtcgggcggtcccatgcacagcttgcttaccaagtcgttgacccgcgtcatcacgctcagaatgtcctcctgacacgccttttttgacagcacctcgactaagctttggacaaagtacgttccgtacttgtggtccctccacaccacaaagtgtgcaaaagtggcgtgtgcgatcaaaaagtccgtcttcagtgtcggatggtcgctaaatggcgaaaggatcactctctcaaaaaacgggtggggggggggggaggtgttaggtcatttcgtaagccacgatgggggcgtttcttaaaaaaaaaatttttacagaaaattggtaattcttcctaccacgaacaatgggatgggtggtaaaacatacaaaaattaacccaaatgaacgtttaccaaaattgccaatatgggcatttccattaattttaaaatccataaaaatttaatattttcccaattttcagcaaaatattaaaaaacaaattataagtcgagaaatttgaaaaaattaatttttgcattttttgttaatatttcattttgtaaatcttacttatttgttggtttttaattgattgttttttttgctaaagaagttcttcaattactatcaaaa

SEQ ID NO: 50930 - DNA, 105 bp, Heterodera glycines
  Genomic contig location: Contig_ID=SeqID_3577; Location=3836..3940; Strand=-
  SCN-specific regions: Sequence locations=1-105
ctctggagatgcgcggtggacgaacgcacagcgccggacaatcaagcagcaatgccaccatcgacaagcccagtacttccgaacaaagtggccgatcgagattga

SEQ ID NO: 50931 - DNA, 1624 bp, Heterodera glycines
  Genomic contig location: Contig_ID=SeqID_3578; Location=292..1915; Strand=+
  SCN-specific regions: Sequence locations=1-10,32-696,719-736,768 -1357,1379-1462,1484-1490,1525-1624
atgatactgctcggtgcggcgctgctgctgttggccatgtttggctgctgcggtgtcaccgcaacggcaccggcacaaaagcggacaaagcgtcgtctaggcggcggacaaagtggcgacaacaacggctgggaggaccccgtcgctgtggtctacacttcgtcaccactgctttggctgtacacggtgggcgccggtgtgctgctgatgttcaccatcggctgcggctgttacattttgtacaccaaagatggggtaggaacggacagagacaatgtggggtcggtttttggccacttattctcaccccccagggcacaaccgtgtacaactcaccgatttaaaatgcaattaaattttttttgagaaatcgaatcattaaaatatagctgacccatttaggctttcgaataacactaattatccccaagaaaagggtgagatttaaaaattatgccctatttttttgggggggggggtagctctatatttcagtgtaaaatttttttttcatgtacatttattttataaaattcgtcagattgatgtggagttgtccgatgctctcaactacatggtccaacattactaccaagggcccggcattgtgcaggaaactctggaccgactgcagcaggcgtttcgctgttgtggtaaaaccaatgaaaaaaaaattcaagaatttttctaacgatattttggaaaatttccaattttttcttgaattttcttgtggaaaaatttaaaaaaaaattattttaataattgatatctctcgaaataaactaattttcttcaagattactaattgacattcaattgccccgttgtaggcaatgcgggttgttccgattttcgtgcgtttcgccaagacccgccccggacgtgcgacttgcgctgcgacgggtgccactaccgaatttggcttgcgctgcgcatcggcttctccgttgcgttggccatttttggcattgtgattttggcacaggttttcttttgttagtggttgtaagagccaaaaaaaattttcctaaaaaattaggagggggcctccactttagggtccacttcgtttgggcgccagaccaagtttttggactataacctttttctttgtaaaccaaatctaacattcttggtatcattcgaaagcttaacatgtttagaagctatttctaatttgtaagctattgtttcgcgattagacaattaccaaaaaagttataacatgaaattgcaaaaaagtcgaaattttttggagtttttttcttaataaattttttacaggctagaaaatctttttgtaaggctaatagaacatgtgaggagcttttgaatgataccggataaaaaatgggtaaaatttctgcaaattttcggctagttttctgtcatttttttcattcagaaaaatttttgcccttctattcattctccattagaaaatgactcacaatcaaaattaaaaaattagttttttaggacgaaatttattgccaaatttcctctgtttttcaaaatcttcgccggcagtgcctatcggccgatattgagtattttggccaataatctcacttttttgagatcttttgaaaaaaaaagagtcctcaaagcgctaaacaaa

SEQ ID NO: 50932 - DNA, 525 bp, Heterodera glycines
  Genomic contig location: Contig_ID=SeqID_20406; Location=179..703; Strand=+
  SCN-specific regions: Sequence locations=1-82,104-111,201-211,316 -331,354-365,502-525
gcgaaagcaaaacattcaactggctcctccggtggtggaccatcagtgccggcgccaaacaatcggaagaaaacgcaaaatcaacaacagcaaaaaggaaacaacgaattgggaggagaaggaagagaaaatggggggaaaagagaggaaaagggaggagaaaaaggagcagcagcggaagcagaggaaaaggaaaagaaagttgcagttgaacatcatcaaaaacaacaacaacaaaagcaagaagttcaagcagtacagcagcaacaacaaaagcaagaagttcaagcagtacagcagcaacaacaaaagcaaattttggtgggaatggagatgaagatggataacagcaaaaatggagaaacaagggaagaggtggaaaaggaaggaaatagcattggggaaggaggagagacggaagagaaagagaggaaaaggaaaaattctaagcaaggagggggagaaagaggagagaatgaagcagaaaagaagagagaggaacagcagcaaattgacactttttaa

SEQ ID NO: 50933 - DNA, 1077 bp, Heterodera glycines
  Genomic contig location: Contig_ID=SeqID_20410; Location=329..1405; Strand=-
  SCN-specific regions: Sequence locations=1-211,248-1077
  Gene Ontology: Mol. function=aldehyde dehydrogenase activity; Cellular component=integral to membrane; Biological process =epidermal differentiation
ctcgtggagtctcagcgggaattctttcggacgggaaaaaccgccgaattggcacatcggaggcagcagctgaagaaactgcgcaagacaatcctcgacaacagcgaatttctctgcgaagccgtgcaaaaggacctgaaaagggacgcgaaactgaattatccgctcgaaatttcgtcggtgatcattgaaattgaatatgtactcgacaatttggaggtgggaaaaggaaacatttgagggatttgagaaaagggattttcagcgatggacggcgcctttaaatgtcgaaaagactttcaccacacttctcgactccccgcaaatcgttcgcgagccgaaggtcagtcgaagtcgaaatgattcttaaaatcgggacgaaaacggaaacaatcgcaagaactttcgctgattttctccaatttagggcgtcgttttgctcattggtccatggaattaccccctcaacactttgctaatgcctttggtcgacgttttagccgctggttctttttttgtgctccaaattcaaccaaaattttgtcattttacagggaatactgccattttgaaaccgtccgaagtcgcgtcgaacaccgccgccgccgttgacgaaattatttcgaaggcatttgaccgggtgagtgtgccaattttttttggggggtaatgccaaagattcttctgaacagtgccaattccgttcagaattatttggcagtggtgcagggcggcgttgaacagaccggcgaattgctgaaggaaaagttcgaccacattgtgttcaccgggtcagcgctggtcgcccgccacatttccagggcggccgcggaacatttgacgccctgcactttggaactcggcggaaaatcgtatgttaaggggaggcattgtcaaataattgggataaaataatcaactgcaaatgaaattgagcggtaattgcaagttttgtgagaaccctcacgacttttaggaccacttaattgaaaagtcaaatattttaagggaaatagcaattttgaaaataacattttcacaacttcccatttgatggcgttgaataatccgtcgtga

SEQ ID NO: 50934 - DNA, 89 bp, Heterodera glycines
  Genomic contig location: Contig_ID=SeqID_20410; Location=1865..1953; Strand=-
  SCN-specific regions: Sequence locations=1-89
ggattatttttcaaaaacacctcgtagactgggggataattggagactgcgggattaatagagactgggctataattagagcatatacg

SEQ ID NO: 50935 - DNA, 301 bp, Heterodera glycines
  Genomic contig location: Contig_ID=SeqID_20412; Location=1737..2037; Strand=+
  SCN-specific regions: Sequence locations=1-160,194-301
atgtttttaatcgctttatttatgctaacattctccttaacatttgatttggtcgtttcttttgccgaaagtgaacaattagtgtattataattacaaccctaatgattattactcaacaagcgggagttccctttccgaactgaaaggtgaaaaaaaggaattttaattattaaataataataaattaatttgttttagatattcttgatagcggggacaatatcaagtgagacatatgacattttattaaactctcgactttgggttaaaaaaaactttttgttttatgcattcagata

SEQ ID NO: 50936 - DNA, 1203 bp, Heterodera glycines
  Genomic contig location: Contig_ID=SeqID_20413; Location=677..1879; Strand=+
  SCN-specific regions: Sequence locations=1-84,106-184,207-733,755 -951,996-1051,1073-1203
  Gene Ontology: Mol. function=RAB small monomeric GTPase activity; Cellular component=Golgi apparatus; Biological process=negative regulation of FGF receptor signaling pathway
ctcagcagctgaacagccagccaacctttgattgtcccgtcccttttcgccatgtccaatttggcaatgtcttccgatgacgagggcggccgaggagagcaaatgtcgctgaaagtggtccttttgggggacaatggcacgggaaagacggcgatttgttgccgttttgcgcaacacgcgtacccacagaaatacatacaggtgaagcagaaaaggcaatttgaattaatttagcaaattggcaaacaaatttcactaagtccggagagaatttggaagaatttggccaattaacttaattaattagctttaattggcccatttcttggcatagacttccggcgtcgacttttactcccgccgcatcgcaatgcctcgcaatgtgtcggtgcttcttcaggtgccctttttgtgcccttcgatcactgactgaccaatgctgattgaccgccactaatttcagctttgggacgtcggcggtcacaatttgacttctccggcaatgctcaacacttacattttcggtgcacaagtgagaagggatggacaatgttaggttgtcatatacacttccgacaacttaggccgttttgttcgtttacgacgtgaccaactcacaatcatttgaccatttgaccgattgggtgggcgccgcgaagaaaggcggcgctcaaatggaaaaggtaccggcgcggaaatggctaatggaaaaatgccgggggagggggtaattagaattcattttatcatttgatcattgatcagcctttttgcttggcattggtgggcaacaaaacggacagtgaacaccaaagagcggtcaaaatggaccgacacaacaaattcgcggaccaaaacgcactcagtgccttttatgtgtccgccaaaacgggcgattccatcgatttgatgtttaagtgagggaaaagtgaaggaattacaaaaaatgactaattaactgattaattagttaattgattaataaattttaattattttcatattgcctttctctttagaaaaacaacagccgaagtgctgggcattccgttgacaaaggctgaccaggaatggaatgtgaatgttgtacaggcacagatcacaacggtcgatcggagcataaataagcggaaacagcagcagaaggcggaggagccgcggaaagaaaagtacggtaggagaaggggagtggatacggtaggc

SEQ ID NO: 50937 - DNA, 62 bp, Heterodera glycines
  Genomic contig location: Contig_ID=SeqID_20414; Location=374..435; Strand=+
  SCN-specific regions: Sequence locations=1-62
tcggcggtgccaatgttcaacagccagctgctgttgccaaccatgccaatcagccaccattg

SEQ ID NO: 50938 - DNA, 2360 bp, Heterodera glycines
  misc_feature (1419)..(1419): n is a, c, g, or t
  Genomic contig location: Contig_ID=SeqID_20414; Location=341..2700; Strand=-
  SCN-specific regions: Sequence locations=1-791,816-905,927-1069,1091 -1299,1321-1501,1523-1776,1815-1930,1954-2040,2091-2360
  Gene Ontology: Biological process=body morphogenesis (sensu Nematoda)
gttggctgggcagtagcagctaccaaaagatgcgtgtctggatgttcgtgcagcagcagctacctaagctttacaacggtgcatgcgtggaccttctgcaatagcatatgggtagcattcggtgaatggctcacctggctgggcagtagcagtgaacggaacacgcgtggcacctgtgcaacattggaggccggcaggcttcgcaacggtacatgggtggcacctgtgcagcattggggaaacggaaggcttcgcaatgttgtacatgcgtggcatcacagagaaaaagacgcggctggctgtgcagtagcagctaccggaacagagatgatggaatgttgagtccaaagtcagggacgcaacatggttttgccttggtgaaggtaacacctcacttatgatttttgcagcacgcttttttacggcggtgccgataggcgccgggaaaattgttggaaatttgaatacaatttgttttaataaaaatgccgattttaaggattactaggctcaattagttaacgaattttctttaaaaaataataaaatatgtgtcaataaaaatgaaaaagcatattttttcgtaggcaactcctgagaaaataaaaaactgtggaggagcctccacaaaatttgcacaaggtagtgcctcagggtccggtcaggggtaagtcgggctcggatcggcgggtcggggtcaaatgggcgaacacacacacacaattaaataattcaagggtaaaatatagtgtgtaccttttactgtttgtatttgttcttttggcgttctgtatttattattattttatttatttgcttcaaaaaattgaaatttatacacaaacacaaggaggaattgaacttgagaccccctttttggtgactaactcacagaccactaagacgaaaaaaccaacttaattgtacttggagcccaaaattgaatcgccgtgtataaatcaaggataaattaattatgaaggaagatttttaagttttgaaaaacgattaagaaataatttagagaagtaaaaggcaggaccataaccagcataaaattcgggagggacaagccaagagcttctttctttttgctcttcggaccaaaaatttttggttcttttccgttttgtcccccctaaaaaaacctttttttaaaaactttttatggcaattttaggcgctgaacaaatgtgacatttatttaaagctaacatctattttatgtgagttaatcgaaatttgactcccaatgttagttctagtgaaatttcaaactttagtttccagattaaacggcattctttttaaatttatttcagattcgtttcaagcgcctaaaaattgtcatagaaacttaaaaatttttttagaggggcacaaaacggaaaagaaccgaattttttactcgtgttattntaaaaatgcagcccgcccggtcccggtagttcaaaattccggaattttttttcaactcagaaatcgagagtctcgacgccaaaacctttgtccccctctcccgactctacctgttgcccttggtgtctgctgaatgttggtcgggtcattgtgtgtctcctcctgcgcgacttgggttatcgaattctccacttcgtccgcgtcgcgtgagaattgctgcagggtttgcgactcgtccaactttgacggcttttccatcagttccgctttcagatgatcctaacgctcgaaaatttggccacgtttggcagtgatttgctgcaaaaatggggcaaaatgccatcgcaagaaaacaagattttttttaatataaaaacattttttaatttaattttgactcgggcggaaattttcatgatcgcgcctcatttttctgcatccactgaactgattgagagttttttgcaaaaatttcaagccttaggcttctccgaataagtgatcaaaattgtaaaaaaaaattattttttttttgcacttgttactgatcgggttttatgtttgccatttttttgctttgaattaagtatggaactgggggctgatttataatttgcacacttttatttaaaaatttcattataaaattttaatttatttactattttttagattatcagcgcttcttgtccgactaccgtgatctgatgcaatgggtggacggaatggtccaattggtgtccagcgataagttggccaacgatgtgactggcgctgaggtggtagcctatcgaactcgcaataaaaaaccgaaaacgctaattcgtttgtttcatcgttgttgtgcaatggtggctgattggcatggttggcaacagcagctggctgttgaacattggcaccgccgagccaaacaaatccgtatctatgaattcatctga

SEQ ID NO: 50939 - DNA, 1199 bp, Heterodera glycines
  Genomic contig location: Contig_ID=SeqID_382; Location=2126..3324; Strand=-
  SCN-specific regions: Sequence locations=1-1,32-251,284-440,485 -701,741-846,868-1199
atgtttaaatttttcacaattttcagctgggctaccatcggaatttgccccaaacagtcgagcgaattgggagaacgaatttgcaatcggaccggcacttatgcatacgaaagcgatggcactttttggcttagtggctcattgaaaataagaaacgccgaatacatttatggtgccgatgatgttgttgggtttggcgttgacttggccaacctgaaactgattttcacaaagaatggccaacatttgggttttaaatttttgaaaattttaaattttaaaacacttagacaccatccatttgttcgcttcttcttccgatcaccaattatttcctttcgtttctttggcttgctcatgtgataaaattgtggcaaattttgggccaaaattcaccttcgacttggctaatgttgaggtgaaaagttgaaaacgggtgctataaaaattcaaatataaaatatatttttaaattttatttaaagattgtttcaatttcgcttcaaaattgttgggacgtcactttctgtcacaatgatctccaaatcagtggggacgaatctttgattgtcagactatgtggaaaaggcgactgtaagccatatgctaatttaaagtgcttccgatacccaaatttgcggagtctcgagactctcgaacagcgcaattaattggtttttttatatttatgaactgtttgctaaattaaaatttatttattgtatttaattacaatttttcgaaagggtggcgcaccgtcttcacgaaacatccgatttcatggaaaaacaatctctcaggcgttttttactttgaaatttcgctcaaagagttaaaacggttagtgtgtgcttttgtatttaatttattcttaattaccataatgatttaatgatttgtttgcttttccccaatgttagcctcgcgcttttcggatttgccgacaaacacaaacctttgctgtcccttttgaaccgttctggcacttacgcatacgcaagcaccggcaactttttgatcaacggctactgggagaaaggcacttgcaaatttgctcgtggggacgtggtcggatgtggcgttaatttggccagtcggcggatcattttcacaaataaaggacaacgtttgggttggtatttcggaaaataccacaaagccttattaatgaccccgggacttggggttggataaataaa

SEQ ID NO: 50940 - DNA, 578 bp, Heterodera glycines
  Genomic contig location: Contig_ID=SeqID_384; Location=2394..2971; Strand=+
  SCN-specific regions: Sequence locations=1-105,127-369,402-578
atgggtgctatatccacccaccaagtctcattcggaaatcccacggacacctggggacctttctttgtgagtatatttccgagtttttggggatgatgatcacgaattgacatattttttgcaaaatacagttaaaaattgggaaaattaacctaaaaggcattcctgaaataaaaaaggccaaaaaatttatttgacactgcaatacttgtttcttttaggcatatgtgatcgatgccaacaactcggctgccgtccattggataccaaatgtcctcactgtacaacagttgtggtcgtacatggatcaaactgagagggtttctcagacgggcttttcgtaataactttatttaaaggattggatacaaatataattttttaaatattaatgttaaaatgagacttttagagattttcaaattttttcaacgagagctttttgaattagagaaaaatgccctgtttttcaatccctcggtaccagtgagctcttccgggcattatttaaatttggcctccctgttcgttagtagaatctgccaaaagttaaaaaaatgattaaattagtaattgta

SEQ ID NO: 50941 - DNA, 1067 bp, Heterodera glycines
  Genomic contig location: Contig_ID=SeqID_384; Location=3214..4280; Strand=+
  SCN-specific regions: Sequence locations=1-96,129-255,277-288,310 -566,589-1067
atgcatgggtttggcctttttctgtcgctactggcggcaataaatttgtcgagaggtcaaattggtccaaaggatgaaagcaaaaaaggtttgaacaatattttcaataaaattttaaatattattttgttttgttttaggtctttttttgatggccaacgaatttctcgagacagggaaaatgcttctcgacgaattcccaggaaacaaacaggcggagaataaatctgatgatggactcaattcacaaaaagcgaatggaaaggcattggaagagaaaagtgacaatttccagcaaaaagcctttgagtttttgtgtggaatcgaaatgaaagcaaaaaatgatgagaaaggaaatgacaaaacaaagaaagatgacaatttgttagcttttaaagaattagaagaaaagcgactcaatttttgtcaaaattggaaaaatggcaaaagcatttggaaaggatggaaagaggcagggatttcaatagtaacatcagtgaacaatttgaaactgaatcagcaaatatacggagaaagtcttcgaacattggcgaaaatggaaattttcaacagcaaaaacaaagaagaatttggaaattttacgaaatttggcatcgatttgctaatgaaagtaactgaaattcttaaaggtaaccaattaagttattctaaacaaagaattttattccaaatggggtaattaaacatttaattgaagatgcgagaattagttcactggctctggctgatcagtctgatcatgaccaacggaaaggcaacaacacatcacgacgaaggaaaagggcttttcatgggatttttcgccgagagtttagcttggaaaagtgttttctgtacttgctgttgacttgcatgtccgccggccttggcactgacatggtcgttcgtctcgcccagcacaaagtgcgggtcgtttcatttggcaattcggcgcctccgcctcccttttctaccgaaggccatcacacaaccccgcttgaaggatttgagattttcgtagctattttttgctttcttaccactttttagttttccaatgacactca

SEQ ID NO: 50942 - DNA, 534 bp, Heterodera glycines
  Genomic contig location: Contig_ID=SeqID_384; Location=5900..6433; Strand=-
  SCN-specific regions: Sequence locations=1-91,137-275,323-534
atgtttaaattgccatgcattttacttccattttttgcactttttctcagtgattttattgtgggacaaccgatgaagagtaaacaatttgattttttaataaattaaagcgaaatttattattatttttaaatttgcagatgccgcagaaactgctgatcaaggaaaacagaaagaagaacatttggtgtgtccgcattgtaatggccacataaaacctggagaattgaaaatgcaattaaagggtaaacaatcgccagccgaacaacaaaaagtaaataattaattaaatattatttaaaaaatatataaataaatttaacaggaaaagccgaaagtggcacgagagcgccacccttggcacgtgatggacgatgtgcaaattggggaggaacatttgccgatgaataaaggggacgacgatgccgatttgagaatggaaaaaaagttgactcgcgaaacgatcggcgaacaaccaaagttttggacggaatcttctgattattgaaatttatgaaaaagcgatcaaataaa

SEQ ID NO: 50943 - DNA, 397 bp, Heterodera glycines
  Genomic contig location: Contig_ID=SeqID_385; Location=1053..1449; Strand=-
  SCN-specific regions: Sequence locations=1-137,183-397
atgccgcagaaactgctgatcaaggaaaacagaaagaagaacatttggtgtgtccgcattgtaatggccacataaaacctggagaattgaaaatgcaattaaagggtaaacaatcgccagccgaacaacaaaaagtgaataattaattaaatattatttttaaaaaatataaataaatttaacaggaaaagccgaaagtggcacgagagcgccacccttggcacgtgatggacgatgtgcaaattggggaggaggaacatttgccgatgaataaaggggacgacgatgccgatttgagaatggaaaaaaagttgactcgcgaaacgatcggcgaacaaccaaagttttggacggaatcttctgattattgaaatttatgaaaaagcgatcaaataaa

SEQ ID NO: 50944 - DNA, 389 bp, Heterodera glycines
  Genomic contig location: Contig_ID=SeqID_385; Location=1831..2219; Strand=+
  SCN-specific regions: Sequence locations=1-110,133-301,324-359,381-389
atgtcaatttcgaccagttcaacaaatggtgatttcacaccatcaataggtggaggaggtaatgaaatgggaaaaggttgaaaataaatggatttttttggggaagggagtaaataaatattataattaaatcagggaattaaatttataaattttcagaagttaatgacgattcaattagtttggatgaagattggcaatttgatagaaaaaatgaaactgttgctgatcggcaacaattgctgatggtgggcaatgaaagaagcttcaatgaggcatttacatatatttttcgacaaaattatttatttttattggaatttcatgaaagttatgctaagaataaggtggaaattgaattcaaaattaccaaacttgtacttgagaag

SEQ ID NO: 50945 - DNA, 2431 bp, Heterodera glycines
  Genomic contig location: Contig_ID=SeqID_3581; Location=304..2734; Strand=+
  SCN-specific regions: Sequence locations=1-292,326-883,905-1151,1176 -1803,1827-2365,2387-2431
gtgaagagcagaaaaaatctaaacccaaatgtgatatttcgcgactcatggaatctgattccgggtccactggcatcaatggtcccaatgttcggcttggacgtggacgacaagccttttttccctcatttggtcaaccgccctgaaaattacggatgccatatcttccccacaaaggccgattatttggcggacggaatgaatccggtcaaacgaaaagaattcgacaaatggtttgaggaaaaccgaaacaagtcgtttttcctcgacgaagcattggccaggtattatgaatttttaaaataaaaataaaattttattttaagctattgtaaaaacgatgtggatattttgatgtccggtttaattgcattccgagcggaattcatggagatgacgaaacggtcagctggaacagacggaaaagtggaccgagctgctcacaaaacaccccatgacggcattgattccgtacgccactgtattacaattgcctcagcttgtatgcgccatttccgcaccaatcacctaaaaccagcccacttggctcttgtgcctgagaagggatatgacagctgtggggacaaccaaagcgatttggctctaaactttatgcagtggtattctgaagagcatggagtacggatacaaaatgctttttcggctgaaggcgaaaaaaggtaaaattttgaaaatgtaaaaataataaaattagagtgatagggtgggtaacttccgtctggatggatggattgagtcggagaaaaaaggactggaaattcatggatgtgtatggcatgcctgcccaaaatgttatccggacgacaaggatgtgatgccttgtggcaagacagctggacgaatccgtgagcggaacaaacagcgcatggattttatattggaacgcgtgctaaatgtggaaattttttggcaatgcgagattgaacaaatgctggcccgggacagaaaaatgaaggacaaattcagcgaatttacgggtgatgggggtccaatcaatatccgtgcttgcttcatggggggcagaacgggagcattgaagcttcaccacgagatagcagcggacgagacgattagctactacgatgtcacaagtctctacccatttataaagtacatacgatgaatttgtcaatatttaaatttaaaatttttttgtagttatgtgacccattatcccgttggtcatccaactctgcatgttccatgtgaggatgttgactggcgccgatccgaagacaatccatatcacctggccattctcaaagtgttcgttattccaccgcgccgaattgacgttccagtattgcccgtcaaagtggatgatcggctttgctttccgctttgtatgaaatgttgcaaaaaatttccaaatgggggtgtaagggagacgtacaactgtacacacattgatcgtcaaagaggatggattagtacatgcacgtctttagaggttaaaagaaaaactgttttttgttggtatatttggtaaatttagctaaatgtcgcattggatgaggggtacagagtaaccgagttattgcgtgttctcgaatacagcaagagtgacaaccagctatttcggccttatatgagcgaattcatagccgaaaaaatgcatgcttcgggattcgatgatcagattcggggaaattttgaagcggaggagaaattcatcgcggaatgccgggaagaatttggaattaaaattgaccgagcgaaaatggtcccaaacaagggaaaaagagcgcttgccaagttggcggtgaataatttatgtaagagtttaatgaattaaataattgaatacttacatgttaaggggggcgtttttctcttcgtaattttgggcttacccaaactctgattacggacgacccgtcggagcttggcaattatttggacaacaaaaaaattgaagtcacaggacttgacatgcttacaccagagaggatcttgatcagctaccatcaaaagaatgattgggtcaaagaacacccatgctcaaacgtcgttgtctcactttttactacttcggcagcccgattgcacttgctaaaagcaatgcaaaaagttgttcgaactcctgggtgcattcttttatatacaggtaaaaattattttttaacgcgacgatttttgaacttttagacaccgattcgctgatttatgttcatccaaagggggcaaatcctttgaaaacaggccctcatttgggtcagtttacggacgaatttccgaaggtgacaaaaattattttaaacatcataatttccaaattttttagcatgatattttggaatttgtgagcggcggtgcgaagcagtacggactgaaactccgcaaaaagggatcagaagaagaagaatttgagtatgttctcaagctgcgtgggatcaccctcaactatgat

SEQ ID NO: 50946 - DNA, 1058 bp, Heterodera glycines
  Genomic contig location: Contig_ID=SeqID_3582; Location=404..1461; Strand=+
  SCN-specific regions: Sequence locations=1-170,194-578,601-732,754 -1058
atgcatgcttcgggattcgatgatcagattcggggaaattttgaagcggaggagaaattcatcgcggaatgccgggaagaatttggaattaaaattgaccgagcgaaaatggtcccaaacaagggaaaaagagcgcttgccaagttggcggtgaataatttatgtaagagtttaatgaattaaataattgaatacttacatgttaaggggggcgtttttctcttcgtaattttgggcttacccaaactctgattacggacgacccgtcggagcttggcaattatttggacaacaaaaaaattgaagtcacaggacttgacatgcttacaccagagaggatcttgatcagctaccatcaaaagaatgattgggtcaaagaacacccatgctcaaacgtcgttgtctcactttttaatacttcggcagcccgattgcacttgctaaaagcaatgcaaaaagttgttcgaactcctgggtgcattcttttatatacaggtaaaaattattttttaacgcgacgatttttgaacttttagacaccgattcgctgatttatgttcatccaaaggtagcaaatcctttgaaaacaggccctcacttgggtcagtttacggacgaatttccgaaggtgacaaaaattattttaaacatcataatttccaaattttttagcatgatattttggaatttgtgagcggcggtgcgaagcagtacggactgaaactccgcaaaaagggatcagaagaagaagaatttgagtatgttctcaagctgcgtgggatcaccctcaactatgctgtaacagaaaaccacggattacgcttcgaaacttttaaaaaacgcgtcttggaatttgctcgaaccggaaaaacccagccaatcaaagtcatttaccccaatttccttcgccctaccgttatcaaaggaaatgtcacctcagctcctctccaaaaaatatataagccttatgttggcaaaggcattgtttgttctcgtgactttcgcgtacttgattttggctattcatctcgataaacattgttatttttatctgatca

SEQ ID NO: 50947 - DNA, 516 bp, Heterodera glycines
  Genomic contig location: Contig_ID=SeqID_3582; Location=1617..2132; Strand=-
  SCN-specific regions: Sequence locations=1-516
atggtgctttttactgaaaaaatcgccaaaattttgaattgtcgtgtcagtgaactgcgtgatcggcttaatcacccttctgattgtaaaattgtagagcaggcgttgaatggactcccaattcagacaacatacaaagaccgaaatgggtacaccaaaactttttcttttggcggcatcacaccccaaggagcttcaacaatgatggcctatggccggttaggcagacctttcaatgtttgcgttgctgcacacttttatgttcgccatcgaattaaactccgtcatccgtttcttcactgtgctgtcgagcgctttcaagaaggccaagaggaccgtttctatccacttgagctatgtcaaatggaagatgtgccaaacgagctggattggctcgggagaatgttcactgaaatccgcagtgaaaaggtcaatggcatgaacgaagaatcaactcaaatttcgaacgaaggacgtcatgaatgtagccaaaatgatacttacactttttggtag

SEQ ID NO: 50948 - DNA, 523 bp, Heterodera glycines
  Genomic contig location: Contig_ID=SeqID_3582; Location=2374..2896; Strand=+
  SCN-specific regions: Sequence locations=1-5,28-235,260-260,302 -428,450-473,506-523
atgtccacatcctctaataaaaattatttaccaaaaaaccaatgcccaaattgtgatggtaattgcaattttttcaatagtgtacaaaaattttttttcaaattttagatgatgaagttgacactgacccttcacccgaagaagttgagaaatggacgccggaacaagtgattgagtgggaccagcgttgctacgggaaaatgccagctgaagaagagctttggcaagaattcctcgacaaaggagaggcaaatgtcagtaaataaaatttttgatccattttttaaattatttctttaggttctgcgtgagttctttggcggaaaaggggcgcttgaagttgagaagagccttcgagaatacgcgaagaaaaaggaacgccgagacgcaattctgattgagaaaagaaacgaatacaaaaaaatgatgggaaaaaaggatgaaaattgaatgttcgaatttctccatccgctatatcaatggcttttattttattcaattattttgatttttaatactcgaa

SEQ ID NO: 50949 - DNA, 1791 bp, Heterodera glycines
  Genomic contig location: Contig_ID=SeqID_3582; Location=3002..4792; Strand=+
  SCN-specific regions: Sequence locations=1-360,400-446,469-821,843 -931,968-1195,1225-1260,1282-1293,1315-1332,1354-1464,1486-1791
atggctgaaaatcataatgagcaaaagatgaatgagcaacaaaatgaaataattccagctaaaaaccccagaagcatccaatcctggaaacttttccgcccaaaatatatgctaacttttcgtttttgcgacggtaaacagctagtctaattacagaatatcataattgttaaaattcagcatgtctttcgtgcttatggaacaatacaaacaaatattcaaatagaccaagtgacggaagccaaaataatgatcttttgatttttaaataataatgataatttcgatgattcaatttttgtaatgataatttcaataattgtaatgataattcgatatttaattgtttgcagttaattcataataaatgttttttaataaaatcatttttttaattttggtcatctcacaacttatcgcccctaacctccattacctcccaaacaacataaaaaaggcaaaaatttgttatgtttgcatagcaaggaaaatgccgagcgcggaagcaatttgatctttagctcattcctctcttgatttaacgccggctccgcactgcaatggatgtgcttatttatttattgccttgttgggataattggcggtaacctaaaaagaaatttaccggccaacagttcaagcactttaatcgtcccaatattcccctaaatgcgcatcgcagaaatatgagatgtcgagaaaagtaggctgtgattttttattgaaataataaacaattcaagtgcaagtggagaataataataatggggcgggtccaagtgatggcggtgttcggaccagaccaaatgaaaaccgtaaactaggaaatttttgtttaataaatttcgatttttttttgaagaacagctgactccgctcagttcacgttcgggaaataatggggctttgcaaaatcgtactaatggtgtgctaattttgaaaaaaataaaaaaacaaattttttttagtgagaaatgtggctgggccaagtacggcgagtgatggtgacgatgaacgtgaaaacggtgagatgaacccttaataattttacccaaataaatgcattttgacaggccccgttctaagcgctgtcatcgaaggccacatgaaccgttcgcggatgcgtctcattcgcgacgagatggttcatcgtgctgttcagcagcaacttgaacaccagcgccatctgttgcttcagcaagcgcagcagcagcagcaacgagaagagcgagaaagacagcaacactttgatcagcaaatggaggaagcagagcttcttcacgaacaactgcaggcagcagagcaggaaaacgacgagaacatcgaaccacagccccctcagcagcagccgcaaccgctgattcgtcatcagcagctgcagttcgaacgtaatgttcgactgcagctgcgcgagtcgcaacgatttgaaaggggagttgcctcgtcaatgctcgttccgccagcccagctctattgggagaccgaatgcatcatctgcaccagcaaccgcgcacacctctacagccgtaattgcggacacatctaccctgtgctcgacatgtgcggtgaacgcggtgatccacaaggtcgcgacttgtatgctctgtcgtgcgcgaattgaggggatttatccatttgtccgctgatggatgtatttgataattcttggacccctttgtcattgtccatcctatcattaccctattatcacaatttttgtaaacgatccattgattgccacttggccttagcaattctcaatcattatttaaactcagccaaaaaaaatca

SEQ ID NO: 50950 - DNA, 138 bp, Heterodera glycines
  Genomic contig location: Contig_ID=SeqID_20415; Location=179..316; Strand=-
  SCN-specific regions: Sequence locations=1-138
aaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaa

SEQ ID NO: 50951 - DNA, 678 bp, Heterodera glycines
  Genomic contig location: Contig_ID=SeqID_20415; Location=318..995; Strand=+
  SCN-specific regions: Sequence locations=1-60,82-678
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccccgaaaac

SEQ ID NO: 50952 - DNA, 1143 bp, Heterodera glycines
  Genomic contig location: Contig_ID=SeqID_20417; Location=413..1555; Strand=+
  SCN-specific regions: Sequence locations=1-246,269-339,362-521,545 -548,571-632,663-1143
ttgatttctctctacgagcgtgccaaggcggacgaacgaaatgtgccgacacttcgtgcgaacactgctcgtaataatggacaacagcaacagcagaaaaaagtgcctgctgctaatggcgggaagaagaataataatggggtggcaccggtggtgaagcagcaaattgttgtgatcagacaagcagagcagcggggagagactgtggcgaaacgagaggacggcggggtgacgagacggcgaaagagaggcaacacagcaacaacagaagttggagagcaagagcagccgccagacaacagcacagacgatgaaaagagtgttgagcgtgaggaacagcaagtgatggaaaagaagcagagaaaggcagcggcagccgcagagagtgtggaaagcatagagacggaggaaaagaagcagaagacgggaaaagactaaaaagagttaagaccttaagacagatgtttttttttcttcacttttttgctgaattttttttttttgggtgtgatcggaatatttgttgtttcttttttatataaatttaaacttctaaggtatgtaaaagtatattcaatactttttgaattttggtggctattagagaaccaaacacttttggctatcgaatgaaattaagaattattttaatttttttttttgtcaaaaagctttcaatttacatcgatttatggctcttcggacggatgattatttttcttcaagttataatccttttaatgccaaaacagttacaacaattatgaatataggccaaaagcccgggcgcatttctagtggacaacgtcatcagtagggcgtgtaattatatggaaatccatatttttttcctggattattggaggcctgaaacgcacgaaaaacatgtttttagcttggtttgaagcttctaggatggattcctatatccattttttccatatttttccatatttcgcgatttatgtccatttttccatattttgggcatgttttgtctatattttgtgtccatattttgggatttttccaaaaaacctctattagaacggcccccagcagctaaatttgcctttttgagcccaaaaaccggaaaattttacaaaaaattattttttcgctaaattttctcgagaatattga

SEQ ID NO: 50953 - DNA, 823 bp, Heterodera glycines
  Genomic contig location: Contig_ID=SeqID_20418; Location=1431..2253; Strand=+
  SCN-specific regions: Sequence locations=1-80,105-216,244-372,396 -526,548-759,789-823
atgtggatcgatagctcaatggtagaactgaccacggaatgggcatacgagtgagttggattcctaaccaaggccaaacattttacttattttaagtattaaaacctaaaaacataaatatattttaatgccgaggcaattgtttgtcttttatctggtcgatgcagaatataattaattcaagcgataataatatttaatatgctcttattttcattttcaatttattattttttttgagagaaaaaaaaatgtgccacgtatttaagcttattagagaatttagagtatgcctaagctgatatgttcagaattctttgcaaacattactgtattaagtatagaaatggctaataatatttactttctttaaagtttttcttaaattcatttttcaacctcttatgtatgtctaattagttggaaaatcaaaaattaatactgcttataaatgttagaatgtacattgcaggtttattatctcttctatcataacagagaatcagattctaacttaattctttcagttgtctgtctttttcttgccaaggcattgaattaaaattgaaatttaaaacaatcccatatgttcgaatggaaggaatagtcaaagtttgaaaataagtttgttctggaactcaaccagatattcaagtgaccaattttatgtctctatgtctctaatatcttatgatttatgatctacgtgtggttcaacactcgacatgaaaatgaatattgaattgccaaggcgtgaagaaataattaaaaaaaaatatatatataaacagttgtatcagctttcgaggtataagttgttcta

SEQ ID NO: 50954 - DNA, 113 bp, Heterodera glycines
  Genomic contig location: Contig_ID=SeqID_20418; Location=1239..1351; Strand=+
  SCN-specific regions: Sequence locations=1-113
ataaaagtcaacgtagaagcctcaaatcaagtggaaaatgcgttatttatgctcaatatatcgaaactagtgcgcagaaaaaaaaaggcaattgcctcaaaatgcggtctcta

SEQ ID NO: 50955 - DNA, 882 bp, Heterodera glycines
  Genomic contig location: Contig_ID=SeqID_20420; Location=637..1518; Strand=-
  SCN-specific regions: Sequence locations=1-247,285-519,552-587,638 -724,746-786,812-882
atggccttaaatgtgacctatcttttcaacctgagcttgtactgctccaactccatgcatgaagttcaagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactagttctctggctctgtatctcttttatttttctttaaatcagccatcaaaaatacctacctctaaaattaccatttttacttacttaactctaactccctaaatacttttccattggtattgatctcttgccagaataatggcaacatattattgataataatggcgggtattttgaatcatgattgtgttttgttgaaattaaaaaaaaaaattaataaaaaaaatttgggtatcaaaaattatgttacaccctaagtacaaacaaattaaaaatttatacaatttctaaataacttttttttatttatttaaagcctatttaaccaaaattaattaaaatttgtaaacaataaaaagatttcttacagaagatttacatctaatatactgacttaccattctattaaaaacagaaaatggaataacaaaataaggtttaaaatgtattaaagaattgaaatcaaatttttaaatattaaaataatatcctccatttacaaaatttaagatattaattttgaacctttgagaattacaaacgaataactctataataaa

SEQ ID NO: 50956 - DNA, 582 bp, Heterodera glycines
  Genomic contig location: Contig_ID=SeqID_20421; Location=647..1228; Strand=+
  SCN-specific regions: Sequence locations=1-129,162-199,244-277,310 -329,356-370,392-424,450-582
atgcttataaacaatcaactttcagaccaccaaacgacgacttttgggccggcatatggaagcgaaggagtcaaagtgaacggcacggacacaacgacgaacaaaagcaacagcaatggtagcagtttgaaaattcataatacataaaaatgaaataaatgaaattaaattcattattgggatattttgaaagaaattcaaatttaaaaaatttttaatcaaaatcaaataatttaaaattaactaaaccactgtatttgtagcataatttaccgaaaatattttacatttatttattttggaaaaagtttcaacaatttagtaacattaaaaaataaagaaagaaagaaagaaaatttattttaattcttccatctttataatttaaatttcttgacaaaaaactgaattatgctaatgaatatgtataaatttaatataattttgaaaattcgtttttccagagtggacatattacttgtacgcctttttaattttggccattggcgccatgggaatatatggactctatcggctttgcagaaggagtacgtttacttataaaaaagtgaaataaaaata

SEQ ID NO: 50957 - DNA, 190 bp, Heterodera glycines
  Genomic contig location: Contig_ID=SeqID_20421; Location=1411..1600; Strand=+
  SCN-specific regions: Sequence locations=1-190
atggctcgtagagctgaaaatggcgtgtgccatctcagccagaagaagagaagcggcaagagaggcggacgtggagcatgtggaggcggagctcgacatgcacgtgccggagacggaagagcaacgagaggaagcgaaggggcacgggccggagacgaacacggacgggaaggagatgcaccgggagaag

SEQ ID NO: 50958 - DNA, 1598 bp, Heterodera glycines
  Genomic contig location: Contig_ID=SeqID_20424; Location=186..1783; Strand=+
  SCN-specific regions: Sequence locations=1-543,565-760,782-922,946 -1040,1067-1598
  Gene Ontology: Mol. function=apoptosis inhibitor activity; Cellular component=cytoplasm; Biological process=chromatin modification
accaacaaaagtcgcattttctactaccaccaccccgacctcggcaatttccactacggtccgcagcatccgatgaaaccggcacggttgggtgcgttcgccccttttgacgtgccaactctgaccctttaaaatgttcagcggccactcacagtttggtgctcaactacgaactgcacaagcatttgacgtgtgtccatccgcccagggccacccaacatgacttggcccgcttccatgcgcccgaatatgtgcagtttttgaagcggatttcgccactgaacgcggatcagtacgagggactgtttaatcgctttaacattggcgaagattggtcggaacgcggagggagggacgggcggataacaaattgtacggcatttcagtcccgtcttcgatggcattttcgacttttgttctctgtacaccggcggaacactcggtggttgctaaaaggaatgtgtccttaatttgcttttgcgtaaacagagggcgccattcggcttaaccacggccaagcggaaattgcgattaattggagcggagggttacaccacgcgaaaaaggccgaagcatcgggcttttgttacgtcaacgacattgtaaaacacacagaaaacagatggggaaactgaaacagagaattattgaaggtgatcggcatcatcgaactcttgaagtgccatccgaggtgatttcgggatgggcacccgaagatttttttattttttgctcttccggcctaaatttttttgtcagatgttattttccgaaatttttggggcttcgtgggaaaaaaccggaaattttagccgttttcgccaaattttagccattattacgggactgaattaaaccatcggccgaattatttttttttatcgcctcaatggcctttcctattttcccctaaagagtcctttacattgacattgacattcaccacggcgacggcgtccaagaggcgttcaacctcaccgaccgggtgatgaccgtctctttccaccgctatggcagctatttcttccctggtttggcacaatttttaatgaaaaaaggtggaaagtcagtcccttgccttcgtttgccaaggcactggcgacatgtacgacgttggcatgggccatggccgctatttttcagtgaacgttccgctgagggaagggatggacgacgaaagttaccacagcggtaattgcaaattatttatcattgattactgtaatttggcattttcagtttttaagcccgtcattcaggccgtcgtggacaatttcaatccttcggtgattgttctccaatgtggcgccgattcgttgggctccgatcggctcggctgttttaacctcagctttgacggccacgggtatgtttagaatggcacaaaagagagagagagtggttgagaaaaagagaaaaagtctggccaaaccattggacaaattgactcggaatacccttccaaattcattccctcagggaatgtgtccgctttgtcaaatccctcggccttcccctccttatcctcggcgggggcggctacacattgcgcaacgtggcgaggtgaataacacaaaagacaaaagaggagcaaaata

SEQ ID NO: 50959 - DNA, 5637 bp, Heterodera glycines
  Genomic contig location: Contig_ID=SeqID_3583; Location=2048..7684; Strand=+
  SCN-specific regions: Sequence locations=1-331,353-766,789-847,869 -1061,1084-1215,1240-2065,2088-2426,2448-2467,2504-2691,2713 -2729,2751-3092,3114-3119,3141-3872,3897-3947,3976-3993,4016 -5176,5198-5247,5270-5379,5402-5556,5620-5637
atgtttgaaaagtttaaaatattacaaatagatgaggaattatgtcttagtggaaaagagaaacaattcaaagagctatgcacagaacttaaagaaaatgcatacgtcgacaattttgtaatgatgtgtgacgacgaaaaggaaataaaattcaaacattactggagcaaagaaatattcaaattagcatccatgaatttgagagaattcgtgtctaatcatgaacaaagcaacaaagagattcaaaaaatggaaggatcagagataccaaaaatgacaaaaatgttgggtataaaatggaatgtcgacacagacgaactcgaactacaaataaaaataccactaatgagtagagacacgacaaaaagacaaattttgaccatgatcgcaaaaaatttcgacccaatgggttggatatcaccagtaatactcaaatacaaactatttttccaaaaactatggagatcaaacaaagactgggacgataaattaaatgatgaagaaataagagagtggaacaatatttcaaatatagacgaagtttccataccacgctcaccatttacaagtcaaaatttaaaatgtgcttctttacaccttttttctgacgcctctgaattagcctacgccactgccgcatatttacacgcaaataataaaactgacttattattcgcgaaaacgaggcttaccccactcaaaggcctaacaatcccaaagcttgaactattgggactattaatagcagcaagagccgtcaagtttatcatcaaagaatcaaaattgaaatttgaaacgatatgtatctggtgcgattcaaaatgtgtactcagctggttaaaatgcaaaaagaatttgccaatatttgtaaaaaacagagtggaggaaataaaacgaattgtgtcagaatttcatatcactttctattacgtaaaatcagcagacaagccagctgatttggcatcaagaggtacaacaatgaatgaaatgaaatacaacgaattatggtggaagggaccaaaatggcttaaattaggaaaagaaaactggccagcccacagtttctatactcctgagcaaaatgattcactttatgatgttaacataatggaaatcgaaaacactcagacaaatttagtcaaaatggactaccaaggatttattgaatggaaaaaatacaattcatgggataaagtgacaagaatttgtcaaatcttattaaaatttgtattttttacattaaaagactctcccgaattcaaaactaaattcaaaatacagaaatttcaaaacgaattgagcttaaaattcatggcacaaaaaatgctaatacgcataattcagaaagaaatggaaccaaataatgaggaagagagacaattgggaatttacagagacaatgatgaaattttgaaatgcggaggaagattaaaaaatgctcagataaaagcgacaaacccaatattcttaccaagaacacattttggtactcatttaattattatggaccatcaccaaagaaatttacacgctggaacaatgacaacactagcagaaattcgtaaaacttattggatccccaaaggaagaagaattgttgaccaaatcagaaaacaatgtttctattgcaaaagatataacgcaaaaccatatcagcaaccaaaaatgccgcaattgccaaaatcaagagttcaaataacagagccttttcaaaacgttggccttgattacatgggtccacttcaaattaaaagttttactgaaaaatgttggataatacttttcacatgtttcaccacacgtgggatacacctcgaattagtgacatcattatcaatacaacactttctcaatgcattccgcagatttatttcaagaaaaggaacaccaaaaattatttggagtgacaatgcatcacaattaaaacttgcatcaaaagtattacctgaagtcctaaaattaaaggaaatacttaaagacgactcaattaaaaactatttcgaaaaggaaaacataaaatggattttttcaatcgaattagccccttggcaaaacggagcaatagaacggttaaatcaaaatgtaaaatcagcaatgaaaaaggcaatcggaaggaaattaatagaatttgactcatttcaaactcttatttgtgaaatcgaagccttagtaaattcacgaccaattacattcatttatgacgaaataaattcgtaccaaattcttagaccaatcgattttatactcccgcacaaaaatctatgcattcccccaattttggaagaaaatgaaactaatgacccaacatatttaccaaaaccaacttattatgaccaaacaatagagttatggaaaaagacaacaaaaattttggatgactattggaaaatttggacagaagaatatttaccaagcctgagagaaagatataaaacagaaaataaaaatccaaagaattgtgtaaaatcttttccagaaatcaatgaagttgtcataatccatgatgagaccccaagagcaatgtggaaaacaggaattattaaaaatgtcataacaggaaaagatggtatcataagaggagctaatgtcgagttaccaaacaaaaatgtcattaaccgtccattaaaattactatatccgttagagattaacaaaaatgactgtgaagagaatgagactatcacaaacttaataaaaaccactgaacacaaacaaattggtgcaaatcgaaagagaaaacaaagtgtcctatcatccccaaaattaagcaaagtatttttaaacacactcacgtttcttctattatttatgcaactcttaccatgcttatcccatttatatgaatgtccaaaaaccaatgaaatatggagaacgaagtatacaacattttgtgttgaaaatggatttactatcagacaaaataaattaacaatggaattttgttatcgtaaaatattttgtcacaaacaacacgtcataaaaaatcacccaccctattgtggaccacaatgcaaatgtcctgattggactaattcttgtagttttgcctcatatcacagaataaaaagagaaataactgatcaggaaaatattcaaaaaattatttcattcttcaaaccaaacatttgttcattcaataaaacggaaaaatgctccctaatggataaaaatatatttagttcaataatgctttatgataatagcattcattcagtcaaaagttttaatttacttcatacacaagccaattctcgaattgattatcgttgccttggggagggcaatctgacgattggtacacaaaaattctgtcaagaacacgaatgcactgacacacatggaacaaaattttgcttttacgagccacacgaaaaaacttatcttgtgaaatcagaccgagaaattatcccaataaaagcatggggaagcatcgaaagaattttttatttggctaatgacacattgatggatgaactcaaacgtaaaaaaagagaattcgatccgttcgaaaacgaacaaatatccgctgaatgtacaaaaggtggaataaaaataaacccaactcatgctaccacggaattagaaattttggttgataaatactttatcctaaagcgaagtccacagagcgaagaatttatttctctacctacaaaaattactatgaacgaatataaaccagtcattaaatttatgaaaggcacaagcgtatctgagtacaaaaacttaacatgtcctccatcaccaatctgtgaattaattatctgtcgattctgtatggaatacattcgaaacccacaatgcataggtcaaatgcattgggcactaattctgatcatgataatgctcaccctttacgttatcacccttagtcttaaaattataaaaatactataccgcttcaccatatttatttttctatcagtctacaattgctgtagaaaaagaaaattaaagaaaataaaaataattaaacggaaacaatttatttatttaatcatgattagccttttactcaattcgccgactattttttcatgtgatgaagtcactaacatggtagcaggaacaaacgactgcgcaattgatcaaaacggaaagattgaatgtatttacgatcaaacaacccaaatttcaatcacaccggaacataaaacgtgtctgaaactcgacaatgaaaagacgcacactacgatggaaacaattgaattatctgttgaaagtctaacaataatttgtgcagagagatctgaatattttatgcgagattatcaattactgtcgagctcacaaaagcgatgttcaggtgcaggaaagtgcactggccaaatatgtcaaactttaacaatgaagggaaaaaatcctgaaatcggtgaccatgccaataatcaaccaggatattcctattgtgtgccttcctgtggtggttggcactgcaaatgctttcttgccaccgatggatgtttattttatagaacatataccgaacccatcgatagaaacatatatgaagtggtcaaatgtccgacttggacgattttagctacaatcaaaatttcgcttgatccaaaaaccatacatactgtggaattaaaacctggtgtcttaacacatgttaaagactcaaatttatctctgacactcacctcaacttcaattccaccaacgccactatttggatccaaatttataattaatcgttcaaacgcaaaagctgtaatagttgataatgagaatttacttaagaatagcctacgatgcgaaactaaagaaaaggcaacaaaattcagttgcacctttccaccagaagcttgtcaatgtcacggaggtgactccgttgttcactgcgaatgtgagaaaaacccactcactgaaatgttcacgagaaaagaaaatattttgcctctcgagacacatggaagccaagtattcttcgacactttattaagggcaaaaataaaattaacaacttcactacaagtgcaagtcacgctaaaaggtcacaaagtcaaagcaatttacgacaaaaataattgtactgtaaaaacaaaatcgttagaaggatgttactcatgcaccaatggagcagaatttaaatttacatgtacaactaactttggtaccgcattggcaaatgtaaaatgccatagtcagaattttcaaataccctgtgacacaaaagggaaccaacagcaaattcagctttcctttaatcaaccgagtgtaaaagaaaaatgtgaagttatatgtccagatggaaaaagtgaaataacaatggaagccactctgaattatgtgagccaacaagacaaaataattaacccatctaataacaaaaaggaaacacccgtacttggaacttccctcgaacaaatttccgatatatttaatttcatatatacattaatcaaaacaaatctttttaattttttaactatactttttactttgattgtgatgataacatttataatttgtatatgtccaatgatttacccacttctttttaaacactttcctttccgtcgcgggaatgtcgcgactacgcgaaataggatttttaatttaaaaaataaaaacattaaaaacaaaaaacatttaaattaattttaaattaaacagctaaacattaattaa

SEQ ID NO: 50960 - DNA, 763 bp, Heterodera glycines
  Genomic contig location: Contig_ID=SeqID_3583; Location=7782..8544; Strand=-
  SCN-specific regions: Sequence locations=1-452,495-717,740-763
atgggcacaaaaatggggacggcacaaatggggggacggcacaaattgggacggcacggaaatggtcaaaatgttgggacggcacaaaatgggggaacagcacagaaatgggtcaaaatgtggggacggcacagaatgggggacggcacgaaatgggtcaaaatgtggggacggcacaaattggggaacggcacaattggggcggcaggaatcggggaaggatgggcatccggcaccgacacgtcggcgacacggcacggaattggtggtgcggggcggcggcacggaatgcaacgaacgggcggcgcacgggtcgggcatggcacaacgggcggcgcacggatcgggcacaagtcggcggcacggacaggcatggcactgaacggcggcgcacggatcggcatggcaagggcaagcagcgcagttgtcggctgttgtcggcacggcgagctgagaaaaggagggagggaaggggagggagggaggagacgaggcaatgcgtctcagacaccctttggttactgattagtgggaggttagggccctccttttataccggcaattcctgcttgaatgcttgtttgccaacttggcagcatttgccaattttactaacctttctcattttccagtttgtgccactttagccttttctaattttctaacattttactatttctttaatatcattcacaatttgtcccattttaacatttgtttaaaatctgttatttcttttaacgttcaaattattcataattaa

SEQ ID NO: 50961 - DNA, 422 bp, Heterodera glycines
  Genomic contig location: Contig_ID=SeqID_20426; Location=95..516; Strand=+
  SCN-specific regions: Sequence locations=1-81,113-136,158-185,207 -240,286-287,313-318,340-422
atgcctttgaattatacaagcataaagaagcaactaatagagggtaagaatgggatataccccataaacataatcaacatgattataaaaatatgtaaataaaatttataaagaaaaatcataaagcgtccataataaaaaggcatatgcttttacatatgtaataaacaaagcatagcaagaaatttcaaatatttaaggaatttgagaatcaatttctacacgtgaacagctcaattgataaaatataaaaattaaaaagataatttgtaatattttattaatccaaatcaacaaaaaataaaacaaattgcagaaaactaatgttttaaaatgagtgtagtcaggatttctttcgcaaatgaccaaaaattgatttattaagtttgggtgtcctcagcgctcattaaataaggtgtcaa

SEQ ID NO: 50962 - DNA, 1133 bp, Heterodera glycines
  Genomic contig location: Contig_ID=SeqID_20426; Location=1181..2313; Strand=-
  SCN-specific regions: Sequence locations=1-528,550-582,609-688,710 -760,782-1083,1105-1133
atgtcagattgtatctgggaaatttacaccatttttgataaaattaattccgagtctgaaaaagttgaggtaatgtggagtgaggtcgatcggtccaaagatttcgatcaggtcaccaaactagaggaaaaggtacttaagggattgagtgaaacgagaaaactacatttagaatctcgccgggttcacaccaaaatgttggagttggaaaacagaattcaatctgtagtgtgggattttattgggcttcacgaataaaagagaatttgagtaccaaaaagaataaaaattaaatcagaaaatgacaaccatcgaccaagaaatacagttcatcaaaaatgaaattgttacaaggtggaaaaaagaaagaaaaattattatggaggcagatcgtttagtgtcatattgtaataatatttctttctatgcgaaaacatatatgatcatcgcatttagtgctccaggaatacatcaactatatgaaaaaatattagagatagcgcaaaatattaggctactatatctacaaatttcaaaggaatataaaaatatttcgaaaattctgggtgagtttgagaattgtttaaaatataaaaatataaaaaaatgtcaggaaaatgagaactcttcaaaacatagcatggcaacctgttataaataccggaagcagatgagaaaatttcgtatagaaattgatgatttattcgaaaatattgtatcattagctataaattacttaaatccgccagaagaatctatcaaagacaaaaatgataataatcgtaatgaaatattttttacgccataccgtaggaaccgaattatacatggacaacaattatctgaaatttttatagtccctataggaggaactgaatcataaaaaaatatttagatttttctaaatgttttttttttttgctctggtcggtaaattcacatccgactaataatatatctgatcacttgttacatgctttcatcaattttttttttgctttcatttgaatatgggttgagtgcgcgagggagggggggggggggcaaaaaaaaggtcaagaaagtgatccctatactacttgtgtctctatttataaatattaatttcgatgtattttaagtttattaataaa

SEQ ID NO: 50963 - DNA, 867 bp, Heterodera glycines
  Genomic contig location: Contig_ID=SeqID_20428; Location=1211..2077; Strand=+
  SCN-specific regions: Sequence locations=1-178,200-207,321-721,766 -800,822-867
  Gene Ontology: Mol. function=structural constituent of cuticle; Cellular component=extracellular; Biological process=cuticle biosynthesis (sensu Nematoda)
atgaactgtgacgcccaggtgaaggcgtacaaatttgtcgcttattccgcgctgaccttctcgctggccgccgtgctgtccgtgttcatcatgatgccgttgatgtacaactttgtcagccacgtgcgacgtcagctcagccaggacatggtgttgtgtcaggtgggggacacagaaagtcaatattatttatttgattaacgtaacaaattttaaaaaataaaaagaaattatataaagcaataaaatattgaaaaagaatttagtagtatttacaaaatagaaataattaatttaatgaattataattaatttattaagggttcgtcctctgacctttggcgtgaggtcgaagtgttgaaaaatgcgccgttcattgctcacaatggcagcacttcatcgtcgttcaacactgctcgaacagctcgacaagcgtacggaggcggcgccgaagttggcgcaggcccagcgcacggagctggcgcacccgcggcgggcgctggacgcgcagcggcgcccggcttttgtaaaccatgttgcgtgcctggaccgcctggtccccaggggcgcccaggacggcacggaaagccgggcaagccgggcgcgcccggtgtgcctggcgccgccggcactggcccagcaatttgtaagcttttccatttgaattaaatacctcaaaattaatgcataaatttttggaaaattatggactaaagccctcaaaaaaaataaaaattaattcttttagtaaaaaatacttattatctcatttcttaggcgaggccactccaccgccgtgcccacgctgtccccaaggcccacccggaccacccggcgaattgggtccgcctggcgaggttggagccg

SEQ ID NO: 50964 - DNA, 678 bp, Heterodera glycines
  Genomic contig location: Contig_ID=SeqID_20430; Location=149..826; Strand=-
  SCN-specific regions: Sequence locations=1-165,194-678
ttccatggacaattgttacgtcttccactatcagcaaacaaaactcgtgaagaacttgtgcctgagtcaattcgtaggctctgtctgaaaattatactcgaaagagaggaaaataaattgccgtcggatgaggacattaacgtaatatgaattttttaatgagtcaataaatttaataatatttaatttaataggactttgtcgagtgtttagaagcctccaaagatgtgactcttcaagaaactgaaggaaaaactgtgaagacaatttctttcggcggactaatggcgagaatttcacattatatgcaaattccaacattttttttttgttttagtctgtgctgcgtaccgtcggaaaatcactcacaaatattctctcgcctgtcacttttttcactgcacattttcccgattggcatttacattccgaggattttcgcattcaaattgaaaccatcgtggagtatttatcgctcaaaattgtgtttatacgataccgtatcaaaatggcacagtacgacccgaattcgacaggatgtttgagcagggaggtgagtcaattaacaaaatgcaacgaatagtaacaatatatggaacataaatcataatttagcaactttgtgactattatctgcacgaagtgatgccacgggtcgacgttttgaaggatttggag

SEQ ID NO: 50965 - DNA, 225 bp, Heterodera glycines
  Genomic contig location: Contig_ID=SeqID_20431; Location=710..934; Strand=+
  SCN-specific regions: Sequence locations=1-225
ttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgg

SEQ ID NO: 50966 - DNA, 609 bp, Heterodera glycines
  Genomic contig location: Contig_ID=SeqID_20432; Location=1..609; Strand=+
  SCN-specific regions: Sequence locations=1-2,181-193,379-392,423 -425,604-609
  Gene Ontology: Mol. function=calcium, potassium:sodium antiporter activity; Cellular component=outer membrane; Biological process=N -linked glycosylation
aagaggaggaagaggaggacgaaagcgggcaggcgcaagacgacgaagagcagggagacactggcgaagagaccgaggcggaagaaagtggtgaggagaccgagaacgacgaggagggagaaagtcgcgaagagaaacaggaggaaaacagtggggacgacaaagaggaggaagaggaggcagaaagtcggcaggaggaagaggaggaagaaagtggggagaagaaagaggagaaagaggaggaagaaagtggggaggagaaagaggaggaagaggaggaagaaagtggggaggagaaagaggaggaagaggagggataaagtggggaagagacagaggaggaagaaagtggggaggagaaagaggaggaagaggagggagaaagtggggaagagacagaggaggaagaaagtggggaggagaaagagaaggaagaggagggagaaagtggggaagagaaagaggaggaagaaagtggggaggagaaagaggaggaagaggaggaagaaagtggggaggagaaagaggaggaagaggaggaagaaagtggggaggagaaagaggaggaagaaggtggggaggagaaagagaaggaagaggagggagaaa

SEQ ID NO: 50967 - DNA, 1112 bp, Heterodera glycines
  Genomic contig location: Contig_ID=SeqID_20433; Location=1052..2163; Strand=-
  SCN-specific regions: Sequence locations=1-281,394-630,670-763,785 -797,838-963,986-1112
tgtccgacgacttggaaaaagcattacgccaaattggccgtgacgacattgtgctgcatcgcatgtacggcttggacatcacgggcgccaccgcggcggacattgacgacgcatggcgtaccagtgcgagtcgtggcggcacgcccatcgtttctgcagcgtcactgcgtcgtgaccattccagcaagggcagtctggcggctgccactgggggacttgcgttcgccgctgcaccaaccgctgcagtcgcgctgtcgcaagcgctcagtgcaacacgtgagttttatatttttaaaattatttatttgggtatctaaaaaagtataaatgtttaaaaatcatatgaaaattattaattatttttaatcgatttttttatgttaaattttaattgaaaatcgtcgtaattcaaatttagcgccatcaagcaccgctggcatttcgccaaccccctcatcggttgcagcggaacaacagcaacagcccatgcagcaggaggagggcaacgtggaaacggttgtcacgcgcactgaacgctttgtgcaccatgcacagaatggggaggcgccaattgtggacgaacgcgtgacggaacacttctatcgggacggggaagaggtgagtgagaggaatttattattgaaatataattttttaaaaaattttaatgaattggaaaaattgagattcagcggttcattaggcgccccggcagggagtaaataattttggtatattaagtcaatttttttaagaaaattaggtaaaataaaaaataataatacccattttcttggattttttttaataatttaaaatatttttagtttttaaaaagcaaacattatgataaaattgattcattaaaggattgattgattgcctctgagaataattaatatattaattaccatgggatggcttttttgttgcgaaatgttggtaatttttctgatggaaaggtaaatttttttttaatttttatcagtttattatcataaattagaaaagggctctgacctttaggggtgagaaaaggagcaattaaagaaaaatcaacagaaaaaggaaaatatcaatgaatgacaccaaaattgaagaaaaaaaataaa

SEQ ID NO: 50968 - DNA, 902 bp, Heterodera glycines
  Genomic contig location: Contig_ID=SeqID_20434; Location=1973..2874; Strand=-
  SCN-specific regions: Sequence locations=1-408,439-482,504-902
atggccaacattagcatcaaaacgctgctgctgcaacggccgggcaatggcggtggcggcgccaatcagtgggaaattgacgccacatgcacggcactttacggcggggtaaaacaatgcctatagggttcacggcacgagagcggggaagggggtggggaagggtaccaagtatagtccccaccatccggaaaatttttaggggaagacgtgaatttttgttgagtatttggggttttcgtattggaatcatccgccccccccccccgagaggagttggtcaagactgacactcggcactcctcccttttcggagcctcatcaacggattttctataattttttattcaaaatataatttcgccattgaattttttgaatttttatagcaaaaaaataaaatggaagaataaatttaaaaaattgaaaataaattaaccggtctggatactgtatggaattacagtaccccggcaaggatttgtgtgtgttggccaaaaaattggcctatctgtcggtgctgaaccgtgccgtgtccatcccggcgcgcccggacgggtgttggccgttggggcaagaccggaacaaagcagtgcgcagatgcatcgcggagatgcggcggagatacgacgcggaaacggtcaaaatggcggatttcattttggatgagagggcgaaacggcactttatggacgaatttgcatttgaacggcaggccgaagagatgaagagggccatcgaaatagaggaagatgaatgggagggagatgaagcggacaaaatgaccaaatgggtgagcgaaagatgaagcggacaaagtgacgaaaaatgcagtcaatgtatagggggacgacttggaaatgtaactaattggcaaaatcacttttgtatagtaaaataaa

SEQ ID NO: 50969 - DNA, 841 bp, Heterodera glycines
  Genomic contig location: Contig_ID=SeqID_20434; Location=1..841; Strand=-
  SCN-specific regions: Sequence locations=1-151,173-289,331-371,393 -425,464-543,565-594,645-841
  Gene Ontology: Cellular component=membrane; Biological process =nucleotide transport
atgaaattttcttcaaaaaattctgataattccgcgggccgtgactttgatcagaaattgagcaatgccgatttgctgccagtcgagaagcagacttggaatgcttacaatattacggcactttggatgtccggtgggcattcattcattcaaaaataataaataaatttttgtttcaattttgtaattaagtgatccacagtgttgccggttatctgacagccggcactttgttttcgctcagattggccagctggcaggtaagcaaaatttaacaaattatattgccatttttttaaaattactattgaaattataaaaatttttaatcttttgcttacgctcatttcggcagttgtttttaatgtttatttcttaaaaaatttatcttagctaagaattttccacttaattgattcctttggcttttctaaaatttttattgatttgcttaattaattatgctaattaggctgtcccgtagtcccttctcaggtgtttgtcgtgttaattttgtctgttctgatcactctctttttgtgcaatctcagctcaaagccaagtcaggtgctgccaaatttccatcgctggcacatttaatttttttaaatgatgatttttttttaatttttaactttttaattgcccatcctccaaaaggtgcataaaattccttttcccgtgctttgtcgtgccattttcggcatccatggtgcccatataccatccctcgttcggatgctcatttgcgtcgcttattttggcatacaaacatttctcggctcgaaggctttcaacgtggcacttcttaaattgtggccaaatgtggcgtattaaatga

SEQ ID NO: 50970 - DNA, 162 bp, Heterodera glycines
  Genomic contig location: Contig_ID=SeqID_20435; Location=1714..1875; Strand=-
  SCN-specific regions: Sequence locations=1-13,37-162
atgcgggatttaaaaaatttgaattttcgactttttatccgaattcgggtgcaagatacgttaccagcggtaatattacctacgactcttttatttgcattttttcaagattatatacaatacaattgtgaaaatttccaggcagttttcgtgggtcgctga

SEQ ID NO: 50971 - DNA, 1213 bp, Heterodera glycines
  Genomic contig location: Contig_ID=SeqID_3585; Location=1159..2371; Strand=-
  SCN-specific regions: Sequence locations=1-110,132-191,236-681,703 -713,735-1213
atgaagagacgcgctgctactcttactgatgctactgctgagcaacatcccgagcccaaaccacaggaagagaccctcaaaaatgtcgagccgaaggatgagtcggtaaccaagaaacgcaaagtggaggaccgagagttgtggaagttggcaaagggcaaatttttgctgacgacctatttgtgtccgggtaataaacaataaaaaattattacatttttaattaattaattttgagatgattggaatcgactgttcaacaatcagcagaaggtgaaacgtgtggagggcgatcgtgtttgcttcagctttgatctgtgtgaggagtgcgcattggccaattgccgcgcaacggacctgctggctccgatgaaaaaaagacccaaaaatgacttttgaatttccttttgatttgcatttttgtccctaattcatttgaattgttcatatttgggattatgcaataataatgaattttttcggcagtggccgcatttgaatctgtcacagtgttaattaatggtcaataggcatgcgaaccgagcgcaggggggggggaggggggaggggatggcatttcctttattccccatcgatcccattgaatttccaacaaaaatggcaccaaaccaacgcaagggacaaaacccgtcactgttcggcaccgcaagtggccaacaataatttaaatcattttttaaaaaatggggtttcaaggatgccatgagtgtcacggggaccggtgcatgccatgtgccaaattgcgaaagcggaaccaagaacgagcaaggatggggctgtgtcatgggcgcatgatgcttgaatttgggccaatgagcagagaacagcagctcaatgcaacggcagcgcgcaacccaatggaagccgcacttcaagccggcagcgaaacgaaggccgtgtttcgttggggggacccgttggcacctgtccatttccccgacactttgttgtacccgaatataggggggatgtgtttgtgtattgtaggggtggcgcaattctttggggcctgtggacacgtaggactatgtcgacaatgtttacttatgcatttaaaaatttcacccaaccctgaaaaatgtccctactgtagagtgagcaccacattttacatgctgcactaaaagcaattttcatttgctgtgtacgtgtggtgctgctcactctacagtatcccccctcccacaataaa

SEQ ID NO: 50972 - DNA, 561 bp, Heterodera glycines
  Genomic contig location: Contig_ID=SeqID_3586; Location=1426..1986; Strand=+
  SCN-specific regions: Sequence locations=1-285,314-561
atgcccaaccgaaacaacatcaacggccagcagcaccatcatctgtcctccgcctccaccaacgacaactcacagcattttactgctgttcatcactgttttgattttgttcgtgtttttcgcgcaggtccccccccccctcccgtctaatcattaattcttttttttaatcctttccaaagttacaggctttcaaaatggcaattgttgcacggcgtctgctcaaaaaccgagccattcaaaaacagttggagcgccgccaaaaaagtcagttgaattttgggcaaaaataaataaataaatttttttttttgaagacatgaaaacgcttcgtcgtcagcaggcggcagcagctggtcagtcgtccattgttgtgcgctcggtgagcaccggtttgccaaggaaccaaccgattcatcaggtaaaaagttttttgcacattaccgaaaaacgccaaaatttcagcgccagcaagtctgcaccgtgccctcccatgaggtcatctacgacgtcccatgcaccggagaggaccagcaagaaggatcggaggacagcttttga

SEQ ID NO: 50973 - DNA, 347 bp, Heterodera glycines
  Genomic contig location: Contig_ID=SeqID_3586; Location=2830..3176; Strand=+
  SCN-specific regions: Sequence locations=1-347
atgcccgatgaacgtgttctacacctcgagtgttttgaaagcggcgattatgatgttagtaactgtgatgaattctatatttaaatattttttcctcaattttaatccatttcagattatggaactgtacgggccggaccgtgctaaagagatgctggtcgacctgcgcgactatgccgaggcgcacggaatgccatgtcaacatgtgaagatgctgctctacaaactggacaaggggctgatcaaatggaaggggacaaagccctgagaatgaatgaatgatgtgtgatgatcattgtgttggggagcgggaaaaattggtgatggtgtttattttaaaaatggaa

SEQ ID NO: 50974 - DNA, 1107 bp, Heterodera glycines
  Genomic contig location: Contig_ID=SeqID_20437; Location=118..1224; Strand=-
  SCN-specific regions: Sequence locations=1-163,186-1107
atggcgccagaggaaatcccgctcgccgaggagaccaaactcgccaagggcgtacgaactgaccggcaattgctacagagaagcatcgaccgcgtcaatggcatgctacgagaatgttttgaccatattcagctgctaggcgacccgtttctgaagcaggcggaggaggacctcctggccgcactcccgaccttcgacgatgagcaagccgacccaaatgtcgaagaatggccagtcatcactcttctctctaaagcccagctcatcctcgacggcctccaagtctacatcgaggctcgattcgacacgacggacgccatctcttctcgcagcagcagtcgtgtttctgatcacggggctgacgacgaaaaccggatccaccgccaacggcaatccaccgacccaccgactcaggcacagccagtgaatgcacatcagccgtccaattcggctagagccgatcaaaccctattcaaccagcgaaccccggcattcccgcttaacctcacatttccccgagcatcgaatcgccccacccatcgatcggaacctcaccatggtcacttccgacagtcgaccaatgacgacgacgcactccgggtcagccgaatcgaaatcccgaggttcagcggatcggcagaagaatgggtcacattttgggccgccttcgactttgccgtccactcgcgccaataccccgccttccaaaagcacctcctcctcctacagtacctcgagaagggatcgccaccccgacggatgattgaaggttacccaccgtcagacgccaattacagcacagtcgtgagcattctacgagaccgctacggcgacgtcggcaaccgacgggaccaactcaatgcccagcttctccacctcaaacctgcccggaacaacctcaaggagttgcgccaactccagcaagagatcgagcggatctgcacccaactttgcagcctcgagcccgagggggagctctcgccaatcgccaacagctcgctggtcaccaatctcatcaaaagcaaacttccaccaccggtactgcttgaactgatccgaatggagcgtgagagctacacttcctggacggctcagaaattggcgtga

SEQ ID NO: 50975 - DNA, 79 bp, Heterodera glycines
  Genomic contig location: Contig_ID=SeqID_20437; Location=2084..2162; Strand=+
  SCN-specific regions: Sequence locations=1-79
atggaagggaaggaggagattcgagactcgctcaaaagagcggcgacgcagattggcgatggagaaggcgagagaaagg

SEQ ID NO: 50976 - DNA, 1572 bp, Heterodera glycines
  Genomic contig location: Contig_ID=SeqID_20438; Location=101..1672; Strand=-
  SCN-specific regions: Sequence locations=1-452,479-580,602-1572
atggacgagcaggagatacacaaccaattgcttaatgtgaatgaacaattgagggagctgaatgcagaagacgagcgccgtctattggatgaaagtaatcgaaatcggggtgcaaatagggacgaaaatttgttaaacccgggtcttattcaacaaaatcaaatagccggaaatgtgacaccacgcgaaaatgataattttcttacgtcaactccaaatatcagtccaattcaccacgcgcaacgacagttgaattttgagggtaatcgtagaaattgggaaagaccccgagacgcacgcggtcgctttatacgcttagaagataataaccaccaagaagcagaaaatgcgcgaaattttaatgcgaacgcccaaaatctccggcaaaaccacccaattttggtgaataacccgaaccaatttgcaaatttccaggttggtggcattccaatccaacaaaatgcaaacaatcagcaacagtttgggataaatggaatgcttccaccgccatttttctggcctcaatttccaatgcaaaatttgcaacagccaatgcaattttacggcgctcaaaatttgggtccacagctaccagctcaaaatttttcaacgttttttaacaaccaaatgcctgtaatgtttccaccccaaaatgtgcagtacccaaacactgcaataaacccagcgcgtcaaatggtgaatcagcaagcagtaaatcagcgagaagaaggacaaaatagacagcaacaaatttttccacaacagacaagtctaagtggcctcgaatatgcaatgattttagaccggcttccggatataaggggaaatgagggcggcgattcgatccgtaatttctttaagaagtactcacagtacacagccgattggcccaacaaaaagcgaatcgaatcgctagaggcaaaactaagcggtcgtgccgaaagagcttataatgccgctttggccaatgaaccatttgtctacgaaaatgttaaaagaaacattttgcaacaattagaggacactgattgcagagaaatgagcgcgtttaatgacttgatgaatggggtcacacgaaagcatggcgaaaacttagacgatttggccgacagaatttcgagcctagtgcgtcgtgcttatccagggctaacacgaaacctggccgatgagtattccataaaacaccttatccgaagtttgaacaatccagatctagcattgaatttggagctccatcgccgtaacgtaatgtcttttgatgaatttgtagctttagcttctcgtgcagaagcaacacaaatggctgcaaaaaggcaaagttcggaacaccgaccaaaccaggaacgaaaatatatgcacccgaacaaccgtgaagttgaaacaagttccaaaaatcagttaagaccctatcaagttgtttgttacacttgtaacgaacctggtcatgtttcacggaattgcaataagacaatgtcccgccaaaaccgaacgaattcccatcgtcttttcctcagcagaatcaacagcaaaccccaaatactgttgccactggggcaaaccgagttttcctaa

SEQ ID NO: 50977 - DNA, 1262 bp, Heterodera glycines
  misc_feature (3)..(3): n is a, c, g, or t
  Genomic contig location: Contig_ID=SeqID_20439; Location=75..1336; Strand=-
  SCN-specific regions: Sequence locations=1-51,73-253,276-1056,1095 -1262
atnctgaaaggagctaaacatgctgaccacactaaacacgttgatgatgatgaggaggaggaggaggaggagtagagctctagcatttttatgtgctaaaaacttgaattttactcaagtttattcataaaaaaattctgaaatttggcagagtgttaggtaggactcatgccaaagtattttcggctcatttgcactttatgaatcgaatcgacttttatgagtccaaagcagggacgggcgaaacttcgaaaacttcgggttttttgggcttcgaacttcgtgcttcgaaaaaaaattgtgcttcggcttcgagtgctaattgtaagacgagcttcgcccatccctggtccaatattttatgagtccaatcaattgacaatcccgggtttttatacaataactttgttcattcatgttcgaacaaaccctatctttttggtatcattcgaatgcaaaaagtctaaagaagcgaaaatatataaaattctcagcgtttaggcaattgccaaaaaagatttgattaattaattaattgctgattattttcgttcgtaagtttttttttttaatgttagaattctctggttttttctcgtattattacattattcagactttgtgctttcgaatgataccaaaaatattttgggtttgttcgatcatgaacaaagttattgtatgaaaaccaggtattatcaattgattagactcataaaatatctttggactcataaaagtcgattagacctagagccggtattttcatgcaaaagttcaaactcttctgaaaacaatgagctaagttaaaaaataccgcttgacgatttgtgcaagtttttagtaactaaaattcctagctcttatgatgagtgatcactgatcagtgcacagatcataaccaaatcatatgttgttgactattttttgagcatttgcactgatgatgatgatgatgatttttgatgattttttatttgataaaaaattgttattaacaacaatttgcttattaatgaatcaatgttgcaagattttttgccattaaacaaattgaatttttttttaaatatttttaaatttattttaaatttgtagcttttttcatttgaaggtgttggtagaatcaatttatgctcaaatattttaagattgcttttctcctggtccgctaaatttttattaatgacacttaaaataatatgcgattgctttacttaatttgacaaaaaaaaaacttataaattcgtatttagaataaa

SEQ ID NO: 50978 - DNA, 54 bp, Heterodera glycines
  Genomic contig location: Contig_ID=SeqID_20440; Location=416..469; Strand=-
  SCN-specific regions: Sequence locations=1-54
atggcaacatccggttttggagactaccatccggacacagacagttggatggag

SEQ ID NO: 50979 - DNA, 346 bp, Heterodera glycines
  Genomic contig location: Contig_ID=SeqID_20440; Location=835..1180; Strand=-
  SCN-specific regions: Sequence locations=1-111
atgttattttctgcttttgccaacttgggccgtacattgactgaatattgttgtgttttatggccaaagttattgaaatggttgcgcaaaattttgaaaaaggaagaggtgaaataatcataaaattaattttagaataaatttataaattattattttttgattattcaattctaacgaaatttaataattaattatatataactaatttttgtagaatattttattctccaacaaatacccaaagtaattcttaaagagatttaacaattttaaaaattgtttttttaaattaacataatcataaaaagatttaataattatataatttttaaaattaaataaa

SEQ ID NO: 50980 - DNA, 388 bp, Heterodera glycines
  Genomic contig location: Contig_ID=SeqID_20440; Location=1514..1901; Strand=-
  SCN-specific regions: Sequence locations=1-61,109-265,364-388
atggaccaaaaagcagaaagttttgttcacatgaaagaaattgaggacaccacgatttgggtattattatataaaaattaaaaataaaaatattcaattttatttaaagtttttgatcaatcttttggcacatattgctctgattgcctctgtgatctgttggcttctgactggatcgcttgtttttcgccttattgactccgaaattggtgcaaaatcgtttccccgttctgttatttggtgttttcagctcttaacaaccatgtaaaatttaaaattaaatgtttaaaaaaatataaatttattttttttattaaactttatttaattaattttttttcatgtaaagaattaaaatataatcattaatctgtttaattgaaataaa

SEQ ID NO: 50981 - DNA, 1487 bp, Heterodera glycines
  Genomic contig location: Contig_ID=SeqID_20444; Location=761..2247; Strand=-
  SCN-specific regions: Sequence locations=1-9,41-151,200-234,256 -260,418-443,482-864,1170-1259,1282-1487
ttttccaaaattgtgccaacaaatttatttaatgctaattaagttcgtcttttttgcgttggaatcattgggcactttggcaattgttggcaactgttgccttgttgttgtgctgatgaggaacagataccttcagagggcgaggtggaacatttaaaaaaatatatatataaaaaataatttagtatattttatttttgaaaattgaaattcatttcatttcacatttaaattgctactaaataaatgaaaaaacaaaattatttttcaatttttctatattttaaatatattttttctgttaaatttaattatattattttaattttattaaatatttttaggtttagttatttattaaattttttttaaattttaatataaattttcatctcattctttgcttttaaattttatgatttaatatgttttgaattattctcaaattttcatatatttttttaacatttaaaattttaatgcaaaacaaatttgtaaaaaaacgatttttttttttacttaaaaatttcctaatctaattactttgaattaaatgtttttaaatcatttttccccaattattttttttttgttgttgattcagttttgttctgatgcttagcctggcgttggctgacattttgcatggcattgtcaccaccacatttttctatcctccaattttgctccgtcgtgttgtcatcccagcgattggtgtccgaatttttaatgtaatcgattggacggcatggtaataattaggcactaattagacaaattatttctttttttaattgttttttaggagcatcactctaacacatgtgagcatatatataataattgcataatgtttttttgaacaaaatttttttttatattaataaaaataaatacacatattaaatattgacaatacttaaaaaataatttaattaaaaaagtttttttctctaataaaaataatttcttttttttaatttaaaattcttattcaaatatttgttttaataaaattgtatataattaatcattattaaaattatatctaattctgttattttctgatacaaaattgcgattttatttattttttaaatgtattttttttaaagttggataaaatatttttttataattttatatttaaattaaattttataaattttgttgaaattcaaaacagatgtccgccatttgtttggatcgtcttcttgccataacgtgaggatttgcaattaactgaatgatgcttaacctaataataaatttgctttgtaaatttgttaccaaattattcttattttgtcaggttgtacggtcagtacagtcaattgattacggtacgacgcgcaaaactattcaccatattttgttgggccacattttcgacattgaataccgtatatatattggcccgtttctgttgcctgatcagtccgctggccgagtcccatttttacacctttggctacggcgaatttgag

SEQ ID NO: 50982 - DNA, 1709 bp, Heterodera glycines
  Genomic contig location: Contig_ID=SeqID_20446; Location=291..1999; Strand=-
  SCN-specific regions: Sequence locations=1-894,920-1142,1165 -1254,1296-1709
atgacactaggcattagtatcaacaaaaatttggtctcaaattcgaccaatccgccgacctacggtgatttattgcagtcagcagaattcgctaatggcactgttggtactgctgacccaaaccatgatgacgcagttttgttcatttacaaacaggtaggaggagcatcggtcgttaaattcgcctattaacaaattaccctaaatgacttaaaaccctaaattaaatcaatttaacttataagtaatgctacatgtattattgctaccgtatatcaaattccattcaaaaagattgtggacaaatacagttggcaatggcttgaacagttcgcgcaacgaaaccagctgatcacttgcggcggtgtgcagttgcaacaggcgctcgagaacggcactctgaaggcgatcattggcggctttggctcatacccaaacaacgcgggggcggccaccgaatatgtcatccccgcggacaacgacccgttcaccgcgtacgccatttacggcgcaattctgaaggacgcaaagcacccggaggccgccaagctgttcatgagttggcaattggacatcgatggtccggtgggtagaaacgaatctgcctttgcaccagggatgcttactacccccgaaccccgtataattttcttgtctcgaatctcgaccaaaaaattgtggccatcacggtttgaatcccatcagtttttgtccctcccaaatttttctcatcccgagtcccgactcgtaagtttttagtcgttccgacccgaattccgactttttctcgttcctgcacatccctgctttgctcgggctggcattggccataccccgccttagccgggaaattatcattttccgaattaatccgttaatgaatgatcggacagtaaaaattttggcaaaaaaccacgttgtttaaatgtccatgctttttttgtccattaatatcataattttttttattttcacatttgtttttgcagaacgctgtccagacttggccagtgcggacggatgtgacgccgaaggacaaccggcgccaaatttgggagtacccaaacacgagccatcagaaatttttagaatttatgtccaatgttgaagagcgtcagcgctttggccgacaagtggccctgttcttggatgacaccaaatgcaacttcgcttcatttgtgcccggtgtccggcctcttcagtgagcaaacaaatcgggcggagaatggcgcggacagaaaaatggggaaaaaccaattggggaaatatattttcaattttttaaatacctatcttaattgaaattgtgcagaaaattgaattttcgattcattgttatatgtaatggttaaaatagcattcatttttggcagaatgtgctttttttctgcgggtattagtgtcttgatcaatgccggtgccgaaagagtagcgagtattagtgattagtgacgctacggaatccgacttccggtttcggatatttttagggtcggaattccgatttccccgaacaattcccatttcggaaatttttgataaaaaaagtcagaaaattttaaaacctttaaaaaaaattttttaccatttcaaaatcagggacatcaactgaaaattttcaaaatcagtattggcctaaaaaataatcattaggggtcaaaagccagcatttagaaaaattttatttcaaatgaaaaaaaaccaataaa

SEQ ID NO: 50983 - DNA, 3263 bp, Heterodera glycines
  Genomic contig location: Contig_ID=SeqID_3587; Location=338..3600; Strand=+
  SCN-specific regions: Sequence locations=1-87,110-705,729-1630,1654 -1861,1891-2059,2083-2120,2142-2426,2448-2758,2780-3138,3160 -3238,3260-3263
atgtctcgcttttgccccctcgcccaaatcaaggaatcgggtcggcttaacacaccaaagggaaaatttagtgagttccaaacctatcaaattaaaaaagaattttgatattcgttttaggtcttttttatgctttggaaattgctcgaagctaccagctcatagggaaaagtataacggaaaacaaattccgttatctgatgaagacggagaagaaacaaagggaaatggccatggaattgatggaaaatgcagggataagaaactttggtacccaacaccttgaggctgtacaaaaatactgggacagggaattcccggatatgtttcgcattgtggcttttgaaatggtaacaaaattcgcttgaaaaatataaagttacatatttttagaagaccgggcttaggccaattttcaagggagagggtgttcgtaaaaatgaagtgggtgtgataagagaaggagaccattgggatgggatcaaatcggcttcttggttttttggtgttcgatacttctgtgtcagctgtgaagtgacgtacgatcgacctgaaagacacagaatggagtgtaaggaacgctgcaagaaatgttgccggatgggattcgggttcccatgtgcggatgacagcccggaaattaactgtgacgagtgccatcgagacttctataacatccaatgctttgaagaacacaagaaattggcttgcaaagagtataaaaaatgtgaaaactgtggggagacacacaacactcggaacaaacacacgtgtggggaaaaattttgcaaactctgcaaagtttgccacccagggcggcaatgtttcatcaaaaaaattcaagtgcgaccgcagaaaacctacagaattgtggcatacgatctggagacgacagtagatgggggagaacaccggcctaatcttgttagtgctgcacgtacttgtaacatttgtgcgggagaagagcgtgaatgtgagatttgcgaaggccccagtaaaatcacatggtcagtagcggatggttttgagccaatgagcgagtttatcgtttggataatgggttttcaacgatttgaaacgattgctttcgcgcattatgctgggaggttcgattcacactttgtcttgtccgagctaacgaagaaggaaattgcgacggagttgatgatggctgatttgaaaatttatcaaataaaggcgggaagagtgtactttcgggatttttggatgcttagtcagaataaattggcggaccttccaaaaaccttggggttaaaaactgcagctaaattgtattttccacacaaatacaataagaatgagaattttgggaagagattacccaacctgccttctttgggagactactgcccggacaatatgaaggaggaagaagccgtaaaattggaagcatggcacaatgagaattttcaaacggaatttgaactaggtagggaaaatagcatttttttctttgaaaataaaatttaaggggaacaactcaagacgtattgcgaaaacgatgttgaaattttgatggaatcaattttgaagtttcggcagttatttttggggataacaggagatttggatgtgatgaaggacagcgtgacaatcgctggtgttgtgatgaagatattcagggcaaaatttttgaaggacaggcatattccgatcatgcctgagggggggtacgagaaagctgagaatcagagcaaaatcgcagtgaaatatttcgaatggttggcccaaaaaaagggagtaaaagtgcggcatgcgtgtaacggaggagaagtggaatttggggggctgaaggtggactgtgtgattggggcagagaaaaaaataattgagtttcaggtaaaagaaaaaatattttctttttaagcaatacttaaggggtgtgcatttcacgggtgtccaagatgttttttgccttggacgatagcgccaaatggaaggacgatggaagagaatcaaagtagaaccgaaatacgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccagacaagggaccaatcaatccgagggatgcttatgccggggggagaacgatgcccttttgtttgtacgcaaaggctacggaagaagttgagatatcaatgtttgacatcattagtttgtatccctttgtcaattatggtaaaaatctacttacttttttataattttttccgcgcttaaggcactccataccccgttggggtcccaaaaattgtagtgagcagggattttaatgtgaattggacaacacccgacgacgtaccctatgatggacttttgaaagtgaaggtcgtccccccgaaaaatctgttatatcccctcctccccgtgcacatcgatgaaatgctcctcttccctaattgttggtcttgtgcgagaagggccaagaatgaatttgtgatgacaaaagatgtgaaaaaatgtaaccatcgtcccccgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtataaggcaaaatatgacatcaatttggcgtacgataaaattggactcaatcccggactaagaatgattgcaaaattggtgagaaattataaaaaatctctaaaaattgttcgaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaa

SEQ ID NO: 50984 - DNA, 612 bp, Heterodera glycines
  Genomic contig location: Contig_ID=SeqID_3587; Location=4711..5322; Strand=+
  SCN-specific regions: Sequence locations=1-41,64-503,536-612
atgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcaccgcaccccactcttctgtttctgcatgattgagagaaatttaagatttttttacgacacaggaaccgggacgcctataggaagggttacaactgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctgggcagagaactacttttgaaccctgttgaagttttaattgatatgttctaccaacgtatagataggttggaacatagaaaaaacaatttaaaaatatattttagagatttggtcggatcgtggtcattgttctatagactcccaccctcactttttgacacttcccgccgggtggttgcggaga

SEQ ID NO: 50985 - DNA, 688 bp, Heterodera glycines
  Genomic contig location: Contig_ID=SeqID_3587; Location=5472..6159; Strand=+
  SCN-specific regions: Sequence locations=1-184,206-296,318-466,501 -539,561-688
atgcaaacaatcgctgaaattaaaaatttcgagattgttgatggtggaagaatttttgttgtgagagcgagaattgagaatgtgatggaggcggagtacagggtttgtaataaaaatgaaaaaaatatatcagtttgtttaggcatgcactttatgccgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacatttaaatttaggatgaggtcaaaagtttggcgggcgccgtgtgcaccatgaaaatcggcgcgagggtgaaagaattcggagggaagagggggatctattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaa

SEQ ID NO: 50986 - DNA, 873 bp, Heterodera glycines
  Genomic contig location: Contig_ID=SeqID_20455; Location=188..1060; Strand=+
  SCN-specific regions: Sequence locations=1-27,207-219,400-414,453 -475,505-514,536-873
  Gene Ontology: Mol. function=protein binding; Cellular component =axoneme; Biological process=N-linked glycosylation
agagagggaaaggatgaaaatagcattggggaaggaggagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggagaagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggagggggagaaagaggaggaaaaggatgaaaatagcattggggaaggagaagagacggaagagaaagagaggaaaaggatgaaaatagcattggggaaggaggagaaagagagagagagagagagaaaaaggaaaaattcgaagcaagatttttgccatttttatacgtccgaattatttaccaatttagacattattcatcaaaaaaggcatttgatcactgatgattatgactagggatcggattcttagttttttaactattttttctgcggctttaactcgacgaaaaatgcacgaaaaacacatttctttttcgaaaatttttcatttttagtgccactattcatcactaggaatcactattttggagcttcgccactaaaaaaaaactatttcggaagttagccactaaaataattttttgccactattttggcgtttcgtcattatttttgccactattttggcattttttggaaaatttcccaaaaaatgca

SEQ ID NO: 50987 - DNA, 58 bp, Heterodera glycines
  Genomic contig location: Contig_ID=SeqID_20455; Location=1091..1148; Strand=-
  SCN-specific regions: Sequence locations=1-58
ggattgctggggtcgtgggttcgagtcccaccgggcgagttaccttttatgttctaca

SEQ ID NO: 50988 - DNA, 180 bp, Heterodera glycines
  Genomic contig location: Contig_ID=SeqID_20456; Location=146..325; Strand=-
  SCN-specific regions: Sequence locations=1-180
gtcctttgtgaaaagtgctcttggcttttgcgtgggaatttgtgctgctcgcattttgagtgaggaattgagttcagtataaatcatttgttcgcgcacattgttgatgtgtttctttgattgcatcgttaacaattgtgcctaatggctgttgatcacatcaaatttgaataaatacga

SEQ ID NO: 50989 - DNA, 844 bp, Heterodera glycines
  Genomic contig location: Contig_ID=SeqID_20457; Location=233..1076; Strand=+
  SCN-specific regions: Sequence locations=1-155,179-483,505-844
  Gene Ontology: Mol. function=uridine kinase activity; Biological process=pyrimidine base metabolism
atgggagatggtcaaatactgacagtaatttctgcacctccagacgcttccaaactaaatttcaatagcctccgaagttccgagtctaccagttcagacgaggtgcttgtaaatgagttgactaaaggtgaaaatcacttaaaaatttaattaaagttaataaaactatagatttattgccagctttgcgtcgcacgaggactcgcacaatttccagttctaaaggggaagaggacattgtgacaacagagagtggacaagtgagttcttaacattacatcataccaaaggttttgtattgttcaaaattgagtttagaaagtgtacacaaagggaaggcccccatggtacgatctggcggggaagcagctcaaaaaatcgtatttgattggcatatgtggtggctcagcatcggggaaaaccaccgtggcaaaaaagattattgagaggctcgaaatgccttgggttttgcctttttttaatcttattcattttttaaatattgcaggtcactgttcttgcgatggactctttttataaagtacccgaaattctttttttaacaaccaatgatttaaaattttaggttttgaatgaagaacaacatcaactggctgcgaaacaggaatacaatttcgaccatcctgacgcatttgactttgaattgcttcgagagtcgttggtccgacttcgagaaggcaaatcggtggaagtccccgtctacgacttttcgacccatcgacgcgccaaaaacccgaaactgatgtatggagcggacataatcattttcgaaggaattctgtcgtttcataaatcggaaatttccgacctaatggacttaaag

SEQ ID NO: 50990 - DNA, 671 bp, Heterodera glycines
  Genomic contig location: Contig_ID=SeqID_20458; Location=995..1665; Strand=+
  SCN-specific regions: Sequence locations=1-88,110-138,160-252,295 -492,537-671
acgccgttccgactttcagcaaaacagcaaaagaagcgcagaacaaacgaaggggggtaagaacaaacattggcaaaaagagaaaataaaccaattagaagactaattacataattatttcaaaaaaattaattccgataatattttatttattgcattctgttgagatcggcataacaataacattggcaccccatcgaatggaagtggcgatttgccaatgaattcggcggcggaaagggcccggcagcgtaaaataattcattcatattaataaacttatttaatttatttgttcgcttttaaggcagacggtgcagcagcgcggcgttagtcgcagcgcgaaacggcgcaattcaaaggccaaaacgaatgactccgcgccaatgccatttggtgggcatttggaaatgaagctttacttttaaatttgaggtaatcaaatcgtggagcaaaaagtcaccaaagaatcgaatggccaaagacatttttgaaggtaaaaagaaaaacaaattaataaattctattgaatttaagcgatttttgtggaagccgaagagttaaaagcaaccttcggaattgagaagggatcgaatggcaaaaggctgagaatggagccaaattttgtggcacatacgaatatgtactgtaaaagaatggaaagtgattaa

SEQ ID NO: 50991 - DNA, 414 bp, Heterodera glycines
  Genomic contig location: Contig_ID=SeqID_20459; Location=777..1190; Strand=+
  SCN-specific regions: Sequence locations=1-186,212-414
atgtcgctttataaggaggatgtgtacgagacggaagacccgccaaatgcggagccaatcgaaacggtggagaaatttgagagcgaagaagtggagaaagtgcacatgagcatgggggctgcgaagaagcggttcgaccactgtttgttggactcggaaggggcaggtaaaaagggagggagctaattggttttgattgttttgtttttgcaaattggcttttatcctcattaattacttaattttccccgttcagatttctccgattcggtcggagtgagacgccttaagcggggattcaaagccagcgaagtctttgaatcggaaacaattggcagcgaggaggaggaaacactcgaacagaaatttaatcgcctcaaccgggaaatcagaaatttggcagccagaagttga

SEQ ID NO: 50992 - DNA, 132 bp, Heterodera glycines
  Genomic contig location: Contig_ID=SeqID_20460; Location=208..339; Strand=+
  SCN-specific regions: Sequence locations=1-132
agccagaacgaatctcctagcgtcaaaaaggaagacgtcgtggccctggacgagttgctaaaaacgatcgcttcgaactgtaagaaggaaggacgccaaccgattagtcatggacggtcagaggaaagctga

SEQ ID NO: 50993 - DNA, 718 bp, Heterodera glycines
  Genomic contig location: Contig_ID=SeqID_20461; Location=79..796; Strand=-
  SCN-specific regions: Sequence locations=1-104,213-286,308-619,641-718
atggagcatctctatcataccagaatggaactgccgattgcacacatttacgggtttacaggtgagtaaactgaaaagctttcacaaaataattggattgtatgaaattaataatttttttttctttaaatttcttatggaattttaaattttggcattttttaaatatatttaaactaatttaaaaaataatttaaaataaatgttaatatggtataattttatggtggtgtctaagctttagtgtcatcaaaacggcaccgccgtaatgagccgggcccctattaaaaaacattttttgaaatttcactatttaaggagaattgctcactggaatggatgttgatggatcggaattaaacagtgaatatttggtcactcgttggcccattgtccgcgcattggttggccaattgaaagccgagttcaacacattagtggtggagatggcactatgggacatggagcagggcatcaaacaatttgttgttgcaaatgcccaaacggatcaagcaaaaatattgaaacagatgatgctgtgggattggatgatggaatacaaacagtttattgttgaaatggatgaaaatgatcaaacaaaaattgtggatgagatgaaagagaaattcaacaaatttgttgattatgatgatccaaaaaagggtggaggaacaattcaagaaaaaatattggaatattttcatacaaagcttcaaca

SEQ ID NO: 50994 - DNA, 207 bp, Heterodera glycines
  Genomic contig location: Contig_ID=SeqID_20461; Location=1756..1962; Strand=-
  SCN-specific regions: Sequence locations=1-59,82-135,157-184,206-207
atgggcaccgcccacacttttgggcatctgctgattgtctggcccaaaaaggtaaaaacaaatttttaaaaatataaatatgtaatttcagaggcccaataattccaattcattttaatatttaaggaaaaaaacaaattctcaaactattgtaaaagccaaataaccggtaaaattttttgtcaatatttaagaatttgtattaaa

SEQ ID NO: 50995 - DNA, 1482 bp, Heterodera glycines
  misc_feature (1467)..(1467): n is a, c, g, or t
  Genomic contig location: Contig_ID=SeqID_3589; Location=10..1491; Strand=-
  SCN-specific regions: Sequence locations=1-453,476-605,629-659,848 -1068,1103-1229,1253-1482
  Gene Ontology: Mol. function=structural constituent of cytoskeleton; Cellular component=cytoskeleton; Biological process=regulation of striated muscle contraction
taccaaaattgacaactcgcacgagaacaacaccaagttgcgcacattgggcgccgaacggatggacagcggaacatacaaactgatcgccaccaacgagcatggacaagacgaagctgaagtgttggtggtcgtgctggacgtgccctctccgccaaacggaccgttggaggcacgtgacgtgaccaaggacagtgccaccgtcaaatggtacatgccagacgatgacggcggctcgcccatcacgcattatgccgtggaacgccaggagggcgacggtggccgttgggtgccgtgcggcgagacgccggacacgcagctgcgcgtcaaccgtctcgtggagggcaaggagtacaagttccgtgtgaaggcagtcaaccgacagggcgagtccaagccgttggccatggaccgcggtgtggtggcaaagaacccgtgggaagcgccgggcaagccgcaggatgtgaaggtggtcgactgggacaaggaccacatggatgtgagtttttggcatacggtattccggcaactactgtatttttgttgaaaacgtcttcgaaaatttcaataaaaaccatttatatgatttattggaaatgttttgagaaattttttaaaattcccaaggtttttcaaaaaaatagaattttttgtgagagttattaattttgaattttgaagattaaaaataaaaaaaattgttcaaaagttaaacaattgaatttttaattttttttttttaaatgaaaataattttttttttggaaattttcatttaaaaaaaattttaaattaaaaatttaacaaattttttaaaatatatttttcggaatttttatttaaaaaagcaaaattttcagttggaatggaagcctccgatcagcaatggtggtgcacccattgacggctatgtgattgagaagaagacaaaaactggcttatggacgccttgtgcccacgtgacgggcaatcagtgcaagggaacggcgtctgggctggtgccgggtgaagaatatcaggtagaaaagcaaaaaaaaataacatggatttgcgtttttttgtccatgcttttttaaatttgttcaattaatttaaatttataggctaaagtgaacaaactcacttttcacggctatcgaatgatatcaagaattattaatttgaatatttagagtaatgttatactcaaattctttattttgattgttttttaattatagcatcgacaatttttgatttaaaaaataaatttgcctaaaattgccaaacgtggattcaaaatggaaattttgaatttgtaattaaatttcaatttcagttccgtgtcaaagcgataaacaaggcgggcgagggcgaaccgtccgacccgacagagcccaaaacggcgaagccacgagcactggcgcccaagctgaacctgaactcgctgatggacatccgtgtccgggctgggcaaccgatcacatncacgcggagttttga

SEQ ID NO: 50996 - DNA, 1849 bp, Heterodera glycines
  Genomic contig location: Contig_ID=SeqID_3590; Location=1..1849; Strand=-
  SCN-specific regions: Sequence locations=1-152,175-484,506-773,813 -1143,1173-1214,1236-1757,1786-1849
  Gene Ontology: Mol. function=structural constituent of muscle; Cellular component=cytoskeleton; Biological process=regulation of striated muscle contraction
ttgttgtgaaacgggcattgcgcaccgacaccggcacgcacttcatcacggcacgcaacgacagcggcactgacacggcacaagtgctggtcaccgtgttggataggcaagtgtcgtactgtatagtacaaccagcaagaaaaaaatgtgtctaattgtaaatagaattattaaatccacagaaaatttatcattatatgtgtcaatactgttataccgtttttgtttccattacagtatattttgtttaaaaaattaccgtatactttttactttcttaccacactctatattcgagactggacggggacataatccggtccatatttttcgggatcccggtccggaattcgagtatattaaaaatgattcacaagggtcaggatctcgaaaacccgggttttaatcccgaaatctggtcctgaggcagttctcaaatcccgatttttttaaaatttccgtctcaactttttttttacatttttaggcctggtgaaccgcgcggaccgctgaacatctccgatgtgaacaagaacggatgcacattggtcaacatcaatgccttccttcattttgtcatttaattgctaatttcaaaaaataggattggaaaccgccagaggacgacggtggtgcaccggtgtcccattacgtggtggagaagcaggacttggccaccggacgatgggtgccggctggcgaaagcacagagccgcgcattgcgctggacgacctgcagccgggccacgagtacaaattccgtgtcaaagcggtaaaaatttcatttttttttataaatttttaatttttttgctccaggttaatcgttacggcgagtcggacccattggaggctccaaaatctatggtggccaaggacccattcgaaaaggccgaccgaccaggaacaccggacattgttgactgggacaaaaactgggccgacctgaagtggacaccgccaacggatgtgggttattatttatggcgccagcttttttaattagtttgttagcataattttatgaggaaattttcggatgttttatttttaagctttttatactataaatttgctaggaaattctcggagttttgaagtaatttgtctttttagattttataaagagagagattttaatgatttttctatgctattttcaaaatttctgaccatttaaggcatttcttataaatggagagattttttaatgattttctatgctattttcaaaattttctgaccatttcaaagcggcacggcgatttagtttttttttgagcccattttggtcaattctgtgctatttttgtaatgaaacagcctggcattattagcaaaaactgctctgagttttcaggacggcggtgctccgctagagaagtacgtggtggagaagcggcttggcaacggcgaatgggaatacgccacggaagtgccggccagcaaaacggacgcacgcgttgatgggctcgttgaaggcaaacagtaccaattccgtgtcaagggtgtcaacaaagcgggcgagtcagcaccgtcaaatccaagccgtacattgttggccaaagcgcgacggctggcgccaaaaattgaccgatcagcaatgccggagattcggatcaaaaagggcggcaccattgagttcaatgtgcccgtggacggtgaacctgatccaaagtgccaatggctgatcaacggcactcagctcggcacatctgatcggttggtactattcggagcagttcgttccaccccgcaaatttttttttttgtaaatttttataacagaatttttcacgaaaaaaatttatggttttttataaaaacaatttttgaactttttttaaaa

SEQ ID NO: 50997 - DNA, 447 bp, Heterodera glycines
  Genomic contig location: Contig_ID=SeqID_3591; Location=756..1202; Strand=+
  SCN-specific regions: Sequence locations=1-75,160-247,275-305,431-447
atgaacgtcggacacattgagtggaccttccggtgcgccaggtttgtctacaaaattatttgtttgtttgtgcccaaattatttaattaaatttaaggacaattaattaatttaatatgaaaattatttttatatttttaattcaaataaaattaatttcagcatttttatgtggcaaaaacttaccaattatgtcgacttgaacacgcttttctgcttcaccattttcgtttgtggcacgaatcacttaatttaattttatataaaatttaatccttaattttgtgtaaattttctgattatgaaaataattaatcaaattctctatcaatttatttttaattgaattaatataaaattttacaatgaattgcaattagttaattaatgtttaatataccattaattaagtaattaataatcaatttatctaaatcgaaaacaaca

SEQ ID NO: 50998 - DNA, 3025 bp, Heterodera glycines
  Genomic contig location: Contig_ID=SeqID_3591; Location=744..3768; Strand=-
  SCN-specific regions: Sequence locations=1-395,418-542,564-580,605 -677,701-1760,1782-1899,1923-2539,2568-2583,2709-2739,2767-2854,2939 -3025
  Gene Ontology: Mol. function=structural constituent of muscle; Cellular component=cytoskeleton; Biological process=mitotic chromosome condensation
tgccgcctcgtatccatcgtgaagatctgtccgaccttgtcgttcgaccgggcgaggacgtcaagttcaatgtgcacatcgatggtgaaccaccgccgaccgtgacatggacatatgaggacggccaagcattgccaagctgtgccaatgtgcaggaccaggactacttgagcaaatttgccatggtcaaaccgacacgggcacaatccggcaaatacaccgtaaccgcaacaaatccgaacggctcggactcggttactgtaacggtcagtttattttttgttgcactgttttaatgtttctcgagttggtattggtaattggaatttctcggctaaacaattttgggaaccaaaaaccgggttaccttggctttaaaagttatgaatcgccatgaaaataaaaaattatcataaactgtgatcggcatcagggttatgcgaaattacgtgtcgtccccttttttcggcacttttgagtttcgttttctttttggatttaaattttttcggtttcatgataaaaaaaatttttagtttccttttctaaatattcattttcgcatacatgcaaaatttttgtaacaccaaaaaattaaaaagtgcaatgaaattttttttaattcattgaaatttggtcaaaattaatacttcaattttgccatttctccttaatttaaatcattttcaaaaattataatttaccgtttttcacagatcgcagtgaaaagtcgtccgacagcgcccaaaggtccgctggaagtgtcggacgttttcgaaaatcagatgactttggactggaagccgccggaggacgacggtggtgagccgattcagtactacgaggtggagcgtcaggacgaacgggacggcatttgggtgccggtcggcacatgttccgacccgcacatggtggtggacggactggccaagggggccaactacaaattccgcgtaaaggtgcgtgagcataatttttttgaatttgtcttttggcaaaacgccaatgcttggcattacggtagtttcggtcgcttgaaatactgtgctttctttgggttacggtattcccagtctggaagaaacattttttcgatggtcattattctgactttatttctacgttacttggcatttattgttaaattgtcggattaatgttcattacggtattgcccaaaattgggggtcgttccatcggttactgtaatttcatcagctattctattttcaaaatcatcccccaattttgatgattcccctacaaaaaaatttttggtttcacaggcagtgaatgccgaaggcaaatccgacccattggaaacggacaaatcgacattggccaagaacccatacgaacgaccggacaagccgaacgcgcccgagttggtggactgggacgcggaccatgttgacctgaaatgggacccgccggcaaatgacggcggtgcacccgttgaacaatttgtcatcgaaaaacggagcaaatacggacgatgggagccggcattgaccacggacgggaacacaaccgcgggcactgttgacggattgacgaagggtacgttttccaagggttataaaaaatggattccgtctttgaaaaaagaatgggcatcgtatttgcaattttttaatatttttttgagttttccacttttttgttgctttaattattttttggcaacccctccctacctattaagacaaaaattagcgcagcgaaaatcatttcgaatttttcggttttaaattaattaattcgtttttcggattatttttacaaatctttagtccccataactcttcaaaaatgacagcagaagttcaaaaaaatttcacagaaaaacaacataggactaatgtattatgaaacccttaatttacccttaaaaatatttgaattctccattaatttattttgccacgtttttccaaattttgaattcacccgtaactattctaaaaaaaacacctaactttacaggtaatttaacactgaattttgaaaattagattttgggtgccgcgccaaataaattttttttcacagttttaataggaaactgaattatgcttgaaaatttacaattttgaaaaattggcattttgtttgtcacacaggtgaggagtacgaattccgtgtgaccgccgtgaacaagggcggcccatccgagcccagcgatccgagcaaatccgttgtggccaagcctcgcaatgtgccaccccaaattggcgacttgcaaccgttgcggttgcacgcgggccaaatgatcaactttgatgtgccggtggaaggcgagccgacgccgcgcgttgtgtggctgtacccggacgggcaggagatcagagcgggcggcaaagtacggcttgagcatgacgaggagcagggccgttgcaagctgcagatcaaaagcacggagcggtcgcacagcggcgaatatggtcagttttggtggcttaaaatgtttaataatgcgattaattagggataataaatgaatgaaattttatgttaatacaattaatgttatctgaatttcattttttaatgccataaaatttaatgttgttttcgatttagataaattgattattaattacttaattaatggtatattaaacattaattaactaattgcaattcattgtaaaattttatattaattcaattaaaaataaattgatagagaatttgattaattattttcataatcagaaaatttacacaaaattaaggattaaattttatataaaattaaattaagtgattcgtgccacaaacgaaaatggtgaagcagaaaagcgtgttcaagtcgacataattggtaagtttttgccacataaaaatgctgaaattaattttatttgaattaaaaatataaaaataattttcatattaaattaattaattgtccttaaatttaattaaataatttgggcacaaacaaacaaataattttgtagacaaacctggcgcaccggaaggtccactcaatgtgtccgacgttcatgcagatcgctgt

SEQ ID NO: 50999 - DNA, 1045 bp, Heterodera glycines
  Genomic contig location: Contig_ID=SeqID_3592; Location=1..1045; Strand=-
  SCN-specific regions: Sequence locations=1-32,54-84,128-287,309 -504,526-578,622-681,715-1045
  Gene Ontology: Mol. function=structural constituent of cytoskeleton; Cellular component=cytoskeleton; Biological process=mitotic chromosome condensation
ttttaataaaaaaccaaaaagtagcgcggttttaaaatacctttgaaattcaatttgcttacattttttcgtaaataatcgaataattttattaaaaaacccttaatttttgtttgggggactccaaattactcgagactcaaaagtgtccatggtttctcgaaaaaatatcgttgggtaattaaaaatgattcattttaataaaaaaaaacaattctcatttctgaactgacgcttaaggttggccaatcggtggacttcaaagtgccggtgaccggcgagccgccgcccgaaaaagtgtggacctttaatgatgcgccaattgctgaaaacgacaaattgcgcatcgcaaatgaggactacaaaaccaatttttcaattcgcaacgcgacacgtgcgcatgccggcacttacacgctgaccgcgaccaatgaaagcggcaccgacacacacggcgtactggtcaatgtgctgggccgtccgagtgcgccggaggggccgttggaggtcaaagatgtgttggaggtagggaggaggaggattatgaaaatgaaatatagtctgtgataataataacgttaaataattaatttaaaattgacccaataattattattattacagcaaattttaaaatttaatatggaattatgatcacttttagaagaattatgggtgatcaaattttatataaaaaactaaaaatttaaataacgcgaattaattcaacgggaaattgctcctttaacgcctattttccgaaaaattaaaaaaaccgggaaattctaattcgttacttttacactcctactttggcattttagtcttcttttgcatgataatttattttccgagaaatttattgtccattgaatatacggtattaccgtattccaatcttgaggaccgcatgacgctggactggaaagcgcctgctgatgacggtggcatgcccgtggaccattacgaagtggagaagctggacatggcgagcggtcgatgggtaccgtgtggacgctgtacagagccgggcattactgtcact

SEQ ID NO: 51000 - DNA, 291 bp, Heterodera glycines
  Genomic contig location: Contig_ID=SeqID_20464; Location=667..957; Strand=+
  SCN-specific regions: Sequence locations=1-34,64-103,154-291
atgtcaatttcaacgaattcaacaaatattggcaaattttcatttgatgattatggtaatgagaaatgggaaatggtagaaatttaaatttgggaaacgatagaaaatttaaaattaaaataaaatcatctaataatttaaaaacattaaaatgcttttttcagaaatgaattatgatgaattgagtattttgaaggaaggagctgttgttaacacaaactgtgaatcattcactgatcagcaacaattgaaggcggaaaaacatagaaattaggaaatatttataattta

SEQ ID NO: 51001 - DNA, 1036 bp, Heterodera glycines
  Genomic contig location: Contig_ID=SeqID_20464; Location=1160..2195; Strand=-
  SCN-specific regions: Sequence locations=1-588,625-1003,1027-1036
cacatccccagctgatttgtcttcccaatcttcaggaatggcaaaagttgcaaaccggaagcggaatgagcgccgaattcgtgccgtccaagacttggcacggcacctcaaccaccgaatgaaccgccaccgccatcggcagcgcgacggaaaacgggacccatcggaggaacggcacatccgaatgaccgccgaacgttatgctgatcagctctctcgcctgggagatgaccacattcaccgactgcagcaccaattcccgcaactccccaacccccgccggcgtcgatcagaggtggggggcaatctgaaagggggaaagtcccagccaaaattggcatcaatggtggtacgcccgccccagggagagttgctcccttcaaaggatgtcggcggcgcagcaccgggcgcatcgaactcccatggccgaaacgagaacgaagaggaaggccgtgagatggccgagaaggaaagaggcagccgcccgagggtgctccctccgccgggggacagttttggagaattgctggagaaagaggcgaaagctcgggccgaagtggccgagctcgaagcccgggcaaagaaggcgaaaatggagagggaggaggaggaacagaaactgaaatcggcgaaggaagcgcgccttcgggacttgggaacccaagccgacgacttgcgccaaatgttgggcgatgcgagctggccgtggtcgaggggcaaagacgggaaaaatggggaggcggtggctccccgcgctgggaaagcggtggccatgccagcagtgccgatggaggatgatggagtgtcacttgccgattcggaaatggaggtggtgccggccgggggcagtgtcgcaagaagcgacgagatgaccaaaacgggcgggaggtctgctcccgccaaagagttctccatctcgtccatttttgccttcattttctcaatttcatttttcattttcccattctccgcttcgatctttgcgagcagtgcattcgtttcctgctgctttaacttttcttggagtcccttctaa

SEQ ID NO: 51002 - DNA, 865 bp, Heterodera glycines
  Genomic contig location: Contig_ID=SeqID_20467; Location=209..1073; Strand=+
  SCN-specific regions: Sequence locations=1-331,380-401,433-491,694 -701,738-798,827-833,856-865
atgatgatttttttgattaacgaccaatggaatacaaatgaaaaaaacttgattattttcccatttttctttttttatactaaatttggactcaagcatgtaatgtttggtctgtcggctgcataatgttcgaattgtactccagcggaaaagcaaattagttttgagagctggacttaagctggcagctttgcacctcccctctccccgcattttttacagaaaatttcacgaaaaaataagaaaatttaagtgaacagtttttttcgttttagacttatataaaagaaattttttgagtttgtaggcctctagagaaaagtaaaaagagttaattttaaaatataaatcaaataaattattttttaatatttaattactcatcagtggtttaaatgaacttatatattaattaattttagaatatattatgtgtcagtagcttgtatttttcagtccttctcgtcacccatagtgatattctgcgatacttgttttcactcttttaattattatcttttttaaatatactaataattcttatttatttattttttaaattgtatattcatttttatttcacttatttttaaaaattcaattaaataaatttactattttaaatattttttattcatcattagtcatgaattaaaatttttttttaagttttttattctttttaatttgttttctttgtctaaattttaacaaaattatattttaaataatattttcagcatattgtgattaatttctcagttgtaaaattgcttttacataaaactgttgtatatctattaattactttataaaaatgtaataaccattgtaaaataatttttataggtttaatcgcttagaa

SEQ ID NO: 51003 - DNA, 616 bp, Heterodera glycines
  Genomic contig location: Contig_ID=SeqID_20468; Location=325..940; Strand=+
  SCN-specific regions: Sequence locations=1-73,95-101,150-241,294 -437,459-616
atgctgatcatttcaccggcatttcctgaacaaaatatttcgactctaatcaatccgactgacgcaaggaaaatcaaaaatgaatttaaaaatggtaaatgtatttaaattaaatattattattttattttattctatttaattaatttctttttagcttttgaaacaattagagcattaaaagaagatgaatatgtcggcgaaatttttggacaatgatttataatgcaatttttagatcaattattttacataattatttttataatttaaatttcgaaaaaaaattaaaacattttgtattatagcttatgagagtatcgttattagtgacgtgactttctgtttattctgtgacttttgtctattttggtcttttcacgcataaaaatgtatgtgcctgccggttttggcattttgccaatattcaacattaaattataaatattttacaaatccgcgaaacttggttaattttaatgcctgacaaactttaaatgcaaaaatagcccgattggtgcatggactgaaggtcagatttcatgcaaaaaattgggaacgaatcatagcaaagcgaaaattaggaaaaacaagcacgttctacatgaataagata

SEQ ID NO: 51004 - DNA, 545 bp, Heterodera glycines
  Genomic contig location: Contig_ID=SeqID_20469; Location=634..1178; Strand=+
  SCN-specific regions: Sequence locations=1-40,63-182,208-254,283 -346,368-379,401-467,502-545
atgcgtgaaatcgtccatattcaagctggccaatgcggaaaccaaattgggtcaaaggttatcatgttattaaatctgtttaagtgatgttcttttaaattagttctgggaggttatttctgacgaacatggaattcaaccagacggaacttacaaaggcgaatccgaccttcaactcgagcgaatcaatgtctattacaatgaagcacatggtttcttaacaaagcccagtctcgcccacacactttaaatttcaggtggcaaatacgtgccccgtgctgttcttgtcgatcttgagcctggcactatggattcaatccgagctggagcgtacggacaactctttcggccggacaatttcgtttttggacagagtggcgcgggaaacaattgggcaaaaggccattacacggagggtgctgagttggtggacaatgtgctggatgttgtgcggaaagaagcggaaggctgtgactgtctgcagggctttcaactcactcattcactcggaggaggcaccggctcaggaatgggcactctactga

SEQ ID NO: 51005 - DNA, 311 bp, Heterodera glycines
  Genomic contig location: Contig_ID=SeqID_20469; Location=1..311; Strand=-
  SCN-specific regions: Sequence locations=1-311
  Gene Ontology: Cellular component=mitochondrial matrix; Biological process=iron ion homeostasis
aattctttttcgctgacgcgacttttccccactttggtcttccaccgtcatggtaacattcaactgctgcaaattgcggcttaccatgagaaagtcattgaccattacgaaaacccaagaaatgtgggctctttggacaaaaatgatccgtctgttggtacagggattgtcggggcaccggcttgcggagatgtaatgaaacttcaaatcatggtttattgaaatcattgattttttagaatattatgaaattaaggttgacggaaacggacaaataattgacgcaaaattcaagacgtttgggtgtgggt

SEQ ID NO: 51006 - DNA, 1060 bp, Heterodera glycines
  Genomic contig location: Contig_ID=SeqID_20472; Location=334..1393; Strand=+
  SCN-specific regions: Sequence locations=1-15,38-345,402-467,490 -820,842-1060
atgaaccagcaagtaagttaatcaaatatatgaaataaaagttgattcatttgaatttttcttatcatttgggcgggttcgcaaaaaaggtgcgataaaatattaccatatgataaaataaataagcaaaatttgagtccattcgcgttaattattatttttggcagtaataaaagatgaatgagaataaaaagtgccgttttcttcccgctgagcttgtccatgcgttggtttcggcattgccgttaaaccaacgctgggcaaccgtgcgggtttcattgttatttgaccgttttattctgtcaatacaacatgaatggcttaaacaattgttttcttcggtagaaaattaattaaaaatattttttatttatgtattttaattgtgtttaattaattaaggtgcatgcttttcgtgcggccaaagatgcccttttagtgcgcgtggaaaacagtgcaggagctaatcttcgtgttctgttccaaggtgggaaatacgggactgggtcgttttggcgccgacgttttggcgccagcctcagtttttttattataactttttttcttgttgaccaaatctaacaatcttggtatcattcgaaagcccttcacaagctctattagccttacaaaaaacaaacaaaaattttagcttctaaaaaagttattaagaaaaaaactcaaaaatttcgacttttttggaatttcatgttataacttttttggtaattgtctaatcgcgaagcaatagcttagaaatatcttctaacgtcggcgccaaaacgatacggacccgggaaatacacacataaataacttataattattgaaagaattcaaacattttacaaatagagaaatccaaatttcaggaatttctgcggagttcaacatcccaaacgacattggcattgtagagtggcttgaggagaatgatcccaccaattacggcatcgtggaatttcgtgctcaaatgcacgcgcttcatttggaacttatcgggaacggaaacaacgaactgctcggggcggccacggcttgtatgtttttgggcaattaa

SEQ ID NO: 51007 - DNA, 116 bp, Heterodera glycines
  Genomic contig location: Contig_ID=SeqID_20472; Location=1..116; Strand=-
  SCN-specific regions: Sequence locations=1-116
aatgaataaaataaatcaaatgttaaaattcacaggtgattaaaatatagtgtatatgtggcacagaaaatttcctactcagaactcattgcttttagtaaacccctgaattcctt

SEQ ID NO: 51008 - DNA, 229 bp, Heterodera glycines
  Genomic contig location: Contig_ID=SeqID_20472; Location=1521..1749; Strand=-
  SCN-specific regions: Sequence locations=1-165,187-229
atgatcgaaaacggaatcagaggacctctgaatttttacatacccacggacggaactcacgtaaaatacgtaagtaagtggaaaatgtgtcagtccttttttataagaatttaaaaggttgtatgaatgtttaaaaaataatttgtaggatggaaacatgcttggattgaaatactgtaaaattcctgaaaatatcatatactgtaagggtaattttggttcattataa

SEQ ID NO: 51009 - DNA, 713 bp, Heterodera glycines
  Genomic contig location: Contig_ID=SeqID_20473; Location=830..1542; Strand=+
  SCN-specific regions: Sequence locations=1-210,232-290,312-656,680-713
atgaccaccgccgcctttcttccgctgctcaaaaaggccgcctccgccggggagttcgctcgcgtggtgaacatcggttcgtcgctcggttgtattggacaggcggccgtttcgcctcggctgagtccgtatcagaacgtggcttatggcatgagcaaagtccgtccccttctccgtccgcccctttctttgatcagtgcttaggctgctcttcatcacttctccaaaatgatggctttggacgagtcggacattgtcactgttgcgattcatcccggcactcaactgtcccttctcactcacccaattttgttgttttaaggttgggttaaaacggaaatgggcggtgctaacgctatgatgagtgtttccgactccgttgcaaaaataatggcgcggatttgcgcactcacaaagagcgactcgggaaaattgctatacggagaaaaggaattgttgccgtgaagaaaaattgatgtcaattcttcccaatttgccttttgccgactttgaaccgtttctgtgaaattatgcctatttttaggcaacataaattcgtaatttatctatgaattattcaccattacctaatttccaattaaacaacattagtgtattaggttttgaattgtttgaaaacttttccctgtgtcaacgctatatccaaaagaaaaaagtttattgagggatttaaaagttgagatactcggaca

SEQ ID NO: 51010 - DNA, 1028 bp, Heterodera glycines
  Genomic contig location: Contig_ID=SeqID_20474; Location=119..1146; Strand=+
  SCN-specific regions: Sequence locations=1-102,124-185,210-322,344 -752,774-783,843-1028
atgttggccttgagcattggccaaatgtcccctgacaatctgtcagtggacaatccgtcagtgatggacaatgtgtgagcaaataacccaagatttgaacaagcatttttaaaaaatgtaaaagacaattaccatagaatgatgaattaaatcgaattctaaataaatagaagttttgtaaaaccccatccgatttttaaaaattaaatcgagcaatcgcaatcgcaaaattttacaatttggggtaccaaagttttggaaggaattaatagaatacatacagattatgaaaatgcagaaataaatgctttgataaaattttttggtgtgaacaaagtttacagatgtattgttcactacatacgtgcaacataatgacaatgaatggtggtgtaagttggttatttttacttatttaagggttcatattactatttcagtgctttttgacagtattgaaaaaattcgagagcatattgaaatagctatcgcacctgccgctggtgctcatgaaactgagaaatacatgaacaatttggacctagcatcagtcagcaaattgtttgggataaatattatagtttgcgaaaaagttagcaaagaaattttccgttggcaggtgtattcgcccaatttagaaatttcggttagactaattattttatatgctaaaaattttacattaactattttaagctttcaataagtcaaaagaagtcttcacattcaatatttttatattaccatgatgcgcattttgaactcataaaacaaccacaaaagataaaatagttatttattttatttttaagtaacaatatgtattaaatttatttaattttcccttttgtaaattgcaaagaaatattgtggtacgtattgtggaacttcatttttcgactcttgcataatagcccctgttatatggttttgcaattttaaaaaaggttttatatcgagaagcttatttaaaaaattttaaactgtagttgaccgatgttgctacgaacacgatgtgtgttacataa

SEQ ID NO: 51011 - DNA, 2783 bp, Heterodera glycines
  Genomic contig location: Contig_ID=SeqID_20475; Location=1..2783; Strand=-
  SCN-specific regions: Sequence locations=1-150,172-791,813-845,879 -1118,1140-1144,1182-1289,1312-1314,1339-1354,1376-1398,1420 -1919,1967-2073,2257-2277
  Gene Ontology: Mol. function=nicotinic acetylcholine-activated cation- selective channel activity; Cellular component=integral to membrane; Biological process=synaptic transmission
cgatcaattccatttggaagcctgatgttttggttggccattcagcaagttgcaaagttgcgacccgtttggttttagctttacaattcggtggaccaacgtttcgacactctttggccggtcggtcgaacggcgaatgagtgcccttctatcagtgtccctctgcaggtgaatgccatcgtcatgttcaacgggtccgtcacttggatccccccggacatcattcgttcgtcttgtcgcatcgatgtgactgatcccccccctccgccgtttatcccctttttatccctccctttaggtcacttcgtttcccttcgatgaccaaacttgcattatgaagttcggctcgtggacctactcgggcttctccaccgatctgttcaacagttccgtctctttggacccgtacactcccaacggcgaatggcatttgctcagtgaacgtttttccaaagtgttcctgtgacctttcgccttcgcaggtgtcagttctgtccgcaattatttggtctacgactgttgccccgaaccgtacgtcgacgtcacttttcacatttccgtgcgccggcgaacgctttattacggtaacaattaagctaatttggaaaactaaacgattcccccgtccccttaaaaaggagtgaatttggtgctcccttcgctgcttatttcttcgctcgctttgctcggcttttctcttccgcccgattctggggagaagctcaacctttgtaaatttattttcgcaatttaagcttattttcggatggttaaaaggtgtcaccattttcatgtccctttgtgtgtttatgctaatggtagccgaaacgatggttcgtttagacaattaattaattaattgtttaactaattaattatgttattttagccacagacttcagacactttgccattaattggtctctcataaattcgctttccattgcttttcgccccttctcagaagttttcttcacctgcgttatgttcgaagtgggcgcctccgtcatttgcactgtaattgtgctcaatttccatcaccgaaaagccgattcgtactttccaatgcccaaatgggtgctaattagctaattaatgccgagtttgcttatcccttcccctcccattttcccctttagcttcgcattttgcttctcgattttttccctattcttttgtttatgcgtcgcccgccccgcgttaaactgccgaattgtgacgacggagagaacgatcagaacaaaatactactgaaagaggagaaaaacagcacaccgacaaagaaagaaaggtgggagaggaaaaggaaagtcgttttctttatttccaaccactttccctccgatcgtttctcctctgattagtttcttccaatcactttccctccgatcgtttcccctctgattagtttcttccaatccctttccctccgatcccctctgattactttcttccaatcactttccctccgatcgtttcccctctgattactttcttccaatcactttccctccgatcgtttcctccgatcacttcctcaccgatcatttttctgttcgatcagttgcccttctactagttcttcttctgcctgtgccaactgtttgcttcccaattccgactccgttacgtccaccagcgacaattttgaaatggactcgcgactgttcattccgccggaccaatggcaaatgaatggcgcatgttgccacggagcgggacaaaacgcagcgggggcggggacaaaagtgcccgttttggatggcaccgcggggagtatgaggttggaataccaaccaagtgagtgggtgttaaagagagacaagttgaagaaggtcatttcatttgagaggggcgccagggattgtacaagcaattgaaggaggggggcagcagactgatcgccaacgattgcgcggtaattttgaatttaaaatggaaatggaaaataattaaagaatgaattgcgacgattgtccggacaacggtatttgttgctgaataccacaaaacgattgggaaacagtgaaaagaaggaaaagcacgacgaaataacggaagaaattcagcaacagaaagagggagaggtaatgagaaaagaagtgatcagaggggaaagagagagagagaagaagagcacagagaaagaaaagaaaaagtgacgaaagagcacatagaaagacagaggaaaaagtgatcagagagcacagagaaagacaaagaaaaagtgacgaaagagcacagagaaagacagaggaaaaagtgatcagagagcacagagaaatacaaagaaaaagtgacgaaagagcacagagaaagacagagggaaaaagtgttcagagagcacagagaaagacaaagaaaaaatgacgaaagagcacagagaaagacagagggaaaagtgatcagagagcacagagaaagacaaagaaaaagtgacgaaagagcacagagaaagacagagggaaaagtgatcagagagcacagagaaagacaaagaaaaaatgacgaaagagcacagagaaagacagagggaaaagtgatcagagagcacagagaaagacaaagaaaaaatgacgaaagagcacagagaaagacagagggaaaagtgatcagagagcacagagaaagacaaagaaaaagtaacgaaagagcacagagaaagacagagggaacagtgatcagagagcacagagaaagacaaagaaaaagtaacgaaagagccacagagaaagacagagggaaaaagtgatcagagagcacagagaaagagagagaaaaaa

SEQ ID NO: 51012 - DNA, 694 bp, Heterodera glycines
  Genomic contig location: Contig_ID=SeqID_3595; Location=1914..2607; Strand=+
  SCN-specific regions: Sequence locations=1-694
atggctattccagctatgatcgcttctgtcccttctacaaaactgttgggatgctcaaaaatatgtatggctaaagaaaagcaaatgatcaaattgtgttgttcgaataaacatcctaaggattggcttttacgactttgcccggcactcggtggaaacgactgcacaatcggacaacaaaatcacgtggaatcagatcagagatcacctcggggacatcattcacgaactttcttcgatgaaatttgaggtggacatggaaagggatgacaacaaccaaatcccaatttgctaaccaattaggacccatccgaaaaaacggaagatcagatcaaaaaggattacgaagaactgtatgaacggatgcagaacaaattccgagcgttagaggatgaatgaacaaactgtgatcaatgataacaatttctcaaaattttccctcatttctcttagtgtagtgatggaaaaaacgtctcagtgagttgtagttgtggtaggagccgcacagtttccatcggcacgagtgggcactgcgtcgttttgctgaaagcgttagaatgtattcaagttatggtcatttgattaccgtaaaccgatgggaatgaccgtcgcatagggccaccattttggtgggacgacggcggaattttaagcaacggtatgaacgatggactcaggaagggcggagagggaa

SEQ ID NO: 51013 - DNA, 898 bp, Heterodera glycines
  Genomic contig location: Contig_ID=SeqID_3595; Location=2924..3821; Strand=-
  SCN-specific regions: Sequence locations=1-410,432-434,456-478,500 -752,775-898
atgggaagacaacgacaaaaagcggaggaatcggcggaagagcgtccaattgctgtccaaggcattggcacctgtccaaaattggcaattcccagcgacgcattgatagcacaaaatggtcgaagggcagcgccaaaccaactgaggccgtattgggtggccgatcagttggaaagcatttaccatttgttccaatcgccgtcgacgcacccgcggccgggcccaaaggcaaaaggcggagaaatccgcgcggagattgtcgaagaatgaaaggccaacaaatttaatgaggaagtgctcattcaattagggaggagcacaaagtttcctcgtagagtcggttggtctttccaacttaatttgttcaccgacactttcgtcattcattgttctgtccttttttctgtttgaaatttaatttaaaattaaatgcaaagattgctgagcctttgatttccctgaattactaaattgaccaaaagtgattaactttcctaaaatttaatgaatgaacgccgaagtgagagagagcaaatatttatccaccggggccttttgcatgccctcccccacttcggcactccccacgcggcaccctttacccattcgttgccctttaatttggccaatccaatcaaactccattcattcgtcctcttcccgctcaactcgtcctttcaccggtgagtttcaaattcgctccttctccgatggttttcccggtgtttttggccatgcttttgctctgtttggttctgtcgtcgtcttccgtttcggctgctgtgagtttaattatttgccaattagcaaatgccgaatttaaatggcaaattcatttgtgtgtaataagttatactggtcatctattcttccttaattaataactcgaagaaataaa

SEQ ID NO: 51014 - DNA, 498 bp, Heterodera glycines
  Genomic contig location: Contig_ID=SeqID_20476; Location=417..914; Strand=+
  SCN-specific regions: Sequence locations=1-30,64-111,140-180,204-498
atgggcatttatttatttgtcatttgtaagtaattaattaaaattaaattaaaattaaaattagccgtttttcagctgggttttcgaaggaggagaggactaattgtaagccacaaaagaaaataaaatataaagaaaagctctttggggactatcaaacaaatttcagggatgagcagagaaaaagggcgaaagagagggcgactgattgggatttggagtgattaatcagccaactgattgggatttgatgggagtgattaatcagccaactgattgggatttgatgggagtgattaatcagccaactgattgggatttgctggttgtgatcagtggttgagtaggatgtcgcacccccggctacccggacgaatgatcggccaaccgaacttccgatcagtcactccgtcgcgagaacgactgcaacgaacgttccatcgtttggcggtgcccaattcgagtcactcccaaccttaaaattgtaaaattcgcaaa

SEQ ID NO: 51015 - DNA, 836 bp, Heterodera glycines
  Genomic contig location: Contig_ID=SeqID_20476; Location=1757..2592; Strand=-
  SCN-specific regions: Sequence locations=1-249,273-631,656-836
cgagtaaatctgaaaaagtcccacccccggccgacttcgactcggatttgcgatcggcgctggccaaaaggcgcagcaaagtgcagcaaaagggcgaaaacgaagcggggacgagcggacagcagaacaatgagacgatgccaagcagcacctgcaacacaacatcagaaaacaacgacaatagcagaaacaatggcaatggggtgacgatggtaaagtgagtgaatcggaggggggggggggacaatgccaagaaaagggggcggggaaaaagaatgtgggaatgccaaagagaggagaaagcgccaaggcacgcccaaacactagagaaatattctctgagtttagccgttacaatgccggccttagtctgcgagagtcggtcatggaaaatgttgcggccggcaccgtcaaaggcgtgcccggaagcgccgtcaaatcgacgcccaattcgcattcgcccacgggcgctttcaccggttgcaaaaaggacagcgggtgagttgggcgggtgattagctattagcattgctttgaatgcttctgctgcttaatccttttaatcctcccctcttcagttacacttcctcgcgcacttcgctggagcccagcgactacggcgacacagaacaacagaaccaaagccatccaaaccaccaccattcccaacattcactggtgcccccgtctctgcctgttcagcaccgcgtctccgttctcagtcagcaaatggaggcggcggcgagcgcagtgcagtcgcccgtctctctgcgcggactgtcggcgccgcccgcggaattgcaaccacaggcacaaaaaaaccgactaattgctaa

SEQ ID NO: 51016 - DNA, 489 bp, Heterodera glycines
  Genomic contig location: Contig_ID=SeqID_20477; Location=1397..1885; Strand=-
  SCN-specific regions: Sequence locations=1-489
gcattacggaacccggcgccgtgcgacgcgtgctccactacggactgggcgagttggagttggacaggttggtgggcgcgttcgaccaatgcgggcagatgatgcgcttccaatgcaaaggcggtgggtgggtcgaaggacggatgggccaataaattgccaaattggccatctttaaagcattgccactggaactgtttcaggccaacgtttgatgcattatggggcggaaaatcggccgtccgtttggtacgcgacgcgcaacgcgcagcacgggctgcagtggggcgacgcaccgcccttctcgcgcgtttgcacgtgcgcaatgaacgactcgtgcacggggcacaggtgaagcggaccgaccaaaatttaaaattcggaatgccttcgagactcaagaccaatccgagtgccgaaaaagccctcaacactttcccaggggctgcaattgtgacagcggcaacgacgcgctggacattggcatga

SEQ ID NO: 51017 - DNA, 915 bp, Heterodera glycines
  Genomic contig location: Contig_ID=SeqID_20478; Location=174..1088; Strand=+
  SCN-specific regions: Sequence locations=1-20,42-275,297-552,574 -807,829-915
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 51018 - DNA, 1888 bp, Heterodera glycines
  misc_feature (1787)..(1787): n is a, c, g, or t
  Genomic contig location: Contig_ID=SeqID_20480; Location=1..1888; Strand=-
  SCN-specific regions: Sequence locations=1-246,316-340,374-457,504 -546,568-637,686-731,760-793,815-1051,1100-1140,1170-1505,1528 -1622,1655-1774,1828-1888
  Gene Ontology: Biological process=growth
ttttgaattggcccgagtataacctttaccgtgggatggtcaaatcgcacaaaaacggctctaaaacggtgctggactcgttcatgatcatcgtcacttaccatggcgtggagttgagggagtggcatgaacgggcggtgatgatgcaacggtggcgcaaggtggccgacaattatgtgaaggatttcaatgtgtccgtgctccatgatgacggtctcttcttggatctgctcgaaaatatggtccataattttatcataataataattaattttatttttaaattatatatttttaatttaaatatatttataagtgcgcataaaatttcagttccccgataaattaattgtaaaaaatttataaaatttttgcaattaaatttcaacatctaaaatgaacctatggtcatatatagtatgtatatatatatgaccgatcaatttccattttttccaaaaatttaaattaaaataaaaatttaattaaaattcattatttttgtttagccaactgacatttggcaatcggcacttggcacattggtatgcatgtccattatttgtgcggcgttcatgaacttcaacccatttgttgttgctgtgacgagcattgtcattgcctgcattctcaccggtaattaatatttttaattaattaattaattatataaatcataatttttcagagacacttggcataatggcattgattgggatgacaattgtgagtttttttttttaattttttagtaattttgctaagctcgagcttggattttggggaaggttcattcccgacattttttggcatattgccaagtccctatcacaaatgtatttgttatctaagtctaattttcaacctccggacctctgtaactctgacccacaactctatcggctttaaatccccgactttttgtgaactcctaaagctcctaaaatcaatttttctttgacacatcctcccaacccttgacgtattaatgctaggagaaaaatgccattttcataaaaattcatttggatttaaccataaatcttttggcatttaaaaatatatgtatttacaatttaatttttgtttaaaattatttctccatttttccaggaccccgtggtgatggcagctgtgatcatttccatgggcttcagtgtggacattccggcacacgtctcctaccatttccacatcgcaaaatggacagaagatgggcaacgacagcggacaattgaggaacgaattcgaatgtcattcgcttctgtcggctttcccgctgtacaagcatcgacatgtaagcaacaaaatgccaaaatatgcaaaatttaaaatagaaaaaaaaatttgcttggaaataattaattagggattaaaactcgccccgaacccaaatttttggccattttgactcaaaccgctttaaaacacgacaaatactactgacctcgaacaccaacccccgactcggtactggtgttactttataccatctaagaatgacatttttgtaaaggaaaaaattattaaaatttcattattaggcaaaatgcctatttttacgcacacttaaaattaattcattgagataattacgaaaagcatactcattaaaaaaagtttttgaaaaaattcaaaccaaaatttagattttaataaggattttgaattaaaaaaagtatatttttagtttactttttatgattatttatcgtttcaggtacaaacatttgcattctttgtctactcgtcgtccctgtctatccggcacaagtaaaaataattanattttcaaaattgataaaataattttttaaaattaattttcaggtttttgtgcgaatcctttgcacatgcatcacactttgtacaatccattcactgtgcc

SEQ ID NO: 51019 - DNA, 430 bp, Heterodera glycines
  Genomic contig location: Contig_ID=SeqID_20480; Location=1641..2070; Strand=+
  SCN-specific regions: Sequence locations=1-262,338-376,412-430
atggaccatattttcgagcagatccaagaagagaccgtcatcatggagcacggacacattgaaatccttcacataattgtcggccaccttgcgccaccgttgcatcatcaccgcccgttcatgccactccctcaactccacgccatggtaagtgacgatgatcatgaacgagtccagcaccgttttagagccgtttttgtgcgatttgaccatcccacggtaaaggttatactcgggccaattcaaaactgaaatttgaatgaattaatatttaataaattaaaatttttgcctttttaatcgtttttttaattttaaaatttcattttttatatttgagtcataactcatggagactttttgaactaattatcagttatttatttattgtacaattttaattatttttaagagtttggcgatgtcatag

SEQ ID NO: 51020 - DNA, 1112 bp, Heterodera glycines
  Genomic contig location: Contig_ID=SeqID_20481; Location=51..1162; Strand=-
  SCN-specific regions: Sequence locations=1-462,484-534,558-573,595 -852,879-1074,1110-1112
atgatcacccggtgcaacaacaaaaactgtttctttattagtgattataaaagccttaacatcatggtgacaaattttgatgtgacaatcggcgaagaaagagcgagaaaggcaggccaagagagagcgagcaaggcatgggaatggttattcaatgttttaccaacattcgaccgaagcattgccgatttgctttggactcacataaagtgggtttttcatgggtatgggggagttgtcaaaccggacattattcgttcaaaattgtttttatttttaaactcaaaacttttttcgttaattaactttaattttctttacatcatttaaaaaaaaaaataagttttgctaatttttgcaagtttatttcaattttaaaaaaatggtaaggttttttttaatttttccttgagacttctgatttttaagaaaattctaaattagtttttaatcccaatgatttatataaaattatgtacaaactgccattgaccaatgcaccgtgccgattcgaataaactcatggactttccatttcagtgcaaactacaatatcaattctatctccgttcttcttgagaattttgaaaaagcggaattcatttcattaacaagtgatgacttttacagtaacctttcggttttacgtgaatacggtggtggtacgggtatgtgtggtgtttcgagtgtccaagtgtatgaaaaacttggaaaatttttttcggctggcgttgtcacgtattattacgcaggatcttttttgcatcaatgtgaaagttttgttatcctgttctttgtctagattaattgctaagtaatgcttattttgtagttgaggtcccacaaagaattcaatttatgaaaaaattccaaaggacatgaaaatttgaaaaattgctttaaacgcattgcattttggagagtgattttcgtagaaaaaatttcaatgtccatgcagggatttttaaattatgcttgcttttttaaattttttttttcgtaatcaccttataactagggatgggatttatatagataggtatattaaaaaacgaaatatttaatttgttatgaaaaagataaatattaagaaaagattgaatttgaataaa

SEQ ID NO: 51021 - DNA, 941 bp, Heterodera glycines
  misc_feature (937)..(937): n is a, c, g, or t
  Genomic contig location: Contig_ID=SeqID_20482; Location=93..1033; Strand=-
  SCN-specific regions: Sequence locations=1-131,155-229,251-710,773 -914,936-941
atgaaatatgtaaaaacaattttagctgtcttctccagtcaattatcactggtaaaaattaccaccgaaaagaagttgaggaattcatgaacatcataagatatgacgttctgcaattggtattaatgaactttatataattaaaaatatttttcaatgaagaaatattcaaaaagcagattttaggttttggaattcagttcgacagcggtagcgctgaatttttcacattttaaattaaatataataacaaaattcgaaagttacgttggtaatattttaagaataaaattttcagttgactttcggttccatttgcgccaacatcacatttgaaggtgaaaaagcaagaatggagtggtatttggggcgtctttccaaaaatgctcaaatgatactcgacaacgtggagccttatgtttcaggcgaacttgtaagatgattcttttacattaatttaaaattagtgacaaatttgtagtgacctttatttctacttaaacaatttaccacttttaaaaatttatattccttaaaaacctataattaagtcttttatgacagctttaaccgattaatgattacggtataaagctttcagattttaaagttactattttaaaagaaaaagaaaaaattaggaaaaaatgaaacttttcattttgtcctttttatataaattcatttatagtaagaagtaaatgtttagcatatttttaaataaatagaaattttttgttaattttaattaaatatgttgtttttattttaagctaaaatcattccccaaaattgaaaacgcagttgctaaggaagttattgatgaaatgacgtttactcagcccgttacggacaacgcgacaatcttccagatagctacaaatgtgttcgagattcttgatgaatacggccatagaaagtcagcttgtatatttanatag

SEQ ID NO: 51022 - DNA, 1005 bp, Heterodera glycines
  Genomic contig location: Contig_ID=SeqID_20483; Location=569..1573; Strand=+
  SCN-specific regions: Sequence locations=1-97,119-154,178-210,239 -604,696-698,721-849,880-903,934-1005
  Gene Ontology: Mol. function=cytoskeletal regulatory protein binding; Cellular component=microtubule associated complex; Biological process= N-linked glycosylation
atgccaaaaattgcgggtgttcatcgccaccaccaccataaacaccaaatgaatggcgcacataagcaaaacaaaggaccaaatggagcaaaaaaagaaaagtataagtcaatggccgcgagggaattgggccaaaacgtgcgaaaggatcagcaaaaagggcacaacaaacagaaggccaaagtttgttgggataaaattcgtcatgtgaattgggcagaagaaaaacaaaaagtttttcggcaattttttccaggcgaatgtttgaatttttcatttaattccgctttcataattttaatttctcagagaaactaaagattctataaaagcttaattgattgaatcctgagaaatttatgaggaattatggggaaaatattcatgaaagcgaaatttaagaaatgaattccaacgcaccaaatggagagaaaagataaaacattttttgatttttaagaaaaattcgaatagaaagaaaaaggaaaagaagaaaaagctaaaagaaaaggccaaagaactagcggagaaagcacttttgaaggcattggacaaagtgaaattgggaaaaagtgaagaaaaagagaaattgaaaagagcactgaagaaagagatgggaagagaagaagagaaagaaaacaaagagatggaaagagaggaaaagaaacagacagacaaagagagaaagaaagaaacggaaaatgagaaaaaggaaaaggcagagagagaacaggtaaatgaagagattgatgctcgagagtctcggtcagaggtctcgtcggcccgagaaaagtctcggctttttggggactttggccacggatttattaacggactttttgaaacacagctaatttaaaagaaaaaattcaacacctaaaaaatgacattttgctaagtaagaaaatctatttttaaattcaatgttttaatgaggctttttaaatgtataagaaaaagtctcacttgggtcatgggtctcgggaaacgatcataacaatacta

SEQ ID NO: 51023 - DNA, 460 bp, Heterodera glycines
  Genomic contig location: Contig_ID=SeqID_20486; Location=1606..2065; Strand=-
  SCN-specific regions: Sequence locations=1-107,147-417,449-460
atgacagaaatattagccaaagtatggaataaaatatgctcagtgtcatcaattgtttatctaaaaaatggaaaaatatgtgaggctaaattttcgtaagaattgggaaaataaaaaaaaattaaatcgattaaaattaaaaaattcagtaaattacaatgaaaaaacagcaacaaaggaacaattaattaattcaacatataaaaaaagtatatttaaaacaccatatgaaatcaccacgagagattaaaaaaaattagcaatgaaaaatatgtaaagtgaaatttgtgaaagaattggaaaaatcaaattaaaacgtttaaaaatttatatcactgtaattagttacataaacactgcccttataaaatgtacataagttggagagaattaattatgcaaatgacataagaattgataattatttatgtttaatattttatttattcccttaaataaa

SEQ ID NO: 51024 - DNA, 701 bp, Heterodera glycines
  Genomic contig location: Contig_ID=SeqID_3596; Location=1454..2154; Strand=+
  SCN-specific regions: Sequence locations=1-236,258-292,315-701
atggtcaactacgcattgcacaaaatggttcccgttttggtcggtgaccaaagtgttctcgtgtcctttgaactgttggcagaacaattggcggacttgggacccggacaaattaacgacgagctaaacaaaatgggcataagtatgaatcaaggacgtgtctcaataggtaataatgtctttttttcggtggaccccaaaactcagccgccgaaactcagccgagacataattcaaattttcaagaaattttcagcgattttttttttaaattttttgaattcttagtaaattttgaaaaaaccaactgaaaatttctttttaaaaaaatttattcacggctgaattatgtctcggctgagttttggtcggctgagtttcggcggctgagttttgtcctgctccgtctttttttaccttctggacaatgcgacaagcaaaacgattgagcaccattttaaaggcgagcggacggaccaaattgagcaacatttgattggtttcttttgaaccgttctcaactaacttctgaaactattgttaacgaatctgtttcagtcccaaatgtgatgcacctgaatgacgaaacatccgttgcaatcgatgcacaattgcagaaagcgttcttttccaccgttgacaattgcacacaaaacctggaaaattcacaacatcaacaaaagacgttctctgccaaatga

SEQ ID NO: 51025 - DNA, 1128 bp, Heterodera glycines
  Genomic contig location: Contig_ID=SeqID_3597; Location=799..1926; Strand=+
  SCN-specific regions: Sequence locations=1-110,133-587,611-627,649 -896,929-1074,1099-1128
atggttgtaataggtcaaattgatgctttgaacgacgtatttgcctttgttaccgatgttaatggcaaggaatttcgtgtcccgcgggaattgtaagttattgcgtaaataatacaacaaaattccaccaaaaaaggattcgtgagccaatgttcggaaattactatcagtttgatggcacttttctggaaagtgatgttcttgagccaacttctgtcacggctttggctaatgacagcaaagcgttgttggacgcccgggccaaactttgggatgaaaaattcggaaatgacaaatgcacattgcagaaaatcaaggaaatgggcatcgattcgttagtgaaaaagtagggaaaacagattgaacatgacaagaaaagtaatttagaatttttgattcgtctgtgagcgaagaagcgatggaagagaatgaaacggagcaaaaggcaaatggaaatgttaaggtgggtcgagttcgccatgacgtctgacattgtaattcgctttggtttttcagttgcacgtcgaagtaaagcgaagcggcagaaaaaacaaaaacggggcggagatttattgctcggacaattttccattggttatcgacagcagtggcctcttgaacagattcttggaggatgagccaatcataagacacgcgccggaccgaaaattcggtgtttggtgcgcgccgcgaaaatattcgatcgacggaattcaatggaaaattgtgcggattgatccggagagcaaaccaaagaaatcggtcccgaacggagttagcaaaatgaatgggcgcagcaaagaatgtgtcagcaatggagggcagactgacgaatgcatttcgagttctccatcgaccgttccttcgcttccatcgacgactgttcgaaactccccgaaattggaggaggaggaggagaaagtggatgagaatgaactctttgagggactcatctgctcgcaaaatgaaacccatttcctcgtcttttcccctgggcgtcgttggttgggccgtttggacaaggcaaagtgtggcaaggacagtgcgtctattctcgggatgtggatccaattcaaaatgtaataaaatattttcattccataagaaaagtctctcttttcagcaaga

SEQ ID NO: 51026 - DNA, 715 bp, Heterodera glycines
  Genomic contig location: Contig_ID=SeqID_3597; Location=2587..3301; Strand=-
  SCN-specific regions: Sequence locations=1-715
  Gene Ontology: Mol. function=D-lactate dehydrogenase (cytochrome) activity; Cellular component=cytoplasm; Biological process=lactate metabolism
tggtgcatattcgtttaatttgctcattgaaacttcgggtgggtaattattgcataactgaatgttccgtcatttatttacgtgttctgaccacttctttattcaaggcaccgactcggaacatgacttagcgaagatggaccgattcctcgaccgatgcattggcgacgcattggctgctgacggagtgctagcgaagaatatgtccgaggctgaacacatgtggaaaattcgcgagaattgctcattgggtcttcgccaggacggttacgtgttcaagcacgacatttcgttgccattagaacacttttacgaggtgacagagcaaattagggagcgcttgcgtgagacgaacgtccgacgaatttgcacatttggccatttgggtgagtgaaagatgggtgccatttacttggaactcaaaacaggcgatggtaatgcccatctcaacgtcaccgtgccaacatttgacgaggacgtttaccaaaggtggattaattgtcggtgtaaagcacaagttcttttttataggctttaccccttcatttatgaaacagtggcctcaacaggcgggagcatttcagcagagcatgggataggactgttgaagcgagaataccatcacaaactaatcgaccaaaaacggcgaatgtttagttctggtattaaacgactgtttgaccctcggctgatattgtctccttacaaaatgata

SEQ ID NO: 51027 - DNA, 845 bp, Heterodera glycines
  Genomic contig location: Contig_ID=SeqID_3598; Location=148..992; Strand=-
  SCN-specific regions: Sequence locations=1-360,405-845
  Gene Ontology: Mol. function=D-lactate dehydrogenase (cytochrome) activity; Cellular component=mitochondrial matrix; Biological process=energy pathways
atggcattattaaaatgcgctatcatccgggggttgcttcatacattcaatggtcgacatttgttttcaacagtcatcgaacggagaggagaatttgccgaacttactgaagatgatctgcggaattttcgtggaattgtcggcgaccgttgtgttaagacagaagagattgacgagtgaatgcttttctcttcgttcctgttcactttcaattttaagatacaacactgactttatgcgttggtacacaggtgggatttcatttgttcggagttcccaagtgtgcttatttccaagatttgtgcttatttttgggtttgaaagttaaaaaaaatgcaaaatttgagctctagtattatatttttgttgatttttaatcattttgaataaaactgttcaaaaaactggtttttgaccccaaacgatgatttttgtcggccaatgctaattttgaaaattttcagttcacagctctggtttttacgctaataaaatatttattaagtcgatttttcatgtttttattgcgttttcttcgcgctactattagttttggaaaaatcttatttttggggtccgaatcttagtttttcagccattttgtcttattttgaaaatagaaacttgggaactctgcatttgtttgatttttctatttctcactgaatactttttttagtaatttcatttccgttttttggttcataaatcccattttttgcaggtcgttctcagtgtgttctccttcctcagtccgttcagcaagtgtccgctgtgcttaaacattgcttccatcgtcggttggccgtggtgcctcaggcgggcaataccggattggtcggagg

SEQ ID NO: 51028 - DNA, 587 bp, Heterodera glycines
  misc_feature (519)..(519): n is a, c, g, or t
  misc_feature (521)..(521): n is a, c, g, or t
  misc_feature (524)..(524): n is a, c, g, or t
  misc_feature (526)..(526): n is a, c, g, or t
  misc_feature (531)..(531): n is a, c, g, or t
  misc_feature (537)..(537): n is a, c, g, or t
  misc_feature (546)..(546): n is a, c, g, or t
  misc_feature (550)..(550): n is a, c, g, or t
  misc_feature (552)..(552): n is a, c, g, or t
  misc_feature (560)..(560): n is a, c, g, or t
  misc_feature (576)..(576): n is a, c, g, or t
  Genomic contig location: Contig_ID=SeqID_20487; Location=24..610; Strand=-
  SCN-specific regions: Sequence locations=1-11,41-109,181-587
atgaagttaagtaattaataaaatgaaaaatataaaattacccagcccttataatggagcaaaatttgatttgaaaaaatgatttctcaccagtaggattattcaaatcaattttttacttaatataatttgttttttttattaaataatgatgcaattatttaaaaatttgttttaaatcccacacctagcttcctgtgctttagtggtttatcaagcgacaattagtaatttatgcttgagagtcttggtctcgggatcgagtcgcgatgtcggtctcgagtctccggaaattcgtcatcttgagcatcattaccaattacaaatatacatttttttgctttctctaaatgtgtccaggcacaaatgattctgtcccttatctatctatggcccttagctggggtgaaagacggcattttgtcatgacagagaatttatccctaggatatacctaaaaattaaaaacaattgtgatctttagaaatcaccgcctaggctctccccttataaaatggnantgnantgttnatgttnagataaatnaatnantttgaggnggtagaaggatggaanaaaagaataaa

SEQ ID NO: 51029 - DNA, 211 bp, Heterodera glycines
  Genomic contig location: Contig_ID=SeqID_20487; Location=911..1121; Strand=+
  SCN-specific regions: Sequence locations=1-211
atgctaattgcatttgtaagaaatgatcagaaaatgcaaatcagtgaatattcaaagcaaaaatatgaggcataccttggaactatttattttatgagcaagaattggcaatgtgacaaaatagcagatgaatttaagaatatgaacggacagaatgccaaaaatttagctaaatatctggactattttgtacgagatatttgtctagaaa

SEQ ID NO: 51030 - DNA, 732 bp, Heterodera glycines
  Genomic contig location: Contig_ID=SeqID_20489; Location=2..733; Strand=+
  SCN-specific regions: Sequence locations=1-12,35-59,112-300,322 -483,508-706,728-732
atgatgagcgacagaaagagaggaacaaaccaaacgacgaaaattctgtgagttaaagcaaataaaataaaaatgataatgataattcatttttaaattttacaaataattccttacaaattaggtaatttcccagttttaagtagagctgagcgggactggtactgaaaaaaggtacaaatgagtaccaagtcccggtttttcccggttttcccagccaaaaagtcacggtcccggtttttgtcaaaattcccggttccgctcattgtcagctctagttttaagtcattgttatctggaatttcccaatttaaactgtccgatcaaacaaaagcagggtgcggcgaaagctcccaagtctttctgatcaattgggtttcgtctgatcacccgttttttgtcttatcatttgtttttcatctgatcggaaaaattgtgaagtcctgcaaaccctgcacaatcacacgggtccatctgctgattattttcctcattttcagcattttaccactgaccaatcgttcggtgcttccgtttccggcgccgcctttaaaatgcctttcgacgagtgaaagtgaaaataaaatggaaaacgatgagccaacggaagcggcaaaattggcggaggaatttgccaccaaaaatttgacgacgaaagaacggatggatgccattctgaagatgatcagcggaagaagcggagaagaaggagcagaggaggaggaagagtaa

SEQ ID NO: 51031 - DNA, 274 bp, Heterodera glycines
  Genomic contig location: Contig_ID=SeqID_20489; Location=1603..1876; Strand=+
  SCN-specific regions: Sequence locations=1-112,135-274
atgatcaatctgagctccgacaattggaccgggtgccattcggccatttcggacgcactttcgcgccattccaccggggcggacgccgcgtatggcgacagtgagctggacaagaaagttgagaggagattctgcgaaatttttgagactgaattggctgtttttctggttgggacaggtgtggccaaattggcacttttcatggctaaattcccactttttgccccaggcaccgctgccaatgcgttgtcaatggcttatgtgaatcgcgcgg

SEQ ID NO: 51032 - DNA, 1550 bp, Heterodera glycines
  Genomic contig location: Contig_ID=SeqID_20491; Location=1120..2669; Strand=-
  SCN-specific regions: Sequence locations=1-111,134-286,312-878,902 -924,952-1133,1168-1307,1350-1370,1401-1550
atgtacacttgtgcctatgtgttcaccaactccgacttcgacttttacacgtcggccgagcttctgaacatgcgtgccccgcccttctacggtaataccgtattcatcggcctgaataaaagtctttcttcccgggttctgtttctttttaccctcccaaattcgtccccggtgcccttttgtcctttgtcccaatgaatgccatggttattcatttcccttctcagcttggcaacggcatttgttgttcgtctatttgggtgctcagttggccgttttcttggcacttttctctctctgtctgtccttccattggccctctcgtcgtctctccgccttttccttcgtcgctttgatggccgttgctggtgggtcaatgaatcggcggtgttttggccatgccaattcgctttttcttccacagttttggcacattgcgccgccactgtcactttcgcctttctttcccaaatggtcggaataagtgccaataaattagtcaactaaatgcccccgcttctcaggtcgaatatcgtttcttccacgtcagcgtcagcggaatttacgaggtgttttttcaattattctgttatgactttctccccccccccgccttttgattttctcttccgtttctaattttggcattttttgtctgtgccaatgccattttcatttgttcgcttcagaaacaccgcggctattcttttttcgtcgaatgtgctgccatctttgtgctattcagctcgttaattcctgcactgcttcatctcctccgattgggccgcgccgattcgcccccgggccaacaattccactccaagttacagtacacccgtgggacctctccaccgactctcgtcacggtatttttaattaattatttgagctgtttagtgctttctgttccagcaaagggatccaagcgaagagcagcagcagcagtgggaggcgcggttcgccatgcgcgagttgccgcctctgccgcccgtcgcgggctttcgatgggccgactgatcgaatgatcgacaaacattgacattttgatcgggtgatgatctcaatatgattgatgccttgaagacaatttaaaattgcatttattcacattcttcgaaaagtgaatcttttgaatattttccaccaatttttcttttgatttcttcgttttgtcctttggttgaatttcatgcaaatttccccccccccccccgccaaggacaatcgatagggtgggcaaccaaacggcggatgaatgatatgccctccgcgcttgccgagaatattgccaattaaaatatccacacttttatttatttttatatgtaattttaatttctaaataatttctctaagtaaaaagtgaggagaaataatttttaaataataattattttttaggaaaattaataagatttgattaattttgcattttcaattttttgctctgtattatatttttatacaattttaatcaattttaccatttaagattcatgacgtcgagaaaaagcagtttgcattgccgcaagcgatgaaggaaaaataaa

SEQ ID NO: 51033 - DNA, 833 bp, Heterodera glycines
  Genomic contig location: Contig_ID=SeqID_20492; Location=168..1000; Strand=-
  SCN-specific regions: Sequence locations=1-414,450-544,566-649,672 -735,764-833
atgccggccgaccagtgcaaggacgtgctctatttgacggttgtgccggacgtgaacgtgatcgcctccaagtgcaaagtgtacatggaggagctgagcaagtcagtccaatgggccgctcttccatcacaaaatttggctaattttttttgttatctttagcatgtatgaacggcgttgccgactcggcatccacgtgcccattggcatccgggaggcgccacgggacggcattttccgtgtgggtcgcgaggagagcaattcgctcagcagcggctcaacgccggcagccaccgtcgcaattcccacatttccgcactcggtgcacgccatgttcatgcagttcgagcccgagtttggtgacgacatgcagcccagtctgcagcgcttgcgaatgtccgtgttttaaaaatcaaaattctaaaaataaatctgtttttcccattttagctttgtcgagtgctgctacgccaagttgtgccgcttcttcctgcacaacgaccatctgtttgagcgtcgcgccttccacgagtccgcctatcgacagcagcaacagccgccccagggcacgtcgttggccacggtgccggacacggtggcaatgccgcccccggctgtaccctccggcggaagtgcgcttggcaccatcggcggctgctcctcggcgggccctcagtcgggaccggcttccgctaccagtacaatgcttcaccatcatcacaccggcggtcccggctcgtcctcctcctccggctccgtgctgcactcgtcgccgatggcccaacaccaacaccagacttcgcccgccacgggcaacaacgggcccaactcgg

SEQ ID NO: 51034 - DNA, 1277 bp, Heterodera glycines
  Genomic contig location: Contig_ID=SeqID_20494; Location=303..1579; Strand=-
  SCN-specific regions: Sequence locations=1-375,437-1009,1031 -1054,1076-1277
atgcattgccttttctcaattgtctacacgattctgaccatttttatggttgcgcacacactttccaagggcaccgtgggcggccaaccgatgaaaacagagcgggtgagttcggtataatttagttggttcgggacaaaggaaccgcagggaatatttttatatccatgagtcatcgtcgtggcatggcattttctgcttatgtggtcgtggcatggcattttctgcttatgtggtcttgaccgtggacatttttgattatgccggtcttgaccgtggacatttttgattatgcggtctcggtcgtggcattttttggttgtacggtcttagtcgtggcattaaatgccacggcgacgactcgtatcgtgctatggatgagttgggtatatggatgagttgggcatggatgagttgggtttggatgagttgggtttaccccatccctaagaaatgaaaatttctcaaaaatttctcttcaatccctaattttaagggtttgagactattttccatttttagtgcttattttggcggtttttgagctaaaaatttttaaactcacatttattgggcaaaatttagtcaaatttacgaaatggccattcatggatgtttcaattccaaatcttggccgtgtatgcccctgaattcctcgcactattaattaaaaacgaacatgaatatgtacaacccattatttatcttcattttgtttaagccagcactttaaattataactgtcactcccaaaagtgaaagatgactgctaaaaatgtgtccccatcttccaaagagagcagttgttcaaggacttcttgcaactctgacacgagtgaaactcgtccactttccatttgcaacgcgcaatccatcgtcaatttccaaaagtcattgcgcgtttacaacggcaaatcggtattttcttagttttttagttttggctttattgcaatttacacgaccataaaaaaatagtttttgcccgatatcgaattttcttggctattttattctgctttattttcttacattattgctatgctttagccaaattatgcattaaattgaaaaattagtaactttaaaaagggttccgattcgctattcgaaatttgtccatcatccagaataggttacccatttattattttggtgtgcattatgtgattttcgaggacgctactcagatttgtcacatgatgtcacctaatctaatattttcaaatctcggttttttcaagtgtctgttttctcaaaaatgcgtcaaaaataaa

SEQ ID NO: 51035 - DNA, 1026 bp, Heterodera glycines; identical to SEQ ID NO: 20495
  Genomic contig location: Contig_ID=SeqID_20495; Location=1..1026; Strand=+
  SCN-specific regions: Sequence locations=1-210,232-403,425-1026

SEQ ID NO: 51036 - DNA, 1197 bp, Heterodera glycines
  Genomic contig location: Contig_ID=SeqID_20496; Location=184..1380; Strand=+
  SCN-specific regions: Sequence locations=1-561,583-975,1004-1197
  Gene Ontology: Cellular component=extracellular matrix; Biological process=cell-matrix adhesion
ctcaaatcccctttgcttgtcctttgttttgtggtcccttcgtccttttccgatccgtgtccctttttcggcgattaccaatgccccgagggctttcactgtgcatttgacaaatgccaagatgagcaggggattgagccaccgggcgattgtgccaaagtcagttatgcgcctcaattaaaacgcgaacgcatcggatagatcagatgtggcaaggaatcggagtgtcggcaaggcaaatgcgttctttatgtggggcgaccgtgcggaaggaatgttttggtggcggagggattggcccgtgcggtggtatccgattgtgggccccaaggcaaatgcattggcgggcgatgtgccattgacagtaagcgaaagaagcgaacgatggcacaattggaaattgaaaggatgtgcggacacagtctgtgaggagatgagcgagctttgccgggatgggatgtgcatgcaattgtcctccatgttctgcttctcgcccttcgattgcggccctccgtcacttttcgagtgccatcaaaacaaatgccaacggcgtcgcgacacaattgttccagttttttcaccatcggcacaaaaatgtgaccccggagaaactctcagcggtgataaatgtgtgactcaggaaggtaatcagcaacagctggtcctcttttattcccactgcttaggatgtgctcaattggtttgctcatccggccaaagctgtttcaatggcttttgcgtcccgacaagcaattccaattgcgctaattccggtgaatgtgccgaaatgaatatttgtcgcgaaggacgctgtgtggcggacatttgcaaagcaaatggtggcagatgtctgccggagaatgcctgctctccggtgagtgtgcccgagggcgagtgccgtcccttccagggcattccgtgttcgctctctgccgctgccgaggactgtcccccgccatacttttgcataggcggaatttgttcaaaagatggtgagtggcagtgacatggcaacaaatacaatgactccccgccaaagagtgctttcgcaaagtgtgccaaatcggagaacgatgcgacggcggaatttgcattcgcgtggagggcaacggatgcagagacgcgatcagagagtgcggggagcacttcgattgtgtggccggctattgtaaggacagaatcagcgcgtacaaagag

SEQ ID NO: 51037 - DNA, 286 bp, Heterodera glycines
  Genomic contig location: Contig_ID=SeqID_20498; Location=787..1072; Strand=+
  SCN-specific regions: Sequence locations=1-139,201-286
atgcccttagatcggttggttgccttcttatccataaatgtgcatccgtttctttcctctgtctctaattccacaaatcccaccacacaactgagcacgagtcaaaatatgtaagttcagggcgtccgtagctgtactcgcggctgctgctgctgctgctggtgccgaagcagcaacaacagtcaccactgctgctactggaattgttgaaaatgaaaatgtctcctccaccccgtcgcccgccgttgtcagctgcagccaaaatgcacgagcaaatggcgattag

SEQ ID NO: 51038 - DNA, 910 bp, Heterodera glycines
  misc_feature (32)..(32): n is a, c, g, or t
  Genomic contig location: Contig_ID=SeqID_20498; Location=870..1779; Strand=-
  SCN-specific regions: Sequence locations=1-83,105-423,449-474,499 -793,855-910
atgccaagaaaatcattgaacatctcaccccncaaacggaagaagaacggggatcagcaggagcagcaccaagaaagcaacaatgacaaggaaaaatatcaaaaatggcttgaagaaaatgctaaattatacaagacagtctacgcacggttgtttcctcaaaatgatgacggtaatttacagggctaggattttaggtgctaaaaccgaaaaataggttgtaatcctaatagatgctaaattcgattgcaaaattatattcaaacaaatttcaagattttcatgagtaaaaagttttcgattgtccgccaaatcatgaccaggatttttgatttttgaaaaatcgattcttagaaaacctaagcatagtcctagttatttgttttaaaatggctaaggcgagggacttacacctactgtgatagtgcataaaaataaattttaattagcagttttggtggtaattagtagaggaaattcattcatttttcttttaatggcatatgctgtattctgaacattgcttaaattttttgctttttaacccatcagatgcaaaaaagggacggcgtcggcgtaagcgcggattcagaggaggatcagaaacttccggctgttccagaagccgcgtggattggagcgcatggctccaatgcatcagcctgattctgctgatcatcattctcatttgtctgatcattgccgcactaatcgccatttgctcgtgcattttggctgcagctgacaacggcgggcgacggggtggaggagacattttcattttcaacaattccagtagcagcagtggtgactgttgttgctgcttcggcaccagcagcagcagcagcagccgcgagtacagctacggacgccctgaacttacatattttgactcgtgctcagttgtgtg

SEQ ID NO: 51039 - DNA, 778 bp, Heterodera glycines
  Genomic contig location: Contig_ID=SeqID_20499; Location=109..886; Strand=-
  SCN-specific regions: Sequence locations=1-3,27-49,118-214,259 -266,288-385,416-505,531-532,556-694,744-778
atgataattttatattatttttttatctcatatactggtaaattcattcattattatcatattctattaatattgttaaaagtaaaaaataaacaattataattctttttttatttagtgttgctttgtatgggattatcaacaaaggaattgaaagatttgaacacacaaattgatataattaagcatgaaataactgaaacaattgggagggtaattttgaaaaaatattttttttaatttaaaaaataatttttaggaaaatgaaggaaaagaaacgatggatgacaaagtgatcaaaaagttggaagacattgccaatgccaaaattgtcattgaaacgctgagtaactttgccataaatatgacagcacaagattatgcaaatttaatgttttttgagaaaaaatttacaattcccgaaatccaagaggagcataatgccagaaaagaaatgaataaattgcaaattttgaaaaaggaattggatgacaaaattgaagaagccaaaaaattctggaagaaaaatggaaaaggacgcaaaaatcaaagccaaacagaaattattgaaatgaaagtgaaacttgagttgatggatttgatgaaggaaagcaatttgctaatgacccgacaatacgaaaacttagcgaaagaatgcgcaaaatttggagaaacggaaaaaaatgagtggggcaaaaaattggtggaaatgtttctcaaaagtttaaaagaaaagatggacaaattgagagaaaaattaacgaaaatgattggatga

SEQ ID NO: 51040 - DNA, 1716 bp, Heterodera glycines
  Genomic contig location: Contig_ID=SeqID_3599; Location=3431..5146; Strand=-
  SCN-specific regions: Sequence locations=1-88,110-403,427-768,790 -924,948-1200,1222-1267,1291-1387,1409-1716
atggacagtggtcataataatcaacgacattacaactttcgccgccgtgtaccagtgaattatatggagcaggagtcaggttcatcacaatggtctcaaaatttggggaatttaagaaattctggacagcaactaaacgaaaacactcatgcgattgtgcaaccaaacaatgcgcagggaaatttttccaatcaccccctcgaaaatcagcctttcccggcccccgctcaaaatcaatcaaaccctcaaaactctaaccatggacagcagcagctcgcagtccctctgaaccctgtcataaattttttcggcgggaacgagcaaaacattggaaacccccgtgcggcgtcaactccaatttcaccgcacatttcttttcaagaagggggcaactattttgtgaattttccccgggaaatgcaaaatcgagatcttgttcagaaccgatataatcataaccgccaaaatcccgcacaaaatttttataaccctcgcgtgtttgtgaattcacagcttaaccgaaacaatgaacggccaaatcgaaacgagtttccggttcgggactcaaatcaccgaatgcattcacaattcgccaatcaccaaaacgagcaatactcggctcgagatgctcggatgtaccaacatttgtcccgacaagaggcaaattcgaattttgtgcctccattgaacctgcaattctccgaaaatgaaaaccgacacaatcatggccagtttccgaatccaagaaatttccaacaaaatcccgaaatggtttatgcacagataaatccccctgtttaccaaaaccaagcgttcccagcccaaaccattcccatcccggacattattatggaattacacaaagtcacactctccaaccaatatgcaaacacaatgagagaaatcccaatcttgaacggaacggaaggaagtgacaaaatcaatgatttcttcctgactgttgaaatgtgtgttggagagtggcgacatgaaaaaaagctggaaatgttgaaaacgaaattgaagggaaaagctctgagggcacttaacatggcactgagtaaatttggaaataccgcgccattcgagacgataaaaacggaaataatgtcgacattgagggagacggattacaaggaagcaagtgcttttcaggaacttacacagacggggaaacgaaaggagggcgaaagtgttatgaaatttggtgaaagaattcaaaggctggtaaattgtgcccatattggtttaagtgaggcacaaagagacgaaatttccaaaaaatttttcgttcttaatatcaatgacacgaacatggcaaaatttttggagtgtcagtcaaaaccgtcccaaacatacgacgaacttttaatggtcgctaatcgtcttagtttggttgaagagaaaactgaggaacgttcggttcaaatccgaaattcacaaaatccattccacttgccaaacgcgaaccaaatctcataccaaaacgaacaaagtcgttattttggtcaaagaaatttccaaaattcttaccagcctcagccaaaatattttggaagaaccgggccaccgagtcattcttacggaaacaattttggaggacgaaattttccagtgaatcagaattttaaccggtaccctagcaatcagcaaaacagaaattttggcaacgaaagggcacagagtaacaaaccgagacaaaacgaaaagcattga

SEQ ID NO: 51041 - DNA, 981 bp, Heterodera glycines
  Genomic contig location: Contig_ID=SeqID_20501; Location=956..1936; Strand=-
  SCN-specific regions: Sequence locations=1-226,262-281,308-359,382 -387,409-413,435-453,475-607,688-877,922-981
atgacaaccatcgacaaagaaatacaatttatcaataatgaaattgtcgcaaggtggaaaaaagaaagaaaaattattatggaggcagatcgtttagtgtcatattgtaataatatttctttctatgcgaaaatatatatgatcatcgcatttagtgctccaggaatacatcaactatatgaaaaaatattagagatagcgcaaaatattaggctactatatctacaaattttaaatgaatataaaaatatttcaaaaattcttcgtgataatgagaattgtttaaaatataaaaatataaaaaaatgtcaggaaaatgagaactcttcaaaacacagcatggcaacctgttataaatacaggaagcagctgagaaaatttcgtacagaaattgatgatttattcgaaaatattgtatcattagctaaaataaatccgccagaagaatctatcaaagacaaaaatgataataatcgtaatgaaatattttttacaccataccgtaggaaccgaattatacatggacaacaattatcagaaatttttttgaattgaaaattaaccactaattactaaataatattcgtcttctaatgtggtaatgcggttaaataattatatttaacgtatttaaattttaaaaatggatttattaataaactatttgtaataatttcttatattatagactctaatatgttgatgcagtgttgatttcaatttattctgttttctaattggtttatttgttatattacttttcatttgaactctcatgttttttatttatttatttacttgattccctcattctcctttacttttcttcagtttatcctcactaatgatccaaaacaatgattattcaaagtatttcaatatatatctaatcaataatttttaatatttttttaaatatttcgtatacaaaacaattcaaaacaatctatcttgctgtttaaaaaaagaaaaaacaataaa

SEQ ID NO: 51042 - DNA, 516 bp, Heterodera glycines
  Genomic contig location: Contig_ID=SeqID_20504; Location=682..1197; Strand=-
  SCN-specific regions: Sequence locations=1-516
atgtcgataaatggttcgtgtgtgaaacgttttcccacgaatttaaaatggatttctctcaaggaaaagaaagtcaatcgcgccgaagtgatgagtttggctgaacagattattgctccggaagtgaacgacaatgagctttttgacgaaattacggcgctgaatgaaatacttgaaagtatttctgacgagaaatttggcgaaatgaacgcagaacagaagtggatgaaggttttcgaggcggaattacccaatcttgtgttgctcgtcaacaaaattctttcaattcccgtgtccaatgcatgcgtggagcgcgtcttctctctttgttcagctcagttgactgatgtgcgcaatttattgaaagttgaaaccgtgaaaagtggcccaaatcaaatcgaattatgatctcacttgcactgaaatgtacgatttgctcatttcctcgccaaaattgttaaaaatgatcatgggaggtgaaaaatataatatttaatacatttttgattgaataaa

SEQ ID NO: 51043 - DNA, 691 bp, Heterodera glycines
  Genomic contig location: Contig_ID=SeqID_20508; Location=1137..1827; Strand=-
  SCN-specific regions: Sequence locations=1-42,68-81,103-338,371 -384,612-691
  Gene Ontology: Mol. function=protein binding; Cellular component =axoneme; Biological process=eye photoreceptor cell development
atgaaagcgagttgtctgactggtgcgtgagttacattttttaagaaaattatgagaaaaatttttgacaaattttttactcgtgaaaagggatcacaattccttttcaatttttttcgataaaatcctaatcaaaccaaatttccttgggtgtctttcattagctcttactttttagaaatccttcgaaatttcattcggaaatttggctgggcaaaagaaagttaaaactaaaaagttgtgaaatttgattaacttgagtttttcgagttattttggtcaattttttttttaattttgcaggtttaagaacagattaaaaattaacaaaaagaccaaatgtttttgatttatttgtttaaaaaataattaaggggtgcacatgatgaaatggaagaaggaaaagaggaagagaaaaaggaagaaggagcagatgaagagaaaaaggaagaaggagaagaggaagagaaaaagggagaaggagaagaggaagagaaaaaggaagaaggagaagaggaagagaaaaaggaagaaggagaagaggaagagaaaaaggaagaaggagaagaggaagagaaaaagggagaaggagaagaggaagagaaaaagaaaagtggttgattagtgacaaagggtgaggattagtttgtcaaaagacaattctagaattttgcaatagaaatttattaaa

SEQ ID NO: 51044 - DNA, 552 bp, Heterodera glycines
  Genomic contig location: Contig_ID=SeqID_20509; Location=963..1514; Strand=-
  SCN-specific regions: Sequence locations=1-486
atgaagaggtgcaaatgtgatttaaagaggtacaaaagtgataaaagatacaaagtgataaaaagaggtacaacagtgattagaagaggtacaacagtgattagaagaggcacaacagtaaatagaagaggtacaacagcgattagaagagtgattagaagaggtacaacagtgattagaagaggtacaaaagtgattagaagaggtacaaaagtgattagaagaggtacaacagtgattagaagaggtacaaaagtgataaaagaggtacaatagtgattaaaagaggtacaacagtgattagaagaggtacaacagtgattagaagaggtacaacagtgattagaagagttacaactgtgataaaaagaggtacaacagtgattaaaagaggtacaacagtgattagaagaggtacaacagtgattagaagaggtacaacagtaaatagaagaggtacaaaagttaacttgttatgagatgtacaaaaataatatcataattttatagaattaggtttatttaaaaatttaaaaaaaactaaataataaa

SEQ ID NO: 51045 - DNA, 1788 bp, Heterodera glycines
  Genomic contig location: Contig_ID=SeqID_20510; Location=753..2540; Strand=-
  SCN-specific regions: Sequence locations=1-97,119-130,173-268,291 -312,335-354,376-418,466-577,599-635,799-835,1010-1093,1117-1446,1472- 1661,1722-1788
  Gene Ontology: Mol. function=voltage-gated calcium channel activity; Cellular component=apical plasma membrane; Biological process =epithelial fluid transport
atgaactataagatagtttttcaggtttgagttaagacttttttggggcactgtatttctctcacaaaaatgtgatttgattgggaaatattaaatagtaaatagaaattataattatggccagcagatctaattaatagattaaatagttatattattaattaattaaaatcattattcggtactgaaatgacccgccccttccgatcaccactcattcggactttttgcacttcgactcaccacgcaaaaaatcctatggaaatttatttaaaaattggaatgtaaaatgaaattgactcgcttcttcgagtttttaaattttctgaaatggatctcaaaaattgacatgtccaaaccctttttggggaaggggtaaaatttatgcaaaaaatcctccgacaaaattaattcctacaaaaaataaattaaataaaatgaaatttaaattctaatttaaaaaaagcatttgcagttggtacggacaaatctgaaaatttacaccgatgggaacatcgacgaggccaatgagcagctgcgggcggcaatccgtcgcatttggaagcgaacgccgattaaaatgctggacgaagtggtgccaccggcgggaagtgagtggggggggggggggcggcaattaattaattaatggcacatataattaacattaattaattaatttataataaattatttattttttatttatttatttattaggtagttgaatactttattaataaaacacataatattggctaattagcagggaaaatataataattaattaaatatttatatttatcagacatttttgaaattgctaattcattggtttaattaacttaaattaaacacaaaatttaatttgaataattaatttttaaacaaagtataaaatttatctttttaaaatttattaactttactttttaggacatatttaaaaattcactttatatttattgatttaaattaaaactaaattattatttgaataaataattttggaatcaaaattaaatttttctttctattaaacttacttttttccccaattaattcattttcttttacaggagacgacgaagtgaccgtgggcaaattctacgccacctttctgatccaagactatttccgacgcttcaaaaagcgcaaagaattggaggccaagggaatggcggcaccgaacactcacgcgatggcactgcaggtgatttggccggccgatcatttggtgccaaaaacgaaaaaaggggcaatttgagtaccgcaaatcgagtcctaccattggcatatgatggattttgtccagcaaagtataaaaacaggagcaatgatttccaagatggatcccacaaccttaaatcttggccaaaaatattttggttttattttgaggcaccgaaaatgaaaagcaggattcggcacggcacaccaaattggaattatttatttatttatttaaaaacacaaagtctgcccatgaatcagtccatgcaaatctattagacaacatttttaggccggtctgaggacactgcacgaaattgggcccgaattgaagcgggcgatcagtggcaatttggacccggactttgtgcacgaagcggaggaaccgcagcatcgggtgaaaatgcatttagtttacatatatttgctaatttatttttattaaattattcttttttaatttaaatatttttatatataaattttttgcgatagttttttaactgatttttttcaattcaaaaatttaatcgcattttttagtaaattattaaa

SEQ ID NO: 51046 - DNA, 890 bp, Heterodera glycines
  Genomic contig location: Contig_ID=SeqID_3600; Location=1140..2029; Strand=-
  SCN-specific regions: Sequence locations=1-55,77-201,223-255,277 -286,308-890
  Gene Ontology: Mol. function=adhesive extracellular matrix constituent activity; Cellular component=collagen type XI; Biological process=positive regulation of body size
atgccatgcgttatctgtccggcgggcccgccgggccaacggtaacatctcaccagcagaatatataaaataatatagtacgataaaaatttatttgcaacgagaaacgaaaaaagcaggacggaatttcccgaagcctttttccctttcccgtaaaaattccgttccggcaaaaaggcggttaacaggttcacagggcttcgggattcccgggttttccggcgggaatcccattcccgccgatttctataaaatatccaaatggaatgttattttgtatgcaattccagaggctctcagggggagcgcggacgtatcggagaggcgggcccatcaggcgaatacggctcagagggtaaatgcaaaatttactgttagattccatacggacacagcgggagaaaaaattttatgttttcaggcaaagaaggaattatgggcccaaatggagcacgtggttacgttggtgccatgggaataaaaggggtgccgggcaggcccgggctgcagggtgaccaagtggtggcaggcaagtgacagtccgtccggcagcaaaaaaatgaacgaacattgcaattttaaggcatcggcatcaaaggacctccggggcctgtcggagcatcaggccccaagggtagggagcaatattttttgggaaaaaaatgaagaatatatacattgccaaactatgcatttgaacagttaaagcctaattggtcaatatgggctataaatccgggtttttctgtcgagaaaaagcggttgaaatattacaaatcagggggtaggattaaattgctgtacagcaattccgggatttttggccggaattccacattatagcctccgaacaactcttgatacacaacataatatgattcatcaataaa

SEQ ID NO: 51047 - DNA, 874 bp, Heterodera glycines
  Genomic contig location: Contig_ID=SeqID_3601; Location=192..1065; Strand=-
  SCN-specific regions: Sequence locations=1-205,227-326,348-568,601 -647,690-832,871-874
atgggcattctctgcagcacttgtgccctgctcgttctgctgttcctcgtgccgataattgtgcataaggcaaacattttgcgtgcagaacttgaggtgataaatgacaaaatgccaattgtctatgttagcatttggagactgtaaatgggctcaaagttactgttaaaaaaagaaaaagttttacctgtattaagtctagaccaaaaatcacaggaccgaaaaatcattttctatttaatggcaaaaaaatttttgctatttatttttattttcactatatctgtattggatcaattgtaaatgggtcaaatcattgatcaaagaatttatttcgaaaaatttcgttcattgattgatcaatagattattgatgcgaaacacatggtttgatcattagtgattcatcaccattatcccctcatctgcttgtttaggaaatgtccgttcgattcaagcaaaactcggacagggcgtggcaccaaatgatccaaatggagccaattaatgataacccaacgatgcatacaacaattgttgcaagtcgaccggcacgtgcatcgtggaacaaacacttctgccaaggctgtcattcattggcatgcgcaagtggcacgccaggaccgaacggcaaatgcttacagcagaataaatattaattatttcaacaaattaaatattaattatttcaatttccttggttttcaggtcctccggggcctgacggttcgcccggagaggtagaataatgcctttttacatgtttttatagccaaagttcccgatcataatagtgaatttttaagcgggaagttaaatcatgcatgtaaacaaaggtttttgggaagaaaaaataccaaaattttaaaataaa

SEQ ID NO: 51048 - DNA, 1530 bp, Heterodera glycines
  Genomic contig location: Contig_ID=SeqID_3601; Location=3312..4841; Strand=-
  SCN-specific regions: Sequence locations=1-193,215-476,499-1228,1250 -1360,1388-1500,1523-1530
atggaaatttttactcgttttcttcacttcaacaattccctattcacaacaattatttgttcgtctccaagtctcgtcaaacgtctgcatttattgttcatcaatccttcatcggttgccacccgcgcgcacttcaaaatggacgccctcaaaagacttgcgagccgtgcacggcaggtaaaaatgaacagattctggggagtctatttttaaaaaatgccatccctgcacatttcagaagtcggcggagatcattctgagcgcggagaagaccgaaatcggtaaggagggcatttttggatttccaaaaatcaaaaaaaaaaaattccccaaaattcaggcgccgagcttgaacaattgctgaccaagaccgacaagacggaggagcacatgaagaagctggtgcatgccatcgaggtgtacctgcagccgaaccctggtggacacttggaatttgcgcttttttgaggaaaacactaattttttcccccaattttcagcagtccgagcgctggacccgcgaaaggacaaatccggccgacagaacacgctggacggtcttggggaggcgatgaaggtgtggtttttggcattcacaacacattttaatgcccaccaaaatttaaggaagcagcatcgaaagcggtgggcgccgagtcgaccttcggaggtgagagaatttgaatcggaaatgctcaatttaattaaccccactaattgcattttctgttcttttcagccattctgctgaaggtgtcacagacggagtccaaaatggcagcaggggaacgccaactcatccaatcggtcaccacgcaaacattggcaagcctccgacacctcctggagaacgaactgcgcaccgtccaggcgtggatttgcaatttttcactcaattttcgacaatttttaatccaaatccctcccttttcctttacagaaggaacgcagcgtgttgaacaagaaacggttggatttggacgcgacaaaaagccgttggaagcgcgcctcggacgacaaaaaaccctctgtacgtcgtgttattttcgtcgccgactccatttttcaaccattgactaattccactgtttttcaggttgaggcagagttgcgcaaagcccaagacgaatttgacacccaactggagaccatcagcactgcgttggaggctcttcaaacggccgtggtgagaattttacacccagaaaaaaaattgtttgacaaaatttcaattattttccaggatcgtcaggctgaacaattggtgcagttcgtggcggcacagatcgaataccacagcagcagcctcaaacttctgaaggacctgaagcgcgacttgggagcctagtgattgatgagcacaacagcagcagaagaagaagcagacggatgatgggagatgaattgccatggaaattcatattggacatacccatatttgtgtattatactggattaatccaaattgatgcgtatatagcgtatatattacttgtaacttgtactgtacataattgtgtgtataataaa

SEQ ID NO: 51049 - DNA, 1510 bp, Heterodera glycines
  Genomic contig location: Contig_ID=SeqID_3601; Location=5539..7048; Strand=+
  SCN-specific regions: Sequence locations=356-360,407-606,628-982,1004- 1364,1387-1420,1454-1510
  Gene Ontology: Mol. function=calcium-dependent phospholipid binding; Cellular component=synaptic junction; Biological process=synaptic vesicle targeting
atgcccatttctccaacaacgcccccttattcgccgcccaagaagcctgatgatgctacattatcgcccctcgagcagaagccagttgataaatcgccgcttacgaagaaatcgaaggcaaaatctccgttcaagaagaagcttggcacgaaaccttcaaagaagaaggctggcgccaaaacaccgttcaagaagaagaagcttggcacgaaaccttcgctgaagaagaaggctggcgctaaaacaccactcaaaaaggagccggaggataaatcgccgcttaagaaggagccggaggacaaatcgccgcttaagaagaaactggaagataaatggccgcccaagaagcccgacttttcttcaccgtccaagaagcccgttcctctgccacgtgctgcaccgggtgccaaagtgagttttccgcaatggcaattttctgtggcatcttgtctaattacaaacacaattaagactgctgccgctgcttctcgtcaaccgatcaaaaaaggcgccgctgcatcacctctcaaaaagcatgctcttccattgcgtcccctttcgccggcgggcaaacgaccggctcctcatcctcctcaacgtccactaacagcagcgaaagtgaaaactgatccatctcatttttgctgtactttttttaatcgcaacaatgttttagcctgttgcccttcctctgcgtcctccgtcgccagcagctcatgggcaagcagttcatcaacctgtccagcatggtctccatcaacctgttcatccttatgcaccgcctcatcagcagcagccaattcatcctcgttattcaccgccacaaccgctgccattccaaatgccggctatgccaacaattgcgactggtggtggaccgctgatccaagtcaacgtgcaacgaaaagagaagccgacgccgcaacctgttgcaccgttacgtgctggtgtgaagcccattccgctacgaaagccagtgaaagctgatgatgaggaggagcagaacgcggaggatgacatgtacagcccaaaacagcaacaaccattggaccatgggacaccgaagaacgcacttgacgaagatgacatgtacaacgtgccggacgcactgaaaagcgaccatggcagaggtgacgtgcaacagaatcatggtacgacgacaccgaacaatgctcttgacgaagatgacatgtacaacgtgccggacgcactgaaaagcgaccatggcggaggcgacgcgaaacagatgggtgcaccgaagaatgatgtcgacgaggatgacctgtacaacgtgccgaacacaacgaaggacagtacagacgacgatgacttgtacagagtgccgaaatcatattaatgttgtaacgtgtgtctatgtatgtatataaaagtgccaccccctgcgtattgtgcctattgtatatatattttatgttaatgtgcttgtttggttgtgattgtaccattacgtttgcacataaaaaatttgatttgtgtttcatataccaaa

SEQ ID NO: 51050 - DNA, 823 bp, Heterodera glycines
  Genomic contig location: Contig_ID=SeqID_20512; Location=257..1079; Strand=+
  SCN-specific regions: Sequence locations=1-204,232-427,450-823
atgatggcctgttattatttggcagctaaagttgatgagtttaatgtttccattgacaattttgtagacaatttaaggtaaaacattatcatttttattaattttttccgttttttatggaattattttcagaaacggcaccagacaatacaacacggagaccatcttaacactcgaaccggatgtgatgcttaaacttgtaagaattgaaaaataaaattgtttctttttaagactctttaattgttccgttagaattacaatttgaccgtccacacgccctaccgccctttcgaaggccatctgattgaaatgaagactaaaattggcagacaattgtcagaaattgagttcgacttggaatcaatcagaccaatgtcaagcgaatttctgaaggtctttctttcctcgcggaatgatttttcgcaaaatgaaatcacttttcagaactctttgctgagtgatgcgatgtttctttactccccttcacaaattgccttggcagcggtgaaattcggcatggataaagcattgggaggtgctttttctctatccatggattggtttcgaaacaaatagttaaattggcagaagtccgttcctccactttaatggtcgactttctcgccgctttgctcgacgtggacatcggcgacactggcggaagaggcacagcagacattttgcagttggagaaactgcaagttcggcttgaccaaatctgcaaattggttctacaacaatttgcccagggcgtaagtgccgaagaaagcgcatcccttcaagtcagtttgacagagaatatcaaatgtattttagtgaa

SEQ ID NO: 51051 - DNA, 1101 bp, Heterodera glycines
  Genomic contig location: Contig_ID=SeqID_20513; Location=326..1426; Strand=-
  SCN-specific regions: Sequence locations=1-547,569-1101
atgctggaggacgcagaaaagaccggcacagacatcactctccaaaaggtggaagaggaattgaaggcgattcaaatcgtcaaggaaagtgccctttctctgcttactcaaccggtctcaaccagcgccatccaattgcgacctcagcaatggcgagagaccatcaaaggcaaacacaaggcaaaaccggcacccaaatggccacatcatgaaccggcacccaaatcgtcacatcatgcgccttcgcctaagcaaaaatcggacgacaaagcaaaccgaggccatccatcgcatccatgcgcatcatgcggaagcaacgatcactggcgatcggactgcaaatttgccaacgcattttgcaacaaatgcaaccggcaaggccacattgcgattgtctgccgtcagcgctcgtcgaacacggcacacaaatctcagaaccgatcatttcacacggtcgtggtcaagtcacattgtatggtgattggcacaacccaaggccgatggtggaagatcccggtcacgatcaatggcataaatttgaagatgaatggagacagtggagcccaagcaacagtcatcagcttcaaaacgtggatcaaattgggtcaacccaaactctctccaacggacatcgaaacccgcaactgcaatgacaccgcattttcaaccgaaggaaaatttcattgcaccgtcagttgtttcgatcggccatccaaaacactgatcgcttacgtcagcagtgacttaaagcatgatttgtttggccttccgtggattgaggaattcgagctcatcccaagagaaattttgttcccaaagagcatcaaaggaaagccaaacgcatcaatcaacgccaatgtcgtcaaggcaacaaacccggcgattggcattacggatgaatcctcgctcaccgctgtgttgcaaaaagattttgaggaagtttttaagaacggacttggccattgcgcaatcaaagcgcacctgattctaaaaccggacgcccgacccatcttctgtaaagcacgaccagtcccccatggtgcaatcgaagctgtcgacaccgaactggaccgcctcttgcagattggcgcaatcaaaccg

SEQ ID NO: 51052 - DNA, 618 bp, Heterodera glycines
  Genomic contig location: Contig_ID=SeqID_20514; Location=284..901; Strand=-
  SCN-specific regions: Sequence locations=1-86,130-541,578-581,603-618
atggtgaccaaaatggcaaaaatagtaatttttggtaaaaaacggctaaaaaattttagatttctcggttcccgatcccgagtcgagaaatttctagggttttttggggtctcggtcgtttcccggggtcatttcccggtctcggttctcgattctcggtaaaaatcatttctcgcacatccctaattattgcctgtcaaattgtcatcacaaagaatcaaatccgaacaatttcgaagtgtgattcacgacaaagggtcatccataattccattaattggacgaaaaagcaatttgataaatgtaattgttcaactttcactcttaatgagtgttaaatgttcagcacaatgtcgctgagcttcgccgcgtgcacgtcgatttgggggagcacagagtgggacagttcagtggacaaaccggcaaatatgagtacaatgcggagaagcaaacgatggaattcgaaaatttggaagtcgagaaggacgatggcttctgattattgaagtttaaatgcgattcttatgccattttcaaaaggaaaaattattcaaaaaaaaaaaaaaattattttttacacagtgatttctatttatttatttggaaattgaaaataaa

SEQ ID NO: 51053 - DNA, 1028 bp, Heterodera glycines
  Genomic contig location: Contig_ID=SeqID_20518; Location=1..1028; Strand=-
  SCN-specific regions: Sequence locations=22-151,173-292,352-422,448 -503,531-544,582-598,620-632,671-708,893-971,997-1028
ataaatgcctttccaattttcactaattgtcgcaatttttgcgctttgcgccgtccctttcactttgggccaacttcaaaacgcagtgaaaggcaaaaagtgcgcgaaagatcaggtgaagtgaaaattggcaaaattcaattttgaaaatccaaaataaatgtttaattcccaaaaaatatttgaaggtggtcaacaaattgacggtgtacgaggacggcgccattgaggccgagtgcggcccgttgccgtgcggttccaccgcttcgacatgcgcggaagtgaaacttgcaaatttttaatatcaaaatttagaatttaatttttaattaaaatttaattcattaattaggacttgagcacgtgcaaagcgccgtcggaagtgttcagcggaatgaaatgggcacagaatgggcaaaggcaaaataaaataaaaaatatttaaatgaaaagtgttgcaagtgtttcttgtttttaagatttgtgctatttggagaggtcgaagaattttggaaaaaatttgggtttttctcaaaatgttttcaattttaaaaatatgtactttaaaaaatatttattttcgaaattcattttgttgataaaagtaaaagttaatttgtggtaatctgatgttataatgtttaatattaaaaaaataaagaaaaaaaaacataaaagataaaaggcataaaatttttaccttttacaaattaattggtaattaatttaataattatttgtttgttattaccttttacaaattaattggtaattaatttaataattatttgtttgttattaccttttacaaattaattggtaattaatttaataattatttgtttgttattaccttttacaaattaattggtaattaatttaataattatttgtttgttattcttcagtttgttgctccgatgctgttcaatgcgtgcctccaacaagttgtacattggcacagaccttgtcacattggtaaaataaaaaataaattccatttttgcttttttgaaaatttacttttt

SEQ ID NO: 51054 - DNA, 527 bp, Heterodera glycines
  Genomic contig location: Contig_ID=SeqID_20519; Location=365..891; Strand=+
  SCN-specific regions: Sequence locations=1-124,179-527
aattttctgctgtcttttggcgagaaagtgatcaaaaatggaggaagaaactcggagaatggaccaacggaaatcgaaacgaaaagcattggccaattcggaaagaagctcagggggaagttgaattttgggaggaaagcgcatggcttaagcaattaaaaataattagttaattagagggaagttgaattttcgggggaaagcgcatggcttaaagcaattaatcgaaagcgaaggtccgttttgaaaatgccggttttgccctcatcagttggcaaaatgtactttttgttttatttaggttaaattaatggggaattaaatattcaaataggctttatgttgataatttgctttattactgatgtggattgagagtgagttttgcgctttcctcacttttcttattggtgctcattagaagagggcaatggaacacaaaaacggcaaaaatcaatgaataacaaatacaaatgtgcctaaatggcgttggttctcacagtcagaaaatggcacaaaatggaaaa

SEQ ID NO: 51055 - DNA, 521 bp, Heterodera glycines
  Genomic contig location: Contig_ID=SeqID_20523; Location=153..673; Strand=+
  SCN-specific regions: Sequence locations=1-87,110-259,297-521
atggaagcgagccactggcactccgccgccagcagtaatgctattaaatgagacaggaacaaacattgagccagatttgcccaggtcgtacaaatccaatcaaaattttatttcttttttcctcaatttagtgcctttctgtatattgaggaaggctcaggattaagtgagttttttaatgtcaatgtaaatcaacttttaattcaagattttaatgaaaaagtttttggagtttagaattaattgctttttactaaacaatttaattctttttttaatctattaaaattataattcattctattgtaattaaaatacagtttcgcgcaataatttgctggatgcagacacaaagccaaacgaatttcgaatgctaatttccgatccaattcattgcatgggaccttcgagcattgacctgaaatttaggcaagaaaaaaaattgaataaacaattcaataattaaatattgtttagaatatggtcaacaaaaggcataaaagtaatgttaaaacatttaa

SEQ ID NO: 51056 - DNA, 696 bp, Heterodera glycines
  Genomic contig location: Contig_ID=SeqID_3602; Location=198..893; Strand=-
  SCN-specific regions: Sequence locations=1-85,107-639,661-696
atgattgatttgcttctcaaagaccacaacctgttgatcaatgagatcgttgaccgcgtggtggttacccagcgaaaatccccatctctttcatcttcatccgaaacctcgtgccatccactgcattttcaacatcaacgtgttggcacccctcctttgtctgttccgtcttcaccgatggtttcaaatgaagaatcatcgaaaaaacaaccatctcatctaactaattctcgcattaccggtgccgcatctgtgccggtctcgccattagttgtggtgcaaacgcagtctgcgaacaattcaaacattggcaattcccctcctgcgaatgtgtggcagaaaagggctgaggcgattcgggagaaaaaaggttcgaataattagtgttctagtgaatggtacatctccttcatagccgtattggatggacattctctgcatggcattgtttcaccgattgcggcaccaacaaacaatgccaactgccccggcattgaccttcgaaagtctgaatatgctccagcggttcatgtggctactgggacacaagtgaagtcactcaacgcggaagaattggccattttatcaagagaagaacatcaacggaaggcgccaggttacgcacgacctcaatcatctgcttctatgaccaaacaaatgctttcaaatatggagaaaacggtatttaatgcttaa

SEQ ID NO: 51057 - DNA, 1993 bp, Heterodera glycines
  Genomic contig location: Contig_ID=SeqID_3603; Location=79..2071; Strand=-
  SCN-specific regions: Sequence locations=1-310,338-477,502-842,864 -950,972-1141,1178-1669,1693-1748,1770-1993
  Gene Ontology: Mol. function=structural constituent of cytoskeleton; Cellular component=membrane; Biological process=regulation of protein activity, epigenetic
acactgctctcacgctcgcttgcgttggtggtcatgccggattagttgacttgctgataaagcgtggagcacatattgagcaccgcgacaaaaaaggcttcaccccgctgattctcgctgctaccggaggccacgcggaagtctgtaaacttctaattgaggctggagcacaattagacgcacaagccgaccgtaccaaagacacagcgctttctctcgcctgctctgggggacggaaagatttacgtattatgttatcaataaaggactggaatcctaactattgccaattacgacgtacgattggtctagagtatattaaaggataaaattgaatacaacgagtctattttttcactgacactgacatgggaacctgtaaaactagtgtatagtaaatagatttttttaaattttcctgtgcttttttaagataattggcaatggggaagaccaatagtgccgatgggtcgattgaaaattaaaattttaataaaatttgaagcgactaacatttactttacacccccccccttccttggccaaacccttggacgcatatgttgtattaacaatttaaaaattttaggtagcagaattattgcttaaaagtggcgcaaacaaagaacatcgcaatttgagtgactatacgcccctttcactggccgcttccggtggttacgtggacatcattcagcttttgttgtgcaatggcgcagaaattaattctcgtaccaattccaagttgggcatttctccgttgatgctggctgctatgaatggacatgaagaggcaacacgtcttctgcttgagaatggatcggatatcaatgcgcaaattgaaaccaataaaaatacagccctgacattggcgtgtttccaggggcggacggaggtcacccgtctgttgatacagtatggggccaatgtggaacaccgagcaaaggtccctctaactttctttcaacttccctttcagtttttgtttttagaccgggctaactcctttaatggaagcggccaatggcggatacgtggacgttggcactgtattaatccaggcaaatgccgacgtaaacacaacgccggtgcctacaagtcgtgacacggcgttgaccattgccgctgacaaaggacaggctgcttttgttggacttttgttgagatataatgcacaaatcaatgcacgcaataaaaaagggtgcaccgcaatttggcttgtaagaaaattgtcaatttaatttaaagaggagacttacaacaatacgaatcagttattgtatttcattttttaggcgtccaataatggtcatttggacactgttcatgtattagttgattacaaagcggacatcgaagcgcaagacaatcgaaaactcacccctttgatggctgcctttcgcaaaggacattcgaaggcattttttatatgtttaaattagtcagcattcattttacagcttgttcatttcctcgttcaacatgtaactcaattccccagcgactcagattgccagcgtttcatttgcaccttaacggaccaagtctcattttaatattattctaatttggctcgtttttttacaggaacttatcgaaaagtgtggtcaatctgttcaattcatttcggaagccaaagaaaagcaggcagaacaggcgaacaaagccgcacaatcacttctggcactgttggctcatgaagtttgacttttattacacatttctaaacttgtacttttccaacaatgtaaaaaatcaaattaaaataaacgtatttggtcagccttcattgaccttcatttaggaggcaattgaggaatcaaaaaaacggagcaaagaacgtcaaaaagaaaagaaaagggcaaaaaaacaggcaaagaaagaaaatgaacaacagtcggagacgacggaacctgagaccgttgatgaagaaaaggaagagttaaatgccgaaaaaaagtcaaacgttgcacctgaaggcaaagcaatcccg

SEQ ID NO: 51058 - DNA, 1342 bp, Heterodera glycines
  Genomic contig location: Contig_ID=SeqID_3604; Location=119..1460; Strand=-
  SCN-specific regions: Sequence locations=1-427,449-1053,1075 -1176,1199-1342
  Gene Ontology: Mol. function=structural constituent of cytoskeleton; Cellular component=membrane; Biological process=regulation of protein activity, epigenetic
atgctcctccaagctggtactgacattaatgcgttgagttccacacataatactgccttaatctacgcttgtgcatccggatatatcgaagttattacttgcaacaaagttctttacttagtagcctttgcttcgttcagtgcgtgaaagagttgctagcgactgggcgttgtgacttggatattcgcaatgaatcgggtcactgtgctctgatggaagcggcaagcattggcaatgtggagataatgaagctgctagtcaagcatggcgcaaaggtcacaaatgtggttgaaagtgttgagtacaaggtgtactacatctcgtgcttactattcgaaattacgttttcttctcccaggaatcggcacttactctcgccgccttcaaaggacatttcgatgcggccaaataccttctctcactgatgccggacaccaaagatgcgcttgaagaggaggaagtttacactgcgttgatagaagcatcaatggacggtcatgtggaagtggccaaattacttttgagtgcgggtgcaaaagtcaatttggccaacgaatcttttgaaaatccactcactctggcggctggcggaggacacaccgaaatggtaacaaattgtaaaacatacaatccaatcgaattttacattaaggtgaaattattgctgagtgcaggtgccgaattggaagaaccgaacgatgagggatacaccccactgatggaggcgagtcgcgaaggccatttcgatgtggtggaaatgctgttggaccaaggtgcaaatgtgaacgcgaaaaatgaagacggattggagacaccgctaacacttgctgcttctggaggatttaagttagtctcacaactaactgaactttttaattattattgactgttaagagatgttgttgaactgcttgtttcgcgaggtggagatttgaccgtcggagagcgtactccgctttatgaagcgtgccaagaggggcacgagaaagttgctcagtacatcgtccaacaattgcgcaaagcttaccccctccaagtctcttttaatgtgtaatttcttatttcatcaattatttcaggttgtccagaaagacctcaacgaatcccttttgtgcactgctggcattgatagtgattcgatttgcaagttgcttattgaaaatggcgctcaaattgtaattttttaaaaattatatttcctaattttttgttatggaatttcattttttgatttaacaattttaaggactgcttctcgaaggacaatcgtacgccattgatggaagctgcccgtcaaaattgtactaaagttgttgagctgctgattaaaaacggagcagat

SEQ ID NO: 51059 - DNA, 805 bp, Heterodera glycines
  Genomic contig location: Contig_ID=SeqID_3604; Location=1413..2217; Strand=+
  SCN-specific regions: Sequence locations=1-118,140-324,346-698,737-805
atgtgtggaactcaacgcattaatgtcagtaccagcttggaggagcattcgaactacgtcagagtgcccgccacaacatgcctagcaaaatggaaatacaatggaacattccatggaagtgtgaataagtaagtacctccatcagcggagtgctgtcagcctgctggacaaattcaggagaattgcgcatgtacccgggttttaattggtcgcaaactaccctaatgaaaatattaaaaattgttgagaacatataagcggcactgagatcggggcacatatatagagtgtgggtcgacaaaaaatcagaataggggtcgaaaaactaaagttttttgttaaaaaaccaagagggaaccttttgatgtgcaaaaaggaaaatgtttttgagaaaacaaaaataaaaccaaaaaggggaaccttttaacttacaaaaaattttttttaagataacgaaaattctataggtatatttttaagtagagtccggtaaaaaaaaatttccgggagcgggagaggggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaaggacaatcaatttattaaattaaaaatatttagaaaaatttataaaggagaaatttgaaataaaaaaatcttatttttgagtcaaaaatcagaaaaattttttcaaattgcttaa

SEQ ID NO: 51060 - DNA, 818 bp, Heterodera glycines
  Genomic contig location: Contig_ID=SeqID_20524; Location=552..1369; Strand=-
  SCN-specific regions: Sequence locations=1-9,52-134,161-292,314-818
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttg

SEQ ID NO: 51061 - DNA, 354 bp, Heterodera glycines
  Genomic contig location: Contig_ID=SeqID_20526; Location=33..386; Strand=-
  SCN-specific regions: Sequence locations=1-190,213-265,295-354
atgggcaaagtgaccaaagaaaatgctaccgtcactgtgctgttgctcaaccaggcaatcgaaacgtacgataccggtacggtaccacggatgcatattgtaatttccttttgctcacactaaatttaaaacatcgccattcgacagataaaaacatccaatttgtataaagaaatgaataaaatttcttaaattttcaggattttcttttatcacttttcctcccccccccctttcatttagttcataattttgggcataattcaaatttaataaataaataaattatttttagtgccaaaaagtgtgaacgatttcatggacgagcaaggggctgtgatgggttttgtttaa

SEQ ID NO: 51062 - DNA, 1485 bp, Heterodera glycines
  misc_feature (1144)..(1144): n is a, c, g, or t
  misc_feature (1185)..(1186): n is a, c, g, or t
  Genomic contig location: Contig_ID=SeqID_20527; Location=735..2219; Strand=-
  SCN-specific regions: Sequence locations=1-85,107-161,183-407,430 -515,537-676,698-1345,1368-1485
atgaacgaccagacaacacggcagtatattattgacagaaccgaactcattcttaagacggtctttcattttttcgaaaagtgggaattttattttattttttttagatggtcacgcaaatctttcacattcgaagccaacatcttgaacaattggacggagtgaaggaaggggaccaaaaagagcaggagcttagtgaatttatgcgttccatttgcaactttcttagcactgttagtgaaatgccatgaaacggatttcataacaatgccactaattcaatcccttttagctgactaacgaaatgaccattatgcaacggataagtacggatactttgcgttcattcattgattcacttctttcgttggtcagcgatcagcgtcttaaaatacttaacaaacaggtgattttttaaaattgatttggcttttttttaatgtttcaatcattttttataggtattccgttctctcaacattattgtgattcgactgtgcgaattcacaaatccgaatgtgtgttttgtggcgctgatgaaattggtcatgaaataccaggcctctgatcctggcggtcaattgtcatcgttggtccgcaaatgtctcaccaaattcactgacgcaattgttgagccgaccaggattgaaaaagtttattaaatagtttttttttgtaaacaaaagttttctttttaggttgacattctgactgtgctgcacccaatccacgagtattattcgcgtttttatgttgccgatggacaaaccaaccaaatttccgacacagtgaaggacacgtccaaattgttgtgtatttttttgcagcgtttggtcatcaaccaaaaatatgcggtacgtttgtcacttttagtgaaaaacactgtaaattttattaagaattttattaacttttggtttaaaaagggatttttaatttattttttcctattattttcgactaaaaatttttaatttttttgtaggggtgtgcatatacttattgcagcctttctaaatggatttttgctttttgttagatgctcaactatctgtatccgtttcccgaaagttcccaattggtgagttatgtgcggcgatgtatccgaacggtgggccgaaaagcgatggaagagaaacggcanggacggtggcgcaggcggagctgcccaaaatcagaataatnncaccaaaatgggcggtgatgatgaactgtcgtcaatattcagccgaatttctggcgacattttccatggggtgaatgaaaatgaatttttatgtgaaaaatttaaataaaaatagcaaacaaaaaacggaaaatttgatttcaggctgtcgaggacttgtacaacttcatggacatccatcctgaccaaaatttaaaatttgaacaactgatggctcggtgcgaatacgcttccattgttcggcgcgcatttgtcgaaattcgtcaaactcgtcttaatcgggagccattgaaaccggg

SEQ ID NO: 51063 - DNA, 1035 bp, Heterodera glycines
  misc_feature (53)..(53): n is a, c, g, or t
  Genomic contig location: Contig_ID=SeqID_20533; Location=85..1119; Strand=+
  SCN-specific regions: Sequence locations=1-98,120-689,712-845,867 -883,905-1035
cgaggaggccggtccgcaagggcacgattcattttggtcgaaaattcgcattntaagacggactttgtgtgactttgacaaagccggcgatgaaagtggaggtctgtaattcttctgggagttccaatttcgcactttgtttagacgccaatgaccagcactttcacccacgacgaccaatgggaaatcgaccggcgaagtctccgattggtgcgccaagtgggcgcaggacaattcggcgaggtccgatcataaaaccaattcgtaaatgaagcaacatcaaaggtgtgggaggcgcggtggaaccattcgatgcccgtggcagtcaaaaaggtgccaaaggcaatcgaatgccaccaatgcgctccctcttccattttaagctgaagcccggctccaccgcttgtgtcgcggattttcttgcagaggcaatgcccagcaaattcttttatatcagcaaaaggtcgcttttaggctcaactgatgaaacgtctgcgacacccaaaactgcttcagctttacgcggtgtgcactcgggaagagccatttttaatagtgacggaattaatgcagggtaagcaattaggggggggggggggtagaccggctcatagaccggtccaattcccaatggtatccaaatccaaagccacaaacatcgcttaatccaaaatcccatgacaatccctggggaggagaagcagagaagggagcatcgttcgcattcagagaatctgctgcactttctgcacggccatggccgagtgtgtaacgtcgcgcaggttgaagaagcgaaggacgcccttttcacttttctttttcagttggtcgacgtcgccgtgcaaatcgcctctggcatgcgttatttggaggtgccaaagcgaaagtgtttaaatttccaaaaattcgcaggagaaaaatttcattcaccgtgacctcgctgcgcgaaacattctcatctctcacccttcggtggtcaaaattgcggacttcggacttgctcggcttatccgcgagaacgaatacgaagcgcga

SEQ ID NO: 51064 - DNA, 110 bp, Heterodera glycines
  Genomic contig location: Contig_ID=SeqID_20535; Location=1058..1167; Strand=+
  SCN-specific regions: Sequence locations=1-4,64-64
tgccacgggaccgggaccgggaccgggccgggaattcccggtcatccgaggtcccggtcccggttcccggtcccgggttttgaaaagctcaggtcccggtcccggtcccg

SEQ ID NO: 51065 - DNA, 64 bp, Heterodera glycines
  Genomic contig location: Contig_ID=SeqID_20535; Location=1112..1175; Strand=-
  SCN-specific regions: Sequence locations=55-64
tgccctaccgggaccgggaccgggacctgagcttttcaaaacccgggaccgggaaccgggaccg

SEQ ID NO: 51066 - DNA, 1039 bp, Heterodera glycines
  misc_feature (11)..(12): n is a, c, g, or t
  misc_feature (34)..(34): n is a, c, g, or t
  Genomic contig location: Contig_ID=SeqID_20536; Location=1..1039; Strand=+
  SCN-specific regions: Sequence locations=1-677,699-888,910-1039
  Gene Ontology: Mol. function=Notch binding; Cellular component =integral to plasma membrane; Biological process=growth
gtgtgaacacnncgcgctgcaagcggagtgccanttgcaacaccttttttcaccgatatccgacgcagcgagtcgcggctgagcatgggactgagcccggatcagtattgtctgaacgtgcgcgacattgacgaggtgtggaaaataaaactgagatggcattggcatcctcgaatgcaaatggacatttttggatattcattggatgtgtcctaggcgtcaaaagggggtgggtacggtagatgggtacaaataccgtaactgatcgaaataacggcaattatttttttaacatacgcattacatagatagaaaagggtctatatttatatactgtaaattcattatgcaccaaaaaaggtaattaattttctgatccccgcccccttttttcacagtgcgctctcggccttcacaactgttccacctatgccacgtgcaccaatttgccggatggtcggtttttggtctaaaaaatgcatttttatttttttgcaatttcattttgcaggttacacatgccaatgcccggccgggtgggaagacggcaatcccgaactgccggtgggtggggatggctaattaattgaatattgggctgtgcgagtttttccaaaatgggggaagggttcaagtgtttttcaaaatccaacaaaatctcggcaaatctcgactgttatatatatatatatatatattccttttaaagggtcgcatttgtgccagtaaattgtgcgctcagtgcagtgaacacggcgtaagtgatcaatgggtgctttgtcagacttttctctgatgcttttcctcgtttcgatttgttattttgactgatcaatcacagtactgattgggttaattgttccaatgccccgctacttcagtcttgcatccccgacccagccaacagcaccaacgtggtctgccaatgctttgacggatacgccggcacattctgcgaaatcgcgccctccgcgttgccgctggtgttggccatcattctggcactgcttttcctcctcctcgccctgtggtcagtttg

SEQ ID NO: 51067 - DNA, 2914 bp, Heterodera glycines
  misc_feature (2881)..(2881): n is a, c, g, or t
  misc_feature (2903)..(2904): n is a, c, g, or t
  Genomic contig location: Contig_ID=SeqID_20536; Location=1..2914; Strand=-
  SCN-specific regions: Sequence locations=1-145,167-274,297-591,613 -680,702-771,795-1294,1317-1550,1576-2005,2027-2216,2238-2914
  Gene Ontology: Mol. function=transporter activity; Cellular component= mitochondrion; Biological process=transport
gtcgacgtgccaccccatgcgccagcgccgcgcgagttggcaaactccgcgacactttcgtctcgctcccgctcatctacgcgtcgtcgttcgcctccgacgacatcgccgcttcgattgatgttcacggaagtgctcgctttggcaccgccgccgccgctggactgaaactgacgtgtgggggtgacaggttcgtcatgctttcagcctcaaatgccatgcaatggatcgaatacaggtgagacccaaccaacaatcgcacatgcgttttgtcctacaaccctttctccaaccgctgcagtatcatcgcccacattatctccgcctattacggtgtttcttattccgccgtcgattggacttcgatggtttacatgctcacttacatggtgctgatgttccccggaaggtccgtttgaacgaaggacagctaaagaatattttttgttaagttggtttcttgagaaatttggccttcggaagtccattctgatcggtgccttcggcaatagtttcggcgcctggttgaaaatgctctccacagccccgggcactaccaagatgtcattgccactaattacctcccttttcgatcgattttggcttacatttattgcccaaacagttaaatcgaagttcatcccaacccatcgctaattgcccttttaattcagatcgtcgttcttccccagtgttattcttggaattcccccgaggcttgcggcggtttggtttggacctgaacaagtccttccattgtccttttcccacttgggttttatttgggattttaaggtttccaccgcttgtgctgccggtgtttttgggaatcaggcaaatgtttttggcatttgattgacaacaattgtcacctctagctcggaattgccattggctttgtgcttcccccgtggcttgtccatgaaaagcacgtcgcgtgcgttcctttatttgtttagctcatttgtccgtccgttccttcccccggcactttcattttagatctgactgtcctgtttttggaaatttctgcgtcgagatttcgtcggctgtagatttggggtgcacccacacggggtacggacttacgggataaaacccgtaaaacccatagcctgtaaaaacccgtatcggccgaaaaatacggactacgggtccgtaaaaatccgtatacggttcaggctcggattcggactctaatagcgcacctctacccttttcccctaaaaggagaaaaataaataaaaaatgtattgaaaaaaatctgtcgacccaggtggaggcggtcggacatagcacgaaaagcgaagaggcaaggccaaattggatgtgatggcacacttttgccgttttgggaattcattcccaggggaagagtcccagttggagtgggggggggagaccaatcggacggggatttgcattatttaggggattggagagacgagaaatgcttttttttgccgggatttacgtaaacaaataaataatgccgagacactgcagcagatgtgttttgaatgacgtcaaaggagagacagacaaaagttgggacggaaaaggggcgaacggaagggaaaaagcggtcaattggtagtcaaaagatatctcacaaatcagcgcaattgattaaactgatttactaattagcaaattagtaaaaaaaaattgttgactcaaatgagtgttgtgatggaaagataaaaaattgaaaggggggattttaaatcttggagattggaaaatttaagagtttaatcgaaattaagttcgtgagttcgttagacagattagacattttttccgatcattttgaatagttttggtgacaatccaaggaaaggcccggcatttcctcccttttgggtgattgaccaaactgaccacagggcgaggaggaggaaaagcagtgccagaatgatggccaacaccagcggcaacgcggagggcgcgatttcgcagaatgtgccggcgtatccgtcaaagcattggcagaccacgttggtgctgttggctgggtcggggatgcaagactgaagtagcggggcattggaacaattaacccaatcagtactgtgattgatcagtcaaaataacaaatcgaaacgaggaaaagcatcagagaaaagtctgacaaagcacccattgatcacttacgccgtgttcactgcactgagcgcacaatttactggcacaaatgcgaccctttaaaaggaatatatatatatatatatataacagtcgagatttgccgagattttgttggattttgaaaaacacttgaacccttcccccattttggaaaaactcgcacagcccaatattcaattaattagccatccccacccaccggcagttcgggattgccgtcttcccacccggccgggcattggcatgtgtaacctgcaaaatgaaattgcaaaaaaataaaaatgcattttttagaccaaaaaccgaccatccggcaaattggtgcacgtggcataggtggaacagttgtgaaggccgagagcgcactgtgaaaaaagggggcggggatcagaaaattaattaccttttttggtgcataatgaatttacagtatataaatatagacccttttctatctatgtaatgcgtatgttaaaaaaataattgccgttatttcgatcagttacggtatttgtacccatctaccgtacccacccccttttgacgcctaggacacatccaatgaatatccaaaaatgtccatttgcattcgaggatgccaatgccatctcagttttattttccacacctcgtcaatgtcgcgcacgttcagacaatactgatccgggctcagtcccatgctcagccgcgactcgctgcgtcggatatcggtgaaaaaaggtgttgcaantggcactccgcttgcagcgcgnngtgttcacac

SEQ ID NO: 51068 - DNA, 65 bp, Heterodera glycines
  Genomic contig location: Contig_ID=SeqID_387; Location=338..402; Strand=+
  SCN-specific regions: Sequence locations=1-65
gccccaaatcccatttcccataaatttggctgcaaatccacaaattggacaaaatatgtaaataa

SEQ ID NO: 51069 - DNA, 565 bp, Heterodera glycines
  Genomic contig location: Contig_ID=SeqID_387; Location=1050..1614; Strand=+
  SCN-specific regions: Sequence locations=1-402,424-470,492-565
atggagcaccacgccaacacatccatcgacgacgcactgctcgtggatgacaatgaaaagcagaaaaggctgttcagtgagttttatgggaaaatttgatcagatcagagggaaatagggaagagacagagagaataaatattagcaaaaatcgggagtctcgagccggaaaatcccggtagaaaaggcctagaaaatttggaaatttttcacaaaaatgtataaaatgcgtcaaagttagtcacctttttcgtgtccggcactgatttattatgtcaactgatcagtaaagataaagatgctttcttcaattattacacatcattaaataagttagtctgaacaaattccatagatatgatcggaacaaccaatgaaaagactgactgttctgatcatttatcagtaaaaaatggagaaaattgtgaaagtgatagctgatcgagacaatttctatttcccattttgagaaaatttgtgtaaaaattttctatttttttcagtgctcggcctgttcatattgttttgttgggtgggcgtcataattttgtgtgcttatccccag

SEQ ID NO: 51070 - DNA, 1300 bp, Heterodera glycines
  Genomic contig location: Contig_ID=SeqID_388; Location=731..2030; Strand=+
  SCN-specific regions: Sequence locations=1-38,60-419,443-1218,1242 -1300
atgtcagacaaccgaaaagaggcggaggaaaagatggcaaaagcaatgtaaaattaaaaatgccaatttttcaatttgaattttaaattttgttttccttttttcagcttcatctccggtgattgttggctttgtgtcttcgatttgctgccaccttctcaacttggccttggaattgcgctgatcagccaccgatttgacttttacgtggacgaacacttcaaaacgcgcaaatggacgctgaaacatattcaaattggaagcaaaattggaaagaatggcacaaatgaaatggaaattgtcaattctgattggaaatcgatgccaattccgcaaaatccgttgccaaagaaaatcgtcggattcgaacgcatcgacatcttgtaaaataggcgattatgcaaaaagttcggtaacacttcccattcattttcagattcatcgaccgaaatgccatcgcttttttccaccattttcgtccaatttttccaatcaatttggccatccggtcgatcatgaacaataaacgcaatatggaattgattttgcgcaacatttggccaatactcggaaaaaacatttatggcatggaattgtccgccttcattttccaccgtttgcgcaaattcgtcccgtcttttctcaacgattgtccatcacctcgttttgtctctttcaaccatggcggtctcttcaccaagtttccggccgatgacagtgccatggcgtcggatggacaagcattggccaaatggcttttgactccccactcaacaaatttgccaaaggtgttgaaatgcatggtggacagggatgatccgaatttggcgtcgaagattgaagcgttcaaagcggtgctttcatttatcattgcgtctttcttaatcaatttttcaatgttttaggcatttgccaattcttcgtctcctaccaatttcatcatttccgtttggtttccgcgaccttttgctgactccgttgtgccatttgatctgacaaatgaattgactcgggaacaattggcgttcaaaagaacaaacatcagccttcattttctgctgatccgttgtccaattgcgcgagaggcgagcaaatggacgaaatgggaggaggaagcgattggctggcgcattgatgatcaatggaactttattaaaattcatgttgatgctgataatgacattggggatgggtcagtgaatgaatgctttattcaaaaaagcaaaatttattgccttgcctttcactttttaggcttctcaacgcaatgatcggcccgagtgatcagcagcagaagtga

SEQ ID NO: 51071 - DNA, 945 bp, Heterodera glycines
  Genomic contig location: Contig_ID=SeqID_388; Location=5127..6071; Strand=-
  SCN-specific regions: Sequence locations=1-495,545-618,640-945
atggctcttgttcgatttgaagaagcgaaatccaaccgtggcaaaattctcctttctcgtcttgggttcgaatatgcttatgagagcgactctcgaatcgagcaaggctgggaatactggaaatgcccaaaacgtcccccttactgtcctgggcgagcttgtgttcaaatggcgtggcacgtcgatgcaaatggaagtcgttacaagatgggtcgcatgtcagccgaccacaaccatgccgcagtttttggccaactcaatgtaagccaaaaaagcaaaccatctatttttggtatagataagacaggcaaatgagcaaattcgccaagaggctcgaagtgattttccgacaaccagtcgaaacattgtccgaaatgttcgggctgaacttccggtcgatgtgcgtgtaaacgcaccaagcgccgtaaacatgcgaaataaattcaacatagcaaagagaaagcatcacgaagaggtgtattttagtgtaaatggtttaaataaaaattttttaaataactaaatttaataactaaaattaaaaggtcggtgatgttggtcttgatgctttgccaattgaaaatattgtgattcccaatgctcttcaaaatcgggtcattttcaaccaaattttaaatggacatcggatgattgtcttctgctcagcgcatgctctcgaaatcctacgtcaatacaataccgaatgtgccattgatggcacatttgaagtaaaaatattaccattttctttaattactgttttttaaccgttaaagtcatgcccgcggggatttgctcagttgtacacaatgagcgcaatcatcgaccattgttcagtcccatgcgtttatgggctattgccaaataaggagggggcaacatatgtacgtttctttgaggcaatcagagacagcattggcaacaattggtcgccgcaaaggctaa

SEQ ID NO: 51072 - DNA, 1070 bp, Heterodera glycines
  Genomic contig location: Contig_ID=SeqID_3606; Location=323..1392; Strand=-
  SCN-specific regions: Sequence locations=1-1,33-145,167-333,355 -962,985-1001,1035-1070
atggagaaggaaaaggagcaaatggaaaaagacggtgaaaaagaaaataaattgtaacaatttttgtagtttaaaaagcataattaagctaatgccaatcaatccaaagaactcttggagcggatcattgaattggagaagcgacagaaacaacaaaaggaggagaatgagagaaaagggcggaacttgggagacaacatcggtatttaatggcaaagatttacactaagaagtcccgcgggattccctctcccactaatctctaattttagatcattcattttttagtcattttttaaatttcatttttaacttctcggtctctgttctccagcagaaggtcatttctgctgatggtctcgaatgcaaaataatagagttgagcgggtcgggtcgggaaaattcccgggtttttcaggtcccggtttttgtcaaaattcccggtcccgctcaattctacaaaaaaataatattcgagctttcttttcatctgaaacttgctctaattttaagtttctgtcactcaattaacggagttaaatcgccaacaaaattgttgggatgtcaaattttgccacaatgagctcgaaatcactgacgacgactgtcttactgtgctcaataagcaaaacaaatcaggtaaatggaaatgaacacaaaaaccccttgtgtcatacacactaattctttaaaaattcccccccccccctcccttcgccccaaccgttccccaaaacttttttgaaaaaggcgccacaaaaaaaagaaagaaaagcggtgcgaaaaaaagtcgagctggatggagaaaaatttggactatgaaattttggtcccgagacacccgcccctcccccgtctcaatcgttcgtcatatgacccttggcctgagacaccccttgtatatgtatgcttggtacgcctcctctatgtcttttggcggtggccgatcatttcgtcactgagaaataatttttaaaaaatgttggcaaaatgtcattatgtaaattattttcattaaataatattttttatttcggaaatgattattaaagaattatgttgaaaataaa

SEQ ID NO: 51073 - DNA, 556 bp, Heterodera glycines
  Genomic contig location: Contig_ID=SeqID_3606; Location=3137..3692; Strand=-
  SCN-specific regions: Sequence locations=1-556
atgctttcttatgcacaacaattaagaactactgaatatataaaggggtcaaagagactttttggatgcacagacggtgaggaatttcattttcatttacccatgctgttttttacgaatttcagctggatttgtagcgatgtgtggatggacattctccagggaggcatgaaatgcacgaaaaatatgtttttagcttgtcaaaaataagcaaaaaaggcaaaatttcgctttttgggttgatttttcgctaaaaatgataaattttagttgtatcatgtttttttcttcaaaatggttttaattagagatcggatacggacgggatccgtatacggatttttacggatccgtagtccgtaatccgtatttttttcggccaatacggattttttacggactacggatttttaatccgtaatccgtatgggtgcctagtccgtaatcccgatcctgatccgtacaattcttgatacggattagggatttttttttggcttttttaaagtgaaatggattatatttttaaattttgtgcagtcaattcgccaataaa

SEQ ID NO: 51074 - DNA, 1960 bp, Heterodera glycines
  Genomic contig location: Contig_ID=SeqID_3606; Location=4791..6750; Strand=+
  SCN-specific regions: Sequence locations=1-203,232-265,288-370,392 -668,697-1213,1235-1376,1398-1402,1424-1960
atggccagaaaaagtcagttttttaggtttttggccaaacttttttgtatctcaactagattttttgaaattttgcaggctattagcgactatcaagcgcttaaaatcacatcaagattttttaatttgaatgataaataaaaatgttatagcgtttggcgccaaagtgggtactctttaagtttgggtccacatttttggtcaaattttttcaaaatttttttttaataagcacgtaaaaaaatgtgatgaatttatgtctgtttcaaaattgtttttgtgttctttttgctctctcatttttcccaactctctctttttaagttacataacaacagagttttgccttgccttttttgacacaccaatcaattggaaaaagggaaaattgagccacaaaaatgaatcgacggtaaggaattttttttaaattacaaaattttcatttacccatacatttttttacgaatctcagttggatttgtggtgacgtgtggatggacattcttccatcttttgaccgtcctcaacttggccttcagaattgaaaagggcgaaggaccaaaagcgaaactgtctgttctgatcgatgacaaatgcgtggcatttccatttcccgaccatccgttgcccaacaaaatccgttttaaggaccttcagatttagtaaatcaaaaaatatacagaaaaccaatcttcattttttcactttatcagctacattgaccattctgtgctcgcatttctccgttccaacaagcaaatttgggacagaagtggcaccaaattggaagtgtttgtgccgttatatatgaccgacgtcaagctcatttgggatgtttttacccgcgaaatttggcctatttttgcgaaaagcattcgccatttttgcattcgtaatgccaatcatctggacaatttgcgtcgtctcatttcaccgacacttctcactgatcttgttcaattgtattcaatcacttcctatggactgtgccccgatggaatttctgacgatgggccaaatgcaactgccggccaagcgttgtccaaatggttgcacacgccgagcaaaaatggaaaagcgaatgaattgtattgctgtgcttatttttgtgaaataacatggatcaacactttcaaggaggtgatcgagctacttaattgttcattaaacgattgactaattattgattgattgcatttgattcgtgaccggaaaatcggtcagtggaaaatgcgtcagtgatacaaatattttaaaataaatttctatggcattagtattgtaatataggactaaacttctataagaaaatcgttctcaatttccaaccccggacccgaactcgaacaaaaaatcgaaaagtcaaaatttcgaaattagattttttcttaaaaatcggtttaatacacggaaacaaactataagccatcaatactgcaataagagatcatttatgctgtttttgaaccaaaaatgctaaattagaaaattttgtactttcgagttttttgttcgagtccgggttcgagattcggaaataggccggaatggataccggattcgtggtcagtgacctcgaaaacgcaaggaacttgtttttaagacaataaaatttcgctgacgcattttctgctgacgctttttccactgacgcattttccgggcgccatttgatttacgctcccttttttgtttagacatttctccgtgccaccacttctgtcgcttacaatgttcggcttgaacttctaatggctagcgaaatgaatacagttgaacaatttgagttggtgaacgaaatgacccaagaaaagttgacactgacgaaggacgaagagatttggctgttgaaacggtgtccaattgttggggagacggcggcggttcaatgggaaaaagacgaaaatttggaccatgtgtgcggactctacttcaatcttcatggaaattgtattgg

SEQ ID NO: 51075 - DNA, 799 bp, Heterodera glycines
  Genomic contig location: Contig_ID=SeqID_20537; Location=831..1629; Strand=-
  SCN-specific regions: Sequence locations=1-266,392-799
  Gene Ontology: Mol. function=structural molecule activity; Cellular component=ribonucleoprotein complex; Biological process=epidermal differentiation
atgggcggtggtggaatgatgggcggaggtggcggtgatatgggcgggtcgatgagtatgggcggcggcggcggagatatgagcggaatgggcggcggaatgatgagcggaggtggcggaatgatgggaggcggagacatgactgggggcggcggaatgggatacggtaagtggcaaaggctttatatcggttcaatccgttcgtccgattttaattttaaggcaattcgtcgtccggctggtgtgcatttgaaggtggtggaatgggcggcgggggcggtatcgccatgggcggtgggggcggcggcatgggaatgggcgggggcggcggaatgccaatggaaggcggagggatggacggcggcatgggcggatttggaggcggaggaggtgcagcaaagcctatccttacccaaattaactaagaaaatacaaacaggttatggttcgaatatgggcggaggtgcgtcgggcggcaattacggcgcatcaaagggcaacttcaaccctcaaggtaaacaccgatcggacataattagcccattttgggctgcccaattcaccaccggccacttagcctcattcagaaatgttggacccgtctggccaacttccgcccattcaaattccgccgtattcggccgaagaaggtgaggagaaaaacgtaaaggccaacattcgtccgttgcaccgatgagaaacggaaaaagaactctgcgcgtaataatttattatcacttttgaaagattgacaaaagcaaatcgaagaattaatgtttatttaattgtcacaaataaa

SEQ ID NO: 51076 - DNA, 575 bp, Heterodera glycines
  Genomic contig location: Contig_ID=SeqID_20537; Location=1143..1717; Strand=+
  SCN-specific regions: Sequence locations=1-96,222-575
  Gene Ontology: Mol. function=protein binding; Cellular component =nucleus; Biological process=mRNA processing
cgccgtaattgccgcccgacgcacctccgcccatattcgaaccataacctgtttgtattttcttagttaatttgggtaaggataggctttgctgcacctcctccgcctccaaatccgcccatgccgccgtccatccctccgccttccattggcattccgccgcccccgcccattcccatgccgccgcccccaccgcccatggcgataccgcccccgccgcccattccaccaccttcaaatgcacaccagccggacgacgaattgccttaaaattaaaatcggacgaacggattgaaccgatataaagcctttgccacttaccgtatcccattccgccgcccccagtcatgtctccgcctcccatcattccgccacctccgctcatcattccgccgcccattccgctcatatctccgccgccgccgcccatactcatcgacccgcccatatcaccgccacctccgcccatcattccaccaccgcccatcgctgaaagtcaatcaaatgccaaactcaaactgtgctaattaccgccgtcgggcattccgccgccgctttccatcccaccgccgccc

SEQ ID NO: 51077 - DNA, 1699 bp, Heterodera glycines
  Genomic contig location: Contig_ID=SeqID_20538; Location=983..2681; Strand=-
  SCN-specific regions: Sequence locations=1-554,576-1491,1514 -1665,1688-1699
  Gene Ontology: Mol. function=helicase activity; Cellular component =nucleus; Biological process=establishment and/or maintenance of chromatin architecture
atgactgttagcagtcacttggaaagctcggatgatcggacagaagcgcaacggacgggcgaggagaagcccgacctgaacaacgtggactatgctggactccgctcggacaacagcgaagttcggcgcaaacagttggacaacatcgcagtggccgcgttggaatttcagccgaagggcaacacactcgagaccacggaagtcgggaaaagtttaaattccaaattaaagcgaattccaatttaggtaaaaactgaagttccctttctgattcgaggcgacctccgcgagtatcagctcgtcggactcgattggctagtcactctgtacgagaaaaatctgaacggaattttggcggacgaaatgggccttgggaagacaattcaagtaaatattacttctcgatccattatctactttttcttattcgccatttcgttgtttcctctcacccatttcagaccattgctctgctcgcccatttggcttgtgaccgtgccgtttggggtcctcatctgatcatcgtgccaacctctgtcattttgaattgggaaatggagctgaaaaagtggtgccccgcattgaaagtgctgacatatttcggtacagcaaaggaaagagccgagaaacgaaaggtgcggcggtgcctttttaatttgcccattttatttgtttttagggctggtccaaaagcaatgctttccacgtttgcatcacttcttataaattggctacccaagacattcgcgcgttcaaaaagaaggcctggcaatatttgattttggacgaggcgcagaacatcaaaaatttcaaaagtcagcgctggcaaacgctgctcagaattcagtcgcgtcgaaggttactgctgacgggtaaggcatagtgaaaccgaatgttacccaaaactcgaaccataaaaagaccaggacttctctcgagacacgagacaatttttttgaatatgccaaaaatggtcgtttttaagtattttcagcccaaaaactgccgtaacaaagttaaaaggatttaaaaaaatctaccaaataagaaattttaccaatctttttttgatttagaagaatttttcttatatttcgtaattatcctgggtttgttttggagatccctcccccccccccccctctcaatggccgtatattttcccccttttcccgtccatttttcctttaggaactcccttgcagaattcgttgatggaactttgggcgttgctccattttctgatgccgcatgtgttcgcttcacacgacgacttcaaagaatggtttcactcgcccatcactgacatggtcgaagggacgtccgaagtggaccaggcgttggtccaatgcttgcacaaagttcgcttttcaaataatcgagaattaatcgcctcataaacatcagatacttcgcccgttcattctgaggcgactgaagtcggaagtggaaaagcaattgccgaccaagacggagaagatcattccctgtccattgtcaaaaagacagcgctttttatacaacgaatttctgtcaaggcgaacgtaagggaaataaaaacaaccaaatgtttttaaatcagaaaacggttcgttattttttgcaggacaatggacaacctcaagtccggcaacatgctttccgtgcttggcattatcatccagctgcgcaagtgctgcaaccacccgaacctttttga

SEQ ID NO: 51078 - DNA, 582 bp, Heterodera glycines
  misc_feature (574)..(574): n is a, c, g, or t
  Genomic contig location: Contig_ID=SeqID_20539; Location=538..1119; Strand=+
  SCN-specific regions: Sequence locations=1-94,116-505,527-582
atggccgacaaaactactattaatcttattcttcaacgacttgaagcgattgaacgtaaagtcaacaacaacaacaatgccgttccagcgcagttgaatgaacaactgcaaagcattgttgaccgtttgtgtgacatcgagcggaaaactgacaccgcaaacaacacaactgcaacgcgacggactcagaggacaaagagcggaagcgcagtcttgtactgatctaccttccagaatcaaccaaggaaaagccgatagaacgggccaaagaagacgccgacatggtgtccgacgttttggacgctttggatgtagaagtgtgcccacagatggtctaccggatggggcgccggaatgatgacaagcggaggggccctcgcctggtcaaagttgtgcttccggcgagcacctttcaacgcttcgctttggcacaatggggacgacgccgaaatgtactccgcgcaaaaaacgaggagtgggatcggctgcttgttcgaccgtcgttgacaaaagaggaacaaaaggcggaacatgaggcgcgtgtcaagaaaagggaggagtacgaacaaaaacngggatgga

SEQ ID NO: 51079 - DNA, 558 bp, Heterodera glycines
  Genomic contig location: Contig_ID=SeqID_20540; Location=104..661; Strand=-
  SCN-specific regions: Sequence locations=1-24,46-170,197-558
atgtgttatagtaaaaaaatccatacttttttccagagatttttggaaccagtgggttcgggttcaatgttttgactagtgaaaactgagaagaattgtttagccaaggcgtcagatttatccttatcggtaaaagcaacctttgaataattttcttagaaattccaatatatttttcccttattctttcttttttaatgtctttccaaagtaattttcgataattaattaatttctgaatgtgttcaggcaatttgggctcaaaattgctttggactaatgggacatattctctaattaaaaacaacaaaaattgattaattttatgaaacattgagtcaatctcagtgcaatctgaaaagaaaaaattccagttaatcgaagaaagaactgagttaatcgctaaataattagctctacgaaaatcgaaaccttttttagaattttcttataagtttttagcttaatttcacacgaaatactgttatgatcactaattgttaaagggagggccaacagcacattttgatattaattgtggattattttgaaaataaa

SEQ ID NO: 51080 - DNA, 1207 bp, Heterodera glycines
  Genomic contig location: Contig_ID=SeqID_20542; Location=231..1437; Strand=+
  SCN-specific regions: Sequence locations=1-25,47-89,117-891,925 -1041,1068-1207
atgtcggacaatccgaaagaagcggagaaagaaatggaaaaagcaatgtaaataattaatctaaatttgattttctaaggtcattttgcttttcccttttcagcttcatctctgccgactgttggttgggagtgttcgatttgcttccgccatctcaacttggcctcggaattgcgatgatcagtcaccgatttgactatttcgttgatgaacatttcaaaactcgcaaatggaaattgagaccaattgtaattcgaagcaaaatcggagagaatggcgcaaaggaaatggaaattgtcaattccgatggaaaagaattgccaatccctcaaaatccgttgccgaacaaagtcatcggattcagatgcattaggaccttgtataaatttaaatttttaatgatttgtgtcaatcatactttcttatgattttcagcttcatcgaccaaaatgtgctcacttttctcggccattttcatcgttttttcgccaattgtgcaacagaattggacattaccactgaaaatgttcgcattttggagtttattgtgcacaacatttggccaatgttcaaggacaccatttatctgttgattttgaacatcgtcgcttttcgtcaaatgcaccaattggccccgtcaatgctcaacgactgtccatcccttcgcactttcaatttgtctgacggcatttctcttggatttccgcctgatgacagtgccaatgcgtcggatggccaaacggttgccaaatggctgttcacgccacgtcacgacaatttgaagaagaagttcatatgcgttatggattcaacgatggaacaatggttggcaaccgtggaacaaatcaaagcggtgattatttgattattccaaattaattcgtatttcccctattttttgtcttctttttaggcattttcaaatgcttcgtctcctgtttatttcggcatttctgtttactttacgccgtcctcttcacttttttcttccgttgtgccatttaaactgaccaacgaattgactggagagaaattggaactggccaaagaagcggaagaagaagaagatttaattagttttcggcttaaccgttgtccaattgtgcccgaagataagaaacagcagaaaatggttaaggaattggacttgttgctatggaaccgaattgaaatttatatcgaagacgacggagtcggcgatgggtga

SEQ ID NO: 51081 - DNA, 1331 bp, Heterodera glycines
  Genomic contig location: Contig_ID=SeqID_20544; Location=204..1534; Strand=+
  SCN-specific regions: Sequence locations=1-526,551-1102,1124 -1172,1194-1331
atgtatgtaaatatccgtcgattcccaactgatcagttcgccgatcaagtggatatctaccgggacgatcccagggaggatgtgcacgaattgtggcgcaaattcacggaaagcatcgattggatccatcggctgaactgtggacgaaaattgctccaattcattcagctgctgcaccgattgttgccaaagtacacggagatgaaccgattgaaagcggaagatcaaagggagcaattggaggaggaaatgttttgggcggcggaagaggaagaaactgtgccaacaccggcggaaggggcggcgcggggagacgatgagggaaacagtgccaaaaacagaggtaaaaattgggaaaagatttcaaaaaaattattattgtttaaattttcaaattatgctccataacaaaattataaactcaagaaaaaatttttttgccacttcaataatatctcacgaaaaaaattttccagccccctaggaattttttctgaaaatttcccgatttcaaacctgtagcaaattttgttctctttctttttgtcttcaaagttttgagtttacctatattttgttacgccaaatttgggaccattttcggaaaaaaattcataaaaatttttttcttttagctcttagtatttataggggaaggtatgcttgaaatttcagctgaattagtccacgggaaattgctgaagtggcaaaaaaaaaattcttgagtttataattttgttacagagcataatcttaaaaattttacgtaaagttttattttagttttgagagccttcgccacattggaactcgagacaatttacaagaaaatcaaagagaaaatgttggcacagtttgagggctggtggaagcgcgtgccggaacagaaggagccgctgtacgagttcttcaaacagctcgaggacatctcaacgcgttacgtcatggcaattgttgacgcatttttcgacggcatttccattgagagttttcggcaggaatattcactgggcgtcaaaggtggggctgtgagcggaatgatcagaattggatttgacactttggcactaatccaaacttcgaaatttgtttattttaacgaacattgggaaaaatgccaacttaatctatcagttttaattagagaccggacaactggggtcggaggatcccgagtcttgatcccgaccgaatcccgaacaatcccgacgattttgaaagaacgatcgggacgaatcccaaatttaatcccgctggattccgaaaaaatccagcggtatcccaatcccgtccggtctctagttttaatttaaaaatgcgacccataccaa

SEQ ID NO: 51082 - DNA, 266 bp, Heterodera glycines
  Genomic contig location: Contig_ID=SeqID_20545; Location=197..462; Strand=-
  SCN-specific regions: Sequence locations=1-266
atgccggacgctgaacaaatgcgacaacagctggagcatcatttcgtctcgaattggttgatggacaccggcagactcgacgaattgaagctggtgagttgatggaaggggctttaaaatcttatccaactaattaagagggaggaggaacgacgggagcaagcagcggaagacagaacgaacgaagaaagtgatcaagacgccgacatcgatgtcgttgactgatcgaggattgatggtttattttcattacacgtataaataaa

SEQ ID NO: 51083 - DNA, 156 bp, Heterodera glycines
  Genomic contig location: Contig_ID=SeqID_20545; Location=1..156; Strand=+
  SCN-specific regions: Sequence locations=1-58,80-80,105-156
cgtccggaaactgagctgctgtaccaaaaaagatttgtatgtgtggcgaagtggtttgtgagaaggtcaccaaaggggtgggtcccaggttcgattcccagtgcatgctattgatgtatttcgatgattttaatgaataaataaaaggaaaagtga

SEQ ID NO: 51084 - DNA, 700 bp, Heterodera glycines
  Genomic contig location: Contig_ID=SeqID_20546; Location=447..1146; Strand=+
  SCN-specific regions: Sequence locations=1-659,685-700
atggccacgcactgtgtgaagggctgtgcgcttgccaatggccgcttgatcattgcgccgactgttgtgatcaccaccggcacatttttgaacgcggaactcgtgtggggcgcgcaacgaaagcccggcggtcggatgggcgaggcgaccagctcgggactggccgggtgagtcctcaaatcggctagggctacggcatgccgtccgtgttatgcctaacttaatcagcaacagcatgaagcgggttggaatcatggcatttttttgtgtgtggattaggaattttccagtccaatataaaagccctagttctatcgaatgatctaaagttatcaaattcagccaactgtgaaggaatttagaatcaaaaaaccggactggcgcccagttgtccttttcaaatttggattatttaccctatgccgttcgttgtgcattaattaattcatccatttaactctcatttttaattgatttatataaatttgatcaaatccccattttttttttctagcacatttcgtcgcgttggatttcgcaccggtgtgtttgaagctattttatacaaacattttgtctaattttgttcccactcccctcggggaccggtaaattggacaccaagcggaaaaatggacaccaaaggaaaattggacaccaaatttctttttaaaaaataaccccaggaattagcttaaaa

SEQ ID NO: 51085 - DNA, 1108 bp, Heterodera glycines
  Genomic contig location: Contig_ID=SeqID_20547; Location=1..1108; Strand=+
  SCN-specific regions: Sequence locations=1-785,836-1108
tgtgaaactagaaaattagaattggtggagaatagaaaagttcacctggctcccaaaaaaaaaattgttgaaattttcttataaaaattttctatgcttttctttggaacatttctttcagctcctttcctatgtcggctacacggatgaacgtctcgtcaaaattgtgtgcgaaaatgtggacgaaagccattcgctgatcagtgcactgaacgaaggcatcaaagggccccgctattgtccgtcgttggaggcgaaatgtctccgatttgggcacttgaaacaccgcgtgcgtatgtggtggcattcttcgtctctgatcagtgatcaagaactggcccaattttttgtttttcaattgaaatttcgactcccgacgggtttataggcacaaaattccgatttttaaaaattcggacgggttttttatgaattttttttttttgattcatggtgtttttcggtcggaatttcaatttccaactgatttttaggcattaaattatgactttttaattcgagattggtgccatctgtctcaaaggatgccactcttgtttttatgattattattaaaactttttgttagatttttttggagcccgagggattcgacagcgaattgatttacccgcaaggctgcgcattggggtgagaatgaatggcggaagggggagcaagcagcgcattctctcccctctccacggaaaattttagatttttttaaactaaaaaattcagtttttaaaaaaaactttttcttggcggggaggaaggtgacgaagaaaaaaaaacaatttttatttttattgaaaactataaattttaaaaaattcaaattcttaaatcattgacccgcattcagtttcaccatggatgtgcagcagaaaataatgcgctccatcgacggcttggaacgggttgaagtcgttcaaccgggtaaaaaataaaaaaataaagcattttgacaaaaaaaaatatcataaaatccaaggatattccgttcgctacgactttgtgcacccgcaacagttgtggccgagcctggagacgagaaaagttgtcggactgtttttggccggccaaatcaacggcacgacgggtgaga

SEQ ID NO: 51086 - DNA, 370 bp, Heterodera glycines
  Genomic contig location: Contig_ID=SeqID_20548; Location=228..597; Strand=+
  SCN-specific regions: Sequence locations=1-27,70-74,96-105,134 -266,293-331
atgaccagtgagtgagaccgagggtaccccctttttggcagaaaaatgtttgaaaaaattgcttaaaagacagcgttttccacaaatttttcaatataacggcggaaaaattaattaaaatcaataaaattttgtttgtattggaattttaaattttttttcccaccaattttcagtcgtatcgcctctttgggttggcgcattgccgcatgttacagcaatgctcggctggacattggccatccatttcatttcgaaatatacccaaaattaaaaaataatttttttttatcattttcccttttttgcaccctttttaattggcaaatattggaaaacaattattatttttcttaaaatttcttttaaa

SEQ ID NO: 51087 - DNA, 872 bp, Heterodera glycines
  Genomic contig location: Contig_ID=SeqID_20548; Location=975..1846; Strand=+
  SCN-specific regions: Sequence locations=1-872
atggtgcgaatttgaatcatagctgtacaaacggcaacactgcgttgtgcgcaacgaagttggggctgaaagacatcgtcaagcgactgttggaggcgggggcagtcgctgaccaagcgaaggaaaagggtaaataccgtaataaatatttcaaatactctttattagtgccaccaccctctaataaagcccccacaaatagcatggggttgaaaatcgggtacattatcatttatctcccgcgacaaataatttatcaaaaaaaaacatttttagaaatgtttatacccatatcttgcgattttctatcccgtatatttgtaattccatttgctattaataagtttttgtttatccatccaattcaaattgcccttagtttaggcgtcgatgtgcaagaagtgtcctcgagttccgccgggcccaccagtgataagtgaaagaagaagaagtgatcatttgaggaaggaaatgaaatgattattttaggcaatgctttatccgctaattgtttgctctttgagctttatccttttgttttggctatttattgtttgcttttttaggttgatttttgcttccgaatatgcttggatacataaatattttctgcttataaatttatataaatttctgtttttgattagtcaaatcttttttaacatccggattcgtgctctgcaccttaaaatagtcctagaaaattttttccaagattttcaaaaaaaaacgggaccagtaaactccatgattgccgttattgccacccaaaaagttataaagcattgaacatgctatgggctttgttgtacaagcctttgctcggctccattaatccttaacacaccgagtcaaaaacgagacatgtgtca

SEQ ID NO: 51088 - DNA, 968 bp, Heterodera glycines; identical to SEQ ID NO: 3607
  Genomic contig location: Contig_ID=SeqID_3607; Location=1..968; Strand=+
  SCN-specific regions: Sequence locations=1-49,71-175,207-249,271 -929,951-968
  Gene Ontology: Mol. function=protein tyrosine kinase activity; Cellular component=cytoplasm; Biological process=electron transport

SEQ ID NO: 51089 - DNA, 1100 bp, Heterodera glycines
  Genomic contig location: Contig_ID=SeqID_3608; Location=494..1593; Strand=+
  SCN-specific regions: Sequence locations=1-175,197-312,334-527,551 -1100
atgaccaaaaaagtggcattggcactgattgacttttggtttcagttggacccgcggaaacgcatctcagctgcaggtgccatgctgcacaaatatttcaacgaaatgccaaaaactttgcacgcactttcgcccacaggtaacagaagaagaaaacatttctcaaaaaaaaatttttctgccatttttagaatcaatttttgccgcatttgatggaattattcagcaacaaaaactttcaattgcatcagagacgacaaatgacagtgacgaaagaagaacgtgttatgtttgagaagaaaggagggggcttgtttattttcggtggaattgtgttaaatgaaagagcgatgttgtataaattacatcattatcatatcaatgcggcgcttatccacacactacaaacaaaaatttgaatggtcatttgggatgaaagacataacttctctaaaatgtttaatcgttctccggttccttcagtgtaatgtcaacttcactgtgcaaaaaaaaaccgtactatctcgtcgtttctcttttaaatattgttttgttatcagtagggctgtatttcgagatttttgtgcatatttgcatattttggctttttctgcacatatttcgtgcatattttgccattttttgtgcatattttccgactttttgcatattttgccatttttcttcaaatattttccgattttttgcatattttgccatttttcttcaaatattttccgactttttgcatattttgccatttttcttcaaatattttccgattttttgcatattttgccatttttcttcaaatattttccgattttttgcatattttgccatttttcttcaaatattttccgactttttgcatattttgccatttttcttcaaatattttccgattttttgcatattttgccatttttcttcaaatattttccgactttttgcatattttgccatttttcgtaaaatattttccgttttgaatatcccttaagtaaatttcggcagacaataggatgagctttagtgctgaaaatcttgagaaatttttgattttcaattgcaaaaaaaaccgataaaatttatgagga

SEQ ID NO: 51090 - DNA, 416 bp, Heterodera glycines
  Genomic contig location: Contig_ID=SeqID_3609; Location=239..654; Strand=+
  SCN-specific regions: Sequence locations=1-20,42-110,133-201,223 -255,277-416
  Gene Ontology: Cellular component=Golgi trans face; Biological process=ommochrome biosynthesis
gcatatcccggcgcagaaggactgtgcagccctgaaattgaaatttctgaaggcggcacaatgctcgatggcaaagggaaattcaacgatttaaaagcgatgttggacagcaacagggaaaacatcaaaatggatgcaatgcgcaggataataaatgcgagtatttagtaatcggatcacctttacccgaaacaattttaaatctcattttttgttcattttttagatggttgctcgtggaagggatgtttctgaactttttgctgctgttgtgaaaaatgttgctgtaaaaaacttggaggtctaacacttaattagcttggattaatcaattaaaagagcaaatttttagctcaaaaagttggtttacgtatatttggttcgttatgcggaggagcagcaggacttggcacttt

SEQ ID NO: 51091 - DNA, 686 bp, Heterodera glycines
  Genomic contig location: Contig_ID=SeqID_3610; Location=2479..3164; Strand=-
  SCN-specific regions: Sequence locations=1-271,293-513,536-686
attttcctttgtttattagtcatcaaaatgggaaacattgtctattctgacaagttgtcctgttacgaaagtgccgactattgtaagccgtcaaatttttgttttgtttttttgaattgcgtttcttttggaggtgctcgttcatgctccgcatcttcgcagtgcgtttacgtggacaattgtggcgactcggccaatgcgcattacgcgtgtttgcccttcgacacgcgactgctcacgtctgttctcgttccgatgatgtaaaagcattcagagagagaagaattaaaacaacgatagatagaaaaagttgtccaatgcctcaacaattaatcaggtggattttggtcgtttccttcctggtaatcgtcctctgctgctccgctttggtggtgttctacgcccttagggtgatccgacgatcattccgaaatccggtacaaactgacggagacatcgttttctacaatgccaggtcagtctcaatgaattccaaaatgaattatttgtccctttgtttcagaaacgtgcacaattttccgcaccctgcagcaatgaaacagccaacggtcgaagacgacggcagacaggaatattattacaacaattcacgtagaaatgattattactgattggttgtgaatgagtgacatgggattgttacggaaaaagtttttctttgccca

SEQ ID NO: 51092 - DNA, 757 bp, Heterodera glycines
  Genomic contig location: Contig_ID=SeqID_3610; Location=4745..5501; Strand=-
  SCN-specific regions: Sequence locations=1-641,684-757
  Gene Ontology: Mol. function=helicase activity; Cellular component =cell wall (sensu Fungi)
acatcgcaagtggaaacacaacacaaaattcaactgaaacgacaattgaagttgaagaaggttgtctaaacggaatgaaataaaaaaagtatgtgaaaattcgttgtagaaattccaacagcgcctactgtaaccgaagctagcaccacggcgacatcaaagacaacggaacaatcattggatgaccaaacatccaatgggacatcttcaccaagtacagtaaacgaaaaacaaccaaaaaccattggaaacgatacaacaacagcagaaaaagcaaacacagaaaggacggaagcgacaacagaaacagaaacgacaccaattcacaattcatctttgaatgtgccaattgatgagcagcagaaaaagtaaagaataaaggttaattattgaattttaataacaaaataacactttagcaacacaacaattgcaaatgaacacggctcattaaatgttgctgaagagacaacggtttatggaaatgtcaaataattttaaaattaaacggcatgttcaggcaacaacccgaattccgacctcaccaacaacatttgcagcaaatacaactgaaagtgggacaactgacggattaataatggaaggacagcaaaacgaaacaattattgttccgccagcaaacaaagaaagggaaaaaggggagaaggcacagaccatcaaattgccagtggcaaagagtgagaagcaaattgaaatcagtgaacaatcctctcccaatttcccaaggcaaatgtga

SEQ ID NO: 51093 - DNA, 506 bp, Heterodera glycines
  Genomic contig location: Contig_ID=SeqID_3611; Location=90..595; Strand=-
  SCN-specific regions: Sequence locations=1-506
atgtgcaaatttctaaacatcacgttgattgctgttattttacttaaaacagtcaaatcggcctatttgtccacgaaatgtgggttccattgggccgactactcaattaaatgggcattcgagcctcaaacacaaagcatagtgttcgttctgaaaacaatgccaccaagaaacttgagcagtgaaggaattctaacaacaggaatagcatttgaagcggaagtaagtgaaattagggtttaaagtcccaattaatcattaatattactgcgcaggaacacaccgaattcattggagttgcaatttcaaagcaaaaagatggagaaatgaaagtgatcagagcaaaagccaaaggcacagaaggactttttgaactgaattctgacaacacagcaaatagagtgagagaaatcacaatgaaaaaacgacagaatggagaaataattgtcgaatttgcacgtcaattgaagggggagaatgaacgaaggttgcttactggatgcaga

SEQ ID NO: 51094 - DNA, 1665 bp, Heterodera glycines; identical to SEQ ID NO: 20550
  Genomic contig location: Contig_ID=SeqID_20550; Location=1..1665; Strand=+
  SCN-specific regions: Sequence locations=1-32,54-104,126-362,384 -442,465-515,553-814,836-1261,1286-1324,1347-1642
  Gene Ontology: Mol. function=chromatin binding; Cellular component =dosage compensation complex (sensu Drosophila); Biological process =dosage compensation, by hyperactivation of X chromosome

SEQ ID NO: 51095 - DNA, 990 bp, Heterodera glycines
  Genomic contig location: Contig_ID=SeqID_20552; Location=152..1141; Strand=+
  SCN-specific regions: Sequence locations=1-60,84-465,489-870,894-990
agccctcgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaattatttttgggatgcgaattgttttgtgcgaaactgttatgaaaaaagggttcgaaaaactgggaaaaccccactcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagcccttgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaattatttttgggatgcgaattgttttgtgcgaaactgttatgaaaaaagggttcgaaaaactgggaaaaccccactcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagccctcgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaa

SEQ ID NO: 51096 - DNA, 64 bp, Heterodera glycines
  Genomic contig location: Contig_ID=SeqID_20552; Location=1356..1419; Strand=+
  SCN-specific regions: Sequence locations=1-64
atgtttgaagagcccttcgagagctgcaccggatgcgagtgcccgcgttgctgtacgctcaacg

SEQ ID NO: 51097 - DNA, 488 bp, Heterodera glycines
  Genomic contig location: Contig_ID=SeqID_20553; Location=492..979; Strand=+
  SCN-specific regions: Sequence locations=1-142,164-188,210-251,289-488
atgggcaacgaaaggtgcacaaattttgggagacgaacaacagtaaaattgggcttagagaagagcactagtgcaaatgggtggattaacgacacaaaaatggttgtattaaatgcgcttaggctggataagccccacactaccggtactaattatattttctgtgtttttttctaaagctgagggtaaatttctcatttaaaatttaagctaaaaatctcgaatatggttaaagatggtatgaaaaattatttcaggtgaaaattttaaaaaagttgctaaatttattaattttgagaaaattgtgacttgtatttgggcacaaatcgggcgccggacttttcgacagcaaaggacttttcgacagaaatattataaattttaggaggggacttttcgacagaaaaagtaattaactttcaaattaaggggcgtaaaatcgtaaaattttttccaaaacaacaaaatgaagccaaaccagtattgaa

SEQ ID NO: 51098 - DNA, 3130 bp, Heterodera glycines
  misc_feature (1387)..(1387): n is a, c, g, or t
  Genomic contig location: Contig_ID=SeqID_20553; Location=1..3130; Strand=-
  SCN-specific regions: Sequence locations=1-32,54-69,91-340,362 -800,840-874,897-1362,1384-1437,1459-1479,1503-1530,1555-1563,1586 -1606,1631-1865,1908-1913,1936-2064,2087-2134,2157-2351,2389 -2430,2452-2476,2498-2695,2737-3130
agtgacgaaatgatagggagcccaaaaatgagtttataaattaattaaattttctgtaaatttttcagaaaatttttggcattctgtcttgtaaatttttcaaaaaatgcaatgctaatcccgtgggacccctacaaaaatcaaatttgtgtaccccgctgcgggattggaactcaattttttttttttttgcggggcgggatcccacgggattaaattgcctttatgaaacctcgtagtgttttaaacaaaaattagttttttataggtcatttaattaatcttctttttagaatcttttatgttagtcattggtccacgctttcattgagcagtgaaacacataaaattttaaaattatgagttgtgttgaataaaaatactttttatgcgcacaattatattcaaactaattagtggatttttatatgcatattaattcgatagtcccgaataatcccgagaagcctataacaactgaattcatctttaggcttaccgtccgctgattcgatcaatcgccgcacatttcgtgcacttttttgcattgtcgccattaatgttggcggctatttaatctgttcgatttatgtcattctgatcaaaccgtcactttcgccgatcactgcttggtttggacaccaaatttttgcactctttttgaacattgccgctgcatcaaacggacccattttgtactttacaaggtgttgaacaaatgtttataatttagtccatcgccaaaaccaaaaaacgggcaatttttagcaaatttttcaaagttgataagcctaaaagcattcaaattatcattattatttgatatttttcctatttaagtagttgggcggtggaatatattaattggacatttgaaatgaaaaacttaaatcaaattatgctgttttgaggcaaataaaaaaatataagatgttttaaaaattgataaagtttacaaaaatatatttcaacatcgaaaacaaagatagtcttgggaacaggatttgtcgaatctctaagattcggctactctcctaaataagggaaatcataaaaacaagggcatttggcagctctgggatatatggaaatgttcccacctttgtttagtacggaatatcggcaagcataccataaggtatttccagccatattcaaaagaaactcgaacacaaaccaagtggcaacactccaaaataatttcgtgcgaggtaccgtatgacgacgacagtatagcaggaagaagaaatcaattacagtagaacaattgcggatcaaaaggctcagataaggatatgacgttttcatataacccatggaactctaatcagtaacaaaggcatttgcattttcggatttgggccaggggtggggcacggacagaatnatcccgcggtctcggattgcgcaaaaaaattaccgcgcatcgtggatcgcgtatttaaaaactcaaaaattttccaactttttcacattaacttttttttaattttttaaaatttccttataatgtgccgatatgggccgcacgaaaaattttaaaaaatttgattgcaaattggtaaaagatttttaaaaaatcaccttattttttgatttagatacaattttttaaagaaaaattaaaggtattcagctccgtcgaggaaaaaagagaatttttaaacgaattttttgagaaaaataatccaacttttcaaaaaatttatttaaaatttgaatattcaaaaaagacaatcgcttcaaattttctttataattttgtcccaaaaaatcccgcggtcgcggttcgaggattcaaattaaaagcgcggattacggccgcgtctcacccctgatttgtgggctcccggacttttcgacagtaaatataaaaacaaataattcttattaaaataaattatattgcttgtcaattttactaaatttcttttaaattaacatacaaatatggattgctaaattagaattactagagatacgttttttacctgggaaaattttttttagaaaaaacacctttaagaaccggtccttaaattttcaaaatacactcctaggaagaatgaaacaattttcttaaaaattcatgtccaatttttttaaatttattttctaggtaaaggattttagattttataaattatttatttcaatactggtttggcttcattttgttgttttggaaaaaattttacgattttacgccccttaatttgaaagttaattactttttctgtcgaaaagtcccctcctaaaatttataatatttctgtcgaaaagtcctttgctgtcgaaaagtccggcgcccgatttgtgcccaaatacaagtcacaattttctcaaaattaataaatttagcaacttttttaaaattttcacctgaaataatttttcataccatctttaaccatattcgagatttttagcttaaattttaaatgagaaatttaccctcagctttagaaaaaaacacagaaaatataattagtaccggtagtgtggggcttatccagcctaagcgcatttaatacaaccatttttgtgtcgttaatccacccatttgcactagtgctcttctctaagcccaattttactgttgttcgtctcccaaaatttgtgcacctttcgttgcccattgaatgtaaattatgaactggactggtgatgatccaaaattgtaatacaattgcgcatattttattttttaaattaaatttgtaattttatttaataggtctacgacaagtcaactaataacagttgtggaagattgatacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctaagtaaaaaagttacctctggcgtcccccagggctctgtcctgggccctttattatttttgatttatattaacgatcttcctgatgctttgccatcaggagtgaaaataaaattatatgctaatgatgttaaattatatatttgttataaagccaagagc

SEQ ID NO: 51099 - DNA, 1426 bp, Heterodera glycines
  Genomic contig location: Contig_ID=SeqID_20553; Location=1814..3239; Strand=+
  SCN-specific regions: Sequence locations=1-421,444-478,518-956,978 -1227,1249-1264,1286-1368,1390-1426
atgggttatatgaaaacgtcatatccttatctgagccttttgatccgcaattgttctactgtaattgatttcttcttcctgctatactgtcgtcgtcatacggtacctcgcacgaaattattttggagtgttgccacttggtttgtgttcgagtttcttttgaatatggctggaaataccttatggtatgcttgccgatattccgtactaaacaaaggtgggaacatttccatatatcccagagctgccaaatgcccttgtttttatgatttcccttatttaggagagtagccgaatcttagagattcgacaaatcctgttcccaagactatctttgttttcgatgttgaaatatatttttgtaaactttatcaatttttaaaacatcttatatttttttatttgcctcaaaacagcataatttgatttaagtttttcatttcaaatgtccaattaatatattccaccgcccaactacttaaataggaaaaatatcaaataataatgataatttgaatgcttttaggcttatcaactttgaaaaatttgctaaaaattgcccgttttttggttttggcgatggactaaattataaacatttgttcaacaccttgtaaagtacaaaatgggtccgtttgatgcagcggcaatgttcaaaaagagtgcaaaaatttggtgtccaaaccaagcagtgatcggcgaaagtgacggtttgatcagaatgacataaatcgaacagattaaatagccgccaacattaatggcgacaatgcaaaaaagtgcacgaaatgtgcggcgattgatcgaatcagcggacggtaagcctaaagatgaattcagttgttataggcttctcgggattattcgggactatcgaattaatatgcatataaaaatccactaattagtttgaatataattgtgcgcataaaaagtatttttattcaacacaactcataattttaaaattttatgtgtttcactgctcaatgaaagcgtggaccaatgactaacataaaagattctaaaaagaagattaattaaatgacctataaaaaactaatttttgtttaaaacactacgaggtttcataaaggcaatttaatcccgtgggatcccgccccgcaaaaaaaaaaaaaattgagttccaatcccgcagcggggtacacaaatttgatttttgtaggggtcccacgggattagcattgcattttttgaaaaatttacaagacagaatgccaaaaattttctgaaaaatttacagaaaatttaattaatttataaactcatttttgggctccctatcatttcgtcactgatcgtttcgtcactgttcagttcgtcactgatcatttcgtcactgcgaaaatttttaaaaaattgtttggcacattgtcaaaactgaaaatttttttaaatttaacaa

SEQ ID NO: 51100 - DNA, 1183 bp, Heterodera glycines
  Genomic contig location: Contig_ID=SeqID_20554; Location=508..1690; Strand=+
  SCN-specific regions: Sequence locations=1-255,277-335,357-416,463 -545,568-773,796-814,845-1003,1129-1154,1176-1183
atgataccaagattgttggatttggatgcaaaagaaaaaagctataatggaaaaacgagctggcgcccaaacgtgagcgctcaaacgcagtgaacccatttttttatggtaaattttttgaaaaaactccaaatagttccgaaatagttttttaaaagtcacaagacaaaattgttcttaaaaagtttagcaaaaaataaatgaaagcctaaaaatcccatccctgtttataaacaaagaatcgagattgatagatttgcttacaacaaacatttacttaattgataaagcagtaattaagttagcttaaaatctttgtatttaagaaatttacttttttccatttgaaggaaaaagcctgcaaacaccagaagaagtccttatccgatggattggtgagtttcaattagaaaatgaaaaaattattataaaaaataataatgaaaaaaacatttttttattcaaaacatttgctttccacctttaggagaagcccgaaaatggtcagatggagaagagtgttggagtgaactcctctgatggtgaatttaaatttatttaaataatcaatccttaaaattttggaattagtcatttaaagtttaaagcttgaaaattatcctgggatataaaatcacgaaatatggccataaaaaatggccaaaatatggccataaatatagaaaagaacaaaaattgatacaataaatatgcctataaactcctaataaagctaaaagcttttttcatgcctttacaattgaaaaaatgggaggattttcaaataattttgaatttacacaattagttattcattttaaaattaaaaataaatgtttaaattcgttttcagtgccgccaaatgccaccaccactgcgcttactgccattccgatcccctgaagcgaaggagaatgaagaaaaggacaaggacaaacaaatccaagtcaccaaagccataatcaaatccaaattccgccataatcaaatccaaatccgccaatcatttatatcttaatttaattattatttttactaattattttattcataatttatttaatgtttttgcttcatttgggtttattcaattttattttcattcaatttattcatttatcaatttatccaaaattcgaccgggattatacttatttcattgtaatatgaattatatttttaa

SEQ ID NO: 51101 - DNA, 321 bp, Heterodera glycines
  Genomic contig location: Contig_ID=SeqID_20555; Location=58..378; Strand=-
  SCN-specific regions: Sequence locations=1-88,113-246,278-321
atttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaataatgctggtgtggtaagtgtgaagaactgtgttcctccaggcaaaaa

SEQ ID NO: 51102 - DNA, 705 bp, Heterodera glycines
  Genomic contig location: Contig_ID=SeqID_20555; Location=543..1247; Strand=+
  SCN-specific regions: Sequence locations=1-705
tttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaac

SEQ ID NO: 51103 - DNA, 1321 bp, Heterodera glycines
  Genomic contig location: Contig_ID=SeqID_20556; Location=6..1326; Strand=-
  SCN-specific regions: Sequence locations=1-79,102-495,540-623,659 -681,717-789,824-1094,1119-1159,1239-1321
  Gene Ontology: Mol. function=transcription factor activity; Cellular component=nucleus; Biological process=regulation of transcription, DNA-dependent
atgtacaaaaaagtattatttaataaattgagcaaatttcagtgtccaccaaagtgtgcagtttcggtaatgaagtggtggaaaaggttgaggtgggaaacaattaaacaaatatagaatattattttaaatttgttcacaaattttcagatttactcacccattgacgaagaggaagaagccaaatgctccggagtttggcattttcggctggaaaagtcaccaatgtgcgaatacatggtgagttacaaaatacctattaactaatttgatcatttaagaaaaacatttaccaaaaaacctaacaactttgagtaaaaaaagacctagaattttttttctccatctaaaaacaaaaaacttttgaaaatcaaattttcataaaaagaccctaatttttgcttggcaaattttaggtcaacttttgaaatcttatgggaattttgtggcactgcggcgccgatagtcgccgacgggaaaatttcttttgggatttttcatgaattttgttaaaaaatatattcaaaattcaataattttgctctctgaatccaaaaaaagactaaaataaggacaaagtgcttaaataaggacaaatcttacaaataagaacatttaaaatttgtaagatttgaaccctcaaaataaggacaaatcttacaaataagaacatttaaaatttgtaagatttgaaccctcaaaataaggacaaatcttacaaataaggacaaagggtaaccctggtttagtgtataaaaatccggtctctaataatttattaaacccaatttaaaaataattatttgcaattaatatactgtgattcgggtttagccatgcgatttttgctaattatccctgctcaattatttcaggtacgcttcatttctgagctgaaaaagttgcaggagccgtcgctgatgaacagtgtgttagagaattttaccggtaattgtccaactacagtaatcacacagtgttttttaaggtcatgaaatgtttgcgaaattgagcgaattttctgtttacaaaaaagttcttgctgaaaatcaaatctttgttttacctctctttgaaatttacttaatatgacattgtttttatttttatttttatttcaactaaaggtttttcaattttctgttgttctaaatttctcatttttaattaatattttctatattttataaatatttaatttaaattgttttaaaaaaaacttttaattaaaaaaaattcagttcttcaaattgtcactgataaacaaagcaacgacacattgatggtcatcgcgttcatggtcggaatacgagaggagtaa

SEQ ID NO: 51104 - DNA, 1879 bp, Heterodera glycines
  Genomic contig location: Contig_ID=SeqID_20558; Location=46..1924; Strand=-
  SCN-specific regions: Sequence locations=1-629,664-731,753-807,829 -949,971-1879
gaagattgacccgaaaattacgaccgatgacgttcataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagggggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattgtttaaaattgttgttgccaattcgacgacacccgattcatacaggatcgaagatttggaaggaaatttaataaaaggaatattttataacctggaattagtgaaaatagatggatgacttttacattgtgctaccctcgaacacaccgggaccagggaacagtacatcaaaattcacagtacgactccccgagattttggaattgggcacaaatttggtcagtagctctctcatcaattatttacccctactcattcaccttactcggtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagattcaaaaattgatgtcgcaaagagcgccgcagaacgcgccgggagagatgtagaaagacattttaatcagatcaacaatatctcgaattccatccaaacccaactaaacacactacgagaaacaaatcctcacattttagaagagcctgatataaaaatttggtttgacaaaatggttgaaatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcactcggtgagcatattaaacgtaaagatattgaaaatagacaagtatctgaagctgagaaaggaccacaaaaaagagaaagactagccaatgaggatgttcaatttcaatatgacagcattgatcaaaaatttattgtctatctttccgctgctgtctcccatatagatttgtcaaaacacctagcctatgtgctcggttttaagaatacaaggctatttcacgcggaagaggcgacttatatgccggatttgacgggag

SEQ ID NO: 51105 - DNA, 307 bp, Heterodera glycines
  Genomic contig location: Contig_ID=SeqID_20559; Location=1572..1878; Strand=+
  SCN-specific regions: Sequence locations=1-307
atgtgtgtggcaaatggcaacactgatcagataacaaaaggggagatcaatggtaaattaaatggtaattgcaatgacaaattagggagtaattaaaatataaaaataggactagaaaaaattaacaaatttgtggtaatattgaaaaaaacaaaacatgaaaaatggcaaaaaattgtcgtccatctccatttgcagaagaagggcatttcaataacgagtcgaaatgctgtggtattacggtatcctactgtaaatcaaaaacagtaccaattcaatacagtaattatggaacaaaaaaatgaaa

SEQ ID NO: 51106 - DNA, 95 bp, Heterodera glycines
  Genomic contig location: Contig_ID=SeqID_20559; Location=1159..1253; Strand=-
  SCN-specific regions: Sequence locations=1-95
atgacgagtgacgaaatcggatggataccatctacacggcgattcaattttgggctccaagtacaattaagttggattttccgtcttagtggtct

SEQ ID NO: 51107 - DNA, 729 bp, Heterodera glycines
  Genomic contig location: Contig_ID=SeqID_3612; Location=176..904; Strand=-
  SCN-specific regions: Sequence locations=1-344,366-380,402-537,559 -608,631-729
atgattgatcaaatcttgatcattttggttttcattgggaccatatgcgataacaagccttcgtattgcctgatcattaagcggcggattttaagcgaaaaaaataggtaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatggagcggcgcaaatatccgcggcgcaactgtctgcggcgcaaatggcgcggcgcaagtgtcgactttgctgagcggcgcaaatttcgcggcgcaaatgtctcatcacgctaattttatgtaagaaaatttacgaattatgtaaataaa

SEQ ID NO: 51108 - DNA, 572 bp, Heterodera glycines
  Genomic contig location: Contig_ID=SeqID_3612; Location=2337..2908; Strand=+
  SCN-specific regions: Sequence locations=1-136,172-425,461-497,520-572
atgtcatccaatgtcacggacactgacagtttcccattttgcctgcttgccaaacttccggttggacttggcgtatgcgaagttggaaatggagaggacagcagtggcagagaaaatgcgtcattagccgttggcttactgtattattattattattgggaaaattagtgtttttcaggggattaataaatgatttaaaccactgacttggcatcctgtaacggtgactctggaggcaacgtcaaatttggggccgtgttttgttcttgaataaaattaaaacatgagaataaattaattatcttatttgtaagtgctcccaagtgtacgtgactgactgattttttcagatttgtgcggatttttgagggttgggagaattttttttttttttgaaaaactattaacacacatatttttagaacaaataaatcaaattaaaaattttaaaaaaaaaattcatgtggcaactttcggaatcattagattcaaaattcatattattattattttaaatatgattcaagactgcaaaatttagtcatttttgattgtaaaatctgttaattata

SEQ ID NO: 51109 - DNA, 1266 bp, Heterodera glycines
  Genomic contig location: Contig_ID=SeqID_3612; Location=3283..4548; Strand=-
  SCN-specific regions: Sequence locations=1-24,46-63,104-239,309 -342,364-486,531-708,733-893,915-1001,1028-1034,1058-1112,1134 -1140,1165-1266
atggcttttgtgagtcccttgagtcccttcccctctctctatgtcaccaacagcaaatactataaaatttttccaaatcccttttcattttcaactcttaaaatctctcttctgtgacgcaaccgcgttaagtccaatcttacatatatagcttaatgaaaggatgcattagtgccgtctgcccattaaaattccataaaaacatatatttaaaatggggaatttttggcatcacacgcataattatttatatatttatatttaaaatagtttaaattattaaaaaataatatttattaataaatttacctattgaatttttatgtatttgaatttaggggaaaattattatttgtattcacattaaatttttgcctcagaaaaatgtatcgacaacttctgcaattcaaccatgtaatctaatgcttaaaacaaggatttttgaatttttaaatttttaataacccaagaattttcgaaaattccataataatttaagaaaatgataaattaaaatttttttaaaaattccatgttttcgcagctccaaatctattgcattcgtggcgattggtgtgactacgattgtgggaagttccaccgccgaaagctgaacatttcagacaataattttgtgcgtgcccatgtggacaagctcgaaaaagccgccttgccgaacaatgaaaatggtgggtggtcaaatgtccattgtggccaagggaaggaagagccatggccaaaactcaaaaattgataaaagaaattttttactaaatttttaaaggaaaaaatcaatttatttaatgtttatcaccagttttcttctcttttacctctgaaaaccgggcacgaaccctaaaaattcgaaatttaagactgataccattgtcgatggaacccaaagttcaaaaaatgaactttttaaatttttacacttgtggctcgatttttttctaaaaaattttttcgaaaaggagggggtatttcgaatttttggcttaccccaccccccccccccccccctcccgaaaaattttaaaaattcataattttttggggtcaaagtcactgatcacgaatatggtgtcatcaaatgtccaaacaaacaccatattcatgatcagtgattttgaaaaccccaaaatatgaattttaaaatttttcggggggggggggaagcaaaacacggaagtaccaaggagggagcaggcgaaactcccgcaaaatgtgtcattggaaaatgcgttacagtatttcaaaaataaa

SEQ ID NO: 51110 - DNA, 1837 bp, Heterodera glycines
  Genomic contig location: Contig_ID=SeqID_3612; Location=5239..7075; Strand=+
  SCN-specific regions: Sequence locations=1-152,174-462,543-959,981 -1088,1111-1357,1380-1401,1482-1544,1566-1624,1680-1689,1711-1837
atggcattaatgccattcttatgtattattattcattcatgtcagcaacagttgagccattttgaatgtgatgccaaacgacgatggcacaaattgtggtgcgcgagcggacaggacgggcatcacacgaaaattgatgaatggaatggcaaaagatgaatgaaatgagagaagatggtgtgacggcacttttagtcatgtaaatatgctgaaattggaaattgttgtttttaggatgaaactaaattgtaaatatttggaaaacggcacattttgtcgcgtaaatatgccgaaattggaaattgttatttttaggatgaatcaattgtaaatatttggaaaacggcacattttgtcgcgtaaatatgccgaaattggagtttgttgtttttaggataaagttagtttgtaaatatttggcaaaagagacactttactgtattgaaataattattctctagctaattaatttgtaaattttttgaataatttttatgaaaaacaaaattatttatataattattaatttaattaaataataacggatattttaattgaataaattacataatgattcatcataaatatttttctgattctatcgcattgcccatttattctgtcacaccaattcgactaaatgttttctccttttttgtttgaataattatttttgttttttttcgacggatcattccatcggttttatattttatattatggttgaccaaatcgtttagggaagggttgaatagaaaaaaagcagatgtactttatcttcattatcccgatttggttataattatctattttttggaaaaaagattaatacgaaagcggacgaccgacttttattcaggcaccatttcaaagtttttgggctgggacaccagcgccgaccttgtcccccaaattccggcaaaatttgtccaattttggcgatttcccggcctcgaaaatctataaattatgatgatgatatgagtaattagcgtttcattgtttttcagcccaatgcacaactcttttttgtcattttgcgttcttttgtcgctttttcattataattttgctggtgccagtcaatgtccgacaaaaccgtaagtgatgattattacgctcgagatcagatttttcaagttttaattttaaatccaatgacgagaaatgaatttttgtctcgaattctctggtctcgagcatagaaaaaaaatttcaaaaatataagcaacaaatttgagaattttgttgaccggcacaatcaaagtgccaaaaaatgttgtcgattttaattcgtcggcacaatgcttgccatcatgcaaccaaacgggtcaagaagggaacaaaacttttgggcttactttccggcttcccattgatgttggacaatgtgacgaagggtaaaaaaattattaattaaaattaaaataatcatgaaaaatacaataaaaaaatttaattatcctatttttaaataatttgccggatttatgcttttttaaagcctgcttatctgctatccggggacattagaacgtgttagcggtggtggtggcggaggttggcaaaatatggcggctgccataaaaaaacaatacaaaatcagcgactacaaaaatgtatgaaaataatttttaattaatttttaattattcaattaaaataattataattaaattcaatttcagaatacaaatattccaaatgaaaagtgcaggcaaaattgggaaaaagatggcaagaaagatggaccaatttggcatggtgtttatgtgtacacagaacggaacaatgaagttcggcacataatgttggagttatcattttcaagcgaaaa

SEQ ID NO: 51111 - DNA, 986 bp, Heterodera glycines
  Genomic contig location: Contig_ID=SeqID_3613; Location=236..1221; Strand=+
  SCN-specific regions: Sequence locations=1-161,191-385,419-960,982-986
atgacgcgccatttaaaaaattcaaggtacaactttggcccaaaccgtcgacaaatttcgattccattttttggcaatcaaagtgaactcgttggctacggtaatgttgaagaaaactgtacaaaatttttttggccatttttaaccataattccaattgtcaggaggagatgctttcaaagaatttgacgatgcttctcttggcacaagcttcatccaaaatatacaggaaggtgcatttttgaaggattttgtcggactttggacgcttggccatgacatgatggcaccaccatcggcagcaggcacccagcaaagtgttgtgctgtacttttaccgtagttgcagctgttccatggaggcctgggtgagtgtaaaatttgatagaaattttatggaaaaaatttaaaaataatgttatttttcgacttgggtggggtggggttacaaaaatcagttttttttttaacttggtttaatactttttacacacattttttatatgtctttttgggattttttatttaatctttttttttgataacttgaaataaaacatggtcactccaaaatcacaaattttaaaattttttatgcctaatctgcaaaaagccaggtccatgaaaaatccagcaggcctggatcccagatccagattatctctaattaatcctttttgtttgattaacttcaatccgttaattcatttatgaacgcacaaaattaagtttactcggccaacggacacagaaatgccggccaaccgagaagcaatttctgttgggactgctgattgtgccaaaacagtggacacaatgatcccatttgactataatgaaaagagcgaatttgccttcaccatcaatggcataactgatgaaaatgcggtcaacatcagtgtccaactgttgcaggaggctcgagctggtcattcattagtccttgaatttcaaaattcttattttatgaaaaatatataaatttca

SEQ ID NO: 51112 - DNA, 1453 bp, Heterodera glycines
  Genomic contig location: Contig_ID=SeqID_20560; Location=471..1923; Strand=-
  SCN-specific regions: Sequence locations=1-262,522-636,705-958,980 -1196,1218-1453
atgacccaaattctgaaactttctgagattccaatgattttccctaaaatttcatttttcagcaccgacaacatttctcatgctgctggtgaacaacaacatgaccaaatagaaagcaaagttcaatttgaagaacagaaacaatcagaaaactatgcaatggcatgctttttcttcacgaggctttaccgaaaattggccggactgttggaaacacccttttatggcaaaacacggtcaaatgtaagtaataataaatgaggagagagagagagagggggaggaagagagaaggaggagggagttagagagagaaatgaaacagagagagagagagagagatatatagagtgggaaaagagtgagagaaagaggggggaggaaaaagggagacaaaaagagtgagaagcagcgagagaaaggaaagaaagagagagggagggagggagagaaagggaaagaaagagagagagagaaaaagggaaagagagagagaaaggggagagagagggagaatgagacagaagaactcaactttttccaattttttgaatgaattaagcgggtcaaggagacgaagtgacaaaaatatcagtgagagactttcagaggggtggcgtcatttcagtacggaagaaattaatttaattaattaataatataatttaaaattgaataataagctaataataataaatatatttgttctctatttcagtttatacggccacaaaaatacacgaccaagtaatttcttgataaatttcatgcatcataactttttctaaaaccatcaaaattatacatttttggtatcttttggtagccctaagtgttctctattttcctgtaaaatttcaaaaaatttcgttgagtttaaaaaaagttgtggtcacaaaggtttaccaaatcaatttatgaaatttacaagccacaacttttttgaaccaacaaccaaatttttaaaattttaaaggcaaatagaagacacttcgggctatcaaatgataccaagtatgcttaatttggatgcttctggaaaaagttatggcgttgatcaaaaattgatcatttttatggtgatcaattattcaaccaagtataactttctatgtgcaaatcgtagaacaaccatcccaaaaccaattcggtagaaaattttgtgctctttccagttggcttgcccattttctttagaaaaaatttcccaaccccctagggatttcgaagtttcccgattttcagtgtattttggggtgcccggtcactacaaaggagtgatctgatcaagttggtataagagacttttttgatcagcaccaaaagttgtgcaagcatgaattatttcaagtttttaaatgaactataagatagtttttcaggtttgagtcaagacttttttggggcactgtatttctctcgtaaaactgtaacttgtttgggaaatattaaa

SEQ ID NO: 51113 - DNA, 204 bp, Heterodera glycines
  Genomic contig location: Contig_ID=SeqID_20561; Location=1352..1555; Strand=-
  SCN-specific regions: Sequence locations=1-26,48-171,193-204
ccgtccgcttcggattttgggctcgctgcttcatcatcatcgacatcgacaggagaggaggatgatgcgcaactgttcggacggcgagtggtcaaatttctgcgcagtttaaacaacggacgccgcaggcgccgcgcatgcattggcattgagcaagtgatgatcgaatttgaaacggaggaggaagaggagcaaaagcgatga

SEQ ID NO: 51114 - DNA, 383 bp, Heterodera glycines
  Genomic contig location: Contig_ID=SeqID_20562; Location=224..606; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 51115 - DNA, 1296 bp, Heterodera glycines
  Genomic contig location: Contig_ID=SeqID_20563; Location=58..1353; Strand=+
  SCN-specific regions: Sequence locations=1-235,259-717,739-1140,1162 -1176,1198-1204,1229-1296
atgatcaaaaactatagaggaggtaaatgtccaaaaaaggcactcgctccgctgcctttcgtccgaccgctcatttgtccgtgtgccattccgtttttgccactctgtccgcccgctcatttgtccgtcccattccgttttcgccgctctgtccgctgcattttgacttgtgctgtgccaatatttaactgttcttccacttccgggcgagcattggacaaccattgccttagaatttttaaaacttatctgtttatttcccaaatttagtcaaaaattcaatttattagtgaagtcttgattaaattccggctaatttcacgattttcagcgattttaaaagtctaaaaaactggaaaacgttgaaaaactgttacgaaatggagaataaaattctttgcgaatatttgtttaattccaacattctttaaatttgaagtgcaagctattttaatgaaatttgctaaaaaaaatcaaaaatttaaattgtttttctttgttttgtttttccatcttttcattccaactttttcttatctgctggcaatttgattagtttttgtgcctcccaattttcctttgactctaaatcgatcgatgttcgttaaattgtttctcatcgaattttgttttgcgaaaattaaagtgtttggatctgagattggtctactctctgtgtttggttgaattgcgtccctgtcttgagtcaaataaaagcacaattacacaaataatgatcgtaattggcataattaaaaagtgacactttatgacattttcatttttccaatgtgttcattccccaaaaattcgggctaatgtaaacaattttttgttttgtttattttcactctcttaaaattgttaatgaccatccggctgtaataattgcttaaattgttgccgtaatggacaacgcttgagtttgtgtttattatggccactcacataaacgtgataattacctaattaagatatcaccaatttgtacattgacgagggcttttgttaatttatttcttaaaaaggaaaatttaatttcaattgaaatttaatttttccatcattttcttttaggaatacgcgacaatcaaaatgcaatggccgagaaaatgtcgggaattgatgcaaaattggaacaaattgaaaatggttaaaataattaatgttcatttttcatttattttaaatttgaaaatgctggaaaatatttttaatttatatttttctttagcattggccgagaaagtatcggaaaaaaattgtgcaaaaaatttttcacgagcaaaattatca

SEQ ID NO: 51116 - DNA, 529 bp, Heterodera glycines
  misc_feature (240)..(240): n is a, c, g, or t
  misc_feature (251)..(251): n is a, c, g, or t
  Genomic contig location: Contig_ID=SeqID_20564; Location=1067..1595; Strand=+
  SCN-specific regions: Sequence locations=1-52,102-203,262-330,353 -410,514-529
atggccactttaaatgtggcccatctcatcactttaattggcgttggggtacaaaattataaattaaaatttattattaattttttctaatatttatttttgttttagtcaattgcttcatccgttgttgctgatgagcaacaaaatcaaaacaaaactcaaaatggaggaggaggcttaaagcatttgttgggatcggatggtaaaaattatattttttatttgaaatttatttaaatntaattaaatanaatattttaagggttaatttttgcttttagttttcactgagcttcgggccaaacaaaatgcgatggccgagaaaatgtcgggaattgagacaaaattggaaaaacaaattcaaaatggtaacaattttattctaattaattcattttcgactttcgttgattaaaatttaaaaaatgaaaatgaaataatttattttataaatttaaattaaaaaacaaatgaaatgaaaatttcttatttgattgttaaataatttattaactattgtaagagataa

SEQ ID NO: 51117 - DNA, 580 bp, Heterodera glycines
  Genomic contig location: Contig_ID=SeqID_20565; Location=786..1365; Strand=-
  SCN-specific regions: Sequence locations=1-31,54-72,144-580
atgaaattaatgacagatttaataaatgatggaagaatgaaattgaaagaaaattcaagtgaaatactaatcaaacaagaaaaagaaaatgaagaaaatattgaaggggaaaaaattgaaaaaaaagcaaaacgaaagaaaaatggtaatttaaatgggatattttttaacttaaatctattgcctttttcttttattttcgaaaaatttctttaaaagtgcgcaaaattttaaataaattcaaataaacaagaattaaggaaaacaacattacgacgcattaaaagaagaattcagagaaaattatcaaatatttaagaatgtacacaatatgaaagatattgaaatttccaaattattcggtattaatcgggaaacagttcgaagatggaaacaagcatttttttctggtatgatccagaatccagacaaaaaatcgcatgggcttatgattttcctgtaatttcttttcgtagggaccgaaaaattcccgatcaaagatgaagagcagcgaacaaacgaaaaagcgaagtgtggaccgaaaactggtaagatgtttgtttgatcttttgataataaa

SEQ ID NO: 51118 - DNA, 418 bp, Heterodera glycines
  Genomic contig location: Contig_ID=SeqID_20566; Location=1828..2245; Strand=-
  SCN-specific regions: Sequence locations=1-28,98-246,268-283,305 -369,391-418
atggcagtgctaatcgattcaatgatggataatttaaaaaataaaggtaaattttacaaaaaatatattaaaaaatgtaaaatcataaattaaaaaacagaaaacgctgatttggtcgccccgttgtttccaatcacttttgtcatcttgggtggggaattgcttgttgaacgtgaaaacttagagatcgactacattttcaactttttgagcggctcagtgacagacgacatctaaaagaaatttgttttgagggcactgatggagaaatgaaaagcatccatagagaagagaaaaatttatcattattattgatgtatgccctagtcaaagaaaaaaattagaaatttatctttgtgattaagtaacgatcattggttctttattttggcgattttccaaatttagcgtaaataaa

SEQ ID NO: 51119 - DNA, 893 bp, Heterodera glycines
  Genomic contig location: Contig_ID=SeqID_20567; Location=291..1183; Strand=-
  SCN-specific regions: Sequence locations=1-193,216-378,401-637,660-893
ctcgtctgctgaattggcattgaatgacgagaagagttgggcaaattacagacgaagattggcaacctttgatgtgaaatatttggaattactgtttgagaatgttgtaaacattgaccaaatcaaaaggtggccagtcgaattgcgaagccgaaggaaatttcgcctgttgtgtgcgcacgtcatggatggaaaaatgtgggggaggagtttttgcaatgcgacgactgtggcaaagtgttatacatcaaattgcccggcgacgaagtgtccaatcgcgtgctgaaccattgcattcggtcagtggcgactgaattttatggaaactgaaatctcggcagaattgggagttggtttaaatgaaaattcaattcgggatcatcatcaaaaaccacgaacaaatcaaaggagcgcacacatactgttgtcgtacaaatttagacacattcaacgcaaattggtcgaagcgcacaccgtcatttgcccatggcgcattagcccggggctgaacacttccgcaacctatgacatcactgcgcgttatcaccaactggtggacagtggccagcccgaacttccgttggcggacaatgtactcgacgaagcgttggccgacaaatttggcgtgcagagccgatttttcttggctttggccatttttggatggcttccaatatcaaagtaagttgaaagagtttgaactgcttgacaaaacccaaaaatggaattcaacgacatgaaatgattattttggggtttagacaagcgacaaatcacgtggagatgaacaaaccgcagccgaactttcactgtcccctctgtggacgacatctttgcgcatcggtgttttccagtgacaatccgctggacccacgcgaacaacaccagcatta

SEQ ID NO: 51120 - DNA, 432 bp, Heterodera glycines
  Genomic contig location: Contig_ID=SeqID_20568; Location=477..908; Strand=-
  SCN-specific regions: Sequence locations=1-272,297-326
atggatgccggattcgtgatcagcgaccccgaaaacataagaaaaggtgttctacccgactctttattaattataattttttcgaaaaatttatggggaccaatcatacaagagcccagaattgttgtcttaaaagtgaaaggtaatgtcattatcagggctcccaactcggctctagtggtgcactttatgcgtccaatggattttagtagagtgccacgggaccgggaatttttgccaaaaccgggaccgggacttgccgggacctgagaagccgggaccgggaccgggaccgcaagaaaaaccgggaaccgggaccaaccgggaaattttaaaaattcaaaaaaattttaaaaatttaaaaaaaaattcaaattttaatttatttcaagtgaaaataatacaaaattatttggttttttatttaataaa

SEQ ID NO: 51121 - DNA, 1626 bp, Heterodera glycines
  Genomic contig location: Contig_ID=SeqID_20569; Location=15..1640; Strand=+
  SCN-specific regions: Sequence locations=1-229,251-456,479-635,657 -839,861-1036,1063-1598,1622-1626
  Gene Ontology: Mol. function=calcium-dependent phospholipid binding; Cellular component=secretory vesicle; Biological process=cell proliferation
atggtcaccattggcacattggatgtgcagtggattgacattcacttcaccgaccgcagagcgaccgatgaggacagacagcgggtgatccgagtaccggtacctaaggcatcgcatagcagggttgaacagctcagagactttttggcggtaacattgcgaaaccgtagcggagcaaaactgttgccaacacccagtgaggtggaagctaacaggaaccgaacaaagcttcttgattctccaccaccactgaaaagagagaaaagagatgtgtcatcaacgccaatgtttgacgcgagtggaaaacgcctccaggactctcctcctttgtataatataaatgaagacgaacgacttgaggagtcaccgcctccttttgaagaaacaaaaatttcggcggcaccaccaccgcctgtcacaagccccgttaagccaacaacaacggtcaaaacgcccgctgctccagctgcagcaccttccgcaactgcaaaaccagcaacgcagtctacagtaacaaaacaggcaccccaatcgccaaaaccaacagcaaagcctactaccgccacccctgttaagtcaacaaccgcccctccgccaactgtaaagacaacaacagcccctccgccaactgtaaaggcaacaacagcccctccgccaactgtaaagacaacaactgaggtaaagagcccatctgttaagccgacaatttcggctcctccagctcagctaaagtcgcatgcaaagacaactgcgccagccaaggcgccacctccagcttcggtttccgctgaattggctcctcgcgctcctctggcagactctccaccgcgttttgatgaagaagaaaataaaacagacaaattaaccgccgcaaaaccttcaactaagacgacaattacggcgcctccggcgcaactaaaaagctcggcaacgcctcatcaacaaaaacagcaagtgcccgtaaaaccatcagctcccatttcggttcccgcaaaaccgtcaggctctccaccgcgttttgaagaaacgagacaaaaacagcagcagccaccacccccaccaacatcagctgctttaacactagcagatttgccagaaaacaccctcagcgttcaaatagaccctctctcatatgtgcccaattccgtctcaattcaatatcttgagaacatggaacgattcaagctggtgttcaatgaggcgatcgtcagtcatgtgtccttctcaccgcagttgggctatgtgcttggctttgaaaaccctcaacatgtcgtgtcaaatgaactgtcaaaatatcctgtggatttgcgcggaggcatctcaagctttgctgtctactcgaaagggttgaccgaaaacatgatcattggcaattcactgagttcgctgcttcgtgttgtgtctatcagcggtgccatcccttgggagtacaacgagaagatttacgactcgccaatatttgcccgtgtgttaccacgggagatcaatgagattgagattgaactgcgcacaatggacaaaggccgtctcgtgccgttcgcctatgggacaacgatggtcgtactgatatttaagaaagtgataaacttctgatttcatcattcattttgtttttatttgacacta

SEQ ID NO: 51122 - DNA, 1491 bp, Heterodera glycines
  Genomic contig location: Contig_ID=SeqID_20570; Location=38..1528; Strand=-
  SCN-specific regions: Sequence locations=1-108,130-177,199-246,268 -315,337-591,614-660,683-758,780-804,826-846,868-881,903-1036,1058 -1491
atcattttgctgggaagatacaattcaaaggacataataaaagaagctcaggacaaagtgacgaaagtgatcattttgctgggaagatacaattcaaaggatataataaaagaagaccaggacaaagtgacgaaagtgatcattttgctgggaagatacaattcaaaggatataataaaagaagaccaggacaaagtgacgaaagtgatcattttgctgggaagatgcaattcaaaggacataataaaagaagaccaggacaaagtgacgaaagtgatcattttgctgggaagatacaattcaaaggatataataaaagaagaccaggacaaagtgacgaaagtgatcattttgctgggaagatacaattcaaaggatataataaaagaaatccaggacaaagtgacgaacgtgatcattttgctgggaagatacaatttaaaggacataataaaagaaacccaggataaagtgacgaaattgatcattttgctgggaagatacaattcaaaggacataataaaagaagaccaagacaaagtgacgaaagtgatcattttgctgggaagatacaattcaaaggacataataaaagaaacccaggacaaagtgacgaaagtgatcattttgctgggaagatacaattcaaaggacataataaaagaaacccaggacaaagtgacgaaagtgatcattttgctgggaagatacaattcaaccaacgatgtcattttatgtaaaaaattgcactcagaagaaatttaacaattaaaattattatcttaattaactgtgaatgaggcgggtaaaagggaagaaaaaggataatataacataaattattttcataattctcaattttattttcattttagaattgattccagtaattccacatttttagaatactgtattttttcctcacaaatgggactttttagaatggtttaaaaattaaaattcaaatgaaaatttgaaaaattggagctctgagcccaaaatcatcgtaagaaaagtaaatcgaagctacataccaaaagaaatttaaaatttaaaacaaaaatgcgcgcaaattcactaagcgcgttcagcaaaagaattttaattttcaattccagtacaaatttttaaaaaactactcataacttttgtcaaagtcaaccaaattaaacattcttggaaacattcgatagcctatgggttctctattagctcactttaattttaaaaaatttggtcaagtttgagcaaagttatggctaaaagtagtcaaagaaccagtttttcagacatttttggtcataacttttttgaaattgaacgaaattttttgaaattttgcaggctaatcgaggaaacgtagggctagcgaatgatatcaagaaaccaaaaaatcataacaatttataacgtaaatcttttcatttggcataaaataattttgatgatcaaaaattctgaccaaaacattcttagaacgaacaaaataaa

SEQ ID NO: 51123 - DNA, 365 bp, Heterodera glycines
  Genomic contig location: Contig_ID=SeqID_3614; Location=191..555; Strand=+
  SCN-specific regions: Sequence locations=1-37,59-270,293-365
atgtcgcaattgcaattcgtttggcgtggatcaaaggtaaaataaataattaatttttcgaaattcccaatttatccacttttaaagcgcataatcgcagttggaactcagaaggggcttccgcccaatcgtcggacaaagacagcggacgaatcactgcgacatgctttgccattcatatccaagcttgggcttatgtgggggccaattcagcggccaattacaagtggtactccaactttatcaactgtcatccaatcggacaaattgcttttttccccatccaacttttcgtgtgcatttatgtgatatcggacgaggcaatcaaaattaaaatttaatggaattttgaaaaaatattttaa

SEQ ID NO: 51124 - DNA, 1337 bp, Heterodera glycines
  Genomic contig location: Contig_ID=SeqID_3614; Location=1375..2711; Strand=+
  SCN-specific regions: Sequence locations=1-54,76-321,350-835,858 -1131,1154-1192,1229-1337
atgtctctgttcctcaactgggccaccttcactatttttaccattgctttggctgtgccaatgtttcagtctttttccggtgtccaatcgtacgctaatgatgagtgaatgaatgactattaataacccaattaatattctaattttatttcagaaatgcttcttcccttacgggcgaatcaatgaaaaaacattttacgaaggaatataacgcattggaccaatgcaccaaaacggaagttggccaaaggatcggctccttctcattgagcttccaaataatcggagaatgcgtcaaagggtgcaaaaatacataaattagtgaatttaattaattaaaacaattaattagcatgcttttttgttacccgggctctttggagcaaagcggctcacagtataattatgggatgacggtgggcatgcaatacaacgtgaaaaacagccaaatgtaaaagtttatcagataaaaccattttattgcttaaactttgtcagaattccgtcgcgaaggaatgcgaagaaaagcattttttattgtgctcgagtgaaaaaaagaggaaaggcggctttgcatggaaagcccagtttggcacggcatcagaataagcggcccatttgcggcatcggcgctagttgcagccatacagaagtagaagtcctagtctgttcgccggagatcacttcagaattagaatttcggtcgagcaaagccaatttaacattgacatccatggagcccgagttgccttttttgtgccaaaaatgcccacatctactggcaatgttttaggggtgagaaagagaaggggtgaatttaccgatttgagaggtccatgacaaaaaatttaaattgattttcgactttttattttgcctgattaagattgcgagagacttaaaagagaaaccaacggtcaatgtgaacagagcgaagacaaatcgaacagcaggaggggtccgtatcgttttggcgccgacgttttggcgccatgtagggaggtagaaatgatgaaatcgttgtaattttttgacgaagtctatcaaaattttttcaacaatatttcgatttaaacaaatctaagaaactgcaaaagattcaaattcatttcttattaattttaggtaaagataataatttaaaaattattatcacgaaaaatgcgtttccaccattaaactgggtcatctcttattaatttaaaaaaataaaagaaaaaataattaacaaaattcagattgatggcgatttaaaagcagaagagcgtggaactttcgtgacgatcgaaaatgaggcaaaatcattagagagactattgacatcactcatattttaa

SEQ ID NO: 51125 - DNA, 1707 bp, Heterodera glycines
  Genomic contig location: Contig_ID=SeqID_3614; Location=3213..4919; Strand=+
  SCN-specific regions: Sequence locations=1-80,124-221,244-584,608 -1567,1597-1707
atgcaatttttcattcgcttttcattagtctttgtttgtttttatggcaaatttgtgccgaacattggccaattgatttgcaaaaatgaagaaaaacaaaatttgatattagtaaaattatacaacgacgaattagccacaaatgacgacactggcgaattatgggaatttatatgcgaattggagcaacaaaatttagcaatggaaaaagcattcgaaacacaaaagcaaaatgggaaaatgtggcgaaaaagttcggaaacatttgatggagaagcggaattttttaggcacaaatttgaaattatcagacggaaagacaatgaattggccgaattattcacaaaattaaggagcacattttattcaacagttttaaagggtattaaacgactgactcccagacatttcatcaaaaataataaaatgaatggaaagaaatggacaattaggcaatggcattacgaaatagtgtccgtcactctgcaaatgtgtggtagcttgatgagctcgattttcgctgttttaatgtccattgtcattgtccatttttgcccaattcatttcactgacaaaacactgttagaaatgtgcaaaatttcaaaatgctccgccataattatctaataaataatgaatagcctaattcttagatgggtccatggcagaatgccttagaaatcaattaacccaatttgttttgatgctgacacaacgcttcaaaatctcaaaggaagaaataatgccaaaaaaagaggaaccgacaattgcgttgaaactgataaaggaatttgccgaattgtggagagagattaaagtaaaacaaaaatcaaaaagcgattacaaaggcactgaaaatggaaaaaataatgggcaaaatgagcgagaaaagtgttgggattcggatgaaaagcaacgaaaaatgttaaggcttgtttttacggctgttaacggagatggcaacataatggcattgaacggtgccacaaaaggtacatatttcccaaacacgaattaatatttcaaatttaaaatgatcagttaatggcggaggccgccgttcgcaaaagcgccgccgcaaaaagcgcgacttggtcctcctaattctgctaattgccttgctaatttcgctcttctttaccgtatattcgtattgtttacacagttccaacgacgattcgcttgagcaacagaacgcggacatggaaatgcttctcgttgttcgccaagcaaacgaaatttttgtcaaatttcgttacggcgacgatgaaacggataagaaaggcaacccgaaaagtgaccatatttacattgtagtggacggtaaaggtgaataacctgccaaattaattattaataagattatgtattgcccttttcccgaccctcaaaaaatgatgggattcggagtttttgagaaggcattatacagttaaatcttacttaaaattaagacatttttttgtgcaatttgattttcggcttttattctgagtttttggctaacggaccatctcgtataaaaacggttgttaatgtaaaacaaatgtcagaatcatttttacgcaaatttttattttataaatatattaaaatgaatattgataaggttaagattggggggtttcaaatttctgaagtgtatgtatgtacctgccgaaaatttggatttttgactgcatttcttcccttcaatttggcccagaa

SEQ ID NO: 51126 - DNA, 510 bp, Heterodera glycines
  Genomic contig location: Contig_ID=SeqID_3614; Location=5083..5592; Strand=+
  SCN-specific regions: Sequence locations=1-363,387-476,505-510
atgtttcaattcgatccgccactaattgtcccaccggaaaccgtcgaaagtgttgatgccatttttgaggcaatgctcactgggcattggcctcccgacagtcacacttatgccctccactcgtgcattgactttgcctaccaatttgtgtgccggttgaacaacggaatgtgcggcacatttgattatttttattcgtaaacttaaatgttaaattgttagatgtccggagaaggaccgttggccgcggccgttcgtcgaatttgaccagcgatgggtgcacagaatggcccatttgggccgtttgtccgtgtttgactttcgctatcgcatttccccacaaaattatgaactttcgcgcgacattttgcttcccattggcaacataattagcagcaaaaaacaatcgtagcaaagagaaaaggataaaacgaaaccaaagggaagaagagaaaatattttgatagaaatggcagaaaaaaaacattttatatttaattaattgaggaa

SEQ ID NO: 51127 - DNA, 468 bp, Heterodera glycines
  Genomic contig location: Contig_ID=SeqID_3614; Location=6668..7135; Strand=+
  SCN-specific regions: Sequence locations=1-102,125-137,159-291,338 -374,396-468
atgaaatccttctttaatttcccatttgtcttttgtattcttttgctcattggctgcgttgacaaatgcgtcggaggagtcgcggcattgccgccaaaatatttgggcattaaaaaccatgacaaatgcttaaccgagtaaattaactctattttaaatgtttagaataaagttgctttttgaacaaatttttaaatttaagcgagccaataggctcttcgcgtcggctttgtttgccagcgcagaaaaaaatcgaatgccaagatgaaacgttgaaagcgcttaatgtacatttaatatttaataaaaattaatattatttaataaataaaatttaggatttggaagaaggccaacatccgccgacttgcgcatgaatccgaagacagaagcgaaagaagcaaatgaagggattgaagaatgacagggaaaagcctggctgaacaaaattttgtctacaaaaatgaa

SEQ ID NO: 51128 - DNA, 584 bp, Heterodera glycines
  Genomic contig location: Contig_ID=SeqID_3615; Location=387..970; Strand=+
  SCN-specific regions: Sequence locations=1-140,175-279,301-398,420-584
atggaaattgtttttttcttcatttcactggccaccattctgctaataggtgaattgcggatgctaaccaagctcaatttttgagtttacattcaatcgcttcgatttgcttaaatttcttctaaaacccattaaatcagtttaaaattttaaaattaaattataattttaataggcaaaacagctcgacttcccagcaataaaaagggaaatgatgcaaataaaagtgattttgcgagcacttctaactccgcagatcaaacacaaaataaacacagtaagacaaaagacaaaacaaattgaaaaatattaattgaatttagttaaaacgacggatgacgcatggaactttttgaaaattgtgaaggtgaaaagggttttgtgtaaaaactcataatttttaattttgtttaagcaaagatttacgaataatccgtcggtgttcagtgaatttttgagtgtcatgcgatccttcaaagacgaagtaaatccaaaagaattaatttttgccttgaactaaaattgcaatcacagaaagtggacagtgtcgaattacatcaacgagttgcgcaactcttcactaa

SEQ ID NO: 51129 - DNA, 1488 bp, Heterodera glycines
  Genomic contig location: Contig_ID=SeqID_20571; Location=190..1677; Strand=+
  SCN-specific regions: Sequence locations=1-97,147-313,335-905,927-1488
atgcaagaagccgaacagaaagcggacggtccagcgcaatttccggccgctgctccgaagccggtaacatttgacaataatggaatatggtctttacaataaaattcaaaaaaaaaaattttattttaaaaaattattttaattttgacaaatcacattagcatggaggcgtcaccacggaaaaggaagccgcagacttcgacgacacaaagagcgccggacaaatctcagaccggtaattaattaattaggggtcatatccaagggcgtatctagggggggggaaggcggagtttaaacggagatggagcagataagcccattcctggaaggcgttcgcatcattcgattacccgctgtcattcattaatttttttctctctcaattaatgcataatgggattaccaaataattttttttagcaaaataaaacaaaatcttattacgaactgaacgacttcgaatgtcttcatcagggggctcgtcaaatgagttcccctttggtacatcccaagccttcgggcaggaaacaaaaatgtttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctacatgaatcgttccttgaaccaaaaagtcaattgggtgaaagatgtcgtgtccaatacaaatgccaattttgagacactgaaagtccaatacgagaccttaaccgaaagagtcgagatgttggaacaagacagtgatgggacgaattcaggtgggactgttagtatttctaatctgaatagagcgtcgcgtgtgccgtttgtgacgccaatgggcaatgcacagcccaaccaagttgtaccgaacccagtgccaattcatcaattatcaagcgaagacgaagatgacgggccgactctttttggcctgaacatgctctcgaacggacccacagtggggtcaggtttggaaatgttttgtgaggagtctgtttttgcatttgacgattgggctgaacgtttcaaggattacctgtccgtgtcaggcaaggcttacacagaacaagaaaaagtcacaagactcaaattagctctgagggacactcctcgggcactgtttaaggagttattgccagcacaaatggacactcttgactcagcattgagtgaacttcgacagaaattggactcccctcagcgtcgggaaattgcgaaacgaactttatcgctgtgcaaacaaagggaggatgagacagtggcgcaatttctcagacgcctgacgcctttggtggatgcgacaaattcgacattgaccggtgaaattcgaaaagagaaaatttgcgaagaatttttggatagattgaagccaaacattagctttcttatccgtctggtgggtctgtcacgagcaaaagacttggacttg

SEQ ID NO: 51130 - DNA, 130 bp, Heterodera glycines
  Genomic contig location: Contig_ID=SeqID_20575; Location=1410..1539; Strand=+
  SCN-specific regions: Sequence locations=1-83,125-130
atgccttccgctcgaacttttgttcgaaatcgtgccttttatccctgccgaaaaagccgtcccgaatgcgctctcttcctgttggctgctgcacaaacttttgctgccacgtgtcatcaaatggcaagag

SEQ ID NO: 51131 - DNA, 1599 bp, Heterodera glycines
  misc_feature (1538)..(1538): n is a, c, g, or t
  Genomic contig location: Contig_ID=SeqID_20576; Location=10..1608; Strand=-
  SCN-specific regions: Sequence locations=1-369,408-949,1029-1083,1105- 1161,1183-1343,1369-1498,1551-1599
atgcgcggtgccgttgctctacccacccaacagccattgacattgactgtaagtgtgctggggttagggggaatttttaattttatgctttttcatgtttttttaaaacacaggtctcgaattcagtggacaacggcggcattggacagcacccgaatggtggtggcggcattgtgcagcatccgaatggtgccgtcggcattgtgcagcatccgaatggtgctgtttctggcgcaagtgtgccaatgtggagtttgaatagtgtaagtttttcgtggagtgacccagggggtagagcgtctaatcaaattcgggtggttgaggtggcattttttttacacttttgtgtcaatgtggagggggaggggcaaaaaaaaatttttgaaattaaaaatttttcttttaaaggcgcttccgcccagtgtgcgtgaagcggttgcacttgtgcatgcccggcagctgcagaagatggtcaacaaacacattcagcccgaatttgcgtctgttgtgccggcaattggtgagaatggtttctcaaacctgtggtggatttacttggagtggcaaccagatatggtgatgaagtaagtgtttttttaatttcatttttcagcattccattttcccgcttttcagccgcgtcgtgggccttgtcgtcttggccggcccgttcacaacccaaaccgacatcagcggctacgacgtgcgcatcatcttcgaccacaacgatttggagcacgaaatggcgatgcacggctggcaggagtgtgtgccgcgcatgagcaacatttgtgccggacaaatagtggaattcacacggctcaaagtgcgcgcccaaggtcacaatgcgaagggcagctttcccttcaccctgctctacaatgcggagtcgcggcaccgcattgttggacagagctcttcggcggtggccacttcaggtggaaaaagcattttaattttaaaaataataatttctccccatttttttttgaaaaaaacatttttgattttaaaaaatattaatttttccccatttttaagtgttcaatccgccgtcaacaaacacgccaataattgttgaagcaaatgacagcaacaatgccatttccattccaagcggaggcagcgggccgataagtcagcagggcggaaacggcgtgtttggcggtggcggcagcagtgtgatggcggcacctcgtcaaagtgatcagcagcaacgagccggcgtgcgtgcaaatggtacgtggaaagcggtccccaccccgcaaaaaaaaagatcatatgatcactccccaccccccgcttttagcaggaagcgaacagcatcgcctggtcatgcaaagcgacgacgatgatgacggcgaggagcagcaggatgaacaaagccgcgggagtggcggcgacggacgggcagcgaattttgcattgccctctgcgggcactgatgcgccgcgaaccgagaccggcgcttcgtcaacggtgagccggaagtgaagaaaaagaaagaaaagaaagacaaaaacaaaaagaaaaagtanagaaagaaaaaacgcgctcgcataccatcattatacgcacacatacacacacacaaataaa

SEQ ID NO: 51132 - DNA, 765 bp, Heterodera glycines
  Genomic contig location: Contig_ID=SeqID_20577; Location=190..954; Strand=-
  SCN-specific regions: Sequence locations=1-765
atgcatagttttcttcggtcacgcttctcaatgctgtccgacatacactgctttttgtgctcgacaatcggtacgctattattcataggacaattttttcacattgcttcttttctgcttgggtccgcatttgttgcagaaattattttggatactctcgatacataatgtgtaacttccagaaggggaagctccgacggattaccgattctgaggacagagagggggaaaaatgcaaatggttgtccgagtcactggccaaagtcactgcgcaatggctgagtgccatgctaccggcactttttggggacaaagtgatggacacgaaggctctccatttgctcatccgtcagaatgcgcacaacgtgggacgtttgttcggtgcatctgcgagacggcagagcgggcgcgatttggttcgttaaacggagagctaaaaattagatcattttacaccccatgcccctccaatcttcagcggcgttaccgaaacgactggttcggtcaaagatgcctaatctgtctgcaacctatgtttggcgatgtgcgtgtgctaggatgcggccatgcatttcacaatgcatgtattgaagaatggctagagggaggtaatcatggttgtgttgtgtgcagggctctcattgtataatgtcgttctttcaattaaaaaaaatattttgacgatttgtgctattttacatgaaccgataaaaattttgctcttcaattggcttttataacttttatgccattgttttcaataaa

SEQ ID NO: 51133 - DNA, 562 bp, Heterodera glycines
  Genomic contig location: Contig_ID=SeqID_20578; Location=122..683; Strand=-
  SCN-specific regions: Sequence locations=1-12,34-397,426-519,545-562
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggaggagatgaaaatgaaaatgagactgatcaaaatacaaattttcatcaaaatgatcaaaatgaattaactgatcagacagatcaattggatgttcaacaaaaaatcgaaattattcacaaatttcacgcaattagagaaggaattaagaaaaagggaaaatattcggcaaaaatttggaataaaattgagcaaaaaattgcgaaaaaattgggaattaatcgaccaaaaatttacgaatggaaaaaagaatttggaatttattattataaaaagaaaaagagggaatttattgaccaaattgatgaaattaaaagaatgccaaaaaatggaagacagaagcaatttgcgaaagagttgggcattagcaaagaaacattaagaaaatggaaaaaggaatttggcattgaaatgagcaaaa

SEQ ID NO: 51134 - DNA, 340 bp, Heterodera glycines
  Genomic contig location: Contig_ID=SeqID_20579; Location=2..341; Strand=-
  SCN-specific regions: Sequence locations=1-30,53-340
atgggggaactttcatttcttaatgaagaaaataaagaaacttggaaaaagtttgtgaaactctcaagcaaggaattgatggaatttgagcaatcaatcaaaggtcattaattaattaattattagggctatgaatatgggtattgaaaattgtttaataatttaagcaacaattgttctattcttacaacatacaaagaccatcaaaaacagaaggcaaaagcgcatggacaataatcacccaccaaacactcccttggccaatgacgcaagaattcccattggcaatgcaaaaggcattcagtcggccaatgacgcaagaattcctatgggactctag

SEQ ID NO: 51135 - DNA, 515 bp, Heterodera glycines
  Genomic contig location: Contig_ID=SeqID_20582; Location=137..651; Strand=+
  SCN-specific regions: Sequence locations=1-201,223-487,511-515
atgggcgttagtcaacaaactattaaatggaataggtattttgacaaaaaattattcataacttttgccaaaatgaaccaaattttaaaagtttggtactttcgatagccctaagggttttctactacacaatttcaagcaaaaaaaaaattgttaaaatttcaaaaaagtcatgacctgagaaattcaaaaaaaatcaggtttttctaaatatttttgatcatagcttcattgaaacttaacgaaactttttaaattttgcaggataatagaaaagatttagatctatcgaatgatagcagtaaaatttggttgtttttgagtaaaattatagcaaaacgaaatttccatatgagatttcgtaccaatttccgtgctgacaatgagtcgaaccaaaaaaatatcaatgcgactaacctaaaagaagtatcaatgatagtaatatgtatttaaatttaattattatcgtaaaatttaaactcaataattttttcccaaacttttttgaaacttaa

SEQ ID NO: 51136 - DNA, 133 bp, Heterodera glycines
  Genomic contig location: Contig_ID=SeqID_20582; Location=1112..1244; Strand=+
  SCN-specific regions: Sequence locations=1-100,130-133
aaattagtcaaaatacatgccagattcgtgattagcgacctttaaaaacccggataacaaattatcatggttttttatcttaaaaaaattttgcaaaacaaaagggtccccccttttgaaaaaattttcaaaa

SEQ ID NO: 51137 - DNA, 1785 bp, Heterodera glycines
  Genomic contig location: Contig_ID=SeqID_3616; Location=488..2272; Strand=-
  SCN-specific regions: Sequence locations=1-629,684-885,908-972,1020 -1035,1057-1084,1108-1166,1208-1613,1642-1681,1710-1785
gaaggccttctttcgtcgaaattctcgccaacttcgtagactttcccggctttacgattgggaggtaagtaaaaaaaaaatgtttagaaggcggaaaatagccttactatttattcaaaataatcaaaatttgtagctaaaatccttactaattcgtttcataatccgctaaaagtgaagcgattttttttcttatgaattgggtgtgcgttgtatgcaccagggttggaattccgaatcccaaaattttttcggaaatctaattttagacgaaacgcttgccaatgccagagatgttgctgagttccgagtttcgacttttgaatattttttagggcttcgctcggattccgaacttacaacattttgggatctcagtatactgaactcggaattcagaattccaaaattttagggtctcagaattccattcatagccaatgggactcaaatttccgtatttttcacttgaaaaggttgacgaacgcggcgccttccgccccatcataccgccctcacaacaaaagcgtttttcacgtgacgtcaccgcatcggacagtccgacaacagcagtaacagcagagggacaacaacgatattgtgccaacgattcatatattttggaccggttaaaataaatttaaaaacattaataaatattttgcaaaaatttaaaattttatcattaaagaatcccaattaattttagcattctcgacgggtataacagacacaaaataccgggaggccgtgttaaagttatggtagaggtactgtattcgagaatttgttacagcatttcgctattattcacattaaaacattttcttgtaggtttgggtgcaagaaattacgacaatttcggacattacttcagatttccaggcaattttatttattttttctggctttaacttaggatttttttttactaattttagttggacatttacatcagcgaaatgtggaatgtaaaaaatattcaaaataaattaataaaaataaataaatatttttaaggaccaggctttggactattcatatttagagccatgcaaatacaagtaaatatattgtgaaattgaaaataaaattacattttttagcctctcattgaacagcattttattggagaaattatggactccaaattcagtaaaattgtcaaaaaattttatattaaattaaataaaataaaatatttattccagtgtttcatcaattcaaagacggctgacattcatcgctctccatttccaaacatttttctgctcatttatgccaatggatcaggtaaatcaaaatttattacggtttttcggttactgtatatcacttttttttagtatggactaactacagactaaagcttcagggaccctgtgaaatggacttgacacggtctaaatgaattttaaaatcggataaaaattcatatttcaaatttacggaaccatgactagggcgtggatttttgtgacaaaaaacccaaaatagttaactgaaaaagtggcaaaaaaatgccgttataacggcaaaaataatggcgaaaattttgcttgataatattcttttaaaaaggcctagaaattttcttaaaaaggctcaaaatgaatttatattttctaataaattttttttggagttttaatctaaaaggttctaggtttttatttttaggttttaaaaaataatattttcatatttttcagttttccatttgacaatgtcacttgttccctaacttttgagtctttcaagtgggttcaattttaaaacaataaa

SEQ ID NO: 51138 - DNA, 1375 bp, Heterodera glycines
  Genomic contig location: Contig_ID=SeqID_3618; Location=2480..3854; Strand=+
  SCN-specific regions: Sequence locations=1-130,153-303,327-344,369 -677,702-803,865-1060,1082-1122,1144-1167,1189-1220,1242-1375
atgctgaaggacaaaattgtggacaaagactcgcaataccttgtcaaaatgcagttaaattctgaagtatttccatttcttaaaaaaaaaattcgggtggcctagtggattacaccccagtcatgacacctttctgctcttccctccatctctcttacccttttcctcattccatgagccattgtgtcgctccttggcacattgagttcgaaatatgaggacaaattaatgtctttcgggggctctggacgttaccacttggtgcaatattgcagttgagtttatcagtccatggacatatgtgtcattacaaaattgtttttaaaggacgacgaaagaccaaccaaaaaatagccaatttaaaatatacccaaatacaaaattttatactttttaggaacgctggaccaaagcgatgaaatgtgtgttgttgaacatgaaacgtgtcattggcattctgaccacattgccgccgacgctgatggttaacccaacaactgctgctgctgcagcaaccgctggaagcaggacagcgaacacaaccgccataattggcaccgccattcccactcactcgccatcaacatcctcttcttcccgttcatcctgcactggcactgctccagttgtccattcatcgcaaactgttccagcagcaaaagatggttggtgagggcaaaaaaaaatttttttttaattttccatttactttactaataccagctccaagcagttctactggacaaagaaagcagaagtgagcaggcgactacaaccagaaaatgtttgacgagcgccatgacaaattttttttaaactaatttatttgtgtaataaagaattttttaatatactatatatatacacacatttattttttcattcgttttatgtcctatcaatattttttgagacaaactaaaaaaataatatcattttttgcgcacagttcagtgatttttctgatgaacgacgccaagaacaaagaagctgcttgtagcaaccagcggaagcgccgggaaaaatgtgacactggcaatgagtcgaagagagcaacgacgacatcatcttcaagcattacttgtacctgttctcagcgacagcgcactgaatgggcatggtgaaattttattttttggtaaataactgttcgaacttgggggatgaaataatttcaattttaatatcccatagagtataaaatttcatttttgttacagttcattttgttctgccactcaacggcatcctccttctacaggaggacgtcggcctctgttgcttccaccagtccaatggccaatggcaactgcggcaacaaaacggaaatatttacgtcgaccattcacactcaaaaccgccgttgttgatccaa

SEQ ID NO: 51139 - DNA, 286 bp, Heterodera glycines
  Genomic contig location: Contig_ID=SeqID_20586; Location=574..859; Strand=+
  SCN-specific regions: Sequence locations=1-286
atgtccaacaaattgaatctgccgttagcattttgcacattatttgtccatattttgctggatgtgccgtcgtcaagcgatgggatgattgccaacaccgttagaaaccctgcgtttagcaaattcgtcactcagataacccataaatcgactcaaacggctcaactggcacaaagagtggtagcccagaaagcaaccggcggaacaatccgaagaaacgtagccaatacccaaacgaaaaatgttggcaaaatgccaaaaacggcgacgcaagaaacgacaaacg

SEQ ID NO: 51140 - DNA, 137 bp, Heterodera glycines
  Genomic contig location: Contig_ID=SeqID_20587; Location=276..412; Strand=+
  SCN-specific regions: Sequence locations=1-137
atggaggagttcaaggaaggactgatcaacgccgcactggacattctgccggattttgcgtttgccgtgcccgtttctctgttcgttgccaatccgccggctgcaattctatgggccggatggttggcggttggaga

SEQ ID NO: 51141 - DNA, 1103 bp, Heterodera glycines
  misc_feature (1092)..(1092): n is a, c, g, or t
  Genomic contig location: Contig_ID=SeqID_20589; Location=5..1107; Strand=+
  SCN-specific regions: Sequence locations=1-15,38-212,235-1103
  Gene Ontology: Mol. function=chaperone activity; Cellular component =nucleolus; Biological process=nucleocytoplasmic transport
cattgactgcaaaggtggaagatcaggaagatgatgtaaacgctacgacggcttcaaacagtacagaagaaacagcagtgactgcaaaggtggaagagcagaaagatgatgcaaatgcaacgaaggctacagcattgactgcaaaggtggaagaacaggaagatgatgtaaacgcaacgacggcttcaaacagtacagaagaaacagcagtgactgcaaagatggaagagcagaaagatgatgcaaatgcaacgacggcttcaagcagtacagaagaaacagcagttactgcaaaggtggaagaacaggaagatgatgcaaacgcaacgacggcatcaagcagtacagaagaaacggcagttactgcaaaggtggaagaacaggaagatgatgcaaacgcaacgacggcttcaagcagtacagaagaaacagcagtgactgcaaaggtggaagagcagaaagatgatgcaaatgcaacgacggcttcaagcagtacagaagaaacagcagttactgcaaaggtggaagaacaggaagatgatgtaaacgcaacgacggcttcaagcagtacagaagaaacagcagttactgcaaaggtggaagaacaggaagatgatgcaaacgcaacgacggcttcaagcagtacagaagaaacagcagtgactgcaaaggtggaagagcagaaagatgatgcaaatgcaacgaaggctacagcattgactgcaaaggtggaagaacaggaagatgatgtaaacgcaacgacggcttcaaacagtacagaagaaacagcagtgactgcaaagatggaagaacaggaagatgatgtaaacgcaacgacggcttcaagcagtacagaagaaacagcagtgactgcaaaggtggaagaacaggaagatgatgcaaacgcaacgacggcatcaagcagtacagaagaaacagcagttactgtaaaggtggaacagcaggaggacgatgtaaatgcaacgacggcttcaagcagtacagaagaaacagcagtgactgcaaaggtggaactgcaggaagatgatgcaaacgcaacgacggcatcaagcagtacagaagaaacagcangtactgtaaag

SEQ ID NO: 51142 - DNA, 1002 bp, Heterodera glycines
  Genomic contig location: Contig_ID=SeqID_20590; Location=1..1002; Strand=+
  SCN-specific regions: Sequence locations=1-1002
  Gene Ontology: Mol. function=chaperone activity; Cellular component =nucleolus; Biological process=nucleocytoplasmic transport
cagaagaaacagcaggtgactgcaaaggtggaactgcaggaagatgatgcaaacgcaacgacggcatcaagcagtacagaagaaacagcagttactgtaaaggtggaacagcaggaggacgatgcaaacgcaacggcggcatcaagcagtacagaagaaacagcagttactgtaaaggtggaactgcaggaagatgatgcgaacgcaacgacggcttcaagcagtacagaagaaacagcagtgactgcaaagattgaacatcaggaggacgatgcaaacgcaacggcggcatcaagcagtacagaagaaacagcagttactgtaaaggtggaactgcaggaagatgatgcaaacgcaacgacggcatcaagcagtacagaagaaacagcagttactgcaaaggtggaacagcatgaggacgatgcaaacgcaacgagggcttcaaacagtacagaagaaacagcagtgactgcaaaggtggaactgcaggaagatgatgcaaacgcaacgacggcatcaagcagtacagaagaaacagctgttactgcaaagatggaagaacaggaagatgatgtaaacgcaacgacggcttcaagcagtacagaagaaacagcagttactgcaaaggtggaagaacaggaagatgatgcaaacgcaacgacggcttcaagcagtacagaagaaacagcagtgactgtaaagttggaacagcaggaagatgatgcaaacgcaactacggcttcaagcagtacagaagaaacagcagtgacagcaaagatggaagaacaggaagatgatgcaaatgcaacgacggcttcaagcagtacagaagaaacagcagttactgtaaaggtggaacagcaggaggacgatgtaaatgcaacgacggcttcaagcagtacagaagaaacagcagtgactgcaaagattgaacatcaggaggacgatgcaaacgcaacggcggcatcaagcagtacagaagaaacagcagttactgtaaag

SEQ ID NO: 51143 - DNA, 598 bp, Heterodera glycines
  Genomic contig location: Contig_ID=SeqID_20591; Location=1514..2111; Strand=+
  SCN-specific regions: Sequence locations=1-235,277-410,466-598
atggaaattaggcggattatgcgttcgatttttgggctcgagacttacgatagcacaaaaagatttattgaccaatcgatattaggatggtaagtaataatattacataaaaaataagtaggaaaaacggtgaaaaaaaatcagaataaaacaaaaaaatcggtattttaattaattaaattacagtgttatatattaattatgcaaaaaaacaagtaaaaagggtaaaaatcggattaaaaaaatattataatattgaaattataaacattaaaacaaactaaactcatagtatacataaaaaaaacatcaaacacgccacaaaaacaacaattatattacaaatatacatgtatatataaaatccaaaaattgctatatatatacataatcttatacatataaaatggaaaaatattatattatttaattaattaaagaatatgtttgttttttatattttttcctatataaaattgcttgaaaaaattgcaaaaattcaatggttttatgcacccaccgtttgtcatcaagctagccttttgtaaattttcgcgcatcttcatatggtcatggttgagctcgttgaactagaaaa

SEQ ID NO: 51144 - DNA, 75 bp, Heterodera glycines
  Genomic contig location: Contig_ID=SeqID_20591; Location=2383..2457; Strand=+
  SCN-specific regions: Sequence locations=1-14,37-75
atggaattattagagcccagaaaagggccgggcttgtcagagttttcccgacattatgatcctgaatgcttcaac

SEQ ID NO: 51145 - DNA, 1157 bp, Heterodera glycines
  Genomic contig location: Contig_ID=SeqID_20594; Location=932..2088; Strand=+
  SCN-specific regions: Sequence locations=1-85,114-720,743-879,901-1157
aaatgtccggtcaaaggattcaacggcgaatgttttgagcgaaacggtggcaatgacactgaatatgaaaattggtagaaaaaggattaaaattaaaaaataatcataaaataccagggcattttcttaaatggcctcagtaatcggtcggtcggtccttcccgaaaatgcttttcgtcgtccatttgcgtccgcaggtgttatcagtacgcgtccacgtcgatgaactacgatcagatgaagccgagcctgattctggtggccagctcaacggccgatgtgatcgcagccgtccgctttgcccgttccaaacgcgtcaacgtcgcggtgcgctcgggcggccatcagttcagcggagcatcgtccgcgagcgggaaaaacatacaattggacgtcagccaagcgttcagagtgagtgcaaggaaaacgcagcgcatttaaacattgagctgatcagagcgccaaaggatcaaatgaaaaaaacgacacgacagcgatgctcctccggtggcaaaacataaaatggcacaaatccccttaaaaatggcacagaaccttctctaaaatgtggcaatgatatccctctaaaattatagtaaaatcgtaacttttcgtactgtaggaaattgattgagtctatttgggtgaccaaaacaaattgatagaaacttaactgctcaacagcatttgtgctcgcatcgactgatgtgaaacagagtgtaattagctgctaattactcagaatgtttctgccggcgattttgcggtgttagaaccgaactgtagcaatagtagcgtcgctgtccgtgttggcatcagtttcacactgctcgagttctttttgatgatggcggaaaagggactgttcgtacccggcggtttgtgcaggtaggaaaattggtaagcttcttctgccaacagaacaaagttaatcaatcggttaattatattttgcatgcaatgccaattttttgactaattagcagaattgactatttaagccaaacaatcaactctagtatatcccatttaatgcttatcccttacagtaatgtccatatcggcggacacatccaaaccggagggtacggcgtggcaatccgcgcgttcggactggaagcggaccatgtgcttgcatttgacatcattacggcaga

SEQ ID NO: 51146 - DNA, 587 bp, Heterodera glycines
  Genomic contig location: Contig_ID=SeqID_3620; Location=543..1129; Strand=+
  SCN-specific regions: Sequence locations=1-505,555-587
atgcgtctttgggtcgcttcactttgcttttacgtttccattttcatattttgtgaaattttgcgcggatttgcatacagattcgagctgcacatacaaattggtggtgaacatcatcaactgattacatctttgatttatgaggtgggtaagttgaaattaaaactttttttttaaagcctttgttaaattgagaattggaaaagctcaatttttaaccgcttcaaacacttctgatcaacttctttcattctctagatcgatttgtctcattgagagatttgtcctgatcgggcctcaaagaaaaaatctcccttactttacaatagccgccgggatttcgcgcgattccctacccggaccgacattttaccaatttacgttttttctgactgcgctttaacttttaacacgttaaaatattggcattttattgagaaagtcaaatatgtaaaattattgcgtttgataggaaagtgagaagacacattaacagaggataatgataaataattatttttgattaataatattgaaaatttttaaatatttaagtgttatcaccatgtatggccccataaaatgga

SEQ ID NO: 51147 - DNA, 2154 bp, Heterodera glycines
  Genomic contig location: Contig_ID=SeqID_3620; Location=1241..3394; Strand=-
  SCN-specific regions: Sequence locations=1-43,97-187,222-366,421 -477,499-563,599-736,846-1026,1065-1426,1458-1655,1677-1698,1721 -1743,1766-1902,1925-1983,2024-2154
  Gene Ontology: Mol. function=dicarboxylic acid transporter activity; Cellular component=mitochondrial membrane; Biological process =dicarboxylic acid transport
atgtctgcgaaaatttataaaaccgacggattttcggggtgagaaaattttcaaaaaaaattgaaaaattttattttatgtatgtttttttttttagtttttacaacggactttccgcgtcaattatgcgacagctcacttacaccacaacacgatttgcggtgtacgaaactgtaattttttcatcaaaatttaaaaagttattaaaataatttttttttctcatttttaggtgaaaaagcaatcgtcaggcgacttgaattttggccaaaaaatgttgctggccggggttgcaggtgtttttttaagaattaaaataaattttgcactattagtgggcaaataaccttcattttcccctccccgaaaaaataaattacaaattttttaaaaattttgatgaaatatttttaaaaaattcaggcgcttgcggcggtgtggccggttccccagccgatttggtcaatgttcggatgcaaaatgacatcaaattgccaccggctgagcggcgcaactacaaaaatgcaattgatggattgtttcggatggccagggtccgaaatttaattgattaaaataattaattaatgaattaatttttttgatttaattttcaggaggaaggcgtctcaaaatggttcaatgggtgcaccatggcaacaggcagagcagtgctgatgaccattggacaactgtccttttatgatcaaatcaaacaggtggggaaaaaaattggaaataaaaattaaatatttttcctaaaaattgcaaaaaaatttttttttgtattttaccatgtataaaatgcaaaattaaaaaaaaataaagattaatttttattttttgtcatggcatggttgttaacatattttctgtagggaattttccgaaaatctcaaaatttcggacagggaataatcactattttcttcgctatatttttcaaaattaaattataaatgtttttcgtacatttaaattattttcacttacgcgtacagatgctaattgccgcaaatttggctcaagacaacatttacacacatttgttttcatcatttttggctgcttcaggcgcaaccgttttaacgcaaccaatggatgtgcgtttttcaatttttcaacccaatttgcaaatttgtgccgtagggggcaattagtccccatttataataattgaatcattaagaccattattaaaatgggctctcgcaatatgctaaaagcctcaaaatttgcatataattgacatagctatactatgcatgctttgccgtattcagcaaaaagtttttgagtcaaaattttattcgtaaattggtttttttgtttttgttttttgatcaaattgcctcattatgtcagacacaaaactttggcattgttttgtcccattcatcgaatttaatgggcaattattccgtgtgaaaacatattttttattattagaatcaagacccggattgttacaggtgctaaaaacgcgaatgatgaatgcaccgccgggacagttcaagggcctatgggactgttgtgtgtacacggccaagttgggcccgaccggctttttcaagggctttttccctgcatgggtgcgattggctccgcacaccattctggtgaggctagatttgttgtaaactgttaaattttacgaattttgggaatttcccaaattttaaatggtgatattcaatgaaaattaattttttttttttttgtttccccagaaaaatggttgcgttgcatttacaatgcacaaaatatgattatttttagcgaaaaaactgctaaatacaatttttcgaccaacagtgcctatatattgaaaactttaaaattgatatcgaaataccgttttcgaagccgaagagaaaaaaaagaccgaattcctcggaattaaaatatttcattattttaatgcggttggatgcttattggagtttcattggcatatggacgattttttatttaatcataagcaaatttttatttaaaaaaaaattaattattttttaaaattcttttcagctttttgtcttctttgaacagctacgaatgcgttgtggttatttgccagagaaaaaagtgatgcaaaaagaggcggacgatccgaagaacataacaacagaaaatttcagcaaagaaaaatga

SEQ ID NO: 51148 - DNA, 368 bp, Heterodera glycines
  Genomic contig location: Contig_ID=SeqID_3621; Location=164..531; Strand=-
  SCN-specific regions: Sequence locations=1-77,108-246,285-368
  Gene Ontology: Mol. function=dicarboxylic acid transporter activity; Cellular component=mitochondrial membrane; Biological process =dicarboxylic acid transport
atggattttttaaaagcggatgaacgtcgtgtttcgcgctggtattttgggggcatcgccggctcaatggctgcttgtaaaaaaaaaaattaaaaattttaaaaaatcccaaaaatttccattttaaaggttttactcaccctcttgacctactcaaagtgcatcttcagacacaacaacagggcaaattgtctttgcccggaatgtctgcgaaaatttataaaaccgacggattttcggggtgagaaaattttcaaaaaaaaatttgaaaaattttattttatgtctgtttttttttttagtttttacaacggactttccgcgtcaattatgcgacagctcacttacaccacaacacgatttgcggt

SEQ ID NO: 51149 - DNA, 333 bp, Heterodera glycines
  Genomic contig location: Contig_ID=SeqID_20596; Location=930..1262; Strand=-
  SCN-specific regions: Sequence locations=1-333
atggttgacgtgcgcaagaagctagagttggaggtcaaaattgaccctgccatttttgtcgtttgctccggcggtgcctttgacccaacaaaaacgacattaatccccgaacttgggcaattgaaactgaacactttggacgagccgtccacaaaagcatacgaacatgtcagggaattgtttggggcatcattcaatttaagaaaatgataatatttgcagataaccgatcagagattgcgttcattggtggccaaggcatacgacaatttccaactttgcctctccaatctccgacttgtcttttcgactcgacgacgtccaaattccgac

SEQ ID NO: 51150 - DNA, 127 bp, Heterodera glycines
  Genomic contig location: Contig_ID=SeqID_20600; Location=1450..1576; Strand=+
  SCN-specific regions: Sequence locations=1-127
atgaattctctcgttgaaattttatgcgattttaacgatagtgaacctcacgaattatcagaaattctacgacatcggaagaaagaaaaagtgaaacttttaagaagacacaccctaataacgcccg

SEQ ID NO: 51151 - DNA, 2769 bp, Heterodera glycines
  Genomic contig location: Contig_ID=SeqID_20601; Location=249..3017; Strand=-
  SCN-specific regions: Sequence locations=1-384,406-498,529-599,621 -660,690-727,749-763,787-830,865-894,919-1123,1174-1379,1424 -1695,1717-1718,1740-1894,1916-2323,2345-2769
  Gene Ontology: Biological process=regulation of protein activity, epigenetic
atgcgctttgcgtttgccgtttctcgcccgggggttctgatcatcgtcacccttttggcattgtgttgtgccatcagtgaaggcggaaagccgcgctctaaatcaacccataaacccgatgtttcatcatcgtccaacaatataccgagtccgcaattcaaatggaataacaatgcgcctgttcttgctccgtggcgttccgctgcaaatcaacgcgtcagcgatcttcgtaccgttgagctgccattctatcaacatataaaagtgagtgcaattgaggagccctggggtaaccgaggattggcatataaaaaaggatttaaattaatttgtcatcgaatctctggccttaggatgaattctggcatttgttttcaaataaaattggatttaatttatttttaatgacgtatgtatatattttcgaggcgaaagctcatgattgtgattcctaggggataggtcttgtagacgtttcttaaatccgcaaagggatagtaaaacaaaaaatgtaaaacattattataaattttcatcgttggcatatttcatccattatgaccttttggattaagtcatccggctatcaatgaattaatttacaattttaaggttattgtgccaatgacgaaattgcccccgtatccagtgcccacttggacaggctttggacatttttcacatatatttgttgtgcccagagaagacttgataaatactgggcgagtttttcagatttttaaatattgcaatatcaaatgactaatttatttttatattttaaatggatgaacttatttcgccccatatattttcggtatttcaaaatgttcaattaacaaatattttttggaaaagaatggcgtgactttgtgtattcattcaattatggggaaaataatattttttttttaatttcagaaattgaattattttctctttaaattcggtttcccctcagttatgaagtccaactgcgcatgtttatgttggataccactgaggagcaacaggacgcttttccgccgcactcaattatgaatattgacgggtatcaagttaggctgccggtcagtgtccgcgtccgggtcattttgtataaattcacaacatgggcgtttcgtaaaataaataaaatcttaataaattttcttaaacacaaaattaaataatcttatatcatcgattgttcttagtttgctttaagaacctaaaaatttttagaaatttattcagttttcatgaagttgtgaccacgaatgctcaaaaaatgcaagaaatttagaaaaaaatgtaattttctgagatttttcatgctaataaagcaaaaaaattggcagttttacgaaactttgtaaaaaaaagctaatattttcttcaaatttaaaataatattaatatttttctagtttttaaaaaattagtcaaagttttttgaaacggtttaaaaacaaaaaaacttatttgacaccatattattgttttgaaaatgataaatatttaactgtatcaaacattcttcggcacatttttgcacaaatatgttttcataaaatttataatatacaattttataggtgctggttttagcctagtggataagaattaacaaaaatgttaaattgttgccaaaaatttgggcggaggggctattagtgccatcgaaaggcgcggcaagagaaatatgatacgttaataaaaacaattaagaaaagtgctccagatttttaaaaatcacatgtttttcgcgcttaaaaaataattacccaattaagaaatagtcaaattaactaattcagcaaatcaattcaaaaccggaaaagaagcaatgctcatttccggtggacatcacacgttacgtgcaccctcgggatagcgaaaacaatgagcaccgtttggaaattgaatgggacagcgacaaacgcgcatgggcatttacggtagtttaattgatgggaagaaagaagtgctgtatgagaccgaaaattttccgagaatcgagaccgtaaagccgcgacttgagaccgagaccaaaaaacccgagacttttctcgagtcaaggctcgagaccgataatgtgccatcatatcccaggccaccaaagatttgttccgtcaaaaaccttaaaatattagattttgagttttcctaggcggcgcctgtcggcaaaatcaagcatttatatgttttctttgatttttagtaaagagaattatattaccataattccgtgctaaatgacaaaaaatcaaaaatttcgatttgaaaaaattttgtttaaagttttacttaagatgttgagaaactgactaaatgtaaaaagtaaattgaaactataataaaacattgtttaaaatttaccaaaaatttaaaaaaattgtgtccatatttaaaaattgatagcctctcaaaattctctttttaacatttaaaatttggtaaacaaaaatatgctcaaataattctgcacttataatcttttgaactatttggttaaaaattaaaaaaagtgtttttctgaaaatttattaagtaattgagaacaattaacgggatggatgataattattcattttataaatacagattaatttggtgaagcgattggactcgaacaatctgttgagccgtattctcgacaacccaaacgctcgacgtccgctggaaagtactagacaggaaattgttaaattgaacaacccggtcgaagacggagagcaaatggaaatggacgctttgaagctctcacttgttgatccggtgtcttaa

SEQ ID NO: 51152 - DNA, 264 bp, Heterodera glycines
  Genomic contig location: Contig_ID=SeqID_20602; Location=340..603; Strand=+
  SCN-specific regions: Sequence locations=1-61,83-97,138-264
cagagagttgccaaagaattggaagaattcgcagggatttgtgagacaattgcagaaacaaaggagaaagggaagaggaaaagtgcaaaggcagaaaaggaagaggaggagagggcggaggaaaaagaggaggaggaaacgagagggacgaagaagcggaagaagaggggagaaacaaccgatgaaggggagggacagcagaaggggaggaatgggaagggccaaacgcggcggaataaaacgcaacgagggcctgacggatga

SEQ ID NO: 51153 - DNA, 1354 bp, Heterodera glycines
  Genomic contig location: Contig_ID=SeqID_20602; Location=1187..2540; Strand=-
  SCN-specific regions: Sequence locations=1-305,327-546,568-724,746 -1221,1243-1281,1304-1354
catttcgagaagaacttctttggtgtttctattggctcggtttgggcgttctctcctcaattggacttggcacgggtcttcacacttttctcctttatttggtcagtgtttcccgccgtttcctccattcttcgctttgtttttaagggaccgcacatcgcccgagtgactctcgccgccttcgagtgcaattcattggactttcccgaaccgccatatcccgatgagtcagtttcccttccatttgtcctttctccactaatttcactgattccgttcagtgtcacttgttccacagatgcgatgggtcattcttcgttggttacgctttggacaatcattgcgaaggtaaagcaaatcgttcgtaaaaacattcgttggcatttgcaggtgcgcttggagtcactcatgtggggcgcgggcaccgcactgggcgaattgccgccctttttcatggcgagagcggcgcgactgtcgggacacgagccggacagcgaggaatatcgagaattcatcgcaattgtcgaacgcgatgcgactaatcaaatggtggggatttgatttaaatatgcgatttttccggtactcaaacgttcgtaccctcagaatttgatggaacggataaaactttggatggaaagggccgtgacgcggatgggctttcctggcattttgttgttcgcttccatccccaatccgttcttcgacttggctggcatcacttgtggtcactttctcatccctttttggacatttttcggcgcgactttaatcggaaaggcactcgtaaaaatgcacatgcaggttggtcgatggtcgagttggtagtggtgaccaatttcgttttaatccactgatcagtcaattttttcaaataagtcactcccaaaaatgacaatttcgctttgctcattccactttttttgccctaatacaacattccactgtcagatgttgttcgttgtgctcaccttttctgaacatcacgttgagcatttggtctcgctgttgaacaaaatcccacggattggcactgttcttcaggcaccgctcaaagagttccttcaagcccaaaagatcagtctccaccgtcggcccggggacccaattccggaacaagcctcaagtctcctccaacaaggcgagtaatccaccttctttctcacctaaattctgctgttttcagtgatgtcctattttgtttctgcaatggtaaatagaaattccttcattttgtaggaattcaaatgttttttttcagattctttggttcgtttattccttgatcaattctttggctcagcaataccaaaggcgtatgtgggaaaaagaacggattgacaaaaagttgtga

SEQ ID NO: 51154 - DNA, 1065 bp, Heterodera glycines
  misc_feature (972)..(972): n is a, c, g, or t
  misc_feature (1010)..(1010): n is a, c, g, or t
  Genomic contig location: Contig_ID=SeqID_20603; Location=617..1681; Strand=+
  SCN-specific regions: Sequence locations=1-73,129-298,327-542,589 -658,686-686,709-805,840-980,1002-1065
atgtttaaatttcttttttcacgtcctgaattgctcaaaaaaattgctggaggtgagaaatatttcgtaaatgctcattttattgaataaaaggcaaaaacaagccccaaaacaacgttttaaaaaatgtacttaattttgaccctaaaaacttattttttactactgatttacttatttcggaaaattttcgatgcgacctctgatttaagcataaaaaattaaaaagaaatgaaagggaaagagaaattaacaaaaatttgggaattaatcgtgacaaaatttacaaatggaagagggaattgaagaaggaaatattcaaatttttaatcattgtcccattttgtagaaggtacaattatcagattatcaaaggaacagaaaatagaaaaaattaaacaatttgaaaaagtgaaaaaagaatttacaagaacattcaatttgaaacccaatgggaaaattaatgaaaaaatagcggaaaaaatttgcgttaaatttaatacaatttgtgattggaagaaaaaatcaaaattgataacacgtaatttaattaattaaaccttttaaattgtaaaatttaatttaaaacttttctttttaggagaaagaaaagtttactcggatgctgagaaattggaatatgtgaaaagagatgaggagatgaaaagaagaaacccaatgataagtgatagaaaaattgccgaaaaattaagcattccaattgccaacttaatacgatggacgaagaaattgggcaccaaactgaaccgttagcatttcgatcatagtaattagggtttgcggattttcagtgatttattttatttattgtgtctttaattcggtgataatgcatgaaaaaagttttcatcctgaaactcttcattttaatcttcagtgcaacatttcggcatcgggattcatccctcatccaatgacatcaacatcccaataacagcaaatttagcttanatgctcctcgtaaatgagattttggatgtgaattttanaatcataaaaaatcttagaattggtcgatcatatggggtctttgcattatatgta

SEQ ID NO: 51155 - DNA, 1490 bp, Heterodera glycines
  Genomic contig location: Contig_ID=SeqID_20604; Location=9..1498; Strand=+
  SCN-specific regions: Sequence locations=1-51,73-519,542-600,622 -690,713-786,828-907,929-1009,1031-1116,1154-1183,1205-1290,1321 -1396,1418-1490
atgggtgctaaggagatggaccggaacccggacccggcctgggagatagcccttgaaaaactgatcaaaaagttgttcttgatcgaatcggtccgggtccggatcagcactttgggtcctccgaaaagtgtcaggtgggcctccggaaaatgccaaatcacttttcgtactttttggaccggttccggaggcccggaaaatcggcaaacaattttcccagactaattttgacccggggaatctaaactcgggctcggaattccggatttggaaagtctgaatccggactccggaacttttccgaatcttccggatttttagctgaggcgaaacttgtatagtgcatatccccccccccccgttttcatcaacccaatacttaagtataaaaaaagttatggttatttaaatccacaaaaccttaagtcggaatttttgtccagaacttttttgaaactcaattaaattttttggaattataatgataggtaaatagtttaaatagaggagttgaaattctaaaaaaaaattttatttaattctttctgaaaaaaagttataaagcattgaacaggctatgttttttgccacagtcatgcgaatataattataaacatttaaaattttcaagccataaaatgcaattgagccaaaattaatttattattcgatagcgctaagatttctctatttaccttaaaattttggaaaaatttcattgagtttcaaaaaagttaaagcctagaaattatgactcaagattttttaaaattttgacaccataactttttttataatttcatataaacattttttaaattaatattctgagagacaacacacttaaaactattgaggatatcaagaattactaatttggttgaaattgggccaagatacgaatttatatgtcttgcattttttatttcctacaacatggcagtatttaagaaacgatccagcacgatttatatgtgctaaaattctgaataagtatgtacttattgtcttcttttgaaattttcaaaaatttctacaactttatttgttttatgataaactgttatgaaacagaggcaaattttcaaaatctttcccgaactcgactacttaaaccctttatttttgtcataaaattggctaaaaattaaaaagtttgatcagctttgacaaaatccgtaacaaatcacattaagattaaaaaatattcctcagagacaccaattaggaccccgaccccccccccccgccctatattccaaaaaatttaaatgcgctgtaaaaaaatgcttaagcaaaaacaaacaaacaaacgtgttcatataatccaaaatcaatccatccatctcaaatcttactaatgatagccccttctcatgtccatgccaccttaaaccacccaaatcccacacccacccatcctaattcctttttctcttaaaaattaataattgcaggctgaaaatgtaatattgtacttttttaattga

SEQ ID NO: 51156 - DNA, 811 bp, Heterodera glycines
  Genomic contig location: Contig_ID=SeqID_20605; Location=28..838; Strand=-
  SCN-specific regions: Sequence locations=1-15,37-811
  Gene Ontology: Mol. function=cytoskeletal protein binding; Cellular component=cell-cell adherens junction; Biological process =intercellular junction assembly and/or maintenance
atgaaattgacaatattcgccattctgtttgtggcattgtttattgccatcgctgaagcaggtgagaaaaatgcaagattaaacaaataaatattgcttattagatggcaatgtccgggcaaaacgccatgaagaacgattgaagcgccaagacaaccgagctgatgaggagaaccgccaggtagacagtgctgatcgggagaagcgccaagacaaccgggctgatcgggagaagcgccaagacaaccgagctgatcgcgagaagcgccaagacaaccgggctgatcgggagaagcgccaagacaaccgagctgatcgcgagaagcgccaagacaaccgagctgatgaggagaaccgccaggtagacagtgctgatcgggagaagcgccaagacaaccgagctgatcgggagaagcgccaagacaaccgggctgatcgggagaagcgccaagacaaccgggctgatcgggagaagcgccaagacaaccgggctgatcgggagaagcgccaagacaaccgagctgatcgcgagaagcgccaagacaaccgagctgatcgcgagaagcgccaagacaaccgagctgatcgggagaagcgccaagacaaccgggctgatcgggagaagcgccaagacaaccgagctgatcgtaagaagcgccaagacaaccgagctgatcgcgagaagcgccaagacaaccgagctgatgaggagaaccgccaggtagacagtgctgatcgggagaagcgccaagacaaccgggctgatcgggagaagcgccaagacaaccgagctgatgaggagaaccgccag

SEQ ID NO: 51157 - DNA, 457 bp, Heterodera glycines
  Genomic contig location: Contig_ID=SeqID_20605; Location=168..624; Strand=+
  SCN-specific regions: Sequence locations=1-457
  Gene Ontology: Mol. function=cytoskeletal protein binding; Cellular component=cell-cell adherens junction; Biological process=axon guidance
ctcggttgtcttggcgcttcttacgatcagctcggttgtcttggcgcttctcccgatcagcccggttgtcttggcgcttctcccgatcagctcggttgtcttggcgcttctcgcgatcagctcggttgtcttggcgcttctcgcgatcagctcggttgtcttggcgcttctcccgatcagcccggttgtcttggcgcttctcccgatcagcccggttgtcttggcgcttctcccgatcagcccggttgtcttggcgcttctcccgatcagctcggttgtcttggcgcttctcccgatcagcactgtctacctggcggttctcctcatcagctcggttgtcttggcgcttctcgcgatcagctcggttgtcttggcgcttctcccgatcagcccggttgtcttggcgcttctcgcgatcagctcggttgtcttggcgcttctcccgatcagcccggtt

SEQ ID NO: 51158 - DNA, 658 bp, Heterodera glycines
  Genomic contig location: Contig_ID=SeqID_20606; Location=69..726; Strand=+
  SCN-specific regions: Sequence locations=1-17,48-125,148-235,257 -396,418-604,626-658
atgggtgaagtatttggtaattaataaattaattcattaattaattatggaatcaatgaattaaaatttgaagtaaatattattaaattgggggcacaatctaggaaattggtctaattaacaaaagctttttatttttaggaaaaaagcgattttctgaattagagaaacgaaaaatagtgagacattttatggaaatgaaagcgaacaattggacaaaaatggacaataaaacgaggagtgagaaggagaaagaagtcactatgacctttgaagtgagccgaacgacgattgccaaatggaagtgccaattgagaaagagagggggtaagaaagtgccaaaaaagaaatcaaaaactgaaaaagcattcaacagatgatcaatggtcggaagaggaagcaaatgagcacacatcggacgaaggcaccgaaaatttggacggagaagaggatggacagcaaccaatggcacatgaggacaatgccaatgaaaatgatagtgaaaatgccaattacagtgaaaatgataatgaaaatgccaattccagtgaaaatgatagtgaaaatgccaatggccgtaaaaacgatagtgaaaatgccaattacagtgaaaatgatagtgaaaatgacactaaaattggagtcaaagaatctttgg

SEQ ID NO: 51159 - DNA, 764 bp, Heterodera glycines
  Genomic contig location: Contig_ID=SeqID_20607; Location=988..1751; Strand=+
  SCN-specific regions: Sequence locations=1-24,86-240,262-764
atgaccgatcagcaacaaccaaagaaaaaaatgtaataattattaaaataatttacctttatttttaaaaataataaaatatttaggcccattgagctttgccaagaagtagtacaaatgtgcgatcataaaggccctaccgcatttgtaaaaattgccaagataaatttccaattttggaaactcgtcaacgaccatttgcggaataaaaaatggcttcttgattatttggagattgatgaaaaacaaatgaatggaaggacggaaatggttatttatgacggaaccggaaaaatattgccaattccgcaaaatccattgcccaacaaaattagcggcttccaaacgatttggatcacgtaaattaaccgattatagtaaatattatttttttttgttaactttctagttacctggatgcaaatgtgatcgcttttctccacctttttcaacatcttttcacttcgtgtgaaattactttgaccattgaaatgaccaatggtcaatttttgttcagtttggcccaaaatatttggccactgatcaaaaacaacgttaaacgcttttcaatgccgaccaactttgaacattttcggcatcacttcccttcaattctcagcagcgaccaatggccatctctccaattcgtttattgtgaagatgttttgcccgatttcccagccgatgatagtgccaacgcgtcggatggacaagttctgaccaattggctgttttcggcacattcttgtgatttgccaccgaag

SEQ ID NO: 51160 - DNA, 567 bp, Heterodera glycines
  Genomic contig location: Contig_ID=SeqID_20610; Location=351..917; Strand=+
  SCN-specific regions: Sequence locations=1-259,282-372,408-443,491-567
atgtgcgatggaagaggaggacgaattggacatttacttgcgcacttcgttcactcaagaacagactcagtcagtggcaaagtgccgatggattaattaccttcccccccccactttagggacattctcgaattttggtcatccatcggcgaagcacaggtaagacagatgaaaggacatcatacacatttaggcataatgactaacttcgctgcttttcagttcccccgattggctcgcttggctcgtttcattttggcttcttccggcgcgccgtgcccaattcccttgcagcagccgtccatctgcaaattgggaccgtatgaaattggcaccaggcttaacttgaggtgttttgtttgtttttttttgccaaaaatctctcccaaaatatatttttaggccagaagtgctgaattcattggcccatgtgccccaccaatcccaacaagttcagcagcagcagcaacaccaacagtcggcctctcccatggagtgaagcgactgaaccgtcaaaccgagcggagaacggcgccaagcataatcccgaagtccctctccgtgtga

SEQ ID NO: 51161 - DNA, 789 bp, Heterodera glycines
  Genomic contig location: Contig_ID=SeqID_3623; Location=309..1097; Strand=-
  SCN-specific regions: Sequence locations=1-231,253-260,285-336,358 -376,431-482,504-604,626-693,744-789
atgcctaccgtaacgattaaattcgggcgaattgtgcataagatagaaggacagactcagttgtttgtcgcccatttctggcctccccattttgcctctgattacaacggtgtccccggcgttcagtgcattttcaaattttttggaccaactttggcgttttgatttgacagcttcaggcttaaagtaaaaacaaattgaagtcgaagaaataaaatcaattatgtttgatttttaagaattttagaaaattcgaaatgaattaaaatatattttaaaaatttcaaaaagtccctaatttgtcgattcatttttaatttttcagcaaattccaaccctttgaagtcgaagaagaaaaaatcatttaagagttttgaaattttagaaattaaaaaattcgaaatgaattaaaatatattttaaaaaatttcaaaaagtccctaatttgtcgattcatttttaatttttcagcaaattccaaccctttgaagtcgaagaagaaaaaatcatttaagagttttgaaattttagaaattaaaaaattcgaaatgaatcaaaatatattttaaaaaattccaaaaagtgcctaatttgtaaattcatttttaaattttttcagcaaattccaaccctttccttcacttggggctcttcaatactgcttgggtagacatcgcccgcaatctgagcaagtttaaattatttacatttattaaaattcgaattatatttaataattattagggcttccttttttacgtaagaaaaatcgctaaatatgtaaataaa

SEQ ID NO: 51162 - DNA, 660 bp, Heterodera glycines
  Genomic contig location: Contig_ID=SeqID_3623; Location=1855..2514; Strand=+
  SCN-specific regions: Sequence locations=1-192,214-521,546-630,653-660
atgagtttgtttaatccaaacgaaccgttcgaaatgcgaattgaaacggtacaggaggagggtgaaggtaaggcaaagcaaaggattcgaaaaatcggcataaatccacaattattagccaattttagtccaaattataatcatttatatgttgaaattttggataaaactgataaacaacataaaatgatgaagcaaaatcacattttaatgttctggattttgacaccaaaaatatgctttatccgaattatgtttaattgaaataagtaattttctaaattccttttcattttacccgattgaattaagcgatttttcgaatacaatgcaaatttagtttttcttttttttgagcggatttcatctcacattgaatttattgtctttggcagagtttgggcagctcaacatcactattagcactccaaatggaattcgtcaaacaatctatcgcctcgtgtcaatgacctttcgggacattaactttattaatgtcaattattcctactaattatgactaattaattaaattaattatttttcctttttcagattgtcggttctcttgaactatttgaggccccgtttgttgttgccccagaggtagaaaattcatttgattttgagaatttttcaaaatttaatgtttaggatgga

SEQ ID NO: 51163 - DNA, 560 bp, Heterodera glycines
  Genomic contig location: Contig_ID=SeqID_3624; Location=379..938; Strand=-
  SCN-specific regions: Sequence locations=1-405,429-455,477-560
atgcacttggaaagtgagttggtacgatcatagccctgttttatacaaatatcttgcagttttgccaattatttctaaaaatttccttgaaaatttcaaaaaatcgaatgaaaatttaatcaaaaatggtgcgcatatataaaagtgccgtcattatgcccaatcattccattctctctctgttcatttgtgatgtcctttcttttcgaagaattcaatgcgtggctgttcgtgcagtttcaaatcgccttcgatcttaaattattttcaatttttttcgaaaatttcaaattttcatccacccgaatgtattggattgcccacatgggcattgtttcgatgccgaacatgaatttgccgaagccctccaaatggaacatgggccgtcttcgcattatgattttcagatggaaattttgtccttcggtcagcgccgatttcaaatgatgctcttcgacttcttcattctttaaaaatttgttaattgactaatttataaggttgaaatgaattgttcttcaaatggtgctataaggttactcaaaaaccatcaaaataaa

SEQ ID NO: 51164 - DNA, 234 bp, Heterodera glycines
  Genomic contig location: Contig_ID=SeqID_3624; Location=3790..4023; Strand=-
  SCN-specific regions: Sequence locations=1-234
attcccgcggcaattccgttggccatcggcggtttcgctgtcccatttttggtcacattgtcttcaattctaaccttacttttgccattttgacttggtttctgatcggctattcctttttaaatattattgtttaatgagattaatttcactaattgctcaaagaagaaattaggataaaaataaataggaattatttaacccataaaagttatttataaatgctaatattaa

SEQ ID NO: 51165 - DNA, 1457 bp, Heterodera glycines
  Genomic contig location: Contig_ID=SeqID_3624; Location=2215..3671; Strand=+
  SCN-specific regions: Sequence locations=1-329,354-363,385-804,870 -1403,1425-1457
atgtccttcttcatcctgactgtccgtggaggcgctgtgcgcggagggcgcggggcgttcattttcattggtgctcttgcagtggcagccgtcctgcagggggcaaatgctgaccagcaggctgccgacagcatacaaattaatgtaggtatattcaaaaatctaattctgtttttattgtattttttgcttttttcaaccactttttacttttatttttttgcctttcatactaggggtgggacggcggcgttttttccgcggttcgcgaccgcggcaatttgaatccgcgactgtgggattttttttttttgcgcggcgtgccgcggatattctgtgacaaatttttgtttgaagcgattgtcttttttgaatattcaaaataaaatacatttttttttgaaaatttggattatttttcacaaaaaattcgtttcaaaattccaatttttcccctccagagctgacaaaacctttaatttttctttaaattttttgattttttggcacaaaattttattttttttcacttttgtaaaatttttccatctttacttaccagtttaaaagtgcctttttctttaggttataaagcatattaaagagggagcccggaaatgcatagagcatcaccgaacgacaacaaccaccacaacgccgccgcaagccgagggcgagttttggcactttttagcaactataaatatcatcccaaattattacttttgcaatttttatggcattgattacttttgacatttttttgttgtcatcatttttttcaatgaaaaaacctttttctggaaattaaattaaatcaaaagaataatttaattcaatgaattaattaatattttttcaattaatatgcattgatttgcggatataagatgtttcttgttgttattagtgcatttttttctttcacattgttcgtgctatttattatcttggagacataagtgccacaatttcaattaggattgagctcgggctccaggctctccgccctattgtgcctctccccgatccccgaatctggcctctcaaacgtcctgagatttcttccccgaggggtcggggcttaaccccaattttaagcaaattcatcaaatgggccgttttttgcggtcctttggcacataaattggaatcaagagtaaattactcaattacgaaccttgtttaaagattaactcatttttccttgatttattttgttacattgcttacacatgcaaatgattgattattctatggcatttttccactttccttaggtaccacgacccggaaaatgagccgtgcgggacgaaagcgattggatttgatgcggaagcaatcgaacgattggaggcggaacagctgaaggaggcgctaatggccgaagcggaacaatttgggaacaaagacaacaaacaaaacgccaatcagatggaaatttgaatggaaattga

SEQ ID NO: 51166 - DNA, 594 bp, Heterodera glycines
  Genomic contig location: Contig_ID=SeqID_3624; Location=3936..4529; Strand=+
  SCN-specific regions: Sequence locations=1-124,148-484,506-594
atggcaaaagtaaggttagaattgaagacaatgtgaccaaaaatgggacagcgaaaccgccgatggccaacggaattgccgcgggaatctgaaatttttggcataaatttaaagaaattcacagcaataaaaagttcacacttttgataaattggcataatgttcgacaatcatttaataatttgggtttttaatatatcttctaatattttgaaaaagtctgcatctgtattttttttactacataggttcaatgtcagcaaaacgaaaatttagaattaaatgtgccacaaatcacaaaatgcttattgctaaaaaactgctcaaattgatcatggacaatcaaaaatataacatttgaacaatttaagagtgttttgaatgaattttgtaaaaatgcggctttttgacctaaaatgaggcttttgaaaattttaatctgggagccctgattaaaatgcttaacgattgaaaaatcccgggtcatatttcagcattttaatttgttatctcgggagtttggacccgagcggagcaaattgggcttatggcatgagtcctgaaattcaattccaagtgccgaaccaccaggaa

SEQ ID NO: 51167 - DNA, 1480 bp, Heterodera glycines
  Genomic contig location: Contig_ID=SeqID_20611; Location=822..2301; Strand=+
  SCN-specific regions: Sequence locations=1-377,406-465,494-504,537 -545,579-627,664-1480
atggcttttgtgccgtttaggcccctaattgttcatccgtcgtccgcccttcggtcgctttgcttgttgttggacaacccattgcgcagcggtaccgtcaactcatggtcaaacgacgccgtttgtgccgcgacttcgtcgtctgtgcccaatgtgacggcaccgttcggctgcgtttgaattggcaaagtttggcatcgctttcgcgcaaatcgcagccattggcaaagtgtgcgcattgcgaagagatcatttgctgtcggtgcgcacaaaggcagcatttgccgctcagttgcgaagagcgcgaactttacgagctcattctgcgatcacacggtgaataaaaatggaatataaacaaattaagggatttttcgattaaaaaaaatattatttaaattaattccgaattttcaccgtattttcacacgtgctgagtcgatccacaaaaaaactcagtgattgataaaataaaaaaaagtaattataaaatcggtgtcaatgaatttaattataattaaatgtaattataaaatcggtgtcaatgatgctgttaatttttgttttcattttcctcccatagatgacaaaagatatttgtgcaaaaaattttgaacgaaaatggcgaattttatattttctaatttaatttataaaattaatcgtataattaaattcattgacaccgatttgtataattaaatttaattaggggtcgacctagcaccttttcacattccccaggccactccctccaatctctgctcctttcccccggcttaaatcgcatcgcccgcggcgttcgctgcgacaattgcaacaatttggtggagaagaacaccggctgtgaccacattgtttgcgtttgtggctacgaattttgttggcgctgtggcggcgattggaaaaggcacaaaaattgcgtgggccaaggacgaattgtgagtgaatggcacaatgaaacatggcatttttgaatctttatttaatacattttgttagaacgtgccactgtttgatctcgtctttgtaaatgggcaaaacggaagaaaattggcaaaatctccggagaaattcttcgccgaatgtgccgagttcagagcactccgtcagcccaatgggcgcaaatttttcaaactgatggaccaaatatttggaaacgatcgcccgaggggacgccaatgggcggagaaatacattcaggcgagaaatattaattggccaattaggcaattaattagaacattttaaggtgtcagaatttgttgaactttgtttggcgaagcgacagataagcggcaaaaagtcggacgatttcagcgcggcgacagaccgactccgattcactttccgcacaattccattcattgccaaaatggacaataaaatgacactaaagacgatcagcagggatatggtggaacaaaattacgagcaaatggtggcgatcagcaagcacattatccaaatgatcagatga

SEQ ID NO: 51168 - DNA, 788 bp, Heterodera glycines
  Genomic contig location: Contig_ID=SeqID_20612; Location=199..986; Strand=+
  SCN-specific regions: Sequence locations=1-62,90-102,137-153,261 -261,293-299,328-489,520-788
atggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggtgtgctggtacgtgtcgcacgcgaccgccaccgacccccagctcgagtcaacacggacccgaaaccattgcacaattcacccagagtaaacagcactcccccggatccgggtaccagaccccgaaaggctggcctcaagaccgagctcacgcagctactccgagcatctcagcgcactccgcctgcaaatgccccattcgccactga

SEQ ID NO: 51169 - DNA, 236 bp, Heterodera glycines
  Genomic contig location: Contig_ID=SeqID_20612; Location=1486..1721; Strand=-
  SCN-specific regions: Sequence locations=1-236
cagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcaga

SEQ ID NO: 51170 - DNA, 792 bp, Heterodera glycines
  Genomic contig location: Contig_ID=SeqID_20613; Location=842..1633; Strand=-
  SCN-specific regions: Sequence locations=1-216,254-308,331-581,625 -707,730-792
atgattgtttttcaaattttgtgttttaaagttttatttgtttatttaatttatcgactatatttttttgcatttttgaataagcaatttgtgccaaacttcgaagaactgaagcgagcggttggccaattgcacggttcagatcgacgtgcgtgtcttgctataaatttagttatacgcaaattttttaaaattcactcttctgtaataataccctattatattgtattcttttaaattataaaataattttcactgcgtttgtgcattttttaatttttttcattcttgatattactatcgcattgttacgcttttccaactcatttaggtttgacgcttcaaatgttttttgaatatacatttttaaattttttgatgtattgaatccatttacttaaactagaagtatgtttttttaatatcacaaatcaaaattatattaatataaccttttctatgttttcgtatattgctttggatttagttttatatttttatgcttaaaatttttcttaattttatcgataaatttgtaaataattcattgccaaattttctagttaaaagcatataagaagtttaataaatttattcaagtaatttattagtttaatttaatttcagaaaattctggagtcaatgatttgtcgacaatgtatgtgatatgaattaaccaatattgttgcataattgtgcttagccgcatatggatccaaaattatattcagcgcgagttcatctgaagcctaaatatgactaattgattcaaaatttttaacaaataataaa

SEQ ID NO: 51171 - DNA, 491 bp, Heterodera glycines
  Genomic contig location: Contig_ID=SeqID_20614; Location=1..491; Strand=+
  SCN-specific regions: Sequence locations=1-39,61-192,215-387,415-491
  Gene Ontology: Mol. function=GTP binding; Biological process =cytokinesis
acaaatccttttccaacaagcgatgaatctcagcgcaagttaaaaccaccacagaatggcaatgtgcacagctcgcaaaacaaagcaatacccgagataaaattgactggatttgtcggatttgattcgctgccttaccaattggtcagaaagtgccaagaaagcgggtacatttaactagcatttttcgctattttatttgtttttgtggccccttgcctctccagattccaattcaaccttttgtgtgtcggtgagacaggaatgggcaagactacacttctcgaatccctcttcaacatgaaaatggagtttgagcaatgcaaccgcgaactaaagacagtcgaactccgcgaaaagactttcggtattcagctttaaagactaacaaacacaacattttttaaagatgtacaggaaggggctgtaaaggtaaaacttcgggtggtggagactgctggctttggcgatcagttggacaaggaaaagag

SEQ ID NO: 51172 - DNA, 772 bp, Heterodera glycines
  Genomic contig location: Contig_ID=SeqID_20615; Location=627..1398; Strand=+
  SCN-specific regions: Sequence locations=1-230,252-434,457-471,493 -547,571-772
atggttggattccatatcaatgcactcgagcgcctgatgaacgacatgatccaggcccccagtgcaagagcgctgagacttatcacgactgagtgtgagaatggcccgcacacaccgcgaaaaattttgcgtgtatgtttcgccagtttaatctcagacttggtagactagaactacgattttcacttttcctgagcttttttacattcttttcccgcctgactacatatcattattttttaatgttttggtatatatattttagtggattaatttgattgccgatcaaaattgtaagctccctactgtgaatgaagcaaagacctacgcgagggcactcgaggtcacaacccaaatcaaaaaattggcgcaaagacaaaatcgtatcacaaattcgtctttttatgccatgtggcagtccggtaagatatccaaatattaaaaaacaaacgaaaatctatgcttattatcttaaattatacaattttaaaaaattcatgggatgacagaattgctcgtcaatctgatgaaactaccgtatgcaacggggaacgagcatctcggctacattgaaaacggtgggtttatatcctacccaagacctgacctttatcacttaatttcagcattgttgaaaaagcagatcaatttcgagagtttaaaaacacctcatgaaatttcacagcgcatggtaagctttttcatagaaaatcgtttcgattcctaccacgcggatgtgcatcgcaatgcaagtgctgattatttcgagtaa

SEQ ID NO: 51173 - DNA, 926 bp, Heterodera glycines
  Genomic contig location: Contig_ID=SeqID_20617; Location=421..1346; Strand=+
  SCN-specific regions: Sequence locations=1-926
atgttttccgtgccgatgccgtcttgtctgttaccgtcaccttcttcaacgtctctgactcccgtccaaacacccgttctctcgccaattgtaaatgattcacgtttttcttatcacgtgccgatgccgttctccccattttcaccgcctccgactccaactttttttcaaacagccgttcccgtcacggatgacactttgctccgtctggccaattttgtgcgttccaccaacagtgacactcaacaacaacaacagttagtccgacaacaacaaatggctgggattgagagcaaagacgacggttaagaaaaagcaatattcttcattcatcaatgtttaatttttagacgcccgccgcatttctgcagcgaatattgggacaatggcaagggtggcgatgctcgaattagtcagaggtattttcaaaaatattttaaccatgccaatagaactgtcataagctatcagtttttcataccaattcttccactttatttatatttgccgaattactgactttcagcccaagtacgttcgccaattgtggactttctttgtatggtgctgtctgacttcaaccaatttggtcacttctgttctttcatcgatagtcgtgaatttaaaattcttgtaagtaaaaaacgaattcaattttataatttcaattttgacagaatacaaaagcgtttactgagcttctcaatcttcgctctaaacagaagccggtgagtaccattatagaaaatacgacaaaaaaaaagttattttaaaattgaattattccccttttttgacagaagtcgtatttgcaagtggcgcgtgcccttaagggttacgagggtcgattggtggatggccatgttatgttgcgaaaagtcaaggacaaaaggaaccagtttaagttcttcccggatttgccataa

SEQ ID NO: 51174 - DNA, 235 bp, Heterodera glycines
  Genomic contig location: Contig_ID=SeqID_20617; Location=1688..1922; Strand=+
  SCN-specific regions: Sequence locations=1-139,161-235
atggatattgcgaaccataaatggggtagggaggaaacggcggcatggcacagagaaatgatggataggtaagaaattgagatttagccaaagataggcaggtagatcgctccattttctgcaattttaatatacggcgaaagaagtgaggagagaaaatccccaaaattcaacattttcagaaaattatggtggggaaatctttcattgctgtgacgaatgttgaaaattttaa

SEQ ID NO: 51175 - DNA, 432 bp, Heterodera glycines
  Genomic contig location: Contig_ID=SeqID_20619; Location=428..859; Strand=-
  SCN-specific regions: Sequence locations=1-218,241-401
aacgaaattcgtttaaaccgtcggttgaacaaaacggcaccgagtcagctgcttgagtttattattgcattcaccaacttcagctatggcataaaactgaatggcaaatttttactgagcagtaatatcagtgacggcgaagaggaatttttcccacaaaaatggtgggaaaaattgcgatttgaccaaatgacgtcatttgaggttcgaaaatcagttgacaaagggctaaaagtcttgagatatcgaaaatgaattgagaatattttccaaaaaaagtgagaaatattggcgaagaatagtgggagaaaaaagatttttacttcaaaggcttatagaacctcaggggttttcaaaaacggaaggagagtcaaattaacagaggaattaatgagttttccttttaaaaaatattttaagaaaattaataaa

SEQ ID NO: 51176 - DNA, 804 bp, Heterodera glycines
  Genomic contig location: Contig_ID=SeqID_20621; Location=1372..2175; Strand=+
  SCN-specific regions: Sequence locations=1-804
atgccttctaaacaacaaaatttgagaaagaagatgcaagatgtgtatcggcgacaggcagagcgatctgtcagtcgggataactcacccgtctcagacgggagtgcagatgggaatggagaggcatcggcgtatctccggggcaccagcaccccaagcttaagtgctttgcaaataagcacgccggcttcttccattggaagtaaaaagaggggaagacccttgagagccggagcgaagccaatcttggctacccaagaaagggtgtctctcattgacacacctcgaactgcggtcactcaaagtgaccagggttcgccgtgcaaaaaaaggggaaaggtcgccgagtgtggccaacccatgtttgcaaatgaagctattgctttgacgcctgtttcgactctaagtcgtggagggcgaccagttaagcaactgggagggcatgccggtaaaggaagaggcaaaaccaacgagtctatgagcaaatgctctgaaattgaccaaagtgtggaaaacgctctaagtccggcaccctcgcacattgtgcctgaaaagataaacttcagcacagtgcaaattaatttcgctacatcgcgaaattttgcctgtaaaatttggaaatgggcagcaatcggcctttacgaacgtgatggcgaaacaccgattgccccaagctctggcccaagatacattgagacctgttggaatgatatgacccagtttctcaatgacggctttgctgccacatacttggcatacttggcaaccatatcacaacgaaaagtggtcgttgttgacccaatg

SEQ ID NO: 51177 - DNA, 78 bp, Heterodera glycines
  Genomic contig location: Contig_ID=SeqID_3626; Location=3228..3305; Strand=+
  SCN-specific regions: Sequence locations=1-78
acttcacttttgaaaagtctgatcaatcagcacgacccaaagccaagcacttcctcgtccgatggccaagtgacttaa

SEQ ID NO: 51178 - DNA, 664 bp, Heterodera glycines
  Genomic contig location: Contig_ID=SeqID_20627; Location=475..1138; Strand=-
  SCN-specific regions: Sequence locations=1-316,347-536,574-664
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggcgaaggccccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 51179 - DNA, 1213 bp, Heterodera glycines
  Genomic contig location: Contig_ID=SeqID_20628; Location=270..1482; Strand=-
  SCN-specific regions: Sequence locations=1-188,211-453,475-503,526 -876,898-1213
ttcgccaaagaaaaagcgtgacattgagaagaagcagcggaacagcactcagtcgggagaggaggaagagatgacgacgccgaaaacgtcaagagtgccaatgaaagcatcagcgataacagaacgagcacggaaggcgaacaaaaacggcaacaacgacaaattctcgtcaacaatcagcaacggcagcaccagttcggcagcttcgcgcggtgtttcgtcttcgtccactcagtgcgtgggccgcgcccagttttacgcaaattttaatttctatttttttttgttggattgggttcggaaaatcgattggaaaacaaaaatgagggtttttaataggcagaaggaatcgggatgcttttggattgatttggcatattcctgatttttaagcttgaatttaagtggatgattcggaatggcaaatcgtttaggtccctttcaagttattgtaaaataattgtcaaaatgtttggtcttggatgggaatcgaacccacgcccccaatcccatttacatttttggcttttaaaccatcggtcagctttttccagaacaacccaatcatcgtcgtcggcttcgtcgttgttaaatattgcaccggacattcttcgccaacaactcccagcaaaacccattggtaccgatgcaccgacaacatttccccttcttaccactctatcatcattaccagcagcagaagctgcaactgcatcatcctccgctttcaatttgcacggcggcgttcgtccggaatggtttgaccgattgttcgcttccaccacccatggagcagcagcaacagtggcacaaagaggtgcaggagggacgacagtaacggaattgtcaagcagtacccagcaacactaccaacagaagcagcaacaaccaaaacatcgaaaaagatggccggaaactgcggatgaagaggaggaatttggcacgacatttgtctgggagcagctgtacgcgaccaagatgttccagtttgagcaggacaaagcagaagaaggcgtggatgagtatggcggagtagcacagcatctgagagaagaagcgatcagaattggggacaaaggcaatcacttgctgaagacactgagcaatggaagtgatgaggcgacggcggcggatgccaacagctgtgtcggcgacgatgagtcgaacgcggcgcccgagtgggctgaccagggcatagccgactttgcaacag

SEQ ID NO: 51180 - DNA, 112 bp, Heterodera glycines
  Genomic contig location: Contig_ID=SeqID_20628; Location=1568..1679; Strand=-
  SCN-specific regions: Sequence locations=1-112
tcagacaggaaatagcacaaggtgggggacagtctcagaaggcaacagttttgggatgattagcagtgggggactcattggattattcgggattgcggcttgcttggagtcg

SEQ ID NO: 51181 - DNA, 49 bp, Heterodera glycines
  Genomic contig location: Contig_ID=SeqID_20629; Location=779..827; Strand=-
  SCN-specific regions: Sequence locations=1-49
ggaagctattcccgaaggattcggtctccccataaatctgggcgcatcg

SEQ ID NO: 51182 - DNA, 1414 bp, Heterodera glycines
  Genomic contig location: Contig_ID=SeqID_20630; Location=110..1523; Strand=-
  SCN-specific regions: Sequence locations=1-118,144-403,428-458,481 -1206,1228-1285,1324-1414
atgaagaaaatgtataataaagcaaaagaaaatgcgacaaaaatggaacaaaatgaaatggagcagaaaatatttctgactggcaatggacagttatttggcatggatatggcacaaacatcatcatcattatcatcatcatcgaaatcggcatcaaaaaatgccgatgctaacaaaaattatggcgagaaaaaggacgaactcattttgcatttgctaatctacgaagtggaaagcgtggtgaaattaatataataagaataattctaaatttgcaaaataagaccatttaaaatggacgaaaaatctcgagattgtgactattttcgtgcaaaaaataaagtaaataaaatttcgaaaatattgaacccaaggtaaaaaatacttgaggcaatttcgatagttttaaatgtttttattttataaattcggatccaaagaacacaaatttttcacgctggaaaaataatttatttctgtaaaatttaaatcttggaataattgaagtaataaaattggctgataaattcattgaaacatagattgaagatgaagcattcctcatgtttgtgaaagggcaatccaattttatgtatgtgttagagtatgcctttgatacggtaactcgacacaatctgaggcaaactgtagatgaaacaaacaaaagattttacacacaaaaatatgtaaagcaccttggcattttgcatttgatgcgaagggattggcattgtgccgaaaatggtgccaaattcaaaccagaaagcagcagcgacaaaaacgcgcaggaaattgaacggtaacaagggcataaacgaatattatggtcatttttgggttaggaattccgtgatttttatagcaatttgatggcagaaaatcttagcaaccaatcttttgccctgggcacaacttttagcagcttcaaatattagcctttgctaatgatcaattaacccaattacagtaatgactcagcattggtacagtatgagcaaaacgtggaatgcaaaaaatttcgctcatatttggacatggtttatgagtttttgttccgagtgcataatggagttgcttcggctgtgaagccaatttttgaaatgagcggcacaattcttacgctaattgatgtcattagtgcactgggcaaaatttcaaatttaaattttggatttgaattagaaaattttgtcgatgttcaaaaactgaaattgctaaattggaacgaattgttgaaatacagaaaaactgccggtaattaaaataaatttagctctttaatctcattaaaaattatttggaaaattaataaaattaaatttagccaaacctaaatttcaaactgaagaactatttatacaagtgtcgagcaaaaaaccggacaaccagaaattaagtgatgaagtttatgaag

SEQ ID NO: 51183 - DNA, 535 bp, Heterodera glycines
  Genomic contig location: Contig_ID=SeqID_20631; Location=697..1231; Strand=+
  SCN-specific regions: Sequence locations=1-23,45-57,104-145,167 -210,248-257,279-312,336-473,495-535
atggccgcatcggcactttacattcccgtgttcaagcgatgctcaaatttatcaaagtaaaaatatattttaaaaacaattgtttattattttaattttttaagaaaattgaatggtgatggagaagcaaaagcagaagcatcatctcaaaattcaacccaaatttatgcgtacatttttgccttagtccaatcggcgtcgacattggggtaattatttatttgtaatttaaattttaaataattaagtaattccgattgaaaattggtttttaatttaacagaaaactcactttatttttttaactccattttcaaacattttcagctccttttttggctcaacaattggtggctatggcgccgatgcgtttggattcccatggatttgtgcttttgttgcgttcgcgcattttctcttcataattttggaacaaatccgcaggatattgtccaaatatttataattaatatgattttgtttgtaattgatttgatgaactcagcccattcttttttgattctcatttttttaa

SEQ ID NO: 51184 - DNA, 385 bp, Heterodera glycines
  Genomic contig location: Contig_ID=SeqID_20631; Location=1901..2285; Strand=+
  SCN-specific regions: Sequence locations=1-385
atggtttaccaaatgtacttggcatccaagtacgaatccgagccctggctttaaaccctcaataaagtccgaaaatatgtatatattcaatatttgcttaaataaactaaaaatacactaaattactaaaaaatggtttaaagccaaaaaatgcaaaatattatcaaattcgagcttcaacaattgcaaatcaaacacatctcaagattttttggtaattatctcattctgttttcgtattgccactttcggcatacaatttgtgacatgaagtgccatgccatcgtcggatgagggcgtattgtgataaaatacggggaaaagagaattgagtaaaataataatataaaatgaaaatatgtgtcaaaaaaatataacaaaatca

SEQ ID NO: 51185 - DNA, 1431 bp, Heterodera glycines
  misc_feature (87)..(87): n is a, c, g, or t
  misc_feature (125)..(125): n is a, c, g, or t
  misc_feature (1355)..(1356): n is a, c, g, or t
  misc_feature (1361)..(1361): n is a, c, g, or t
  misc_feature (1370)..(1371): n is a, c, g, or t
  Genomic contig location: Contig_ID=SeqID_20634; Location=1..1431; Strand=-
  SCN-specific regions: Sequence locations=1-6,28-400,423-436,458 -852,879-992,1015-1102,1124-1431
  Gene Ontology: Mol. function=ATP dependent RNA helicase activity; Cellular component=nucleolus; Biological process=RNA localization
tcagtaacaggtaaagaatagtttacaaagaccgtttttttgtttcatcgcaatttcagatggataacaagtggcgaatacatccanaatgaagcggagggcggggagacggggcaaagacgagnaagggactggtcattctgatggtggaccagcagatgagcgcggagacggccatgcaaataataaaagtgccacttttatttttggttgttttcgaaatcacgcattttggcactttttagggcacgagcgatccactgaactcccaattccgactcacttacaatatggtgcttaatctgttgcgagtgccggacatcaatccgcagtttatgctcggcaattccttctatcagtggcagaattattcccgccttccggaccttctgcagagttgaaaagccattcttaattgttgatttctcgaattcttcagaacttaacaccaaaagacaacttttcctaagtgcgcatgtcgaccatttgtcggaattggaaggacttttcagattggagaagcaaattgagcagcagagaaatgccatcaaagcattggtactgaagccggcaaaagttatccgcttctttcagccaggccgaatgctcaaagtgacttttttgaacaccatgcttaacgctaaaactaaacgaaatgcattctttagctcaaatgcttcgacaaggacttcggctggggcgtgctgttgaggtacaccaaaaagccgaacccactgaatccgttgtctcctgaaatgctatatttcctcgacgtggctgtgttcgtctcgcgcgaaagtgagaactgcgcgcaaaatctatgtgcggtgaaacctccgccgcccggggagaatggcgtggtggtggtgctgcccttcgctttcgactgtatccaagcagtgagcacaattcggctaaaaattcctcaagagctgaagagcaaggaggcattccaagcagtggccaagaccattctggtgaattattttgttatttttgaacattgtcttttttcggaaagagcagcctcagacaggtcagtcccaccgttgggactgaacttcgtaaaggtatgcaaaagtgaatatgaattgaactgatgacatcgtttgtttttgttggctgatgtctctacacttttcatgacaaatttcagtgacataaattcgaaatattccatcagttttgatgtctagctattttccccgtaggaaacgaaaaaacgcttcgaccaactcattcccgaattggatcccatcgagcacatgaacaggtccgacccgcagctgaaaaagtctttggaagagctaaaaaggtgcgaagagcggttcacggaacatccgctaaaaggccgnncgcgncttcgatgnnatttgggaagcatctattatggggcaaaaactggaggacgaatacaaacaagccaagaag

SEQ ID NO: 51186 - DNA, 2007 bp, Heterodera glycines
  misc_feature (1923)..(1923): n is a, c, g, or t
  Genomic contig location: Contig_ID=SeqID_3628; Location=268..2274; Strand=-
  SCN-specific regions: Sequence locations=1-112,197-209,240-312,334 -812,834-924,991-1044,1103-1268,1305-1354,1376-1423,1504-1615,1637 -1639,1664-1959,1995-2007
atgagctccacggaagagaaagtgcgtttggctcaggcaaaagcaaccaaaagtacataatttaaatatacttaactttgaatccttctcctccttctctgtaaaaggaatctatttaaatttaatttttcaaaatttttatattaacataaaaaaaaatttaaaatcaattgaaaattgtatttttttttattttgggaaatcatcactaaaatttatgttttttttaaattttaaatgcttaaatttcagctaaaaaattgtctgaccacgaaaagaagagaattacgaaacaatttttcaacttaaaagaacatttggaaaatgaaaaaatgccaacgaaaatgttagagaaaaaaattgccaacacttttggcattcatgagcgaacagtttatgattggaagaaaaagtttggaattaatgcaagtaaattgtaatagaataaatttaaatagattaagacatatttacgctttattaatatcattgttttaagaaactaaaatcaaaagatattctaaagaacaaaaattcgaaattgtacagcaatttgaccaaatgaaaagccaaatgaaaggcaaatccatcgcaaaaacggcttatgaaatggaccaacaaattgctaaggaattgggggtcagccgttcagtgatatgccaatggaaaaaggactttggcatgacaagtaaattcaataagaattttcataaaatttctgactatttttttattttttggttttttaattttcgaaaagttaatttttcaagtgaaaatttaaaattttgtaggtcaatttttattctgccatttaaaataattatttttttgatgacatatttacccaatacaattttatttcgttgaaaattttgtttctctttttattaaaagtaatatttttatttcttgctgcattagtttttattattttttcaatttgaaatttttgtaaaagtgatttttaagaaataaaatatataaattgagacttttttaaagaaattcaatataatcacatttcttactcagattaattggtaaaaataaattattaaaaaattggttttttcagttattttgaaaaattattttttcagatagcaatcattgtcatgacgattcagagaaaataaaaattgtcaaaaaatatttcaaaatgataaagctgaatcctcatctttctaaaaattcctttgctgagcaatttaatattagtcaccgaacacttaataattggatcagcaaatttgcgatgaaaaatgtaaataataacaaaagtaaaataaatttaaatttttgatttaagcaacaaaatggaattctcttctgctgaaatgatcgatcgtttaaaaattgtttgaattattaattgctattttagttgccgctaagaaaaaaactaaagtttagaaataagttttttagtttattgaaaaattgtaaataatttatttatttattttttcttataaaagtttaatatatttaaataattttcatattgtattctttgctaagaatcagtgttataaatttttttatcccaatgttaataaaacctttaagattttgaatgtaaaatacttatataattcttccctccctggtgattttgtttttctcttaattacaattaaattaagacttaaaaaatatttaatgtggccaatgaaaaaagttaattaattaaagtgggtttgttttacttctaaacaaaaataataatcataatttaaaacttttgttcagctgttgttgcggaaatcgcatagttcggcgccgtttgttataaattatgtcattatcaaccaaactaaaaaatttttgttcatttgatagctcttaaggttgattggccacttgtgaaactgtaattttttatacgaaaaatatgaaaaagtggataatttcaccatntaaaatcgaaaaattttgattttgtaagaactttagaaaaaaatttattcataaaaaattaattttattttggcatataataaa

SEQ ID NO: 51187 - DNA, 3953 bp, Heterodera glycines
  Genomic contig location: Contig_ID=SeqID_3628; Location=3090..7042; Strand=+
  SCN-specific regions: Sequence locations=1-544,566-702,724-770,794 -1159,1181-1568,1591-2670,2692-3176,3219-3287,3369-3722,3744-3953
caaaggcgaactgaagtgaagctgagcaaaagcatcaacaaatttgatttgctaattccgagacggaatagcaatttccaaaatcgtcgaaaaggagagaaagctaattccgagttggaatagttgttcacccaggtggtggcactctcaattactggtgttaatccgggaaggataacaattgcaatcacttatcgaggccaaacagagcaagaggaaaatttgttggaaagcaaggctgaaagctgagtggcattgttaatccgattggataacattgcctcatcgattttgattgttaatccgggacggataacaatttactctcactgttaattcgagttgaatagcagttgagcagcaccaattttcattgttaatccggtacggataacaattgaatcactgtaaatccaagtcggattacagttgatcagcatcttgaatttgatccgagtgggacaaattaagaaaagtccaactatggcagcggtaataaaggctggaaaaggccccggaccgtttttgccagagatgtgctgggcgacatggtgggaacgtttcgaattcttcatccagcttaaaggcgtgaccgatgtcgcaacaaagcgtctgctcctgttcatcgaaatgggacaggtgtacgaagagcttcggcgaatggcacagcctgaggatgtccgaaccatggaccttgccgaaattgaacaactgatggtggaacgatttggcgaagcaaaatcgattgccgcgtcaggcatgaattgttttcagccaagcagcagacagggcaatcgataagggactattcggtgctattgcgaagtttgatagcaaaggcagaatggagccgcgacagcattgacatgtgtctatgcgcattgtttatcaatggcatctctaatgatgcaattcgggttgaattgatcaaaaagggcgaaggacctaaaattcaaggacgcagtcgaatcagccgttttgttggagcagtcaatttggatgcccaagcaattggctcaaattcaatgccggaggtcgcaaaagttggcactcagcaaagaggaccaagaacgccgacgaaaagcacgagaggttgttttcggtgcggaaaaccggggcattttgcaaatgtgtgcccgaatcagaattcgacatgcagaaaatgcgggaaaattgggcattgggctgttggttgcaaaatcaaaaacagagacggaaatgcgaattttggtcaacaatttgatcaaaagccaaagaccaacggacgaccaatcaagaagattgaatgttcaaatgtcagcgtcattcacgaaatcaagggaatttctgccgatcctggtttcattcaactcaacattcacaatggaaagttggagtttgagttggacagcggtgcggacgtcacagtgattgacgagatcgactggaaacacattggaagtcaaaattggaaccatcccaaggattggttgcctatggcgggaaatccattgcgggcattttaggaaaggcaaaagtgaaactgacgcacgaaggaagaacgattgagtccaatattcatgtcataagtggtaagcacaaaaatttgtgcggccgcgatttgatcatgggactgaaaatcgatctgaaccgagctttcggaattccgacaattcgtgccgttgaaaacaaaaaggaattggaagcatgtttggcccatgaagttgaaaaagttttggaccaatggcaggcggagaaaatcatcgagccagtggcaaccagtgaatgggccactccgctggtcattatgccaaaggcaaatggcaagctgcggttgtgctttgactataaagtcacggtaaatccttggttggatgtacaccaataccctctcccacgccccgaggagctattcagtatcttgaatggtggcgaaaaatttacgaaaatcgatttgaaagatgcatatctgcaacttatgcttgacgaaaaagccaaaaattgtcttacaatttgcacgcacaaaggaacttcgctcgattgccattcggagttgcttcggcacccgcaatttttcagcaagtaatggaagaagttctgcagggcattgatggcgtggcagtttatctggatgatattctgatcacagcagccactgatcagcaacacgtcaaaagaatcgaccaggttcttaaacggctgtctgagaaaggacttcgagtcaagcgtgaaaaatgtgaatttctcaaatcagagatcgaatatttgggacacattgtggacaaaaatggtttacatgcgtcacctggcaaaattgaggcaattttgaaaatgccggagccgaaaaatctaaagaattgcagtcatttctgggaatggtgaactactatggaaaatttgtgccatccctggcaacgctttcagaaccgctcaatgaattgaggcgaaatgatgccaaatggacatggacaaaaagccaacaaaaggcattcgataggatcaaaaatttttcacaaagatgaaaaaagaaaagttggtgtgattgcgtatgcctcccgaacgctaaattcttcggagcgcaattactcgcagattgaaaaagaagcgagggcaatcattttcggagtcgacaaattcaagcagtacttgtacggtcgaaagttcgtacttcaaaccgaccacgagccactaaaagagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattgccgtgtccggaagagacaaccatcgactgtgttggactcgaagttcagcaagttcaggccgaaaatatttcatgcttgccggtcacagtcagtgccatcgcaaagaagtcaaaaaggatgaaattcttcgaaaagtgaaagaattcatcgaaaaaggatggccacaaaaagtggaagaaggactaaaaagttttcggtgctaggtcgatccacaaaaaagctcagtgtgggcgttccacaaaaagctcagtgtgggcgttccacaaaaaaagctcagtgtgggcgttccacaaaaagctcagtgtgggcgttccacaaaaaatgctcagtgtgggcgttccacaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatgaataagacttttatttttatttttttgttatttcgatttgagtattcgacctctaccaattccggttttgaagaatttataaaaaatcacaaagctatagaacttgtcaaaagctatcaaaataaagaaattaaaacattaaaaaaactccatgaacaaatgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatttattcaaaattgatttccaaaatggcgaaacattataccttattgataaagtgataattttctttgactcctttttaatatttaacaaattataaattcccgaaatagaaaattaactgataacaaaaaactttatctcaattttattgtcttgctgaaggactaacaagaactaaaaataaacccattgaaattttttaatttatcttttttcacagcaaaaatataaaaa

SEQ ID NO: 51188 - DNA, 2973 bp, Heterodera glycines
  Genomic contig location: Contig_ID=SeqID_3629; Location=160..3132; Strand=+
  SCN-specific regions: Sequence locations=1-1899,1921-1953,1975 -2028,2069-2475,2498-2775,2798-2973
cctgcgaatgtttttcacaattcgaccaagtacctgaatttgccaggacaacaatcgaaaatgcacaatgagaaaacaagaggtgttacctgggatcagaaattttacacaaatatgaaaaaagagaagatgtagtgcttgcttatgcctccagaacgctaaaatcttcagagtgcaataactcgcagattgaaacacaagagaaggcaatgattttcggagtcgacaaattcaagcagtacttgtactgtcgaaagctcgtacatcataccgaccacgagccactaaaaaagatttttgggccaaaaggagagctcccgattgtggcggcaaaacgacttcatcgatggtcactgacattgatgaacttcgactttgaagttgtgtactgctctacaaagaatttggcaatgcagacggtctgtcgcgattgccgtgtccggaagagacaaccatcgactgtgttggactggaagttcagcaagttcaggccgaaaatatttcatgcttgccggtcacagtcagtcccatcgcaaaagaagtcaaaaaggatgaaattcttcgaaaagtgaaagaattcatcgaaaaaggatggccacaaaaagtcgaagaaggactaaagagttttcatgtcatccgaaatgagttcgccttaatggaagggtgcatcatgtttggaaatcggacaattattccgtcaaaatttcgcacaaaaatgttggaaattttgcacgcgacccacccggggatggtccgaatgaaggccctggcacgtcagaagatgtggtggccaggaatcgacaatgaaatcgaaataatccgaaaaagatgcaaaatttgccaagaagaggcgccggatgagcggaaagtgccattgcatccgtgggaatcaccagaaagactgtggcaacgaatacacatcgatttctgcggaccattttggggatcaatgtgctgatcagcatgtatgccaaaagtaaatggcctgaagtggtcagaatgcgaacaacaacggcattggccacgaatgaggcgctaaggattgtcttcacagcgcatggacttcccgagcaaattgtatccgataacggaccgcaatttagttcaaaagcattcggtgattattgccaatcacggggaattgttcacacattgatcgcgccatataatccaaaatcgaatggagccgctgagagatttgttcaaactttcaagcagggaatgaacaagctccaaaaggaggggatgaagcaagaaattgcattgtctcaatttctcctgaaataccgtgtcacaccgcacgcagcaacggaattggcgccttcggaaatcctcttcggccgcaggcttcgaactttgttggattttgtaaaaccaaccgcggtgaatgattttgaagaggccaaagtgccaaaagagtcatatgcggaacgaatgaaaaggaatttcgatcgcggggccaattcaagaaaaaatttcgaggtaaaccaacgagtttacgcgagaaattatccggacggatcaaaatggatcccaggacaaatcacccgaaaaattggaacggctatgttcctcgttcggacggcgagaggaatgtggaaaagacatttcgatcagttaaaagagaatttgactgatcagaattcggacaattcgagttcagaaagtgaggacaattcggactcagaggatgaagtgccgatcgatctgatggacgacgaacatctgccagcaccgccggaggaacagcatcaactggagcagccagaacagcaggctaatgctgaacctcgtcgttcaacgcggaagcgcaagaagccgaagatcttcgatccctcggactgatcacggcttcaagaaggagggacgaatgtggtgtagtgaccaatcaataagtggagtgaactttgttcactcctttcccttaggaacatttcatccccacatataagcgctgtcttccctccctccctcgttcattctggcatttattcctcccattgcaattcccttcgccttgaccattttattattatatttgtgcttcaaataaatatttgttttattcatatctgttgttctcggacacaacagattttggcgcagtcagcagagcaaaggcgaactgaagtgaagctgagcaaaagcatcaacaaatttgatttgctaattccgagacggaatagcaatttccaaaatcgtcgaaaaggagagaaagctaattccgagttggaatagttgttcacccaggtggtggcactctcaattactggtgttaatccgggaaggataacaattgcaatcacttatcgaggccaaacagagcaagaggaaaatttgttgaaaagcaaggctgaaagctgagtggcattgttaatccgattggataacatgcctcatcgattttgatgttaatccgggacggataacaatttactctcactgttaattcgagttgaatagcaatttgtgcttcaaataaatatttgttttattcatatctattgttctcggacacaacacatttcatttaaaaatcagttaaatattgatatatttatccaagcatatgaattaatatgatcaatagaataaaaatatttcattcaataagtaaccgcccaagaaatcactcacaatccaaaaataatagagaaggcttatatatattggaatttgcttctaggctttattcatttagacatacatacatttagcagtttgccaataatttttgaattctaaataaatctaataaaaaatagaaattcatttacattttttagcaattttaaaaatttcattaatggagaaattggcaccgcaaaattattgtctagccgattcaacagcatcatctttggcaaaagctgcccaaatggaattggacttcatccaaagcgttttgttgggcccacagcgaggaaatttgacggcaattgaatgtttattggcacaaaactttagcaaaca

SEQ ID NO: 51189 - DNA, 615 bp, Heterodera glycines
  Genomic contig location: Contig_ID=SeqID_20637; Location=216..830; Strand=+
  SCN-specific regions: Sequence locations=1-336,358-468,491-528,550-615
atgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccacaaatgtccgtccgcaaatgtccgtccgcaaatgtccgtccgcaaatgtccgtccgcaaatgtccgtccgcaaatgtccgtccgcaaatgtccgtccgcaaatgtcccactgcgccgattagcatattcatttacgcttaaagttcacttgtttaaataacttgtagcctttactaatttaaattacatgatgttaatgcttaattattctcacaaaattttgagcaatgcccttcttattggaatgttgccattttgaccggcccgtgccactgaaactattgccgattataccacgtttgctatttttacaattatttatcaagaattgaaaatacataaagatttcttatgtttaatttaaagcattatactaaaaataatttgtgaattaattatccataatattgagctaaattgatatactatccactaattgtagtaatcaaa

SEQ ID NO: 51190 - DNA, 814 bp, Heterodera glycines
  Genomic contig location: Contig_ID=SeqID_20638; Location=292..1105; Strand=+
  SCN-specific regions: Sequence locations=1-260,290-548,570-691,714-814
atgccaattgatcaatttgaattgatgaacgaacaaaccaatgagcagttgacactgttgagcaatgatgaatcagctaattgtaatcattgggtgatgaagcgatgccaaattgggcagtcggcgacggcacaatgggaggacagaaatttgaatgatttgatgaacaatgtcaacgttgagccttatcatgacattccgagtgaggaaaacatcttttgctggtacttgtcaagtttacgggatacatttcaaaagcattttaaagaaaaatgaaaataaatttcaaggggttttcgaggtcgctgatgacgaatacagcatccatctcaaccaattccgtactcctttagctcattttgaatcatatatgtgaaattctaaaatttttacagatgctaccctcatgggcataaatatgcctatgagtgtacccttggcacaggaagctgtcaaattcgttgtaaaattagtacatttataggcatctggaaatgtatgtgaaatgtgccccgtaaactagacacgtacccttttttcttcggttggtgtcatttaatttaaaatttcgctttaatttagggcatctccgcccgagagccaacagattgtttacagacgacatcgatacgagttgtgccttccttttgtacgagttgtcaccagacaccctttccccccttcagggtttcactgcagtctaagcggcttccggcagtaaaagtggatgaattgtcgagaaatggctgaattactcgttgcgagagactcaaagtgctgctactcatttttatttgttgattctttcgctcga

SEQ ID NO: 51191 - DNA, 928 bp, Heterodera glycines
  Genomic contig location: Contig_ID=SeqID_20641; Location=215..1142; Strand=+
  SCN-specific regions: Sequence locations=1-358,410-548,570-582,607 -682,704-725,747-771,793-928
atgttccgtcggctatcaccgggagaatacggtaagctaaacggtatattgaatacggtagtcagggggattttcagtaaaaaattaggattattcattaactaaaaaccatcgctaattggtccatcagcagctgaacttccgcgtgtccgtttattcgcttcgctgccccgtccaattgcctccccagcaattcgccgtcaaaaattgtgtcgccactttggtcaatcaaaaatatttgtaaccgcttatggatgaataattaattgtttaggagaatttgcaattttcgtgtgaatattctgtgggcattgagcacattggggaggacaatgggaaaatgtttgaatcggtgacgaatttttaaaaaacaattaaataaatatttaaacttaaaattcaaataattcgaataaatcactaattgaattcaatttttcagctgactttctccactttgtcttgtgaacaaactccgtcaaatgttctgctcaaatgcgcaaatggcgccaattcaaatggggcgccagaggcacaacgattggaagttgagcataaataattattatgtacaaatcattcaaaatattaatttttttatttttagcccattttcttatgcaagaaaaacgcgagtcgacgacagcaaaaataacgacagaactgacaaatttaaagacaaaaatggaggacgaagaatggctgccgatcgaagagatggaggaggaaaatgacaaagttggggaggaagtaattaaggactaattagagaaaatggatatttaaaaaattaattgaattaattgaacaatttaagaatgacaaagtcgagcgaagaaatgaggagaaatcacagacaaaacaaacgagtgagcaagaacaatttagaaatacttactgcctgtagtggtgttaatgtattggtata

SEQ ID NO: 51192 - DNA, 912 bp, Heterodera glycines
  Genomic contig location: Contig_ID=SeqID_20642; Location=283..1194; Strand=-
  SCN-specific regions: Sequence locations=1-21,53-86,108-119,141 -361,403-522,545-697,733-912
atggtcaattttctattttccgggccctcaaatttattttttcataaaaaattggcttaaaagcttaaaatttaaacaaattatcgcatacaatcactttcaattgcttatttaaagctgtttagcagagcctggacgggaccggaccccgccgggattttgcccggtgatttttgggcaaaccaaaaaacgggggtcccgggggtcccgcccgggtcatttttcaagtcccggtcccggccatttaaaaattccaggctctactgtttagtccacctgggattgaaaaaatgtgttttaacccggttttggacatattgtaggtgctgtggggtaatcccatcatctcatgaaactcttctaaaaaaataatatttttttaaataaaaaatttcaaaaattgctgcttgggcctgcaattgcgggttgccggattttttaaagggccacaattgcggattgcgagaatcaaaatccgattgcgctaaacacttctgcgggctccactctctatggttaataattttatttgaaataaaacaaacgtttagaagagtgtgtatttaaggatcaatttaattaaattttaacagtgacctatcaccgggaggacagtgtacccgccgattaaatccctcattgtctactaacaaattaggacttatttccagtcttttttttcaaaattttgaggctctatttattttgaaaattgaaatattatttaaaattcctttattatgagaatttataaatgtgtcagtgaaccctgtgctgataaaaaggggaacaaaattgagaatgaatgcttcagcaacagagcagcagtgataaggccacaagaaacaatcaattttgataaaacagagtaattaataatcacagcaaacggaattttaattggaaaataaa

SEQ ID NO: 51193 - DNA, 379 bp, Heterodera glycines
  Genomic contig location: Contig_ID=SeqID_20642; Location=1253..1631; Strand=+
  SCN-specific regions: Sequence locations=1-379
atgaacaattcaactttcgcttcaaaaaatgataagttaaaaaacaatcattcaaataatgcatcttcaaatccaaaaataagcacaaaacaagcaagtaagtaatgctgaaataggcaaaaatcttgagaaagtccagtctttttttgctgacgaaattaattttaacagaaaaagaagaatttacttaatatgtgccatattttggacccctaaaatttaagtgacatcaaattatacaaaagcgtctcaaatttttcttaaaaaatcaaaatcatcggattgtcaagcccatgatgatgctccatcttcaaacgacgaaagcatgaacaatattgaacaaattgaaagttagttacctatttgatgggattagaaa

SEQ ID NO: 51194 - DNA, 205 bp, Heterodera glycines
  Genomic contig location: Contig_ID=SeqID_20643; Location=132..336; Strand=-
  SCN-specific regions: Sequence locations=1-82,104-205
atgcccctaattatttatttttctgttcttttttattgtgtttttcttattttcaaaattgacccacaaggattgaattggttacagctttacaacttactggcagcaattccaatgtttttaccattagcattaaatccaatcgtaccaatttgcacaatcaattattatcgtctcaatttcatttcttacgtaaagcgttttg

SEQ ID NO: 51195 - DNA, 663 bp, Heterodera glycines
  Genomic contig location: Contig_ID=SeqID_20643; Location=441..1103; Strand=-
  SCN-specific regions: Sequence locations=1-152,193-298,320-401,439 -477,500-568,604-663
atggttgtgcacggattggtgaccataaaaggggtggaaaatcgaatttggaatttgttggcattaactttctggatgtttcttgtctacgtgtccatgtttggctatgtgtcacaatttattttccgctattttgtcattgttcggtacgctaattaattattgaattaatcaaaataattaattaatcaaaataattttccaagtttaagtgacaaaaacatttcgtccctcaaatattttttgctgctttttctgatgcttttgttcccatttgcttattgcgttaatgtcttcatttgctttttccctccttctgatcacgcaattttggacgataaatacgtcgcggcaattctcggcattaatctcgacgatcaaattattttggctggatatacatttaatgtaaatttaaattaataaattaaaaaaattgtttctaatttaggatgtccgtgtgactattggttactgttacattatcatagtatgcacttttgcttatctcataatgtttgtgctggcatttcgtatcaaacaattcttggaaaagaaatcgaaatcgtaaattaattttaatttttttaaatttaaatttttgcgttttaaagcgtttcaacttcttctgaaataaccaaaaaaatgattgaaatgaataaa

SEQ ID NO: 51196 - DNA, 285 bp, Heterodera glycines
  Genomic contig location: Contig_ID=SeqID_20643; Location=1191..1475; Strand=-
  SCN-specific regions: Sequence locations=1-151,214-285
atggccataactatagtgagtttaatcgataatttgtttgtttggtcggcattcggatttggcattttgttgaatggcattttgatccatttgattgttcgacacacaccagtgcaaatgcgcatttacagcaaagtgcatttgaaatttgaaatttttataatttaaaaacaaatcgcattaattaattatatgattatttgatataaattacagatattagtccaaacatgcgtgacagacattttaatgcttacaatgactcttcttttcaatccggtttaa

SEQ ID NO: 51197 - DNA, 582 bp, Heterodera glycines
  Genomic contig location: Contig_ID=SeqID_20644; Location=2331..2912; Strand=-
  SCN-specific regions: Sequence locations=1-582
atgaataaggcgacggcgggctgccagatctgcgggccatatcgtaccgtcgtcttctgccaacgtcgatttgtgtacacgcaagtgaataaacaagtggtgacagagaacccactgaaggcatttgtggattggctcgtctttcaacttccaaagaaatacgacacatatgcctattcacattttggtggacgtttcgatatggtgcttgtcttccgcgagctcttccggattggctttaacccaaacatattaagaaaaggaaacaagctttatgagatgaaggtgcaccagaagaaaacgagtaaccccaacataatttttcgcgactcttataatttgatgccttgctcattaaaagtttgataaatggtacgccgagcaccgctacgaaccatttctttgaatgaatcgctaccaagctattgtaccaacaacgttgaaattttaatggcagctctggtggcatttcgacgcgaattcttcgaagtgtcacgaagaatgaaggaaatgtcgcgaaatgtgcagcatcagatgaaatcatgatggtatcgacgtgctgagagagtgtatgacaataaa

SEQ ID NO: 51198 - DNA, 1140 bp, Heterodera glycines
  misc_feature (1127)..(1127): n is a, c, g, or t
  Genomic contig location: Contig_ID=SeqID_20646; Location=52..1191; Strand=+
  SCN-specific regions: Sequence locations=1-578,605-924,946-1140
  Gene Ontology: Mol. function=pre-mRNA splicing factor activity; Cellular component=nucleoplasm; Biological process=mRNA splicing
cccctgtacttgactgtcaaggtgttcaacaacagttgtctcaacaggaagagagaattttgacagacaaatcaaaaaaatggaagcaattacaatcaaaaagatatgcagaaaaacgaaaatttggctttgtcgattcacaaaaggaggaaatgccgccaggtttttttacatgggtttgaatttaatgtatcaacggaaggtatttagtgagattcctctaagaatgggttggggtatgtaatgtacttttccccgggtatgcaaaccttaatcgaatagccaatctttggtttcttggactggaggttggctaatgttaaaactattcacattcagaacatgtccgcaaaatcattcgcgatcacggggacatgacctcaaggaagtaccgtcacgacaaacgagtttatttgggtgcactgaaatacatgccacacgcggtcataaaactgcttgagaacatgccgatgccttgggagcagatcagagatgtcaaagtgctttaccacatcaccggcgccataacatttgtaaacgaagtgccgcgagtgattgagccggtgttcattgcccaatggggcacaatgtggatcatgatgcggcgcgagaagcgcgaccgtcgccattttaaggcattgttttttatttgtttattttttgtattcgaaattcccgttttaagagaatgcgtttccctccatttgatgacgaagaacctccgctggattatgccgataacattttggatgtcgaaccgcttgaaccgattcaaatggaactcaatgacgaggaggaaaatctcgtgaaggaatggttttacgattacaagccgttagcgaagacgcggtaacattttgggttacgactttaaattctttttcgaaatttcttcctcagctgtaaaagtgtcatttacaaagcaatttgtacttttcacttttaaggttcgtcaatggtgaatcgtacaaacaatggtcgttcagcatcccgattatgtcgactctttaccgattggccaaccaacttttgacggatctgcttgacgaaaattacttttacttgttcgacctcaagtccttcttcacagcaaaagcattgaatgtggccattccaggaggacccanatttgaccattaa

SEQ ID NO: 51199 - DNA, 814 bp, Heterodera glycines; identical to SEQ ID NO: 20647
  Genomic contig location: Contig_ID=SeqID_20647; Location=1..814; Strand=+
  SCN-specific regions: Sequence locations=1-814
  Gene Ontology: Mol. function=pre-mRNA splicing factor activity; Cellular component=snRNP U5; Biological process=mRNA splicing

SEQ ID NO: 51200 - DNA, 475 bp, Heterodera glycines
  Genomic contig location: Contig_ID=SeqID_3630; Location=246..720; Strand=-
  SCN-specific regions: Sequence locations=1-97,135-151,193-266,308 -431,468-475
atggtcgaacaattgcaaagttttgctggtgaaaatgaggcggatgtgcactttttggttgggcaagaagaagaagaaaaagaggcaaaaagaaaacattttaaatttaaatgtttttaattttgaaaaaatttgagtatttcgaaatgacaaaaaataaaataattaaaataaaaattattaaaaaaatttcactttaactgtttctttttgcgtaatttatgtatagttatataaaattgaaataaattacgaaatgacaaaacaatatttacaaatattattaaataaaatatatttattttttgtcactttttaatttttaagctcatttcggcacacaaattgattctgagctcatcgtccgaagtgttcgacgcaatgtttcgatttgatgcacaaaatgcaaagaatggaaaaagtaaaaagacaaaaaatgaattatcaaaataaaaattataaaaaaaccaataaa

SEQ ID NO: 51201 - DNA, 822 bp, Heterodera glycines
  misc_feature (187)..(187): n is a, c, g, or t
  misc_feature (277)..(278): n is a, c, g, or t
  Genomic contig location: Contig_ID=SeqID_3630; Location=1621..2442; Strand=-
  SCN-specific regions: Sequence locations=1-149,175-466,512-608,630 -651,674-716,741-799
atggcgaaagatttacatggaaatttgatcagtgaccaatgttagaggaatggcatcttaaaaaaattgatgcacattacgaatttgatatgatcatcagatacatagtaaaaatttataacgaaattcgaatagttaatgataagaattgtaatttgattttaaaaaacaaacacttcgacattgnatacagtatctctgccgcacaattaattacagtatgcctgtgtctgttcgtctaccgtatatgggtgcgtctccggggaattgtgaaggnngccatgcccaaaactttattactttgtgtgccccccccccctttcccactcaattcctcttccctgtcagcagcagtgttgtgcaattccgcagaagatggatgctggggacggacgaaaacgccgtctttcttcccaccatatcgttacgttaattaacgtaattgggcgagtggggtggatggtgggataatgatgatgatgatgatgatgaggatggcgattaagatgattattgggtgcatttattaccccctattacccaccaattctccctagaagtaactccttttattggtgccgctttttgtctcttacgccgtgtcggcaaaattggaggcccccggggggttcattcatcggcaaaagtgggggaaagcaatttttgaaaaagttgaatacgaatgggaaacagagtggtgaatttttgaaaattcaaaggaagtggaaaatttcaattttatcggttgacgaccccttacttttgttttttctttttctttttgaattccgaagcccagaaattttttaaatttttaataaa

SEQ ID NO: 51202 - DNA, 694 bp, Heterodera glycines
  Genomic contig location: Contig_ID=SeqID_3630; Location=2660..3353; Strand=-
  SCN-specific regions: Sequence locations=1-277,299-389,415-549,571-694
atgtgtcctcccatgattatgattgatcacaatgatgttaaacgcattgttagtggtgatcaacaattggccagatcaccaccatcctccgccccgtccgtcccattcattttgttccactaattgcccaattatccactcaaattggtttgatgatcggtggtgcttattgctcaactgggcgcccccgaggggatgtggccaagtgccgacaaatggccaaatggctcccgctgcctgccaatgaatgcttgcttgcccccgggaccattttgtgtaaaagcaaatgttttcttttcggttttggcccccctccccccgttttggcccctcgggcgatgcgccttttgtttcgttgccgacaaatcgaatcgacacaacaaaaagcttggccgccgctgccgccaccgccgcagggaacgcaaaagccccattaaaaggtcatcaatctctaatggggggggaagggagtcaattgacttttggggaccgtccccggcagcacagcagtcaatcaatccatccaaattttccagcacaccgcaaagatggggacaaagtgtgaggaggagaggagagaatgtgtaaggcaaatggcgcacacacagtttgtggccaagaaaaaacaaaagctaaatggcgaaaagcactaattaattaattagtctaaaggaatggcacttgaaagattaaa

SEQ ID NO: 51203 - DNA, 913 bp, Heterodera glycines
  Genomic contig location: Contig_ID=SeqID_3631; Location=58..970; Strand=-
  SCN-specific regions: Sequence locations=1-285,307-370,434-459,481-913
atgtccctctcctccaaggtccatttgggagtgggggtgggcatgaggtcatcatatatcatccaaaatgtgcaacaatttttatgggagcagggtgactcactcatcgagattacgtgtcaagagtctcgacaccggaaaattctttcattttgtggcacggggcccccagagggctttttaattatctgttttggtgttaaggtcaggaaaaaagtagagtcttgtgatttatgatttattatgatgatgatgatgaatcgaaagtaatggtatttgactttaaaaaatcacactaattttaatgtcatattaattagagaccgacgggatttggacgggatctcgacctcgtgatccctctcgaccgttttttatatttaatttaatttcattaaaatctttttaaataaatcttttttaaatttaaattggcactatgtgttcgcctgaggacaattaaaaacaattaatatttgtcgccttttttgcagaaccgccgtgccaaagcaaagcgccaagaagaagcgacgcacgaaaaagtgttctttgcgcaggcaaacgcggcactcgtgctcgctgcgagtgttgcccgagcgactgaagcgggtggcgtcgctacgacgatgggagacccagcgacaatggcaaatggtacggtagtgacaaaatgccaaacaatgacgaccacgtggtgaatggcacggacggatgagtacgggaacggaaatgaaatgccgttttgcttttaatgatttgatagcaattatagttttgataattttgataggcatgacaatgctgaacaaatacgggttttcttattccgatactcgagactggacaagttttaatcattgctcagtgagctaattgctcttgaatatgatcccgaaactcaaaaccgattaaa

SEQ ID NO: 51204 - DNA, 732 bp, Heterodera glycines
  Genomic contig location: Contig_ID=SeqID_3632; Location=286..1017; Strand=-
  SCN-specific regions: Sequence locations=1-156,213-234,257-319,351 -397,419-613,635-698,720-732
atgttcaatgttcaatctctgctagcggaaaacggcacgaaatgtaaaagtggcacgaaaagtgaaaatggcggcgaactcgaaaaggtacaaagcaaaattacgtttaatttgttttttatttcgaaaattttatacggggaaagtcaaaaaaccaatttaaataaattttaaatttccgttataaataaataaattaattaactttaattggagactaatcccattatactgaattaagaattaattttaaaaactaatttggcctaattagataatatacccattcagaaacatgaagcaatttccatcgacaatttggcacttaaaacaacaacagcttcaacaactccccttcttgaccaccataaacaccacaatcattcgctgctactgctccaaaagcctggcacaaccacctccactaattgccccgcgccgctaccggcggcaccctttgatcttccttcaacaaccacctgctgcccagccaccgctgtatttcccatgtttgtgccctccggcggtgccaacaacattttcccgcccgtcgctggtggtggcattgtgccgccgggcagcagaaatgccgactttctgccgccccaaatgaatcatcatcatcatgcggcggttgccgcggccgcgtttatgcccgggtcaccaatggccgccgcagcaatgttgtggcttcatcagcagatcaaccagcagcaacatcagcaggggtag

SEQ ID NO: 51205 - DNA, 541 bp, Heterodera glycines
  misc_feature (489)..(489): n is a, c, g, or t
  Genomic contig location: Contig_ID=SeqID_3634; Location=93..633; Strand=-
  SCN-specific regions: Sequence locations=1-1,23-54,91-220,291-541
atgataaaattcgtaaaaatatgggttgaaaaatatctttgggagggatcacccttaaaaaaatgtaaaactttaaatattattattttagtttttagatttttggatttttaataagtttattcaactactattctttaggagacttatgaattttagaaattgaataattcataatttcacatatttaatatcaagtatatttaaaacacaagctttaatacttgaattttctttttcttggctaaaaattcattttaaaaatttaaatttaaattttattttttattggctaaaatctttgggcaaaaaatattccgctaaattcaattttcccacttttcaccccatatcaatcagtggaaggaagcaatgtgtctcaaattatgcttttggtgcccaaatcatcatcatcatcattccctgggggcttcgaaatacgcaaaacatttcgccaaaaccaatttgggcgcaaaaatcgctgcttcnaatttttatttgtacgacgaaaatgccttcgaaagtgttttctagtaataaa

SEQ ID NO: 51206 - DNA, 495 bp, Heterodera glycines
  Genomic contig location: Contig_ID=SeqID_3634; Location=940..1434; Strand=+
  SCN-specific regions: Sequence locations=1-219,262-459,483-495
atgcccccgggggctgtccaattgttcacaaatggaacaaaaagaaatgatgatgaaatgtgccatcaaaatgccatcttttatgggaggcaattccgaaaaatttattgcttatccgccatcttaggtgatgagaaagtttctatttttttcgtaagaaattattatttcggatgagaaattaaaatttatacacgattatttttcgtattttttgtgaatttataaattaaattttaggaatttttttgtaatatttttccacaaaaacagtgcagcaaaatgtttaacggcaacgagaaaaatacgctaaactttgccaggtctccgttcatacgaattttttaggatcattttttaattattcccggaatttcgaggtccgattcaagaaattttgggcctcggaaccagcttggttcgggctctactaaattaaaaacgtttttttttatagcattaaattatttttcttaatttgatagattaaaacaa

SEQ ID NO: 51207 - DNA, 1070 bp, Heterodera glycines
  misc_feature (598)..(598): n is a, c, g, or t
  Genomic contig location: Contig_ID=SeqID_20649; Location=647..1716; Strand=+
  SCN-specific regions: Sequence locations=1-1070
atggcaagggttgaggacgaggcggaagtgggacgacggacaaacacacgttgtgcttgtccaatgtgggacggattggatgccaagccgattcggtggtcggaccgattgtcggaaaagggcgtcgaagatggatctaagacacggccatcatttgcagaaaccgaaaaagcattagacgaaaccgattccaaagacgcgaatgttcaagctcttccgttcccccggtttaagcccatctatccgacacgttgacggggaatgaccaccggcagaattggcactttcaccggagaccatttggaagagcattggcccagcgcaagtctaaagggtggcaatggacgaagggactgacaaaagcacctggggttgttggattttgatggttatgtgcttaattcccactgaactgctcgaattacacaatgtgatggtgtggaagtaactgaaaagagacggacttcgcctttttcgtccctttgcacattttttacctttgcccggtgaatacgcaaagttccgcgatggaatcattcggattttcgctcaaagtcggcgaccgctgcaaggagctttcgatacgaagcgatggcangcgggggaaggactctgacggagaattggcgatggtttctgttcggctcttcgaaggtattcggtgaaggaaatttgcacaagtttttgcatccgagcacttcgcaagcgtagccaatgattttcaaagttccggttgacctgcaaaaagtcgacgattttaccgaacgtttttcaacattttcagacacctcggaacccccagaagtttcacttcactttgggtgggaccaatgcacgggccaaaacacgagggaaggctgagacggatcggaatgtgctcgaagtggcacccctcggtgatcagagtcaaattgttgacgattaaatcgacgggcaatggattttgcactttcactgaaacttcggaggcacaatcgaccacccaacagagttcatctgagaaaaatggaaataaggcgaaaacggggaaaaaagcacttgcctttctttgccctttcttgaaatggcga

SEQ ID NO: 51208 - DNA, 1587 bp, Heterodera glycines
  misc_feature (93)..(93): n is a, c, g, or t
  misc_feature (195)..(195): n is a, c, g, or t
  Genomic contig location: Contig_ID=SeqID_20651; Location=8..1594; Strand=+
  SCN-specific regions: Sequence locations=1-210,260-351,373-471,494 -514,536-584,608-767,809-943,991-1587
atggctgcaaaccgtgcccatgccgtactcttcccgtttcattatgcacaaaaagccacaaaaaagtgagaaaaaaagacacaaagtgtgatnttatatgggacaagacagacagacaaaaggatggataatgtacgttgtacgggtggtgatggccaaatttcaatcaagtaaaagtgccaaaaattactttcncatcatgaaggggagataaattataattttttatgaaattattgtacatgttttggtgcccttttgatggcatcactataaatgagaaaaaataactttcaaaaaccccgtattttttatccagagtcattattgattataatatttttcgaacactatatatatatatatatatattatgaacagggaaaccgaaacaaattaaaatttgaagaaaaaaacataattctttctttttggcatgtaaatatttttgtttaacgtgaaataattagcttttgttacaaatttaaaataatttttttggcgttaaaatggtaaattaagagaaataacccacaaaaaacattatcaaaaagcaggaaagaaagtaaaaaaacttgtttaaggataatttgtgctaaatttagtgggcttatcataaaattggcccacaaaatcaattcattatgcttatacaatatgaagcggcaacggatggaaagtcaggccaacattgaagcgcatttcaagttcattcgaaacgccctcagtgaagtgctcgcgaatggccgctttctgaatcaattttcaaaaattttatttaaattcgttattaatatattatttataaggtttcgtttttaggcacaaaaaatcgcaaaatatgcattaaatggcacaataatcctcaaataggaacacaaatatgtaggcaaaaaaaaattgtttgcattaacgctttttatgaagtaaaacacgtaaatactaaaatttttcaattgtaaatgatattattaaataatttaaaaaataggcattataaaagtcatgatagaccagggttcggatctattctgatttatcagaaatcttctgatttggaggtagtgaccaaaacaaaaaaaatttccgccggcccttttccctcgcccatttcccaaaagttttggaaaaatgcgccgcaaaaaaaaattcttaaaaatctgaatttttgatcccgaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatattaaaaaattgaaaaatgtcaaaaatatttcaccaaaagagttctttttaaatgcagccttccacccattccataccaacaaagattag

SEQ ID NO: 51209 - DNA, 705 bp, Heterodera glycines
  Genomic contig location: Contig_ID=SeqID_20653; Location=579..1283; Strand=-
  SCN-specific regions: Sequence locations=1-240,262-543,565-603,625 -640,697-705
atggcacatttggggaaaatccaaattttcaccaaagtaattggttttatttttttgtggaaataattttttaaatttaaggctcagccattgtctccagctgatttggacggactggagacggcaagttcagttcaagttatttctcgaccaacaatcaatggtgcaaacacttctttcaaaaaagacaaaggcccatttgctgcttcaacatttgttccatttgcgcgccaacaccgatttttggggcttttggatgagcagggtgggaccatatcatttttgggagtccaattttgaatgttgtgatttttcaggagacgaggcactgcattccgtgttgcggcgacttgaacaactttggaagacgatgccggacgatgaacaaatgcgacaacagctggaacatcattttgtctcgaattggctgctggacaccgggagatttgacgaattgaagctgtgggttgagagaagggcattaaaaaatgttgtccaactaattaagcgggaggaggaacagcgggagcaagcggaggaagacaaaatgaatgaagaaagtgatcaagatgccgacatcgatatcgttgactgatcgaggattgatggtttttattttcattacaagcggcagataaagtttttaaaaatttgaaacaattttaaaattattttggtcacttttccttttatttattcattaaa

SEQ ID NO: 51210 - DNA, 159 bp, Heterodera glycines
  Genomic contig location: Contig_ID=SeqID_20657; Location=468..626; Strand=+
  SCN-specific regions: Sequence locations=39-159
tttttaatttttaaaatttttttgaatttttaaaatttcccggttggttccggttcccggtccagaagaaaaatcgaggtcccggtcccgacttctcaggtcccggcaagtcctggtcccggttttgcccaaaattcccggtcccgcttcactccagta

SEQ ID NO: 51211 - DNA, 981 bp, Heterodera glycines
  Genomic contig location: Contig_ID=SeqID_20659; Location=994..1974; Strand=-
  SCN-specific regions: Sequence locations=1-127,150-153,219-482,504 -831,855-981
cgattatataaagacgaaattgatccagacaatcctccgcaacagcaaatagtgcagagaattgatgctaaagctggaaaaaaaggtgaagattaagggagcggacctactcttagcacaaacaatcaaattttccatttaaataattgacacaaaaaaataataaatttggaatataattttcaaaaaaaaataaataaatgaaaaacttaaattttgatcaagaaaaaataaacaaattttagtttttcaaaaaaatcttgcattctcaactgaattaggcacgtaattttaagcatacagtgacaaaaattaatgaataaaaacaagttctttgggttttcgagatcgcaaataacaaattagttaattctgaaccccggactcgaatttgaacaaaaaagtcgaaattagaaattttcgaatttgcatttttgattcaaaacggcttaaatgatttcttattgcaggattgatggctttcaattttttccttatatttaaaacaattttgaactagaaatgctaaactcgaaatttttgggctttcgactttttgttcgaatacgggttataaataataaatattttggccattttttaggcaataaaaatcgtaccgatgtgaattatcactgtgacgtgcattaccatggcacatacaaattcacatatttgaccaactttttcgcgcgttggcaaaccggtgccaaaattgaccgtattgatttgtttatgggcaaggcatatttgaattatttcctttggcacgatgccaacaacgaaacatgggaaagtgatgaggacgatgtgttaaagctattcagatttcagctgccaaaaatggccaaaaagttgaacacccgttcacagtttgccatgaccgtactgccagggcttcatgaattttgttgcccaacagatttggccaatgacgacgatttggaaaattgcattggacatgaagtggccaacaccaag

SEQ ID NO: 51212 - DNA, 616 bp, Heterodera glycines
  Genomic contig location: Contig_ID=SeqID_390; Location=869..1484; Strand=-
  SCN-specific regions: Sequence locations=1-260,282-491,553-553,586-616
atgttgtacaaagtgggtgctgaatcttggcacttttgagcacccattttcagacaggacaatttaaaaaaataacccgtcggtcttggtgactctttttcagcttgtcagatagtcccaactttgctctacaaaaccataatttgttttgtacctttatccttttcttggccaagaaatcagtggttgaatttgtccacttttttaagtagacccatcagtttatttgagtctaactatcttgaatttaatcgatagatcatttttaaaatctcaaaaatggcagaatatgatcgggaatgatggtgcatattttgattaattttgagttattatttgattttttataaatttttgaatgaaatttttggtcggggtgacagaacttatacaacaccccaatatttctctaataaacaaaaaaattaaaacaatctcttaaatttcaaaaaagttatgtttcattcgtttttttattgttcattcatatcatatttaaattaaattattataaaaaaattattatttttttattatttttatcttttttttcagaataaaccttttttcttattttatttattagctcaattttagacttttgctcgcaaataaa

SEQ ID NO: 51213 - DNA, 2454 bp, Heterodera glycines
  Genomic contig location: Contig_ID=SeqID_390; Location=1857..4310; Strand=+
  SCN-specific regions: Sequence locations=1-275,299-522,569-974,997 -1169,1192-1519,1541-1578,1602-1888,1955-2030,2055-2313,2392-2454
atgtctgctctttcctataggacagaaattgatcggctgtcacttgcggttaacggtgcaaaaaattccgattagcatagcataagaagggtgacagaacttatacaacaccccaatataagagctatcttatggtaccaatgcaaagttcccagtattttttttcaaaataagacaaaatggctcaaaaaccaagattcgaacccaaaaaataagattttttctaaaactaatatcagggggggtccggcggtgccgatatgcgccgccggggaattttcttttttaatttgaagcaatttgttaacagattttgaccaaaaattatcaaaattttgtgattttttagctaaaaaattcagaaaatcgtaaaattgtgactgttctttaaggaattttgggcaattacagtatttgttaacagattttcaccaaaaaataaaaaattttacgattttgagccattttttaagaaaaaaaagttttgtggggccgggggccgcggtgccgataggcgccgccgggaaaaattttttcaaaattagtaattttggtagaatttatatcagcgaattaaatcattaagcacaaaaatttgaaaagtttggggaagcctgaaaataaagggcaaatcttagaaaaaaggtatagccaaaagtacaaaaggtaccaagttttcacacatttttggtcataaacttttttttaaacctaatgaaattttttgaaatttaccagactaatagaggacacttgttaatatatacgttatattaagatccctttatttagactgttctaataatggtccgttaagttaatgaaaaaacgacgtctagagaatttatatttcgccgagatcatgttctccgttctatgcgacaaacgggaggagacctcagtgttccggagattgacgatgagcataagtgtgatgaaatgaatgctgtgacacggaaacatccatctccacgagatcctgcctccttctcctctaaagtcgcagcgtgcctaccagtttccgcgggctaagtcaggggcttcacgaacttcatccgcgcaacgttttgctggaccatcagaacggactgctgccggacgaccggttgtccatcatgtgcgaagtttccgtcctcggttcagactgtccgctttgccaccgtcagccttaaattttcattttcagacagcacagcgccgtccgttggtcagccgatcacaatggcgacaagaagtgcgagtgcagccgcttacccggtggccacgcctcaactgatcgtgggcacggcgggtgccggcggtggtggcaaaatgccgaacgccgccgtaaccgcgaaacaaatacagcagcaacggcactggcaaagacagcagcaagagcagatgcaggtgagggggtcaattcgagggcgaaacaacgggggggaagggcgacgacctgctccgctaaaattttgttcaataaactatgtttttagaatttgacttttttagagatttttcccagtttggagaatgttgtttttaagcaattgtttttactagcacttgttttggaaggggaatcgaacttttcccgagtgagagtgtgtgtgcgtgtcctaatgtttttccgtttgcagcaccaccatcctccgggcaacatgctgtcaacgacgcttcaccaacagcagcaacagttcagtgccggaagtgacggaggcccattcataagaccatcacaccaacagcaacacacgccatggtgccgcatgctgtcgctgcaattggccagcagtactgcggcgccaacgcggggttcgaatacccgccaatgatggcatatacgcgtcaaaataattcaactacaattttcccatggacaaatgtgctgaaatttttaccaagcattaaattgtgaaaataaattgaagtattgaaaaatccattaaattaaatttaaataaaattaaatatttgaagtaattcttattgactatcagaaaaggaagtcaatacctttaccaaagtattctaaaaagtacattataccaagggaaaatggaaaaaattgatcattttttgggtcgtcggtttttaagcttaatttcatccgcggacatcgtagagccctatcaaccaaaggttcttttgaagcaaattttctgctctttctgtcagtcaaaaagttttccacgaaaaaacttttccgaccctcctaggaattttttcgacaccaacccctgcgtttacggcattttaacagtgaaaatgtcaatgtaattgaattttgttagatttatcgtgttataggatgtcttttcatgatgttcattgctttattgctctttctttttccaaaaatcttttttcattaaaaaataatgtaaaattttttattttcattattttcaatacctaaaaactttacggtgaagcacaaataatcagcttgcgaaatttatgaattaacaa

SEQ ID NO: 51214 - DNA, 3280 bp, Heterodera glycines
  Genomic contig location: Contig_ID=SeqID_392; Location=410..3689; Strand=+
  SCN-specific regions: Sequence locations=1-460,497-2658,2713 -3098,3121-3280
atgtatgtgaagaaggtgtcattaatggacggattagcgctggacattgagcgaaagcttgagataaagcctgcacgttatgcaggaaggaaaactatgatgaaatcgatgttcatcagtcaggatcggttcgagtttaccgccaatctgttcatggaccaaattacccgtcgcatcacaatggggcttgtttcaaatgccgactactcgggcacaatcacgcggagcccgttcaattttcaactgtttaatgtgcgggaaattgcgatcatcgccaacggccgttcctacccccaggccccttacgatttggactacccgcatggtattttaccactctttgtgaaaggcatagggaatgattgattattttattataccacggcgcacgttgcgcgcgctgttggtgcctgccgcatatatacagcgagctcacgcgggaaaggctcacttttttcgcaaaaataaattaaatatattaataaataataataatgtcgttggaagaccacaattattgcggcgagttgggcggtaacgaaacgcccacaaagagaagaaggagaaatgacgatgatgatggggagggagaaccgaaatttcaaaaaaactgcattcgcacactgagcgccgacaaacagtacaaccaaaaattcaaaatgcagagcgtaaagtcgacttttgtcatcgaaaatttgcccgccaaccctgagtcaatgctgcgcacattgttcgctcactgcatgtcaaccgccttggacgagtcccagcagaacggaatcacaccggatcaattgggcgctacaatctcttcagatctgctaaatccgagcatatggattcctatacgccgcatttccgacaacaccgccgactcaatcatgaaccgcttccttgaggtggcacagtcaaaatcgcgggagggctctctgtggggctcgccgttcactgtgaccatcacaacgcttgatgttgcgcagctacctcagcggcaacaggtgcgtggcagtgggaaaaggaccgtagattcagtgcaacatgtcgtcaaagaaagtgctcttctgcgaatcaacaacatcgatgatgcttattgtcttttttacgctttggaggcaagcaggaagtaccacatcaaagagatgagccgaagaaatttctgttattatattaaccatccgaacgagcgacgactggaagacgtgtttggactgatgagcagcgtaaacattcgcacagatttgagagaatatgatgcggttgtctatgtgccgattgtcgtggactattggaatcggaaatacgcaacaacaaaccagcgatttaaggtgttcatttttggcgtcacaggcagctatcgaccaaaatttcaatatgggccggacaattacaacatcgaaatgccgctctaccatcacaacggccaattcgacggaattcgatgtggggtgggcaaagcggtatttgggcgtgactactactgcttttcgtgtgagtgcccctacgataatgctaatggtcacacgctacaatgtaaagcaaagtgcataaattgtggccgcataggagtggggcgaccgtgccgagcggatgacaacaacgacagttattacagagaatgcacagcatgtggcaaggatttcatgagccaagactgcttcagtcatcatttgtcgagcaatgtgtgtcaacagttcaagaaatgcaaacagtgcggagttgtgtggaatgtcagacaaaaccgacgaaaaggacgcagcggtcacgtttgcggtgagaaattctgctacacttgcaaatgttaccataaaccggagcggggctgcttcatacagcagttgaaggcgcgccgccccaaaaagtacagactgatcgccttcgactgtgaaacaacacagaacacgcgaattgagggcgaccgcagacttcattctgtcaacttcatctcatgctatgtcgtctgcaccaactgtataaatgaaaatttgtggcgaaattctctacaagcgccatgctgcatttgtgggcggcagcgcaccgtcacattctcccaccgtgcctatgaacgcacccaaaccgatgcccaattcatcactccgtgtccaatggcggcctttgctcaatggctgctcagcgaattcgatccgcgctatcccacaatgctcttcgcccatttcgggggtcgctttgacaacattatgctgtttcggcagttcttcctcaacgggttttgtccacagatgatccgtcggggtaacaaattatacgaaatgaaaattgcgaggggcgaaaaaaacccggaaatcatcgtaagagacagctggaaccttatgccggtgccgctcggcgctctgcccggagcgtttggactcaatgtgcaggataaggagttcttcctcatttggcgaatgttgagacgaattatgggcacattctgcagtcgctaccgccaaaagctgactacttatacggtggaatgacgcccgaccggcagcgcagattttaccagtgctacgcggaacaccgccatcagcagttcgacctgtgtgaacagctcgcagcctactgcatcaacgacacgcacatactaattgaggcgttggtcgcatttcgaacggagttcttgacgattattgacccacttgagcgacatggatgcttggatgacgacaacgacgacgaagaggaggaggaggtggaggaagaagacaaagacaatgcatttgaagtgatcggcgatggcattgacataacgtgggagccgatgaccatcgccagtgcctcaatgagacattttcgactcaatcacctgaagcgagaacagctcgccattgtgcccgagtgcggctacgacacgacaaacacgcaaagccttgtagcgctcaaattcatggactggtacgccaaaaagaacggggtgagcatccagacggcacactcgcccgacggagagaaaaaaattggccagtacactgtggacggatacatcgcggcgaccgacaccgtgattgaggtcaacggctgccactggcatgcacacgaccatccacgtcaccgttttcagccccaaacagtgatggcgaatgggaaaacggcgcagcggatacgggaggacgatgcgcgacggctggccttcatcacatctcaggtgcaacaagtgctcgtattttgggagtgtgaaatcaacgctgagaagcgctacaacgacgaaatgaaacgctcctttgcgcagtacaaggacagcggccctatccatttgaaggactgctaccatggaggacgt

SEQ ID NO: 51215 - DNA, 626 bp, Heterodera glycines
  Genomic contig location: Contig_ID=SeqID_393; Location=594..1219; Strand=-
  SCN-specific regions: Sequence locations=1-29,52-589
atggacgagaattttcatcatcggcaattaattccctcaaaatatttacccacccacccattctcccgtcgatttttgcataccccccacccattctcctgtcgattatcagcaaaccaaaatcgggcagctttgtttccgatggaattgtggaacatgtgagatcggtaaaaaaaccaaataataagtaactgaattttgtaaatgatagggtggaaggcgacctctacagaaccaataacagtgttgaagcttggcacagaaatctgaacgcgttattccgttcaccatcgccacgtctaagcatttttcttcggaaagttcggcaagaagaaagccattggcgtcagcaagttaaagactttgcaaacaacccagcaaatggaatacgtggcaagggaatgaaacgcaagcaaaattatgtggaccaagacatgaatcttaatgagttatacgtcacgcgaaacaatcgccatcctctgcaatatttgcgcgcaatttccaaccgaatggcagaacctctttaggacaaaaatcaatgatttttcatgtttatagtttttaaaacgtaactaagaacctctttaggaataataattgatttatttttcatttttaaaattaaa

SEQ ID NO: 51216 - DNA, 533 bp, Heterodera glycines
  Genomic contig location: Contig_ID=SeqID_3637; Location=1081..1613; Strand=+
  SCN-specific regions: Sequence locations=1-14,36-533
gtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagctaaagaagatgtcccataatcgtgatctgtatttattgatgtattgtacatttgtatgcatatatcatttgctgtgtattatcactttatttccatctgtgttccgaa

SEQ ID NO: 51217 - DNA, 592 bp, Heterodera glycines
  Genomic contig location: Contig_ID=SeqID_3637; Location=1991..2582; Strand=-
  SCN-specific regions: Sequence locations=1-15,41-50,73-592
acgcgtcccatcgatttttattcattttttctttgtttcagcttgaaatgttaaataaaaaaattataaaaacaaagtacattatcaacggagttgaaaacaaaataattcatcaaaatccgttgactgataaacgagtctgaaggtgtataggacaaaataccatcggtggtcgaatgctaaatcgtccatacgaatgggtctttggcatgattcaaaagggtctaataaggtccggtttttccctgtgcccgatcggtctgcagacactcttctgcccattatcgctgaaaatattgaggtgggaagcacgatagtatcggatgggtgggcggcatacggagggattaataacatgcagcagcaatacaaccacgaatggataaatcatcaaatttacttcgtagatcccgccaaccctcaaatacatacacagggaattgaggctacctggagggctttaaagcaaagccttaaacatttacatgggactacacccgaacttttacctacttatttgtttcagtacgcatttcgtcgttatcacgaaaacaaaaaaatatttcagcatattttggaagaaatgcgccat

SEQ ID NO: 51218 - DNA, 712 bp, Heterodera glycines
  Genomic contig location: Contig_ID=SeqID_20660; Location=1110..1821; Strand=-
  SCN-specific regions: Sequence locations=1-130,152-169,191-224,246 -369,391-403,435-588,610-712
atgccatttcgacagggaatgatgctcgaatgccgaggggttcattcaattcccctgcccgtttgtctaaaaaaaaattcaagaaaatatatttgaaaactgctagattctccccgtattgtttcccccgaattttttaaataaaatttcaagaaaacaattttcaggtgattttttaaggagaatttttgaaaaaaatggttggaaattccaaaaaaaaaatttttcttggaattttctttgaaaacccatggagtactgataagggggggggggtgggagaaaccaaggtcccttgtttgtcacttcctgttggatttaccaaataatttgggaataattgtccgcccccccccctcccatttttctaagaaattttaagaaaacattttagaaatcttccaaaattttttataaattttattaaaattattgccccgcaattttgcacatttaaccagcagcgcaatgagtcggatgaagccgaattggacgcgcaactgaagcgggcggcgcttgcacacgccgaacatttggagcgagtgatcaggacacagaagcaaatccacgacatggagactcagcagattgtgcaggtggtggtggtgaaggagtagtgcgaaaaagtgttgcaaattttggtctcaaaaattttcggaaaaagtgccaaaatttggtgcaacatttttctaatatgcgctatggaaataaa

SEQ ID NO: 51219 - DNA, 388 bp, Heterodera glycines
  Genomic contig location: Contig_ID=SeqID_20661; Location=302..689; Strand=-
  SCN-specific regions: Sequence locations=1-363
atgtttagtattttttttattgtcatatatttttcatttatctgaaatgataaatttcacatcctcatagctgaaaacccaggtaaatttttgcaatttttagagaataaggatttcttgagatccggtggtggcgccggcaccccgggaaaatattatgttgtggattttgttgttttacaatattttccaattgttactaaggagtcgaacttgaacttacgtttgtaggaaatgtcatgaatattttctatttagctttttttttacaaaaaaagtaggcgaaaaattaacgtgtaacgcttgtgcgcaaaggttggaggcacaaatgtggacttacaattagtaaaaatctagaaaccctaaaaaatttaataatataaataaa

SEQ ID NO: 51220 - DNA, 399 bp, Heterodera glycines
  Genomic contig location: Contig_ID=SeqID_20662; Location=108..506; Strand=-
  SCN-specific regions: Sequence locations=1-150,175-399
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcgtgttttcgtttgtacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacag

SEQ ID NO: 51221 - DNA, 1075 bp, Heterodera glycines
  Genomic contig location: Contig_ID=SeqID_20662; Location=561..1635; Strand=-
  SCN-specific regions: Sequence locations=1-215,256-276,315-514,536 -550,657-671,693-753,778-799,821-863,886-944,966-1006,1035-1075
atgggaggggtgcatggccaactgagcgccagccatttgagcgccgccaagtgagcgcgggctatctgagcgccagacttttcagtactgaagccaaaacctattgcgcgagtttttcttgcaaacccaaacctattgcgcgacttttttcttgcaaacccaaacctattgcagggggggtgcgcgacttttttgactgcgcgactttatgcaacttattttaattaaatttatttaattttaaattattttaaacgtcttaaaggtcaaagacgttgaatttaaattcatttaaaattctccaaaaattccccgcaccaagcggatccgaaccccagggggggcggccagactgacgcactaaccactcggccacattggcaatggatgataaacattaatttgctctcataaagggaaaatttgacgtcaccagcgggggcagggggggcgagagcgagcagcgagagaggggaggggggtcaaataaacaaatcaattattgaattcagggttttctcttttaaaagcaaaaagaaatgggggaccgtataataaaatataatttaaaaattaaaataattaaaaggttaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaacgcttcttttatcttttcgttaaaaattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaattttttttattgtcccaatttttaccattttgtgttttttcaacaaaataaa

SEQ ID NO: 51222 - DNA, 514 bp, Heterodera glycines
  Genomic contig location: Contig_ID=SeqID_20663; Location=220..733; Strand=-
  SCN-specific regions: Sequence locations=1-386,408-514
atgagagccctctggcgtttggcgcgggccttccccggcacactcatccgctgcatttgcttctacgccgcccaagccctggagatcgaacggttggtggcccaacaagaaatcccggacattttagtgacgacagcggacgcgacacagggccacgagtcgtcacttgccgtcgtcgtcacaacatgctccgtcttcgacagtggagccgactctcagcctttctgggctgatgccgcacgggtggacgtcgccatctcccgcgccagccatggaatgatcatcatcggcgatttgctgctgctcaaccggacggagacgtggcggcgctacctggaccaagcgacgactgagacaacagtggtcggtccggagtacttcgacttcgagcagttcaacaaccccgacaactactacgacaaggacggacagctgatctcagccaacggcggtgcggtacggtcagagcttttctacagcaagtacggtaaaaatgtgtggtacaacaactccg

SEQ ID NO: 51223 - DNA, 327 bp, Heterodera glycines
  Genomic contig location: Contig_ID=SeqID_20664; Location=816..1142; Strand=-
  SCN-specific regions: Sequence locations=1-327
ccaatttggagtgtttttgctcatgaaatttggcccattttcgcgccaaacattcaccatttgtccttttccgatggccaacatttggacaatttgcgtcgctacacttcgctggcaattctcaccgatctcaaccaattgaattcaattgactccgataatttgttgcccgcggtgattgctgatgatgggccaaatgtaactggtggccaagcgttagcaaaatggttgcaaatgccgagaagcgatggccagccaaagcaattgatttgctgtgttgatacgtcagaagcaattgaatgtgtcgatagtttcaaagaggcatga

SEQ ID NO: 51224 - DNA, 399 bp, Heterodera glycines
  Genomic contig location: Contig_ID=SeqID_20665; Location=327..725; Strand=-
  SCN-specific regions: Sequence locations=1-240,385-399
atggcttcgaatggcaaggcaacggaagcgtcgtcagaagaagtgcgttgttcgtcgggtgctgccgccgcgtccaccgcttcgtttgtgccgtcgtcggattcgccgcacaatcagccggggtcgcatgccatcgactggaagacgtacgccgctttgttatcctcaccatcgggcgccgatttgatggcggcgatgttttcttccgctgctgcgcttggaccgacgaaagcacacggagaggaggaggaggaagagagcgaaagaggggagggacaagagaatgttggagaggaagagatgacgaggaagggacggacgacgaaacgagctgtgaaagacgaagagacggaagaagcggagggagaagagcgggagggaaagcggatggaactctaa

SEQ ID NO: 51225 - DNA, 925 bp, Heterodera glycines
  Genomic contig location: Contig_ID=SeqID_20666; Location=250..1174; Strand=-
  SCN-specific regions: Sequence locations=1-380,402-615,637-925
ttggctgaagactttgccaaactttgcattagcaattaccccatcaaaccaatcgccaacgaattgacgtcaggtaaaagtgccaaatattctctaaaactcgaagaattacattggaagtgaatacgaaaatgaccattttaatgagactttgattttgattttcattgccacaatttgtcaggtgaaaatggtggtgagagcggcgctaagccatacaacaaggaagaactggaaacaattgggtgagaaattggaccaacattttttttgaattaatttgattcatatttttagacgttttctcaccgacattttggctttccaacaggcggatgagagtccccacacgccgcctgctcatcttaatctgccaactatggctgtcctgaaaaaacaaattggcgacggcgtcagcgcggggttcaaccgcttctctttggtgagcagaaagggtggcctcacttctcgaaacaaaaagtgccgacgagaaaatttatttgggtgttaataaaaacaagtccaaaagttttctggatcacgaatccttcatccaacacgaccaattcttattttggacccgaatttgaataaaaagtccaaaactcaacgagttaataatttctggtctaaaatgggggatagcaccacttactattaccgtttggcaaattaattaagaacaaaaatttggttttgggcgggttaagttaatttgcattcggttggtcgaaaaaatgggaaacagcgcatcctttggtcaattgtcggctttgtcggttccattttttgatttttcaggtcacgcacggttttggcggctatgcttttgccggagtgatcaacgttctgatcgaaatggtcaaagaatgtgagcaacgattgtcgtctacgacagaaggatgagaaaatgccgaagaataaa

SEQ ID NO: 51226 - DNA, 740 bp, Heterodera glycines
  Genomic contig location: Contig_ID=SeqID_20667; Location=178..917; Strand=-
  SCN-specific regions: Sequence locations=1-321,349-386,418-551,573-740
ttctaccattcttcacttgctatcactgtttcagataaacgagatgcaaaaagaacagaataaagaattgacggaagagaacaaacgattgaaggccattattgaagagctgaaggctggaaaagtgatccatttcaactcagtttgatgaactcactgatttcacctttttacagcaaaaggcgctcatcactgaccagtcccaatcatcgtcaaccgcctctgccaagtcaccatcaaagccattcaaagatcacctgcgcaaaacaggcagcaacagcgtcgatctgcgtaaaagcattgaagtttgttgatttatgcctaacaaaaattcaaaaattagccgcgttcttttcatgtttttgacggcaaagtttttttctttgaaaattttatttaaaatgtaaaaaattttttgggaaacgacaaggggcaaagaacatgcccgaaaggcgtcaggtcatctaactctgtgacaatggttaaaatgccatgtaaattgggcggcatggcttcaaaaaagcaaccaccatttttgacgggctaccaaattttaaaaattaaccaaccaaactgattttatcacctaatctccacaattaatttctcctgaatttgctacagaagtccgggattgaaattcaaacaggacaacggcaacacagcgaggacacctgcttcaccttcctgctagaggctgaagccgtcaaggcgagttacggagaatgtctgagcaatgg

SEQ ID NO: 51227 - DNA, 1754 bp, Heterodera glycines
  Genomic contig location: Contig_ID=SeqID_20668; Location=177..1930; Strand=+
  SCN-specific regions: Sequence locations=1-29,53-1214,1236-1689,1711 -1728,1751-1754
  Gene Ontology: Biological process=nucleobase, nucleoside, nucleotide and nucleic acid metabolism
tgctgggccaaggatgatgcgggtgccttatctgtcgggcggcggcggaggcattggcggacagagacgttcaacaggcggaggcacagattattggcacaagaaaggcggcggcggtagtcaatcgggcggaggacgcgaagacgacagggaccgacgtccgggtccgggcggcagcagttattaccaccaacagagaaacaatgaccgatggaagcggaatcagcacccaaacgcaccgccgccgctgagtgttgcacagcgacgggcccggggtccgttgcccgactgggacgaggtgactgggactttgtccgtgcatcaatcaattcattatgtatcggaacacctcatgtcaggtgcaagaagtcgcggaagacagcttcgactacatggaaataatggagagccaatattcgtaagaatgcgtgtcattgggctatggtaacgaatctgtccctcattctttttttggctaatcacattcggaggttttgaggatgctgttcacgaatctgaactcggacttgcccaattccgaccactgacccgaactcgaacaaaaagttgaaactttttttccaaaatatgcgttaaaataaatcaaattcaattgcgcatttttcaattaacaatttaagcactgatttgttgtaaaagcttttacacatggaaaagcatctttagaaaaaaattcgattttctgtatcggaatcgagtaagtcgcagtgcagatttgtaatcagctactaaaactgtttttgagcctaaaaagtaaaaattagggactcaattctttaccattgtctgtcgttgaaattaatcctaaaaatgacatcaaattcagtcagtactacgccctttccgccgttcccccctttgacccgtcgcttggcgtcattgcttcagccgccgcacatccctcggcggcacccatcgttccgtctgttgccgtcaccgctgcgcatgctgccaacgtggtcagtgcgtcggtcgtcccgcccgcctcccttctgtcccccaccggtctcatctccttcccactgtctgctcccactgcgctttccccgggcgccgtcgtcgtggccaccactgaccaatttccgcccacttcggccgccgctcagttcactcccgtcgttctgactgctcaatttccgtccaatgcgctgttcgccacgcgtccgacgaccaccgccccattcattgacgaacagaagctgaaggacttagtgcgctcgcaaatgtttgtgcatgcatctagctagccccaggcccgtaacccggaaaaatggactagtggagtgttttttgaaaatccaaattcaaaattgctaaaaacggtctgaaccgatgtataaaagccgaaatggataggaaaaatagcctgaataagggcaagcgcgcccccattgctatttttcctatccatttctagcttttaaacatcgattcaaataatttgctaatcaaaatttaccatgttttaacccacattggttacgggcctgaacccagcgcattcttgatccatgcacattaaagtgttctttctttccagtgagtactacttctccgctgacaacctccagaaggacttcttcctgcgccggaaaatggacatcgacggctttttgccgctcggtttggttgccagcttcccgcgcgttcgttcactgacgctcgaccagaatttcattgtctccagtttgtgtgacagtgacaaagtggagctgaacgaggaccaccaaaag

SEQ ID NO: 51228 - DNA, 772 bp, Heterodera glycines
  Genomic contig location: Contig_ID=SeqID_20670; Location=141..912; Strand=-
  SCN-specific regions: Sequence locations=1-115,173-233,256-281,321 -452,474-525,577-640,662-719,741-772
accacttattccgttataattagtgctgaacaatcatttaaagaccaaactcaagaaacgattacaaatggagcgttaattgcattttacgtagcattggccataagtttcttcgaaataattgtaattttattaaataataaaaataattttgttttaaaaattaatttaaggctttttctgttatgagcacgttgaatttaaaattgttcacttcaaaattagaaactcagaataatgtgcacaatttaagtgaacgatatcaggtgaagcaaaaatggaaaaattaattaataatttaatatattttaaattaatttcagttggccgaaaacattcgcacggggcgacaacttgggcccacttttttgctgcatttcctaaataattgtgttgtaattatcccatctgtgcttggcttttaccaaattatcacccatccaaaattattggaaatgatttgggtgatttattttctgtttttgtccattagcaatttgatgatcgaattcacgacaatcaggcaaatttaatgaaaaaataataaaatttgtattttaataaattgaaattttagtcgccatccgattttgcaaagggatgccctgcgaattttgtccaaatttttcaaggcattttccatgaaaattccacttgtccaacgcattggtgacacagaaggccaaaagatcggacgaattgacgggaaaaggatgcaggaaaagaaaatgaatgaaatggacaattattttgaaatgttgacgaagcaatg

SEQ ID NO: 51229 - DNA, 595 bp, Heterodera glycines
  Genomic contig location: Contig_ID=SeqID_3639; Location=421..1015; Strand=-
  SCN-specific regions: Sequence locations=1-14,39-401,435-595
atggaaggaattgcgggaaaaggggaaggtaatgagaagagcagtaggaaagggaggggacggcattgggacggaaaatgccttttttggttccgctaaaaaatgctaaatgatcagatctcaaatataattcggggaatacaattctcattaatatgagtaattttagtgttgcataagtaggtaaattaatgggaatagagaatgaaatctattttttgtttgtgaaagatacgaaaaaaaaggaaaaacgatgatatagatattggctctctacagcccccccccctagctgtgcccttgtcaggagtcctgaaaaacaggatttaaaaccctgaaacccggtctgggtccacagttagttacaaagaagagatactgtacttatttacaatttgcattatatatatatatatatatatatatatatatatttaaatttaagccagaatccgatgagcaaaaagccatcaaagaattgcacgaatttataaaaacaaagtttgaagctctccaaagacacagacaacaggaatctaacgcaatcaaacataattttattggaacggactatcaaaacgtattgaaaatttaa

SEQ ID NO: 51230 - DNA, 489 bp, Heterodera glycines
  Genomic contig location: Contig_ID=SeqID_3640; Location=1519..2007; Strand=+
  SCN-specific regions: Sequence locations=1-181,203-305,335-489
atgtgggattgcggattgggatcccgcaaaatcccacaatttccaaaatgtgggattgcggattgggatcccgcaaaatcccacaatttccaaaatgtgggattgcggattgagatcccgcaaaatcccgcgcgggatcccgtcccgcaccgggctataccaatttggtatcatgtgagtgtttttcatgtttaagatctatgattatgaaattgcaaaatgttagaattagaataattgaattttttttctattaatcgctttttaaatacatgcatataaattcgataaattgattgaaacatataataataataatattaataataataattgcgcaaaatttagataaacatattttattttgaccgaaatagccggaagtgtttgccaacacttatttgcctaccggacatttgcggacagacatttgcggacggacatttgcggacggacattcacgaacaatttcgggaaaaaataaaataa

SEQ ID NO: 51231 - DNA, 1136 bp, Heterodera glycines
  Genomic contig location: Contig_ID=SeqID_3641; Location=764..1899; Strand=-
  SCN-specific regions: Sequence locations=1-114,144-244,267-318,363 -586,608-788,818-1136
atgcccgtcctacaaagcgacagggccaaatggcggtacccgggtagcatgcgtgtgctgcctgggtatcggccacaggccggcggagtgctggattttggaagcttggggttcttaatttttttttgtaaaatattttttttctctttgcagtggaatgggccgctgccttcctacagctggagggccagtacatggagcacttcaagcgtgttgcggacagaaaaagcaaaaactgcttcatctgcctgcaggatggccaccccaagggccgctgctcaaacaccaaattggtggccgaatttggaaagttcaaggtttttttttcaaataattttaaataaaataacattattttttttgtagtcgcttaaccacacagtgcagcgccactccgacccaaaaggtcgctggaccgacatggtcaccaccagtgaccagggcagctgcatatcgcatacccagcgcaaatttggtaagcatttcggtataaagagcttaacccttttacccacctatcggtacatttacatgggtacccccgtaaatgtaccgatgggtggggaaaaggggtgaaaactgaaatattaaaacttttttccagttcgcccaaatttgcggatggtctttacagacttcatgttgaacaactgtgaccgggccgctgctgtgcagcgacgctgggacgaactggcagatgtggcccagcgagtgcactccggtgttcagaatgttatttacacggagaaaccgaagaaggaggtaaaatgcttttcaaatttattcacaaaatttaaaaaaaaaaacttttttttttgttaagccaccggttgccggctacgacttcgtgccggcaacaaaggcgcaggaaatgtacaagcgccatggccttgcacaggcactgctttgcatgtacgttttgccatttttttcaattttttttatgattttcaatacaaaatgtacatttacaggggtaccaatgtaaatgtatataatgttcataactttagtggccgaaaaattccactgctctaccagtgcgacgaggcgactggcattgcggcattgcacctgacccaccgccccgtcctccacggccccctggtgcccactggggagccgccgctctcgac

SEQ ID NO: 51232 - DNA, 1991 bp, Heterodera glycines
  Genomic contig location: Contig_ID=SeqID_3641; Location=2397..4387; Strand=+
  SCN-specific regions: Sequence locations=1-81,106-451,476-984,1006 -1206,1236-1490,1513-1819,1842-1991
atgttctttggttctttgatgcggaagagcaaaagatcaacccacggtgggactcgaacccacgaccccagctttccgtgctgtgctctaaccaactgagctacgcaggcatcctctccattgctctcttctctctcctatcttaggaggagaatcactctcttaatctccttcactgccgtcttggcacaaggggagagagtgaccgcatttatcacatccccggcctttgagaagaccggtccccggtctctttgatgagaaagctccagtctttggatggacaacttctctcagagtggggagggggagctgtcggcttgacacaaactccacaccgaatgtgattccatgacaggagcgccaagtgatgttctttggttctttgatgcggaagagcaaaagatcaacccacggtgggactcgaacccacgaccccagctttccgtgctgtgctctaaccaactgagctacgcaggcatcctctccattgctctcttctctctcctatcttaggaggagaatcactctcttaatctccttcactgccgtcttggcacaaggggagagagtgaccgcatttatcacatttattaataataatatttgttttccagatcaaaatgcctatgtccatctactatatgaatgtcgttcacgacatcatagcgtcctagcttgcactcaatgaggacgaaaaaatcgaattcgacgccaagaagaaccacttcaagcgcaaacttgggccgctgagttatggcaaccggatcccgaaggccgaaaaggcccactacaccccggaacagcgcaggaggccgaccgctggttgtccaaccacgcttggctgcccccagcgcccttcaagggcatcctcttcccggccaagagtaagtgctttaaaatttttagtctgggactggaaaaaggctttaagactgtaatttctgtacatttatatgggtacccatttaaatgtacattaagtattgtttttatgtaatgtttgatttttagtctggaactggaaaaagggggcagctgcgtatgctgcgcactggcgagatgagttcattgggtccgataacccggacgtcagggcagctgcaaaggccgctgccgagggcaactttgtcagactcggcaccaacgagtacgtgcgactggacgtgcgcgatctcacgcagttgaacatcgacgatgcgctgggaaacaatgtttgtttgttttcctttcggtctataagaaaatgctttttaagtgtgtgttttgcagatacgtaactatatactataggcacatttatgcgggtacccgcataaatatacctatagtatatagttacgcattttttatattgacaggaagacgtggcggacgtggatttggtaaagccgctgaccgctccgaccttgaagaacgtcaacgccgacacgcgccatgagatcatgggcacgatcgtcaagcgcagccttcgcgcaaaagccatcattgggctgctgcagcgaaaggtaatcggacttgaatttagctttgatctgactttaatttctcattgtcttccaacaggtggtgttgaccaggcatgcactcgaccgcaccaaagccaagtttcgaaagcgcaaaagggagctgaaacgtgaggtcaacactgccattggcaccatccgcgctgccgaagacgacctttttcagcaagtgcaacagctcaaagagatcgctcctaaggctaagctgaagaagctcggtctcgcggacattggcccggagctcagcagcgaaagcgaaggggacgaggaggaagaggatgcggctcacaacaccgagcagcagcagcaggacgatgccaacgacgtcccagacgacctgaccatggacgaaagggccgatgctgctcgccgccgtgaagttctcgactttgagacaccagtctacgctcgggaactgcgggttttttttttggaatgttcttagacccttgtaattatctataa

SEQ ID NO: 51233 - DNA, 651 bp, Heterodera glycines
  Genomic contig location: Contig_ID=SeqID_20671; Location=581..1231; Strand=-
  SCN-specific regions: Sequence locations=1-23,46-162,184-318,431-651
atgataaatttgataattgtccaatttgtctcaattttcatttccgtcccatcacttttcttgtatgcattggaatgttggtttatttttgaaggacgcaaccagaagtttgaaggcagtttctacaaaattttcttgctctccgccatcatgtaaaataaatttaaattgcatttacaaaaattaatttgccgaaaaagcggcaaactgagagagtataaaattgtttaaaattaatctttctaaattttctcgcataactttttttatttatgaaaagacaaatcgcattttagttaaaaaaatttggtcggaatgaaatatttttcaaaaaatttaaaaaataatttttaataattttgaattgaatttacccaaattttaaatttttgaaaatattaaaaattgtatttaaattttagaatattttcatcaacctccccaacgtattggtcacaatccgtgccgtggcaattacggcactttttgacactttggcatcaatgcctggttggctggcacgtctcattttcgcctcgactttttacaatgtgcttgtggaaaattgcttgacatttcttcttttggcccatcggctgtcagcaattgtcaaaccgttgacatatgaaaaggtcacacatattaattaaa

SEQ ID NO: 51234 - DNA, 1102 bp, Heterodera glycines
  Genomic contig location: Contig_ID=SeqID_20672; Location=678..1779; Strand=+
  SCN-specific regions: Sequence locations=1-347,376-392,418-444,480 -492,527-813,835-918,946-1024,1046-1102
atgactaggaagtgttgtgtgacagacgtgcctcccacaaatgaaccattggggttgtccgactccgggtcgccgtccgcgagcgacagcagctactcctcaccaagtgagtttaatgcggggcgggaattttggcgccacaaaaaatttttttttaaggtagtacgacagcggacgtgagttgaatgggggtggggaatggcacaatttcaattgtataatcctaatgaaattgaattttcagattccgaagagagtgcctcggggacgaagaagaaaccaactcgcaagagcgctgctgctggacgttccacgaaacagacgaagtcaggcccaaagagtcgtcactcgcccgccggtcgtggaggaggacgtccccagacgccgcgcatgaagaaacaaccgctgaagaagaagccgccgagtcgcactcctggtcgacgtgtgaagaaaccgtcaacgaagaagtcgcctgctccccgccgtgcaaacacctccaccaagaagcgcggacgtcctgccaagaaagcggaacaagccaaaccatcggacagcggaacagccgccgacagtggccgcgacgacagcggacgtgagttgaatgggggtggggaatggcacaatttcaattgtataatcctaatgaaattgaattttcagattccgaagagtgcctcggggacgaagaagaaaccaactcgcaagagcgctgctgctggacgttccacgaaacagaaggcatcgcgcggaggacgtgcgggcaacaaaaaggcgcaggaagaacgctctgaatcgtcaactgaatcgggctctgatcgcgaggaggatgaagaatgaatgagccagccggagaagaatgctgcttcacgagaccaccgcgataataacactaacccccatttaaaaaaagagaaattgtatctctatgtatgtatgtatatattgtatgtccatatccctgtggcattatcttgctgaatgtaattctcccacaaatggttgttgttctatttaaatatgccatatatatgtgtatttttaataattgtaatatgtttgccctgtttatgcatgttttatggtcatttattctcattgctga

SEQ ID NO: 51235 - DNA, 76 bp, Heterodera glycines
  Genomic contig location: Contig_ID=SeqID_20675; Location=972..1047; Strand=+
  SCN-specific regions: Sequence locations=1-76
aattactggagttagcatcatagcagtgcttttccttgtctttttgatgccctcgcaaaatctggttcgcttctga

SEQ ID NO: 51236 - DNA, 700 bp, Heterodera glycines
  Genomic contig location: Contig_ID=SeqID_20675; Location=41..740; Strand=-
  SCN-specific regions: Sequence locations=1-595,617-700
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgtttcataaatatttttttcagaaagtgctctaaagtgcaccaaa

SEQ ID NO: 51237 - DNA, 419 bp, Heterodera glycines
  Genomic contig location: Contig_ID=SeqID_20675; Location=1379..1797; Strand=+
  SCN-specific regions: Sequence locations=1-56,83-163,210-210,236 -391,418-419
ggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattca

SEQ ID NO: 51238 - DNA, 782 bp, Heterodera glycines
  Genomic contig location: Contig_ID=SeqID_20677; Location=225..1006; Strand=+
  SCN-specific regions: Sequence locations=1-158,180-317,342-398,423 -479,504-782
  Gene Ontology: Mol. function=glucosidase activity; Cellular component= cell wall (sensu Fungi); Biological process=cell wall organization and biogenesis
atgccggcgggaccggaaggggcggaggccagcgccaaaccaacgggacagagcgcagcacctggtggaacttcagcagctggtggaacttccgcggtgggacagcagccagccgaagcctccaagaaatcattggctccagcggggaccgcatcggcgggtgagaggagagggacgggcgggcggggaagcgtttttggttcaccctaacattttcctcattttcagtgccctcagcgtatgcggcgcccggcacggggacggctatgagcacgacatcgcagaagtcagccgccggaggagccatgtcgcagaagtcagcagcgcctgctggaggagcctcggcactgagcaccgcgtcgcagaagtcagccgccggaggagccatgtcgcagaagtcagcagcgcctgctggaggagcctcggcactgagcaccgcgtcgcagaagtcagccgccggaggagccatgtcgcagaagtcagcagcgcctgctggaggagcctcggcactgagcaccgcgtcgcagaagtcggcagctggaggagccgcgtcgcagaaggcctgaacaaccaccggacagcacaagaacaagacgctctacaacccgcttcaatgatgttcatcaacagtgatcagaaatgattttaaatgatcccatattgttcccccatatatgcctaatgtgctctattgcctgtgatcacttgtcattgtgttgtgtgattaagaatgggggtatgagtgaaaaatttgttatgaaaattagagtcaaaggaaaaaa

SEQ ID NO: 51239 - DNA, 1794 bp, Heterodera glycines
  misc_feature (1114)..(1114): n is a, c, g, or t
  Genomic contig location: Contig_ID=SeqID_20678; Location=140..1933; Strand=-
  SCN-specific regions: Sequence locations=1-452,486-728,771-871,893 -1121,1146-1188,1210-1295,1318-1675,1697-1794
atgaactcatcaatttacattccaaatgatgtgctttttgatgtgttcaaattgtgtgatcgttttagtatcaatgaacgctttgaatttgtcaatggtaatgataatgattcaattaattagtctcttatttgttagctcattggagtgcttttgttgccgcaaatgaagccaatcattttccaaaatttaaaatgggcaaattgtggatttgcccgttgttctgttcacttcaatattcactcagggcacatgaagaaacaaccaatggagaagtaattaattttaatataccctaatgaataattaaggttgtttaattcttaattatttgtgtttagatttttgcgaattgcacagacaaatgcttgtcattttactcaaattttataagcgatgaatggccggcacagcgaataccattttgcatttacattcaagttataatttccaataatttttaattaattaatattaattttatagcgatttgctaatgatggcacaactttgaaaaaaattacactgaataattgcgtgtggaaggcaagttaattaattaattagttgttttttaattagcaaaacaaacattttccgattgaacggccgcaaagtgcgcatttcttttggcatttcaaggacctgtgctttggcaaaatgacaattgacattttcaatgacaaagcattgactttgtttttaattgattgcccaatattcaaggcaatttaaatgataaattaaaaataaatatttaaattaattaagccccacgccgaacacttcaaaattcgcacttccaccgaaccatgggcatttaagcgagtggttgagctgatgaagcaaaaaatcactttagaaattgacaaaaattatttaattgaaatgcgacaaaatgggcaccaatttgaaaaattgtatgaaattgacaattcagtgattgaattcattctgacgggacgacaattttgttcaaaaattgttgttgaggcacatcaattcgcattactttttgaagtgagtggtaaaaaatggaaaataaattattgaggaatgagacgaataattaccaaaagtcgactcttttccaaaaaaatttctaattactgtntaatagtttttatttgattttattttatttttgtaaataaggttgacttttaattaaaaacatttgtaaaatgctttgatctaaaattgactaaggttttaataaaaccgataatgttatttaaatgtttaccaagacttgagactctctcgaggcttaagcctcactaaataatttgctaattttgggagatttatttttcaaagattttcaaaaattttcagctaattgagaaatacaaaagcgcatcaatctttttgcatcatgcaattccaattgtccgcttatttgtgccttctttcgcttggcattgtcggcaatttgttgagggcacactttgtcaggtggaggaaacggtctacgtcagttgggctcgcacggttgggcgccagcatgtttttccactataactttctacaacttttttctttgtcatccaaatcttgatatcattctaaagcttaatgtatttaaaaactttttctaagctattgctttgcgattagacaaataccaaaaaaagttatacatgaaaattgcgaaaaactcgaaattttgaagttttttcttaataaaaatttttccaggcttaaaaatctcttctctttttgtaagactaatagagcatgttaaatagctttcgaatgataccaagattgttggattagataacaaataaa

SEQ ID NO: 51240 - DNA, 88 bp, Heterodera glycines
  Genomic contig location: Contig_ID=SeqID_20678; Location=1..88; Strand=+
  SCN-specific regions: Sequence locations=1-4,26-88
gtagtcattttcaagttttgttattttttcgttgaaaacacactgataaatatgttatggtgttaattttaatcatttttcgaaaaaa

SEQ ID NO: 51241 - DNA, 796 bp, Heterodera glycines
  Genomic contig location: Contig_ID=SeqID_3642; Location=819..1614; Strand=-
  SCN-specific regions: Sequence locations=1-106,129-265,304-446,488 -647,688-796
tttagggcttttaattgctaaaatgtgtaaaaaaagttttaataaattgctaaattcacaaaaatgttccttggctcttttcatccgccatttttttcgtttcccaacaaaattttgtcaaaaaatttctgaccaattcatgcaaaatgccatcactgctgaagcactgtcatcattggcatcgccggtgcattgttttagcactccgatggcattgacattcattgaccatttgaggaatgaaaagcagcaaaagtaatagaataaattaacaaaataaaagtttatatgattaaagtaattaagactaattaggactgattggcacttttcccttttcagcattgttttcgtcgatgcattcacttggcttcggtggcattttcaatgcgaccgtccctatgagctttcttttacgtcttctattaattcctccgatggaattgtaattaattatttttatttattttttctatttttaaaatttcccctcagattgatcagttctctcgcatttgctttgtccgtccttttccttttgctttgctaaattttcgatttgcaattctttcgccctttactgcttttaatctgtttggaatctcaacaattggaaatgaattcacaaatgtttttctcgttgtcagttttatttattattttatttctttttaatttctttttttagaatgcaatttgcgttgagtcatcgcctaaatttgcgccctcttttcatgtcaaattaattgaccaacacattaactcatttccttttgagtgtccattggagcctgaa

SEQ ID NO: 51242 - DNA, 48 bp, Heterodera glycines
  Genomic contig location: Contig_ID=SeqID_20682; Location=948..995; Strand=+
  SCN-specific regions: Sequence locations=1-48
atggaaaatgtacaacaattaaacaattttcttggagcaagataccag

SEQ ID NO: 51243 - DNA, 775 bp, Heterodera glycines
  Genomic contig location: Contig_ID=SeqID_20683; Location=180..954; Strand=-
  SCN-specific regions: Sequence locations=1-775
atgttcccttgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggt

SEQ ID NO: 51244 - DNA, 457 bp, Heterodera glycines
  Genomic contig location: Contig_ID=SeqID_20686; Location=134..590; Strand=+
  SCN-specific regions: Sequence locations=1-161,185-457
atgaaaaaggacaacaaacgtgaaacttttggaggacatgagtcgaacagagagcgcaatccacatggccgagtagtaagtgatcatctgcgcaacgcgagctcgccgttccgtgatcaccatctccacgttgggctgtgtcctgttgcttacctggtgggaaaattaaaaatggaggcatttaagacagcaattaaggcattaattgccgtttccagccctggcatgccatgcctaccgtgatggacataagttgtggcaccgtgttcatcagctctttgatggtgtgcgcgagacggagacggacgagcagccgactgcgcagcgcaattgcggtcaaattgatggtgaacgaagaattgagcagaggagagttacaactgtgcacttaaaaaattggcaaataacggaccaaggggttcatactgttgaaaatttggtaagcaatgaattaata

SEQ ID NO: 51245 - DNA, 2458 bp, Heterodera glycines
  Genomic contig location: Contig_ID=SeqID_20688; Location=7..2464; Strand=+
  SCN-specific regions: Sequence locations=1-39,61-461,513-545,568 -783,815-872,894-940,962-963,986-1043,1065-1393,1415-1684,1706 -1727,1749-1908,1930-2058,2080-2458
atgcagagaaaattatttaattcaattgttcttcatgacaattcaattcatatggtgaaaactttaaatttacttttttcccaaattgactcgataaacaattttcgttgttttggggagggcaatctgacgattggtactccaatttactgtcgagaacatgactgttttaaaaataattcattcaaacaaatatatggaacaaaattttgcttttacgatccatacgaaaagatttaccttgtgaaatctgacgaagaattaattcaaatcaaagcatggggaactattgaaaaagttttttacttgccaaataatttaaatcaatcatttattgaaaatagacggaataaaagagaagaaaactcttcaatcaatgaagaagcaaccattgagtgtttaaaaggaggcattattattaaagcaataaatgatatacaagaattacaaatttccattgaaaattatacaattataaaaaagaacccccaaaaagaggaaataatttatttacccccaaaacttacatcctttgaatataaacctgtaattaaatttataagtaacccagataaatcaaatgagaaacaaatcacatgtcaatcatctcccgtatgcgaattaattaactgtcgattttgtatggaatatcttaaaagcccacaatgtgtagaccagattcactgggcattaatgcttgtaattataatgataattttatatgttatttcattaagcctccaaattattcgaatactcacacgttttatccattggattttacaatttatttttaattgttttaaaagaaaacccaaagtaaatcgaattagaatttcaagaccaaagttaaaaagaccattgatttatttaatcacttccagtttaattttattcaaaatgatttttgcttgtgatgaagtgacaaatttagtcgctggaacaaatgactgtgctgtaactcaagaaggaaaaattgaatgttcttatgaccaaacaacccaactctctattacacctgaacacctaacctgcctaaaactcgacaatacaaaaactaacaccactatggaaacactacaaattacaatagaaactttaacaataatttgcaccgaaaaatctgattattttacgagaggttacgaattatcttcgacatcacaaaaaagatgctcaggcgctgggaaatgtaccggccaaacttgtcaatcagtaaaaatgtcagaccggaatcccgaagtgaatgatcacgctaataatcaaccaggttattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaagcgagaattaaattgtctatcaatccagaattaacctattctgttaacttgaaacccggaattttaacacacattggtgacgagtctaatagttctatatctgtcacactgacttcgacttcaattccaccgacgccgttatttggttcgacatttattatagttcgcgaagaattaaaagcagcaatagttgcgaacgaaaatttactcaaaaatatattacggtgtaaaaacaaagaagaagcgcaaagttttagttgcacttttccaccagaagcatgtcaatgccacggaggtgattccgttgtacattgtgaatgcgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacaaattttggtaccgcattagccaatgtggaatgtccaagtcaaaaggtccaagtgaattgtgataaagaaggaaaagaacaacaaatccaacttgcatataataagcaaaatattacagaaaattgtgaagttatatgtcccgatggcaagtctgaaattactttaaaagctaatttggaatacatatcacaacaagatactaaaattattcccgctaacaatactaatgaaaaccccatcatcggaacttccttggaccaagtaattgatataataaattttgtttacactcttattaaaactaattttttcaccatatttattattatcatattcatacttattctattttttctaattccatgtctactacctattatatatagaattatgtgtgcttgccttcctcgttcgcgtgggagtgtcgcgacagcgcgaaatcctaaaataaagaagggaaaaa

SEQ ID NO: 51246 - DNA, 650 bp, Heterodera glycines
  Genomic contig location: Contig_ID=SeqID_20689; Location=370..1019; Strand=+
  SCN-specific regions: Sequence locations=1-138,161-230,253-438,483-650
caatacgatggacgtgctcagaacggtgcgcgaggagggcatcagacagcccattacggtgatgtaccaacgcgcggtgcgtttttgaaaagaaatttagaaatgtcaaaggcaattagagcaaatgagagaattcccctgccattaattaattaattaaggattacatgttaaatatcgttggtggccaagatgaagcagagccaaactacgaaattaaacaggcaaagaaggaaataataaaatttttaatgaataattcatagttggaagtgaactgcggttcggttgccggcacaagtttggaccgacggacagctcagcttaaccatgtgatgctgcaaagggccggttttcagccggcccccgaagatttgcctgaaaattggccagacaaagcgcaaatcgaatcaatcaaaatggcatggtgagaaagtgaatataaaaaattatatttgaaattgaatcaaattaattattttccatttgtatagggaagcctataacaaatccgatgcaattgtggtgattttgatcaacgaaatctcggagactattttcgatgcaaatttcttcgagactgagttggaccgactctcaaatggacgcattaaagtcgaacggattacattgaatgattgtgtacacag

SEQ ID NO: 51247 - DNA, 448 bp, Heterodera glycines
  Genomic contig location: Contig_ID=SeqID_20690; Location=311..758; Strand=+
  SCN-specific regions: Sequence locations=1-158,180-205,227-448
atggttcatccaaacactagaccgaaaattaacgaaatggtcagcgagttggccgtgtacggagttctcattggcaacatgaccactggagcggtgagtttattcggaaaaagagtgcttaatccattaaagtgtccgaggcttttaattattattagtaaaatgattatttattcaatcaaataaaagtgccgttgttttgcaggtgtcgcacaatgtgcagcagggccacctgctgaagaccaaattggccactgccaacgaaggcggcatttccacggggtcggcggtgcacgactctccaattctgttctgagcaatggcaaattgaagaagaaaaacaaacatttgcgattttcgaattacatatatagaataggctattattttgtttggttttcaatgaatttatccatttgcattttgctatattttgggaaaaagtgaa

SEQ ID NO: 51248 - DNA, 221 bp, Heterodera glycines
  Genomic contig location: Contig_ID=SeqID_20691; Location=586..806; Strand=-
  SCN-specific regions: Sequence locations=1-221
atgcccaaggcactaattaatcaactagtgagagactaatgagaaagaaaaagggcaatttgatgattttagggggagggagaggggcatggattgggaaaagattgacggagagattataatgaaaaaatgaattttacagcataatggtgaaatggaagaaaaacaaacgcccaagagaaaagcgacgtgggaaaagggcaattaaataggaaaataaa

SEQ ID NO: 51249 - DNA, 1166 bp, Heterodera glycines
  Genomic contig location: Contig_ID=SeqID_20691; Location=1331..2496; Strand=+
  SCN-specific regions: Sequence locations=1-176,222-475,498-639,671 -697,719-869,896-1068
  Gene Ontology: Mol. function=electron transporter activity; Cellular component=extracellular space; Biological process=electron transport
atgcgccgtcgtccgtttctttcgcttttcattttattcctttctctgcgctttacgccaattttggcacacactgacaatgaaaatgccgaagaagcagagaacagcaacaaagttgagcccgaaaggccaaaaagtgacgtagaaggggaaatatccaaagacccctcaggcggtaaatttaaatcaaaattatttatttatttgaaaatgattaaattggtaggttttggcactgacattgagtgggtgccgtgggatcaagcagtttcggtggcgcttgacttgaatcggccaatttttctgctcattcacaaaacgtggtgcggtgcatgcgatggtaaaaattataattaaactttgccctaaaaccaattttaatttactgtttcaataaaaagttggcacttttctctgccaatccaacaaattgatcaaattgatcactttgcgaatggtcctttgatcactgatcatttattattttatttaaaattcgcgtcacttcactctgatcattaaaatgccgaaaagcgaaacgattgtttggttttgttcagcgctcaaaaagagttttgccacctctccaaaacggaaggaactgttggagctgagcaagcagttcgtgatggtgaacacggaggacgaggaggagccggaggaggaggagtacgcgccggacggacggtacatcccgagactgttcattctgagtgagtggaaaatgtgccgttgctgaaccactggcggttgattagggcactttgtcggtttcgggactcgaaaagaaacggcactctcgagacaaaaaaagagctaatgcaagctcaactaatcaattttttttttatttagcccctctccaattgattttaattttaattaaaattatattgaatttagataaacatggcaaacgccttccggtggataataagaagaactatccgagtaacgtggcctacttcccgcagggtaattattttgttagtctaaacatttgtaagcattcgactaattaagtgccggatgtgatcagagcgatgaaagagggcacggaagagtttgagaaggagcagaaggggacagagagaacggaagagggagagagtgtggagggaaaagagaaaagggagaaggaggaggagggaaaaaagaaaaagaaa

SEQ ID NO: 51250 - DNA, 578 bp, Heterodera glycines
  Genomic contig location: Contig_ID=SeqID_20692; Location=183..760; Strand=-
  SCN-specific regions: Sequence locations=1-31,64-375,399-578
atgaaccgacggtaaaagaattttaatagtcacacaaattcatcatttatttaactaaactgtttttccataatttcagttggatttgcaacgacgtttggatggacattttcccctcttttgaccgtcctcaactcggcctcaaattggcacttctttcgccacgttttgatgcgcttgtggacaaacatttcaatggcaaaagcgaattgacaatttggagaccaatcgaaattagcaaggacattggaacaaaaccgaaactttatgtacaaattggtgacaaatttgtggaatttccattgcccgaccgtccgttgcccagcaaaattcgctttgattctattcagattgagtacttaaaaagcagagctatgacaataaaagcatttatttcattttcagttacattgatcactccgtcatcgcttttcttcgttcaaatcatcaaattttcgacaaaagaggcatcaatttatatttgtggcttccttcacataccacgaatggccaaccaatttgggacatttttgttcgtgaaatttggcccatttttgcgccaaacattggtcatttga

SEQ ID NO: 51251 - DNA, 3489 bp, Heterodera glycines
  Genomic contig location: Contig_ID=SeqID_3643; Location=1814..5302; Strand=-
  SCN-specific regions: Sequence locations=1-1440,1462-3489
atggaatggcccgcgttttggcagagttttgagagtgccgtcgaccgtgccgcccttgagcccgtcgacaagctcaactatctccacggttgcttacgcggaaaggctgctcgtgccgtaaccgcctaccgtggaggggacaattatgcccatgccgttgccgcactcaggcgactcttcggagatccacggaaaattgccgaagcacttcagtccgaactgatcaatctccggcctgtggacgatagcgttggatcactgcaacacttcctcgagactttggagcgtgtgtgccgccaacttttgaacctcaacatgccggatgacagcccattcatgtaccaaatcatccgcagcaaattgccgtcgactgttctgtccgaactcatcaaaatggaacgtgcagcaggcattccatggggtactcctcagctcagagctggacttgccgaagttctcggagtcagagaagaggtcgaacgatgcctgcgcgaagccaatgccgacagacaaacacgatttcggcacgaagcaaggccaaatcgacctcagcgaccagaacggcatgaaaatgcgcgagttttttccgtcgctcagtccgtcagaaattctgatgacaagcgagttccgtcctgcctgttctgccctggccggcattgggcctcggagtgtaacaaagtgacagatgcagagactcgaaaacgttgccttttgcagcagaaccggtgcctcaattgcctacggaagggtcaccaattaagggagtgccggtcaaagcaagtatgccgagtgtgcaaagaacggcatcattctgcaatctgccctagtgccaaagggacatcttctgcccgttcaaagcaacagaagccctcgcccaggaacaaacagagtttcggaaacgagcgcaactcaaggccattggtgtcatccgcggttgccaatgaggctgactcaatcactgagccgaaaactgttaacacaatcatggcaattgtctccccatccgttcctcatctcgtcatgctcatggccctccgagctcctgtgttctcagaatccgcaccgaacaagcgccgtgacgcactcttcttctttgaccctggtgcgcaagtcactatggtcaagacgccactgataaggcaactgagccttccgaaactacaagacgatcagctagaggtgaatcctttccacacgcggcaacccatcaagatgaaagcgccgcaacacgttttgtgcgtccaacgagaggacggcggatacgaaactctggttgcccatcggacggactggatagtgccatcagtgcgccgtgccacattcctccagggaatgttagtgcctgtggatgaagaaccggacattctcgttggaatggcagacttttggaagtttttcaacggtgtccaacgagtctctccgcaacttttcaaagtcaaaacttcgatcggttccactgtctgcggacgcgatgaaattccatcccgcccaactgccgaccatccactgtccgttatgcccgtcactgtccatgttcctgccaatgaagacgagatgcccaatacggctgtcagcggaattcagagaaacgaatccatctctgatcttgactcgctacgacaattctgggaccttcaaaacattggcatcagagatgatccactcgaaaacgatgacgagacggcacaacaaatcttcgaccagacgactacgcgcctggcaaacggaagatacagcgtgggatggccatggaagaattttccgccggacctgccctcaaattttgccatggcccatcgccgattgtcttcaattctcaaccgtcttcaacattttcccgaacttcttgccaagtacgaagccacaatccaggaacagcttcgactggggctcatcgaaccagccgttcgtactcgaggactcgagcatttcctgccgcatcattgtgttgtcacacacaaattccgtcaagtccttgacgcttctgcccatccaaaggggcaaaactctctgaacaagtgcatgttcagagggcccgtaattatgccggaactcgctgggattctcatgcgcttccgcttggctggcattgcgctgtggggtgacttggaaaaggccttcaattcactcagcttgctggagcgcgaccgcgaattctgcaaagtgctctgggttaacgacgtccgtaaaccaccgttgccggataacgtggtcatctaccgatggtcaagggtgccattcggagtcattgcctcgccctttttgctggcagccaccatccagaagcacctgaagcaggacgggtccccattggccattgaaatggctgaaaatgcctacgtcgacaacctgctcatgcaatgcacttcaccctcagaagcgctgaacaaatacatgagcagcaagactctgttccgcgcctgtcaaatgaacattcgcgaattcatctgtaactcagacgaagtcatgtgccgaattccgaaggaagaccaactcgtgaaagaagtgcccaaagtgctcggccttcactgggagttgaggccggacaagctttacatcgactttccgcccatggacaccgaaagtcgttgcgttactcgtcgaactgttctccaacagctcgcctccgtttttgaccctctcggactagtgtgcccggcacttcacgatgccaaaatgtttttccaatcactttgggaaaccaagcttgactgggatgatcctctttcgactgacaaagtgcaagaatggaacacaattgccacgacttggaaccagcaaaaggtccgtgtcccgcgccgagtcatcccgttggaagtggcctctcatcagctacatgcctttgtcgatgcaagcaaagatgcctacggagcatgcatcttcattcgggcacaacatgaaatcacaatcacggcccatctcatttttgccaagagccgagtgaagccaaaggggtcaaatctcactattccgcgcatggagctcatgggaatgctgattggcattcggatgcttcaatttgcagagaaacagctcggacttgccgttcgccacaaattcatttggtgtgactccaaaccagtccttggttgggtgtcgtcttccgagcagcaacctcgttttgtggagaatcggctaaaggagatccgtgccgtcgaccaagtttgctttcgctacatatcgacagagcaaaacccagccgatgtcgcctcacgcggatgtactgtgcttgaactcacctcccatccactctggtggaacggcccaagttggcttatccatcccgaggatcgttggcccatcaccatcgaagtcaagcctgccaatgatgacgtccaaaccattgctgagatcgctgccatcgtccccattgtccaaaaggtcgaagcatggatttgcgccgacagattcagcgactgcacttgccttcggaacgtggtggttcttctcctccgtgcccttcgtcgatggctctcaatgtctcgctag

SEQ ID NO: 51252 - DNA, 631 bp, Heterodera glycines
  Genomic contig location: Contig_ID=SeqID_3643; Location=2950..3580; Strand=+
  SCN-specific regions: Sequence locations=1-631
gcaggttgtcgacgtaggcattttcagccatttcaatggccaatggggacccgtcctgcttcaggtgcttctggatggtggctgccagcaaaaagggcgaggcaatgactccgaatggcacccttgaccatcggtagatgaccacgttatccggcaacggtggtttacggacgtcgttaacccagagcactttgcagaattcgcggtcgcgctccagcaagctgagtgaattgaaggccttttccaagtcaccccacagcgcaatgccagccaagcggaagcgcatgagaatcccagcgagttccggcataattacgggccctctgaacatgcacttgttcagagagttttgcccctttggatgggcagaagcgtcaaggacttgacggaatttgtgtgtgacaacacaatgatgcggcaggaaatgctcgagtcctcgagtacgaacggctggttcgatgagccccagtcgaagctgttcctggattgtggcttcgtacttggcaagaagttcgggaaaatgttgaagacggttgagaattgaagacaatcggcgatgggccatggcaaaatttgagggcaggtccggcggaaaattcttccatggccatcccacgctgtatcttccgtt

SEQ ID NO: 51253 - DNA, 549 bp, Heterodera glycines
  Genomic contig location: Contig_ID=SeqID_3643; Location=5353..5901; Strand=-
  SCN-specific regions: Sequence locations=1-393,418-549
atgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccatcatgaacggactgcaaggcccagcgagagaggcggaggaagcgcttttcactgcctttattcgagatgaccggcacttgacggagtggttggaagatgcgcgagaaatgctggctcacatagcagcggaactcgcagatgagcccaaccagccaatcgcggcgggaagacagcaaccagctgttgctgtgaatccacccgtgccagccgtgccattcgtcaacaatgccgcatttctcggcggtgccaatgttcaacagccagctgctgttgccaaccatgccaatcagccacgattggtgccaaataacaaatcgtgccaaacttgccggctgttgctgcgcctgcgcctttag

SEQ ID NO: 51254 - DNA, 235 bp, Heterodera glycines
  Genomic contig location: Contig_ID=SeqID_3643; Location=6377..6611; Strand=-
  SCN-specific regions: Sequence locations=1-108,134-235
atggagaaggcctgcaaaatttggagagattatatcgattttagtgcgctaggttcgatgaaactttttaaaatataagcctaaactttttggcctgtttaaaaagggattaaaaatttttaaaaattttattcatctcccttttgatagaaaaagcatcagagagccttatttaacttttaattaacatttggtgcgtttcagagcactttctgaaaaaatacttatgaataaa

SEQ ID NO: 51255 - DNA, 460 bp, Heterodera glycines
  Genomic contig location: Contig_ID=SeqID_20695; Location=896..1355; Strand=+
  SCN-specific regions: Sequence locations=1-460
atggccgtcctcgtcataattctgtactttgtctgttccggacagtgcagctattcgtccggcgaaaagtatgccgacatagacggggacatcgaagcgggcacagcccacggcccacactggcccagcgaaatccgtgtcaaattccgttacggaagcaaagacagggacctggaggaaaatcggaaaacggaccacgtttatatcgtagtcggaaaatacggtagggggaggttcggttaactctattagtgagcggaagttaagtttttttccgattaggataaaattcggtaattaattctaccgatttttcatacctgtcagaaaatccgagaaatgatagatattatgccaaaatatattttcctttttttcgttattcaaaagtttctaatttttagaatacgaccacacaacaggtggagctcgagctcgaaacaagtgcgatttgaaataa

SEQ ID NO: 51256 - DNA, 639 bp, Heterodera glycines
  Genomic contig location: Contig_ID=SeqID_20695; Location=1487..2125; Strand=+
  SCN-specific regions: Sequence locations=1-96,124-253,275-508,530 -607,629-639
atggctaatggtaaatggtccaatggaagtttggactcatttcgtctgtgcctcgactttgcctaccaatttgtgtgcctgttgagaaatggggagtaagtaaaataaataaataaagaaatcggtatttacgaggccccaaatatgccagaattccttaaaaattattcaaaagggatgctatgtcgtttcgtaaaatcctccattttaactatttttggacaaaacatggcattactttgcaaaaaaacaatcaaatttcaaattcttggtatcattcgatagccaagctttttctctataagtttgcaaaatttaaaaaaatttggtcaatattagaaaaagttgtttgaaaataagtactatttctgccataacttatgttaactttgataatttgctatgcaaaatttggttacttttagcaaagttatgacatgttttgtcgaaaaaatcgccaaaatggcggattttacgaaatgacccagcacgcagaaaaggcaaaactagcagccatggcattaagaaccatatttttgccgatctatcaaaattgaaaagaaagcgattgcatttttattttttgctatgaattgccattttgcacaaaacaaaatcaatgttattgttttgtaaaaa

SEQ ID NO: 51257 - DNA, 138 bp, Heterodera glycines
  Genomic contig location: Contig_ID=SeqID_20695; Location=2333..2470; Strand=+
  SCN-specific regions: Sequence locations=1-82,131-138
atggctgaccatggcggaggtggacgtacccgtggagtttggcaggttattttgaggatgaatggtcataatcagtgatggatatgattgattgatcatttgttgaattttcagagccattttaagattcttttataa

SEQ ID NO: 51258 - DNA, 99 bp, Heterodera glycines
  Genomic contig location: Contig_ID=SeqID_20700; Location=1696..1794; Strand=-
  SCN-specific regions: Sequence locations=1-99
atcacaggttgtgaagaatcggctccctccgatgcgggtgccctcggggtggacgcacttcgtctttggtgcgcttggctcgcctccgaatcctcgggc

SEQ ID NO: 51259 - DNA, 1496 bp, Heterodera glycines
  Genomic contig location: Contig_ID=SeqID_20701; Location=11..1506; Strand=-
  SCN-specific regions: Sequence locations=1-358,381-405,427-435,464 -999,1031-1352,1374-1496
atgaatttatttcttaccccagcaatttttctttttttattttatttcgtttttatttcaaatgtaaaatcattggtaagttttgattttttatttagccaaacattctatgtaaatttctcatttccaaaagtataaggatatcaaatttttgaccaaattttataccattttttccaatttttaattcccctttttaagccatttttaattaagatgggtgggccaacgtaaataattgacggtttttaagaaaaaatcaatgtaattgagttgatttggtccgccgaaaacagacctttttcaatgacacacttaaaccaaaacgactaaccgcattaaaagttaatggttttaataattttataattgaaacatttttaatccttcaacttttgttttaaaaaatttgagaggttttaaaatcactgaccgaaaaaattaaatttattttcattaattaccattcaattttgtagcagactgtacaacaactcgaagatgaagcaatggttgcatttgcaaagggtcggacgttttttgatgaattttgtgcgactcaatggttgaccattgaccgttacaatgacaatttggcacaaaaatatgaaacatttcttggcgttttgtacttcattaaaacaaattggcaatgcgagaaagtcgttgacaaattggtgaaggaagaggtaatggaggccaattaattaacactttgttaattggcgctggaatttgtaatttcagcgacaacaattttattcttcggaccattttataattttattccaattaatgcatttcttaaaaactatattaaaagataagatttactgtaaagtaattagctcttttgtttattaagaccaacagtgatgatgatgtgaatgacgtgaaggaatgtggtatttaccgtaagcatgtgatcatactgtacgaatatttgtttcgggaatacgctcgacaaagtgtaaaaggttttgaaatgatcatttctcttaaatactgattaaaaataatcaatgatttcgcaatcttacttttaagcagctgatcccgacttggcggaacaaattcccattgtggagcagccgatcgtaaaatttgcctaccatgaacggggatggggcgtactgtaccgaaatgcgggcactctgattgaccttatgcaaagtctgtgtcaaatttggcgcttcttctttgatcagtcgtatcggagaacattcaaaagcagaagcgtttgttggcttgcctatcatcgaattcaaaaaccgagttttgttaatcaagaatcactggtgaagaaatatggcgttgaattggacaaattgaatcggacagaatttttgtacaacaccaaaaatttgaaaataagtgccaattcaaattttgacaattcgtatctccgtcaccgtaaaatttttgatgaaaacatggcgaaatttttggaaaaagtggaaacaaatcacaaacagagtttgacagaatcgaagggc

SEQ ID NO: 51260 - DNA, 442 bp, Heterodera glycines
  Genomic contig location: Contig_ID=SeqID_20702; Location=837..1278; Strand=+
  SCN-specific regions: Sequence locations=1-192,245-378,400-442
atggacattcgacggcattttatgtgccaaaaattgttttgtttgccccttttaatgataatcacttcattttgtacacggtcatcaaatgctgaacttagtcaaaacaacaaaaaattgtcctggattattggtaagattttgcgtgttgtgatggggggggggctatagaaaattttcaaaaaatcttagaaaatttttttaaagaaaaatttagaaaaatcttttttcaaaattttattatgaactactaattttttcaaaaatcactgaaaaatgtttcaaaatttttttgaattttcttacaaaaattttctattttttttttgaaagtttcaattgaatttttttttattagttaaggggataggttaatatttttataaagtacatttttaggttataatttaacataatatggttttactcagggattggtcta

SEQ ID NO: 51261 - DNA, 1504 bp, Heterodera glycines
  Genomic contig location: Contig_ID=SeqID_3644; Location=382..1885; Strand=-
  SCN-specific regions: Sequence locations=1-226,258-840,879-1001,1030 -1203,1225-1504
atgattttgggccataagcctccgttgatgaacatgctggaccagcttgaccagcccgtcttcactatatggtcggactggtgagcaaaaattatgatgcaacaaatttaaagattttctatttttcaattacataattgacgatctcttttcacggcacttttggttttggatttatttctcttttaataattgttttgtttaaaaatttgaatattgcacattgaaaaataattttatttatttaaataatttttggcactgaaatggtcggaaaccaaccagcgcagttcgaaaaaataacaaaaaattgcaaaacatttcttaaggcgtcgtcctgctgaactgggcggctccggtggcttcatgacaattggtggtccggacaatgaccactgttctggaccatggcataatgttccacttatatctcgatggaacagctggacatttcgagtggatgggtgagaatccaaattgatttacccgggtggagaccaaaagatatatgatgaccgattaagacaggggagtgggcaggtgtcttgggaccaaaatttggtaataggtattgtggttggtccgccctttttggcaaaaaaataaagaataaacgcattccggattctcgtgattagcgatctcgaaaattcctcaaaaatttttttttggaaatctttcaggttccagatcggcaaatatcgttcatatcgtgactatactgctgcggtggacacgggcacggcgctgatcggtggaccagttcatctgatggaaatgatcagtgagtgggttctgctggcaaacacgataatcagaagagacgagaaagtttagtaaagagagagagagaggagagagagagagaggagagagagctccgggcactaattctagctcgggatttcgtactaggataacttgtactgtgctgagccgttataaaaaaaaagccatcaaatgaagcttttaagcacccaaaaatcccatcgccccaatggaattttttaataaaattcaatttttaatccttttgagttgctgccacaaatgctgattactgcgaggaggacaacctgtacactgttccatgtgaccaacgacccaaattggcctcaattgtgctgaaagttaatgggaaagacattgtggtgccagcggaggaatatataattgatgtgtgtgtgaaatttgattttaaataaccaattttaatgaattaattaatcaatagttgaatctgccggatggaaaatgtgcccttgggctgtttggccaatatggcgtcggattcacgacggtaaaacatttagaattttctttggcacttccactttggcattttcaccccaatctgtgctgattgagctgttgattcattcaattccaggattgggactggtctataaaacttttcggccctttcactttggcatttttgcgtaaatctgtgctcattgtgccattgttaactcatttattcccaggattggctgatccctga

SEQ ID NO: 51262 - DNA, 832 bp, Heterodera glycines
  Genomic contig location: Contig_ID=SeqID_3644; Location=3058..3889; Strand=-
  SCN-specific regions: Sequence locations=1-219,241-390,412-471,493 -549,572-733,756-832
atggcgtcgaatagtccttacattatcagtgatttagcgcagcagctgcaagtggcgcttgacacctgctaccccttcttttgggtaattgactgccgatgcacagaccaaaattgtcactatgccaaggattgggaatatgaaaagcattgctttaacgccaggtctgtgctgggcgggcactgttgcactgctctgaaaatttggtttttatggtgcaaaaattgtgtttaatagcaatttttttgaacaaattttcaaaagttttttttagaacataattaagcgacaaattatttgcgttcgcctattaaaactcaaataatttttttaggttttccgaaatttccaacttctgatttccaagaacattttttgagtcggaattccgctttatgaaattttggggccttgaaacgttatctctaatagagaaaaacaatggcaattgttttaaaagtatgactatcgtatgaatttatatttatctaaaaatgcgaaaatgccgaaatatttaataatacgaaaaaacccgaaatgttgacacccaaatttaaaaaaaaaaaattttgcccatttatgcaacatatttttcatcgaaaaaactattattaaattcaagcaaatcgacaagccttcatgggagtggagacaaattaaccataccatgtcataattgtatggatgacatagaagcagcaggtgatgggcatcgagtcgagaaaagtctcattaaataagaaaaaacaaaacaattttgataataataattagggcttgaaattttcatgtaaatattctttgaatagttggaaattttgttccgaataaa

SEQ ID NO: 51263 - DNA, 1104 bp, Heterodera glycines
  Genomic contig location: Contig_ID=SeqID_3645; Location=1290..2393; Strand=+
  SCN-specific regions: Sequence locations=1-145,167-346,370-446,503 -657,679-864,887-998,1027-1104
atgagcagtgcaccacaacaccatgcttcatcgcatgaacaacatcaaccacatgccaacggcagcatttttcaaagtacacgcgaataaataatttgtaaaaaattattcgacataatgccaagccaaaactggacaaaaaaacattttatcttattttttattccgcaatctcggctctcgggattatttaccggtctcgatcagtagaaattttcgaaaagctctgtttgtttagacccaacgccattcctggactccgcttcactgctggtgtttgccggtgctcttctgttaccgtaggattgagatcaaacaaaattattgattaaataccttaaaactgattaaaataaattaattaaaattgcttttacattcaaacaatcaccacagttctctcttctacatggccgtcttaattttggtctgttgtcagtgccctgagcgacaacgccaacggcaccaacaacgtgaacaacaacaacggcaaaaacgacgattgaccgggtcggccggtaataaaaatggaattcaaaaatttcggggcggattttcaagatcccgtcccgtaattcctgtctcaacataaaaggggcatcatgtgtcagcaaatttttaattaccgtattcccgaaaacagggcccctcagggtgctttattttttaacccccctcggtcctctaatttagtggctgatttacatgatcccgtcccgtaattccggtctcgataaaaggagtcatatgtcagcgaacttttaattaccgtatttcttaaaatatagccagctcggggtggtttatttttcaaccccctaggtccattaattttgggggtttccttttttttaggaaatgcggtattaaatatttttttaatttagtggaaatagttgaatctaaagcaacgacaatttcgacatcttctgcctcctcaaatgtggatgttgaacttcaagcaaatgaacaacaaatggggaaagaaattgctgagcataaattttaaagaaaaatttaaaaattgaaactgccttattttttttaataatgctaatattaattaaagcggttatttttcaacgaaatatttaattcatttta

SEQ ID NO: 51264 - DNA, 205 bp, Heterodera glycines
  Genomic contig location: Contig_ID=SeqID_3646; Location=179..383; Strand=-
  SCN-specific regions: Sequence locations=1-102,125-205
atgtgcccgccggcgacaaatcggacaacggacactgatcacatcaaagtggcggctgctacagtagacgattcgcgcgctaccgtaggcgaggggcttgcggacggtgacgacgacgacgacgcttcgcaactgcgacacgcgtcaacaccgttgctgacgcgctactattttgacgcggtcaccgctcaatgttatccgtttg

SEQ ID NO: 51265 - DNA, 204 bp, Heterodera glycines
  Genomic contig location: Contig_ID=SeqID_20705; Location=10..213; Strand=-
  SCN-specific regions: Sequence locations=1-146,168-204
atgtcgcaccagaaactgcgaagaaatgctaaaaagaaaggtctacaaacggattcactggaaaatcaggagaatgaggacccaatgccggccaaccaagagaatgtaattgcgaatgacgcttttgatgaggaagaagacttgctgaacatgaaaatcccagcaccgccagagtcatttatgcatagagacggcaatcgaatg

SEQ ID NO: 51266 - DNA, 259 bp, Heterodera glycines
  Genomic contig location: Contig_ID=SeqID_20706; Location=369..627; Strand=+
  SCN-specific regions: Sequence locations=1-259
cgatttgtcacttggcttcgttacaacgtttggctgctgctttatccgctcggccttttccttgagggtacattttgaaaacttcactaattatctcaatttatctttgaattctttcagccctcgttttgctcatttccgttccgtttttttactcttccgtcgtttattcactgcaacttccaaatgcgctcaatttcagttacaattttggcgttgtgttggcccttttcagcttcatttgcttccctttcagtgg

SEQ ID NO: 51267 - DNA, 339 bp, Heterodera glycines
  Genomic contig location: Contig_ID=SeqID_20707; Location=1232..1570; Strand=-
  SCN-specific regions: Sequence locations=1-339
atgccggaaattttgaaaacagtaaataatgacaaaaatggcaagcagaaaacgaagcaattatcatcatcaaattacgagaagcaattgcagcaagaatttgcgatattagaaaaaaaacaaatcctcgaggaaaagccattgcgcgaggaattgaaagaccaagctgagcgagtcggtgctgcactgctgtacacgctgatccacatgaaaatgcggctgttgttcgagcgggaaaaggtcaaaaaagaaatcagcatatctaagaaatccgcaaaggccacatctcaaatgtggggattgtttaagcgtgtggaagaagcagtggtgaaaccagtg

SEQ ID NO: 51268 - DNA, 2093 bp, Heterodera glycines
  misc_feature (24)..(24): n is a, c, g, or t
  Genomic contig location: Contig_ID=SeqID_20709; Location=89..2181; Strand=+
  SCN-specific regions: Sequence locations=1-24,48-204,226-232,254 -407,434-1146,1168-1237,1259-1389,1513-1531,1553-1590,1629-2093
  Gene Ontology: Mol. function=structural constituent of cytoskeleton; Cellular component=neurofilament
agaaccaatggattaaggtgcatntaaaaaatggtgataaaataaaaattgatattcccgctgggtcataccaaaatgagcaagaattggaaaatgctataaatgagtcgataaaaaatggtataaaacaaccggctacaagagttaaaagacaattggaagatggagtggatttgttttttcattataatccagatgattactgggaaaaaattgaggaagaaaggcaaagatataaagaattgttaaaattgatagtgacaaagtcaagagaacgtgatgatgagacggacacgcataggaagagaaaaatagaggatgaagaaattactcctctccaaaatcaatcgttgactaagaaatcaagaatagaggcgctagaagaagcagcaaggcaaagagatgacgggaaggaggaaaaggaggagagaactggtcaagaatttctcaaaatgtatccagtaaactatagagagaagctaaatgaagttcgattagaattaataagagatttattcaacattcaagaccatatgaaaaaatatcaaggtgtaacagatggtagaagaattcaagaactaaatgaagcagcactaaggatgagaacagcaatgaaacaccgaagaaaaaatttgaatgcttttaataaagcagtgttgaaaaaggatttacgaacaacagctgaagaatatgagaggacgagctatgaacaaaataaggattacgttgaaccgttttttgatagttatccaacagattactgggaacatattcataaaaaatatggaggccttcaagacgattacaaaaaaattcgcaaattaagagagcaacaacaatttttaactgatgaacagaaaaaacagtcaattcaggatgaaattgatcaacttcgtcgacttattgattataggagaaaaagatttgctgcattggaatacgaagctaaaaagagggactcactgcaacaacaaccaatggctttagccttgactcatggtgaagtactaaaggaacgattaggaaaaatagagcgaaccaccacatcacatggggaagagacaaaaactcatggaaaatctttagttgagttgatagaacaggtacagaaagaaagaggtgagaataaggtcgaaaccgagggtaagacacgaggagaaattttaggagataaattaaaagccaaaattgatgaacaagacagtggtgcagatggtgcaaccgatggtgaagcactaaaaaataaaccagaaacaacaattattggtgaaaaaggaatgacaagaggagaaattttaggcgaaaagttaaaatctaaagatgaagaaaagaaagaagaaagaataacccatggcgaagcattgaaaaatagaattgaacaaattcccgaagaagaaaaaacagaaggaaaaacaagaggtgaaatgttaaaagaaaaaattggggctagtaaaccaatagaagaagaaaaaacagaaggaaaaacaagaggcgaaatattaaaagaaaaaattggggctagtaaaccaatagaagaagaaattgaaggagtgaaaacacgtggcgaatcattaaaggatttaattgtttcaaaacaaattgaaacaattttatttaaatatttgaaggagcggcggaaattttcaattgattttaatgaccaaagaattgacttcattgaattgtcagctcaattagggtacattctcgggttcgaagaccctacaaaaattctgattggagctatagcaaagtattattgtgacttaaagggtggtatagacagcctttgtgtgtatattaatggaataactgagaatgtaatagtaggggaccaactcgcttcacttttgcgaattgttgtcgttgaaggaaaatttggagacgtgattgagaagatttataacacaccaatgtacattaaggtggcagtaaaggaaattaatgagattgaaattgaaattaggactagggagggaaggcttattccattccaatggggtacaacattacttgtattagcatttaaaaaatctattgtattttagtatttaaatattcattttcacattatagtatatattaataattga

SEQ ID NO: 51269 - DNA, 532 bp, Heterodera glycines
  Genomic contig location: Contig_ID=SeqID_20710; Location=13..544; Strand=-
  SCN-specific regions: Sequence locations=1-48,70-182,219-450,472-532
atgccaatgtttcttcaagttcaaatgcgaaaggtaaagctaatattcaaaaatattcaaattttatattattctcattgttttttagaaattgaaaaattttctacaaatttgtcaaagttaactttatcaaacacgcacaccagtcaattagatgatcaagccatggaagtaaatccaaatattggaagtgttgatccaagaaatgtccaaatgccaatgcaaatgtcaatggaagtgagcaatgagcatgtcaattcagcgaacggtcaaaaattaaattctacggatcaaaattatgttgatcaagcccatccgatgtccgaaggaacaactgacacaaatttgatcagccataaaagtgatcaaattggtccagaaacatcaaacagtcaacaaaaacgggcaaaacagcgaaagcaaagcacaaacaatattcagcggactgaattcataacagaaataaaaggatccttttcattcaaaccaaaagcctcagaagaaccaattgtcaaatatattgagaaacaaa

SEQ ID NO: 51270 - DNA, 133 bp, Heterodera glycines
  Genomic contig location: Contig_ID=SeqID_20711; Location=134..266; Strand=-
  SCN-specific regions: Sequence locations=1-133
atgaaaaataggaatttaatatttctatttttaacatcaagaattttaattgaaaactgctgtttagccggcaaacatgccgatgaagcagccaaaacagatatgcgacggcgtcgaaatgagcaaattcaaa

SEQ ID NO: 51271 - DNA, 1867 bp, Heterodera glycines
  Genomic contig location: Contig_ID=SeqID_20712; Location=327..2193; Strand=-
  SCN-specific regions: Sequence locations=1-172,194-196,231-259,284 -296,318-379,402-516,646-763,785-794,869-1333,1379-1569,1601 -1680,1710-1740,1762-1867
atgctttataatcaaatcttctggactgctttgtctttatcagttattctgatggcacaaaaggccaatggtggaaataaaaaacgaaagcttattctcacagcggaagcttcatctgaagaaccacctcatattgcatattcagactcagaagatggaataagtatgaatcaaaatatttaattttgaaaaatctaaagtaatcaattttttaagaaatattttacttgagaaaaacgcatataataagtctcaaaattttaaaatatccagtaaaaaataatctggttttgagctattgaattttttgagaaattacctaatctctttaaaaaaatacaaaaaaacgaaaaatgtaacgcttagatttgaagtctcgaaaaataaaaaaataatttattcttcattttcttaaaaatgccaacatagttattttgtaaaagtgcaaattaggcatatttcattgactgtttcgttaaattgctaggtgttaagtaaaattgcctttgtcacctgtttaaaaaaaaactaatttaattttttagatgattaatttaaaaaatcgttattattaattttttgcttgtattctttttcaaaaaaaaaattgttttttaatttgcaaaatttttatagaaaaaatttctaattccacttcattaaaaaagaacctactgtttttgaattttcttttcataaattttttttagtgatcagaaattggtgaaggtatgtgcttttttaagtatttattggacttagatgacaaatcccaatcagaaaattggactctcattttaattcttataatataataaaaataataataagataatttacaaataatacaaaattttagtaaaattatcgcttagccaagcatcagtgtttctgatcaaaatggacaaatttttttctaaatgcgaattaatttctgatgaccattcaaccagaaattgtcttaaagaattaaaaattgtggatttgcgaagcatttttcttcaaaatgccacccaaaatgatcaacagtcggtgcccgatcagcaaaagccatcctcctcaaagcatttagaaagtgatatggataaaaaaatgaccccaagagtagtggattctgatcagttaatgaagttatttattgtaaaaagtatgcaaacattggacaatccgtccaacagtttggagcaacttcggatggtaagcaattttattgaatctcaaattttggcattcaataaaattagataataataataatttgaatttcgatctgggaaatagaaatgattatgcgaaaaatataatgccaacattttcatgagccaacttgatgttaaaattttatagtaatttttatttagaaatttacaaaatttttgaaattcttcgatttgttcccaaatgttttcgcaacaagggcaataaaggaattgacaacagaacagaatttgctaattttacacgaattgatgctgctttcaattgattatgcaaagcaaatttatgaaaaactttatgataaaaataacgaaatgaaattgaaactttacggcgaacaatacccattgctctattttgaattttataaaaatttggaggagaaatttaacacaattagtttagaaatttctaaaattttactcaatcacttcggcagaaagtaatttttttttgactttgaaatttaaaaattaataatgattatttaacagagttgatcccttctccaatattttttctgattttaaaagacaaattaaattgatggatcgagaagaaacaaagcatgaaaaactaaactgtattaattcatttttccataaatcatttttttaagttcctagatgaaaatctgggaccaaataaa

SEQ ID NO: 51272 - DNA, 968 bp, Heterodera glycines
  Genomic contig location: Contig_ID=SeqID_20714; Location=106..1073; Strand=-
  SCN-specific regions: Sequence locations=1-187,230-327,403-550,573-968
atgcagaattataaatcggcatgggctgtatggaagaaggccggcaagaaaattctcgtgatcaccaacttttgtttctcaccaaaaaaaggggggttgtttgggtgatgatcaattttctagacgacaaagagagaatatcggggcagttcctggctggacgtacagccaaatggagaaaaaatgcaattaattaattgaaataattaaaatgaaataaataaataatgtagagaacaagcattaattgttagcgcaattctagagttttggtctaaagttttgactttcaaaaaaacgtatgaacaccgttttggatgattatgcttatttttatcaattatgaaaaaaatattaagtcttttttagagttaaatatttttttaattattttcttaaaatcccttttttaggtcactcggtcgcacagccacgcgccgtcctccacccgaattgaggtgctaatcgccaaaagtgacatccgtcgggcggcagtgaacgcaattagtgcaacgcctggggcaatcgttgccaatgcgctggagggcatcagcgacgcggcaaagcatcagttgccgaagattgccaatctgaaaaagacggccacccgacaaaggaagggcattggggacggagcagcgggtgagaagggaaacggacaaatgagcaacattttaatatttggaccaaagggtcgacaattttcaacttaccctaaaataggctggataattaattaatttcaagaatttttatttttcaaaattgataaaatcaaatgaaaaatggaaaaaattttcattgggattcctttcaaattaatgaccacttgacaattagttacttcctttaagataatccgctgtcaagcagagaaacactgcgcaaaagcttggtgcaaaactatcgcaacggcagtcaccgacggacaaccgttacagtaccaatgccacaaacatcgcattacg

SEQ ID NO: 51273 - DNA, 49 bp, Heterodera glycines
  Genomic contig location: Contig_ID=SeqID_20715; Location=855..903; Strand=+
  SCN-specific regions: Sequence locations=1-49
cccagtctctattaatcccgcagtctccaattatcccccagtctacgag

SEQ ID NO: 51274 - DNA, 913 bp, Heterodera glycines
  Genomic contig location: Contig_ID=SeqID_20718; Location=955..1867; Strand=-
  SCN-specific regions: Sequence locations=1-142,358-489,677-913
atgggcgcacgtcgatgcggaagcggtaggagcggcgcgtgaaccgcgggctgtggtcattgacgtcatcaatgtgaatgtccgcggtggcaatttggcacagctccaacgagcggggatgaagcggggaacggctcttaacattttaatattaattttaataatttttaattattattttaacgaaattatttttttttaattttgtaaattcttttttattaaattaggcgggaaataatagtaaatgtttttaaaaaataataaataatctgagagagaaaaaaactcaattttttaagtgaattattaattaaaaaatagtaaaatttaaatttaaatttttttaaatatataggtagaaagctatttttggaagttaatattcatacatcttaaaattaaacaaaaaattttgactttaaaaaaatgtaaaagggattttttaatgaattttctgacatggtgtaacatacaaaaaaggcgtagattttttaatttttaaaaattttttattataaatgtttttaaatatattttttaattattctacatatggagaaattcaagaaaattatttttccattaaatttaaaaaataaagacaaattaaatgaaatcgaaaaattttttaaaattattattttaaataagcaaataattcaaaaataataaagaaatgatgaacagcgatcaccatgagtcgcgctttcacaatgatccgatcagtgctctcccggtcgatgttgacgccggaccggacaatcatcaccccgtcactgtccaccttgaacaggtcggagccgttcagcagctcaacgccttggacctgatcagagaaaggaaaagcggaatgatcaaaatttgagccgactgcttctgatcaatagccaaatatttcactgaaaataaa

SEQ ID NO: 51275 - DNA, 491 bp, Heterodera glycines
  Genomic contig location: Contig_ID=SeqID_3647; Location=287..777; Strand=+
  SCN-specific regions: Sequence locations=1-180,202-491
atgccggactttacaaacgaaattgagacactgaaaaagcctcaaaactcgccgccaaaagagaaaaaaaaagtgggaaaggcaaagaaacaaaacgccaaaggatgcagcaactcaatttcgaaattattcaaaacgaaattcaaaaatatgttgaagtcgccgaaaaagaccaatgggagcagcagcagcaaaacaagcgaaacacaaaacatggccaatcagcagaagcaggaggaactgcagccgctaacttcatatttgttggatcagaaattaaatggacaggtaaaaatgggggcaaattaatacaataatgtagaaaattgggtaattggtcagggatacggtataacaattagtagaggaatgacagacgccgatcgaaattcccggccaacaaatcttttatccctcaaatataccaacattagagcgcggatttgacggcatatgccattttctgctaacttcttacgaattaaaatgca

SEQ ID NO: 51276 - DNA, 651 bp, Heterodera glycines
  Genomic contig location: Contig_ID=SeqID_3648; Location=1129..1779; Strand=-
  SCN-specific regions: Sequence locations=1-57,79-99,121-651
gaagaaagaagcacttctctgtacagcttgcactcctgcaaaatgatgttcatctgcaggtccgactcaatgttccctttttggcgcagctcatagcaaagtgaaaatatccttcaaaatgttaatcatcggttttgttagcataaataatgattgaccgaccaattaattggcatccaatattttgggaattcgcttttcacattttccattaggtccaattctggtagcttaattaatttgcattcgaatcggatgattccattttgatcaatgtttgtcgttcgactgacttggatcagttcggagtcaaccagtgactccatgtttggaaaacgctttcggacttggatggaaatgtcgcggaggacgagcacttgggtcaaacacaaataccttttaaattgcaaggagtttaaaaatatattattgttagcttcattgcccctggctcacccattcatttgctgcctaattacctaattatgttcctcctaattgcccttatttgggggctgtcaccacggatataagtgccaatgaaaaatgcagggctatcgacgaagccaatattttgaaagatttgcttccatctgagaaaaggcagaaaataacgaattatttgtctgtaattaataaaaaaggttttac

SEQ ID NO: 51277 - DNA, 1902 bp, Heterodera glycines
  Genomic contig location: Contig_ID=SeqID_3648; Location=1454..3355; Strand=+
  SCN-specific regions: Sequence locations=1-206,228-248,270-372,394 -793,823-841,863-953,983-1303,1325-1439,1483-1628,1658-1740,1762-1902
  Gene Ontology: Cellular component=integral to membrane
atggagtcactggttgactccgaactgatccaagtcagtcgaacgacaaacattgatcaaaatggaatcatccgattcgaatgcaaattaattaagctaccagaattggacctaatggaaaatgtgaaaagcgaattcccaaaatattggatgccaattaattggtcggtcaatcattatttatgctaacaaaaccgatgattaacattttgaaggatattttcactttgctatgagctgcgccaaaaagggaacattgagtcggacctgcagatgaacatcattttgcaggagtgcaagctgtacagagaagtgcttctttcttcccattagcacttaattacccataattaataaatttatgtgtctgtgaattcagaaactgcaaaatttgtgcaattacgattgggtccccgtcccattgggtcattttacacattttaattaagtgtaaatttgcttgctctgttcagcttatccccaggtggtgtttctcgccgtgcgcatttactttttgctctgtctgatcgcccgtcaataccgtgtccacgaaaatgcggaagaacagaaccaagtggacagagtcattccgctaatgacagtgcgcgaaattctatgccaaattaaatttaattaggtaacaatttcagatgctgcaactgattttcgtgatgggatggctcaaagtggcggaggtaaaaatggaaaagcattaattttaatgtttttattttcgtttttaatttaaggcactgttaaaccctctgggcgaagacgacgacgattttgaatgtttaaaattattattattatttataatatgtaaaatgactgataccccattaggcaattacataattgaccggaacattggcattttcctgacaatggtcgacgagtgttacgatcagaaaccgccccaatgggcaggtgaaaggacacttggaattttcaatatttttaaataaataacaattttaaagaaagcacaaacttaaaaaacacgaagaagcccctctacgcggagaattgcgcgctttacacccaaaatccgctcgtcggctccgcaactttgtgccatttgccaggggaaagtgatcgcgtccgaatggtccaacggcggccgagtggtaaaaaaaagcaattaattaagggcctaattagaatttgtgtacaattttttttcgagatatgggcaggcgtcacagcagcaatttcccctcccaacgtccctatttgatctctccgaagagacttcgttttcgccattcgttgccaattcgtcccgccgaattggtgctttttgtacataagtgtgagcagcaggtgctttcccgttgtacaacagaacaaggcaaaaaatattgcttttaatgtcaaaaatttaatgtaaatttaatgtttttttgtgttttattccaaattatttttttggcgcctaaaaatgctaatgatcggccattattatttagtaataataatactaatacaccgaaacaaattcaccataaaaaattttataaagccggcatcgaatcttttagcttgtttgaagaagcaatatttgctctgctcgagtcccacaactgaaaagtgcccgttgctaatcttatttaacaaattgtgccattttaatttttttaaatatttatttttagccaattattatttcgagtggactgtacgaaaatgatattgtcaaatcagcagaaaatgtaaaaaaaaacggagaaaaaaatatttgaacaaaacattttgccattttagcagggcatttcgtcgccgtgtccgtcctcggccgaagtgccgcgccatttggacacagtgaaagaggacgaagaggtggaaacggcaaatgacatcgcaacggaggaaaacggcacaaagggaaggggcgactga

SEQ ID NO: 51278 - DNA, 142 bp, Heterodera glycines
  Genomic contig location: Contig_ID=SeqID_3648; Location=4323..4464; Strand=-
  SCN-specific regions: Sequence locations=1-142
cagcgagtagggggcgaaggcgggcggggggcgggcgtgcgccgattgggtgtcgcgaccaagggccgcgtcgacaggggcggcccgggggagcccgggctgtgccggtcgcacaatgaggagagcaacggctcaggcccgc

SEQ ID NO: 51279 - DNA, 601 bp, Heterodera glycines
  Genomic contig location: Contig_ID=SeqID_3649; Location=575..1175; Strand=+
  SCN-specific regions: Sequence locations=1-143,172-601
atgaacctgtcaactgcaagtttcgtgccgctagcgccggcaccaacggcgggtgtacccccggggcgtctctacccgaccattgcgccaccggggaccgtcgcggtacaatcgacgccggacagtcactttcacagtgagtcaaatttaaaaaattaattcatttaatatgggtccaaaggcgataattaacacaaaaaggctggtaatggcatttcaaaaaagcctaaattgacgggtgaaagttcgagactcaaaaagtcattattattactaattgaggctaaacatgggttggacagctgaacaaaaaatttgtttaagcattgcgcgagtcgcttgagaatccgccacttccaccgattgatcagcaaccgtttgccaaccaatcgcaacaacaacagccacttccttttccgacaatcgctccgccgccgtactacgatcactttgctggaccagccaacggtgtcggtagcattggtgtacggtatttagtgcacggaccgtcacaaacgcacgaagttcactccgtgcacgcagtgccaagtggaaatgccggcgcagcaaggggaggtgggagacaggcgaagtcatgaga

SEQ ID NO: 51280 - DNA, 867 bp, Heterodera glycines
  Genomic contig location: Contig_ID=SeqID_3650; Location=911..1777; Strand=-
  SCN-specific regions: Sequence locations=1-489,511-867
atgatcactttcacttatgctcttttccagttaaatagcatcgaacttttcgttgcgagtcgcttcattctcggactttttgtcacaattggcattggcatcagttcagttttcctaatcgagtgcaggtcgaacaaacaattaccgtatttgctaatattttcctgaacatttttaagcccagtgcaatgtcgaggcggaattggaatgatcactggtctgatcaagaaggccttcactaatcgaattacatttttaattatccgttcattaggcataatgatccaattcggttgcatcgtcggcgctcttttggcaatgcccgaattgctcggtgatcaatcgcattggtggatgctttttctgctggaggcactcgtgctaattgcggtcaccgtcacaatgcttacgcttcatgaaagcccgaggccggaatgcttccaatttaaataattgcaaaattttaaatttttcagttttctactgttccacgaccagcacgacaaagccgccgacgccgccaaattttactggggacaaaataaaagtgccaatgccattttggatggatttcgcactgaacaaacaaaacgttcaaatgccatgggaatgctcgaagttttgagagagaagcaaagcatcggcacagcgaggggcctttggattggcattttcctaagcatttgcatggcattttgtggcatcagcggtgggcatttattggccaactttttaattgtttttattgccaaatttgtcttgcaattagtgatcgatgcttacatcgtggaagtgttacaacagacaatgggcttctccgctttgtcctcttccttcgtttacattggcattcaaattttcggcttg

SEQ ID NO: 51281 - DNA, 1346 bp, Heterodera glycines
  Genomic contig location: Contig_ID=SeqID_20721; Location=1124..2469; Strand=+
  SCN-specific regions: Sequence locations=1-575,599-971,999-1346
atgtgcaggagagaagaacaaagtgatggcaaaacgaaagtgagctctcatctgctttaaacattttatccaaaatgtctaagggctcgtaatttcttcagacaacttattatccatttccttatcgatagaaaaaatggactcggtcaatttaccatatttgggccatcttttcggtacttaagcagttttaataaccaagaaaattggcaacattttattttcattctgaaatttttttggggcaagtcgaggatgccaacaaaactctgtgacttcattattaaatttgtcctctgataatgggtttttcaataaagggagtcgacagattacaactcacaacctccttctaatttttattaggaggttttgtacatcgccggaggcaccaccggccacgtttataacatggacatttggcgcctcgagcggccacttgggcaaccgcgaatcccatggatttgcaccccaatgcacagagatgggcttgaaattggtcgttatcggctggagatggctgcacatggccaaaagctgtacactttcggtggcggagcacccgaattttgtgctgaatttgaagaagtactttttggtatttttctcctatcaatcttttctcacagattctcgctttcgacctcagcaccaatcgtttcggaaaggttcgagctcttcccgacccgaagtacggagttcccatcggccggaaatgccatgcgttggtgcaaaaggggaatttggcgtatttaattgggggatgtcgcgacgcagaaacacaacaaaatgtgaggggaaaaggtgatgaacgaggcgaaagggaagggtattcagcaaaatcgaagccatcagctgatagccgacgtttggaagttcgacatgaacaccgcccaatgggtccgaatgcgcaacaacttggcgaaggcggtgtttttccattcggctgcccttacctccgtcagtattgtcgggatttttatttaaaaattccaaatggccaactttgctgctatttgttaggatgactgtttgtttgtgtttggcggttgcaccgacgaactctccgaacgccgctgcaattccctgcagcaaatgtggctccaaccgccctctctcaagtatttggcctcgatttcgttattgggacttttaaacgaaacgcaaattcggcggataaacaaagagggcatccgactgagcaacgtggaggcaagtgccggtcggattggccaattacgtgcctaattgacatcccttcaggcttttattccgcgccttttcttgccgacttccgctgcttagggctcgcgcaacaaaatgaagttaggcgaaatttcagaaaa

SEQ ID NO: 51282 - DNA, 1018 bp, Heterodera glycines
  Genomic contig location: Contig_ID=SeqID_20721; Location=1..1018; Strand=+
  SCN-specific regions: Sequence locations=1-65,89-351,373-388,416 -672,694-757,781-1018
tcccgtcggcctgagttttgcgagtgttgtgagtgtatttgttgcgtttcgccttttcccctgggtcattcattcattgttcactcattcgataggtcccatccctcgcagtggccatcgcgtctttgctgactccgatttcatttacgtatttggcggatacaacccatttcactctcctgacagcacttagtctgtgcttttctattttaaaaacgatcttttagctaaagatcattttcataattttagcactgatttttggcgcttcaaccgtctcacccatttatggcaaaaatgcggcctttcctcctctgacccaacgactcagttgccgaattcgttggcttcttttgcatgtaatttcatttgtgcaattatcaatcattgaacaattttttaataaaagttcaaacgaagggacaaagtccgcatacatttttgaagaaaaattaatacgtttatttcccccttttagtggcttcatcttctaggcccagcgagtgttttatttttgggggtaccggcattcccttcggtctcgccgcttcaaatgaattgcatcgaattcgaattgatttgcttggaaatgtcaatgttcgggtatgaaaatggggtggtatattcccgatgccccccccccccttttttttgacagaaaaaatttttaagacgaaaaacatatttctaaatttagaattttttattttttttcggatcagtgattttatataggccaaataaatgatatatttgtgaaaagcgactcccaaaaccctcagaagcatgctttcacgacaaataaaacaaattgtctttcaaaaaaaaggggggggaacagcaaaatttgatatggaacagaacgaccattcgcaagactctgcttcagactgagccgaaacaaagctatgaacaaagacaaaacacagcgaacattcggcagagggggcgcagtggcggggaggcggcggacgacgcggcggaacagcggctgatgcccccgcggatgtgagcaaag

SEQ ID NO: 51283 - DNA, 828 bp, Heterodera glycines
  Genomic contig location: Contig_ID=SeqID_20722; Location=97..924; Strand=-
  SCN-specific regions: Sequence locations=1-828
atggcctatcgacggctaacgacaatgcttcaacggctgcagaagactcccgaggtgctcaagcagtacaccacagtgatcaccgatcagctcaatgcagcaataatcgaggaaacgacgatcggagctggtaaacacgaacacttcatccctcaccaagcagtgatcacgcccaaaaagttgcgggtcgtctacgatgcgagcgcacacacacgaggggcaccttccctcaacgactgcctactcagaggcccagtttggctgccggatttggccggcatgctcattcggttccgagcatgccgagtaccagtgatcgccgatgtcgagaaagcatttctcatggtcgggattgaagaggacgacagagatgtgtgcaaatttttgtgggtgcgcgacccatttcggccagtgacaacggacaatttggtgacataccgatttcgacgcctcgcatttgggctcacgccaagccccttttgtctcgccgcagttgtacgacaccacctgcgcaaatacgactccaacttcgcggaagaactcattcgggacacatacgtggataatgtgctcatcccggcggacactgcggaagaagcagccattaaaggacaagaagcaaaacgaatgtttgcggacgcgcggatgaaccttcgggaattcttgagcaatgacgagacactcaacagcagcttttcggacgcggaattcctcggcaagacgacggccaaagtcttgggactcgaatggaatgcggagacggacaaaatacgaatgaagtaccccgggagcgaacccggcactccgatcggcaccacacgcagaacg

SEQ ID NO: 51284 - DNA, 600 bp, Heterodera glycines
  Genomic contig location: Contig_ID=SeqID_20722; Location=1640..2239; Strand=-
  SCN-specific regions: Sequence locations=1-600
atggtacgggacagccaacaaacccgtgcgcagcccaacggaacacgaaaagaagagcagtacgggacgaatgcccgtttcaccgagcgaacagtggcacgcggcaacgagaacggacacaagggtgggaatggaccccgcttcgcgcaaaatgggctccctccaagcttcgggagggggaattgttcgttttgtctggagagcggacatcggccgagtgaatgccgcgcctatccgacgccgcaggcacggaggaagcgactaattgagcaaaagcgatgcctgcgttgcctgggctctgatcacacattcgaacagtgccaacgaacggtccgatgtgacgcatgtcgaaaggacgatcatcattggcttatgtgctggaagaaccaaccgggaaaccaatcccggccctccggtgaacccgaacggaaggagaacaaccacgcgatgctgatcagtgggatggaccaacccactcacgtcactacatcacgagacgagccgaacagtcgagacatatccgagatgaatgccggggagcaacgggctttcaccgcttttggaagccgagtcccggcccagcaaatgatcgaagagtga

SEQ ID NO: 51285 - DNA, 1023 bp, Heterodera glycines
  misc_feature (969)..(969): n is a, c, g, or t
  misc_feature (974)..(974): n is a, c, g, or t
  Genomic contig location: Contig_ID=SeqID_20723; Location=1553..2575; Strand=+
  SCN-specific regions: Sequence locations=1-180,202-911,934-1023
atggatgatttttacattgtactaccttcgaacacaccggggcaggagaacactacgtcaaaattcacagtacgcctccccgagactttggaattgggcacaaattggtcagtagctctctcatcaattatttacccctactcattcaccgctctcggtataaatggtcaagagtttataaaagtatgggaaaatgacaacaatgtccccattcaagtttatttaccggacatgaattttaaaaccgccgggggattgggaaataaaattaacgaagcattcacacatcattacaaaatcaaaaaacaacgtgggaagagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagctaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggctttgggtgagcatattaaacgtaaagatattgaaaatagacaagtatctgaagctgagaaaggaccacaaaaaagagagagactagccaatgaggatgttcaatttcaatatgacagcattgatcaaaaatttattgtctatctttcccctgctgtctcccacatagatttgtcaaaacacctccgctatgtgcttgcntttangaacacaaggctatttcacgcggaagaagcgaatatatgccagatttga

SEQ ID NO: 51286 - DNA, 939 bp, Heterodera glycines
  Genomic contig location: Contig_ID=SeqID_20724; Location=242..1180; Strand=-
  SCN-specific regions: Sequence locations=1-263,291-379,401-602,626-939
atgccatacgccattttcgacaccccgggccaaattgaggtgttcacgtggtccgccagcggcactgtcatcaccgattcattggccgcctcttttccgaccgttcgtttttttgagtttttcaacacaaatgcaaaaggctttttgcaggttgtcgcttatgtgatggataggtaattggaggcgttgtgccgcccattcattacttttttaatatacaaaattgttataattcgagtgcccgttcgaccaacccgacgactttcatgtccaacatgctctacgcctgctccattctttaccggaccaaattgccatttttcgtcgttttgaacaagtccgacgtggtggaccctgcttttgccgtcgaatggatgagagattttgagcagtttcaagtgaccaacaatttttggaaaattatgctctttttgcctttgttttcagactgcgcttgaccaaagttcgtccagtttcatgaacgacttgacccgctctttgtcccttgtgctcgattcgttctacgaaaatttaaattgggtgtccgtatcggcaaagacgggtcagggctttgataaggtgaatttaattttgttactaaattttcagggttttcattttcccactggatgatgcttttccctaaaatttttactctagaaggaaaatgttaatttttaggttttggagttaattgaaaagtgtcggttggaatattgggaagtgtataagccaatgtgtgaacgagtggcacaagagagagctgctgagacagcgaacgacggcacaaccgacgcaatgccaacggaaaagttggcgaatttggaaataagagaaaatgatgtgccaagtgatgagaagggacaaacggaggaggcgcaaattacagaaacaaatggcgaagaacattcaacggaagaaagtgaagcgcaaaagtga

SEQ ID NO: 51287 - DNA, 99 bp, Heterodera glycines
  Genomic contig location: Contig_ID=SeqID_20725; Location=102..200; Strand=-
  SCN-specific regions: Sequence locations=1-99
atggctgatgacaaaagctgtgacggtgcttcttctgcgttgcctccgtgtttaattgtgcttggaatggccggttctggaaaaagctcatttgtccaa

SEQ ID NO: 51288 - DNA, 586 bp, Heterodera glycines
  Genomic contig location: Contig_ID=SeqID_20725; Location=430..1015; Strand=-
  SCN-specific regions: Sequence locations=1-82,109-133,159-353,377-586
gacgttcaagtgtcttcattcgatagccgaacacttcgcgttgtcgtggaagtgagtgattcagtgaaagttccaccatttgttttttgataaatgtaattttaatagggtttaattagttttcattgtatttgccattttctttgtttctttttctcagttcccttcccttcatttttaggacgttaaaatgcgttcccaaccatcagccaaaccgtcctttgatgcaaaactcatcttcgatgaccacattcgattgatggccgccaaacagcggctaagccgtgggaagaaaagttcgcgtgccttcaaactcagtctgatcgctgaactgttcggcatacgcttgccgccacaacagcaacaacaaaatgatggcattgccttccgacattccctcccatgtcagtcgaactcggcgagcagttcatcgacggaggagaaaaggccccgcggcattgcacccggctcagtgcagaaactacaaatgcaaaccaaagaaaacgaccagcgatcggattcgtcggctgctccgcctgacccggagacggcacgacttttgcccggccaaatacatcacttgtag

SEQ ID NO: 51289 - DNA, 220 bp, Heterodera glycines
  Genomic contig location: Contig_ID=SeqID_20727; Location=214..433; Strand=-
  SCN-specific regions: Sequence locations=1-141,163-220
agagaataacagctcaatcgaccaagcggcgcacatgaatgaacacagaaaccggccctccccgcccaaacatggtccgatggggacaaaaagtgcacgtgaatggagacaacatcaaccaatgcatgtgaatgttctaccgcaaatgaaggaagtcacagcgaagaaagaagagaaggaagagaaaaagacagcccatttgatcagcccatttctctaa

SEQ ID NO: 51290 - DNA, 771 bp, Heterodera glycines
  Genomic contig location: Contig_ID=SeqID_20729; Location=183..953; Strand=+
  SCN-specific regions: Sequence locations=1-66,90-437,459-576,598 -676,698-771
  Gene Ontology: Mol. function=Rap GTPase activator activity; Cellular component=nucleus; Biological process=signal transduction
aggttccatgtgtccacccttttgccgtttaccattggcgacgcgcaacaattgcagcgcaaacggcacattggcaacgacatcgtggccattgttttccaagagcagaacacacccttctgtccggacatgatcgcgagcaagtacaaaaaagggcaacattcagtgcctaatttaattattttctttttttccaaagctttctccacgcctatttggtggttcatcccattgagccgggcactgaccgcacgcgttaccgcgtgtcgatgacagcgcgagacgacgtgccgttctttggcccgacgcttccgcgctcttccataatttggaagtgccaactgcgcgactttttgctcaccaaactgatcaatgcggaaaacgcggcttataaggcggaaaaatttgccaaattggcggtattatggcaattttcattttctgaattaatcaagtttgttcaggaacgcactcgggcatcgctgctggatggactgtactcaaatttgaaagagcgggcccaattttacggcatggcatttttggattcggtggacagcgcgacgaaacagcagcaacaggagaagcaccaccaccaatggcaaaacaacgggcaaaaccatcaccagcacagccaacagcagcaactgatgaacggaggaacgaacccaacgttttgttttccattgacactgcgctcgttctgatgctcctcttattcaatgatcaaaagagcaaaacacatttttgactgattatataatatatctg

SEQ ID NO: 51291 - DNA, 246 bp, Heterodera glycines
  Genomic contig location: Contig_ID=SeqID_20730; Location=901..1146; Strand=-
  SCN-specific regions: Sequence locations=1-86,115-246
tgccacgcaatgccgccgcccgactccacggtggtgctggtcaccggagcggactgctgctcctcaaccatcacaagcactcgacaaggagcatcagcagcagcagcttcttccacgacgaacacaacgatggcttgcgacgtcaccgccgcttcatcgctcaatttgttgctaattgccgctaatgatggtcagccgccgtccggccggaagccgtcatcatcgtcctcgtcgacatcgacatga

SEQ ID NO: 51292 - DNA, 767 bp, Heterodera glycines
  Genomic contig location: Contig_ID=SeqID_20732; Location=299..1065; Strand=-
  SCN-specific regions: Sequence locations=1-265,294-317,339-492,531 -591,613-651,683-708,738-767
atgctgcctttattaattgttgaattttatgttctccttgtaatttccttcgttatgccaatggaaggagattcttgtgatgttggtaatttaatgactttcatatcttaggaagtgtttattagagaccgaaattgaaaatatcaggccgaaccgcccggtcaaaaaagccagtttaaacgggcgtcccaggccctgtcaaatttaggctgggcgttttttgtaattttttggaattttgaattaataaaaaaaatcggtagtcttttattttaaattttgtaatttttaatggcgcttttttaacagatctttctcaaaattgagaaagttttgaggttttaatttttacgctcggttattaagttgtctgtgatgaaaattttgcatttctttttctctcgttttggcgtactattttcatgtttctaacacattaaaaaacatgaaattagtaaatgctagtaattttggttgtaagggtataaaaccaatttatacatttatatcaataaaaaatattaattttagcattttggtagggattagcggcctagggcttgagttataattagggctcgaaattatatggactaaaaaacgtcaaatatggacataaaatatggactaaaaatgcccgaaatatggactaaaaagctaaaaatggtcaaatatggaccaaaatattggctaaaaactgccaaaatatttgttttaaaccctccaaaattccaaaaggtgtgtatattcatatttgcttaaataaa

SEQ ID NO: 51293 - DNA, 683 bp, Heterodera glycines
  Genomic contig location: Contig_ID=SeqID_20732; Location=1450..2132; Strand=+
  SCN-specific regions: Sequence locations=1-223,282-600,666-683
atggccataaaatatggaccaaaaatcgcgaaatatggacataaatttttccaaattgagggtacaatttctcaaaatttcttcaaattcgctaaacgcaaagtaaaactttcaaaaatgttaaatatgggattaaaaatcatttaaaaaaaacacgatacagcttaaaatttattcattttagcgaaaaatcaacctgaaaagcgaaattttcgcttttttgtttatttttaatataaattaaccaatttttaagaaaatttaaatttaatcaatattttcggcaaaattttgctgaaaaagtctttttcggaaattttttcggtctttagggacaaaaatgccaatttacctgatgggggccgttctaataggggttttttgggaaaatgccaaaataaaaacatgtttttcgtgcgtttcaggcttcccacagtccaggaaaaaaatatggatttccatataattcccagccctactgatcagcgtcacaaatgtcctagaaatgactttatttaaaatttcaagggggtctcaaaactgaaaagtaccaaaggctgttcagttataataaactgcgaaaattttaaaaagaagtccaaaatattatcatagaatataaatttatttcttttgaatatttttttaattaaatttaaaattttcagtgatttgactgtcaa

SEQ ID NO: 51294 - DNA, 1833 bp, Heterodera glycines
  misc_feature (1809)..(1809): n is a, c, g, or t
  Genomic contig location: Contig_ID=SeqID_20733; Location=719..2551; Strand=+
  SCN-specific regions: Sequence locations=1-353,375-585,608-1234,1256 -1596,1618-1833
atgtccaagcgcttcactgatttttctattgactcaattctcggcaaaaagcctcgacagggcttcctcatcaatcaaattttgggcatagcccacgtgcttggatccgttcaacacggtcagggttcgtcgaataaacctgtcaacgagtacgtgaagaagcttgaaggaagcttggaacacaacgaaaagtttcactacaccaaaatgaagagccgattcagcatcgaggatgtacctgcaaacccggaagccttactatcagcaatcttccaatactgtatcgaagaatcgattgcagacagtcgcaagcgaggaatcgagcccactcacctcggttgtctcatcagcagcccactgctctctggtggtgacattccgattcccatccggcaaatcaacgaaaacactgtcaacaccatcctgaaccgcttcacccaagtggcccagagtaaaaaacagcagaacatcaccttgtggggcgagccgtttactgtggttgtgactacagtaaaccgtttgggactccccaccaaaagacaagtgaagggaggagcccgtcgtcaattggctcgggtgcgtcatcaaatacatgaacaatgtttaatcaaggttttcccgcgattaaaaacatttggcccactatcaatgtgctagtttaagatcctgaacccggatagacacaacttttgtttgttttacgccctgcaggcaacaatggttgcgaagacaaaacaatggcctcgatggaaatttcaccgatatttgaataaccagcacgggcaacagggacaacttcagcatgatgcggtgcaactcatgaaccaaattggtgcgcctttgaatttgaacgcgtacgacgctgacacatacgtgccgcgagttatcaaccattggaataacaaccatcaacataaccgatttgctgtcttcatatttgggacaactgggcactacaaacccatctacaaatacgtgaacaacagctacaacactcctcttctcctatatttcaacgacaatcactttgatggggtgcagaagcagagtggcctgttcggaaagccttactgtttggagtgcgaacagccatatggaagagcatcaaaacacagcaaatcatgtaaagcacgttgcattctttgcgctcgctgtggtccggcattcccttgtgaagcgactggtggcttcttcagaaattgcaccttatgcaataagaattttaacaacaatgattgcttccaacaccatctccaatccggtttttgcaaacggtcaaagaagtgcagggattgtggtgttgtttgggacgttacagacaacaacaggaacggaagaaaaggtcatgtgtgtggtgaacgctactgcaagctgtgtaaaaacttccacaaccctgaacgtggctgcttcatcaaaccgctcgagcctagagaattggacccatatcgaattgttgcttttgacttggagacaatgcaacatcagcctataagtcgtcgtgagccagagaagagacagcatcagcctaacttcatctcagccaaagtgatttgtcccggatgtattgacaacggtagatggcggaatggaaccgcaggatgcaaagtgtgtggccctcaccgcacagtcgccttttgccaacgtcgatttgtaaacacagctgtcgacaaacaagttgtcactgacaacccgttagagacgtttgtcggttggatcatcaatgatcttccgaagaaatacgattcctacgcattctcacactttggaggccgtttcgacatggtccttgtttttctgaaatgtgttcanagatgggtttcaaccctgaaatga

SEQ ID NO: 51295 - DNA, 118 bp, Heterodera glycines
  Genomic contig location: Contig_ID=SeqID_20734; Location=177..294; Strand=-
  SCN-specific regions: Sequence locations=1-118
gcattcttccgcttatccctttcatcagctcatccgccgcttcatttggcgtcacctccaaacaatcgccgctgctcaatttgggaggggcagtgaataacgccaaagaattgccggt

SEQ ID NO: 51296 - DNA, 961 bp, Heterodera glycines
  Genomic contig location: Contig_ID=SeqID_3651; Location=396..1356; Strand=+
  SCN-specific regions: Sequence locations=1-302,324-508,532-547,570 -770,845-961
atgggtaatggcaaaggcaatttccgaccaacgtgcggaaaggtggccgagacattcatagaaattgcaattcaccaacattctacaccagaaacagtggtcacagaccagggaaggcaatttatttcacaaattttcggaaatttgacaaaaatttatggatttgaacatattatgtccactgcttatcatcagcagtcaaatggaatggccgaaggttctatgagaatattggcaaatataatttccacgacaataaatgcacaaggggacaattgggatgaaatattaagtcatgcaatttttacttataataaatacatcagtgcatacggcaacaaaatattcaccctattttatcatttatttgcgtgaaccccgactacccaccgatcaaattttgaaattgccctcaagtaatgaatttttgtcggacatttccgtttgtacacgaaaatacactgagaaggcatcaattgcatggaaaattgtaagggaagaaattttgaaagcccaggagaaaaacaaagctgaaaatgaccaaataaggaaagcaaatttcagaaatttgaaatggcccacttaccactgataaaaaaggaagtacttaaacataatttgaccaacaaatgtacagagtacatataatcaatttagtgcacattcaaagaatacccgaaatttgggtttcccataaagaaaatgtggaacgaagaatgagtgacaatgaaaatagcagaacagcagctggactttgataattatgttgcatttaattaaatttttctattttctaataacaaaaaattaataatcaaaatataaagcaaaattaaatttaattgggggcgatccctttaatgccaacacttatccccttccccactcttccccacgatcagtctctgtcccgactgcgaatcgggaataggcggaccatccaattatataatactcttga

SEQ ID NO: 51297 - DNA, 1194 bp, Heterodera glycines
  Genomic contig location: Contig_ID=SeqID_3653; Location=313..1506; Strand=-
  SCN-specific regions: Sequence locations=1-78,100-157,181-237,274 -409,454-484,539-629,651-755,806-864,887-902,924-1044,1101-1194
atgcgcttttggtatttgcttaacatttctgatcaccacacgcaattcctcagctgttttcgcgtgtccaatcgaaccctttgctttttgttcggtttggcccaatttctcgtcgttttggcttcattgtttcaagtttgaaattgttttcaatgctttgtttcagttcaaacatttctcattttagcacgtttattcatggacaaaatttgggcatgtgtaagcggcggaaaaagcaaaaaaaatattacaaattataaataattattttaagtttcaaatgcaagtcgaatatttcggcggatgccaccactgaacagcgccttttggcttacgatttggtcatttttgacttcggcctgatgcatcgcattttgaaaatgtccaaatgcgtcgcgaattatttggcaaattaaaaattattttaatttttatacattttttcaattttaaggatggcggctatctccgcttttcatggtgcattttaaatttacatatattttcaaaattattttctttaaatatttctttttttgaggtgtgttgagcattctcttgctctcctcgtccttctcattgttcttattttatcgctaaaacgaatttggctttattggccaggtaatttgtcaaatttattttttgtataattcaatattaattagaaataacattcagctctgtttatgcaatcaacttatgtgcttggaatggccattttgacaatggccacaactccaaaaatggttttcaaataattaattatagaaaataaaaatgaaagctttatttattttattaagtttagcttgaagcactgagtcgatctgttgataacgcgttgggaatcgccttttgcatttacattggaggagttttgctaaactggatgtttacagttaaaaataaaaaattatttagagcctgaatttagaaacaagaccgaaattcggaaacagaacggaccgggataatgtttccgggatacaatatttgagtgggattctggtccgatataagccgcagaacatgtcctgggtctattaaatttgaaaaaatagtaaataataatgtaaaattatttatcaaaatatattgatgcccataaagttggttctttggcaccattattgggcggaggaggcgaatttggcacaaaacattcgtgaaaatgaaagtgccgacggcgaa

SEQ ID NO: 51298 - DNA, 260 bp, Heterodera glycines
  Genomic contig location: Contig_ID=SeqID_3653; Location=1871..2130; Strand=+
  SCN-specific regions: Sequence locations=1-41,97-260
atgtttgaagctaaaaaaggagaacttctcagtaagaaatgtttataaaatttcacatttaaatttagtaaaaattattaaaaagtaatattttttgtggcaaaaatctattcacaaatcctattctaaaatccaaacaattgatatttgtgggtaaaatccgttaataaattgcaataaaaatccataaatttccagacggttggacacactttccatttgaatttgtttattatgtcaaaactcaaaaagtaatttaa

SEQ ID NO: 51299 - DNA, 262 bp, Heterodera glycines
  Genomic contig location: Contig_ID=SeqID_3654; Location=550..811; Strand=+
  SCN-specific regions: Sequence locations=1-41,97-262
atgtttgaagctaaaaaaggagaacttctcagtaagaaatgtttataaaatttcacatttaaatttagtaaaaattattaaaaagtaatattttttgtggcaaaaatctattcacaaatcctattctaaaatccaaacaattgatatatttgtgggtaaaatccgttaataaattgcaataaaaatccataaatttccagacggttggacacactttccatttgaatttgtttattatgtcaaaactcaaaaagtaatttaa

SEQ ID NO: 51300 - DNA, 1363 bp, Heterodera glycines
  Genomic contig location: Contig_ID=SeqID_3655; Location=821..2183; Strand=-
  SCN-specific regions: Sequence locations=1-140,228-277,307-576,607 -993,1015-1363
atgcccgagcatttgatccctttcgaccccggccatatcattccgtgcccgtttttcacacgtactgtgaggaatatcgtagaacaaaccaaaccggacgttgtatttatggtctttcggtagtacatttaaatagaaagaaaataatataaataattattaatttacatattttaaattaaaaaattgttcgcttattaaaataattaattaattaacaattttttgtttgctgtgaatttataacgattttttaaaccatcaaaactacgtaaagattaaaattaacatttatattaaattttaggtggtataatgaagttctgaatgtcccatttaatgaaaatgggactacaaaaaatgacgaaattttgaaagcatttcgccatgaattgcggcattttcaaaaattcgtcagcaaccgaatattcgtctcggccccaacactgcaattcaaacatgacgtggccaaagagttggccaaacggttgtggcaacacgctccgcttggcgacctgcaactatcgcttcgggtaaagcttgttaatcgttgcctccgttttctaaattttactgatttaaaaaatattttttatttttttaattgccattaatctctttggcacttcctttttcattgttttgccctcgtcggggaatcctcgccttcccgtgccaatttacaaaacactgccaattttcttaggagcattacgtcacaaatcgcttttcctatgcccgtctccgtctgttgaactgtccaaaatgtgtccaatttgacctcgccgaacatttctgtgacgcgcgcacggacaaatgtgcggcatttgatgagcaaattcagttggccaactttttcgacaacaaccatctcagctatttgggccggcaatcagtgcgcccctttctgagggcaattggcaaccaaatttggcacgataaacgaatgaatgtttaagggactgactgattgggatttgaatttagcatgaaaagttttgacattgttatttattggcattatgaataaaagaaacggaaaataaaaacgttttgaaaaagccgccgcaatgcagaaaatgaaaatacacccataaaagttagtgccgaatcggaaatcaaaatttttcacgaatgaacccaaaaaatccagtcgcattttccaggtcggattcgaaatcgaaaattccaataaagtgcgatcattttttagccaaggttctcgagcagcatagaactgtgtctcgaaaggaacagtcgaaagctaacaaaaaagcagattttaggaatgaaattttctgcacctaaaatagaaacggaaactgtgaaaaaaggcataagaaaggcatgaaaatggaataaa

SEQ ID NO: 51301 - DNA, 729 bp, Heterodera glycines
  Genomic contig location: Contig_ID=SeqID_3655; Location=2317..3045; Strand=-
  SCN-specific regions: Sequence locations=1-169,210-549,582-729
gaccgttataaaatcctacccggagaagaacggacggagcgatggacaaaacaattaaagcaattattagtacaagaagggaacaaaacacctcaaaatctgttaaaatttgttattgaccgtaaagttaaggtaattcaaaaagagtaattaatgcctgtacagattgttttttttaaaaattattaaataaattattaataattattggtttctgaatattaaataggttttagaataaaccggggaatacagacacaggcttttccaataagtcgaactctagtttaagtagtaaaaatatttataaatcgaaaaccttactgaaattgttttgaaatttcaggggaccgggaatggcactgtccttcttgtcggcaacagtcatgccgatgtggtggcgcgtgaattgggagaggaaatgaatgcttattaccacgattttcaagtatttacaatgccgggtaagcgaggcaaaaaggacaaaaccggggacaaaaatccgcaacaattgtcctaaaaccagaaaattgtttttttagcaaaaaggaatatttttattttaaaaatcaaaaatcttttaggcataatttgatttgatatatcaaatgtgagcaaatcctaaaaaattacaaaattggatattattttgttacaagacacctaacaaatgtataatgttttttgcgatgagaattttttacattgaaattacatattagaattaaa

SEQ ID NO: 51302 - DNA, 600 bp, Heterodera glycines
  Genomic contig location: Contig_ID=SeqID_3656; Location=166..765; Strand=-
  SCN-specific regions: Sequence locations=1-132,155-184,208-600
atgctcgactcggacttccaaaaggcacgctttgacatgtactgggcattggcattcgtcgcaaatatccaaccggtgtttgaaaacaacgactatttcgcagaggtaattttgaaatagatttttttactcaaaaatagcaaaattttattcataaattggtctttaggtcagaattaaatgttttggccattttaaataaattttgaactattgccaaaaattcaaattgtttacgctttttgacactcaatttagagacatgatctatagcaaaaaccaatgcaaaattggtgtcaaaaagaattaggagtagaagccataatcgaaatatgctactacagtattgcttacagtacccaatttcgttcgtccccaaaaggtgttctcctaccgtcccttcctccactgttggtcccttggcgtggaaatgcaattttacctgctcgccccgttggccatgcttttgctgctgtcacttcggcggcttacaccgcccgtttgctgcgccatttcttctgctccaccgtacttcttgcatcggttattggtacacaactgctcactactgtaatgcctgccctctcttttggccttatg

SEQ ID NO: 51303 - DNA, 621 bp, Heterodera glycines
  misc_feature (445)..(445): n is a, c, g, or t
  misc_feature (448)..(448): n is a, c, g, or t
  misc_feature (451)..(451): n is a, c, g, or t
  misc_feature (462)..(462): n is a, c, g, or t
  misc_feature (465)..(465): n is a, c, g, or t
  misc_feature (471)..(471): n is a, c, g, or t
  misc_feature (474)..(474): n is a, c, g, or t
  misc_feature (480)..(481): n is a, c, g, or t
  misc_feature (497)..(499): n is a, c, g, or t
  misc_feature (501)..(501): n is a, c, g, or t
  misc_feature (505)..(505): n is a, c, g, or t
  misc_feature (511)..(511): n is a, c, g, or t
  misc_feature (514)..(514): n is a, c, g, or t
  misc_feature (516)..(516): n is a, c, g, or t
  misc_feature (521)..(521): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (534)..(535): n is a, c, g, or t
  misc_feature (540)..(540): n is a, c, g, or t
  misc_feature (542)..(542): n is a, c, g, or t
  misc_feature (553)..(553): n is a, c, g, or t
  misc_feature (563)..(563): n is a, c, g, or t
  misc_feature (566)..(566): n is a, c, g, or t
  misc_feature (569)..(569): n is a, c, g, or t
  misc_feature (571)..(572): n is a, c, g, or t
  misc_feature (574)..(575): n is a, c, g, or t
  misc_feature (577)..(578): n is a, c, g, or t
  misc_feature (580)..(581): n is a, c, g, or t
  misc_feature (583)..(584): n is a, c, g, or t
  misc_feature (586)..(588): n is a, c, g, or t
  misc_feature (590)..(590): n is a, c, g, or t
  misc_feature (592)..(592): n is a, c, g, or t
  misc_feature (595)..(596): n is a, c, g, or t
  misc_feature (600)..(600): n is a, c, g, or t
  misc_feature (602)..(603): n is a, c, g, or t
  misc_feature (606)..(607): n is a, c, g, or t
  misc_feature (609)..(609): n is a, c, g, or t
  misc_feature (614)..(614): n is a, c, g, or t
  misc_feature (618)..(618): n is a, c, g, or t
  misc_feature (620)..(620): n is a, c, g, or t
  Genomic contig location: Contig_ID=SeqID_20736; Location=376..996; Strand=-
  SCN-specific regions: Sequence locations=1-19,41-102,125-621
atggcgatttctgtacaaatgcatttggaaatgatcaaatgttgctctgttgttcaaacaaaagtgaaggcccggcatcagcagaagaaggtgtaacaccttaaagaaagaacaaaaattatataatgaactcaaaagtcataaactaaatattaaattcaaaaattgaacaaatattctagtagttccccccataaattttttttattgcaattgaaactttttcagccgctactgttagactttctgtctgccccggatttctccgtgcctacccaggcaatgctcttcgcccttcagcagtgtgccgtaatgctttggtggcgttggcaaaggtgttttgatgatcactgtgtgctcagtgggcggcggtgccgcggactgctgaagttgtcgcaagcgaatgtttgtcgccgatggttcgcagcagtcgtcgttgttgttnccnttntactcccactnttncttctnctnattttnnccaattacacaattcnnntncaanaaaaanccntnctccntttnctnctnctnnctttnancataattttcnccacttatcnaanaanannannannannannannnananacnnactnannaannancacanactnana

SEQ ID NO: 51304 - DNA, 478 bp, Heterodera glycines
  Genomic contig location: Contig_ID=SeqID_20736; Location=1795..2272; Strand=+
  SCN-specific regions: Sequence locations=1-7,29-478
atgcgatttttattcaatttacattttactgccccatttgttgtttctttagcaaaacgctcttcgaataaccctaatctctgtccaacaagcaattcgatgtctgacatctacggcttcatcaacaatatctcagatcgtatatcacgacgcgtacgtcgcaagcgcccaacggagtctggggtttctggtgaggaccgagtcactttttcgaaagttcattttctttcggttttcaggtgtcagcggcgcaccgccggagactcggaaggacgacaaggcgaagggcggcggctgctccaaaaagtgcgcttgcatcatcgtgtgcagcattctcacgctcattgtgctcgtcatcggtggactcgtcctggccgctgtcctgacgcctgaaacattcaaaaatgctcctctgttgagcctcatcgcgggcaaaaagaatgggggcgtggatggtgaggagaaagaaaccgaatga

SEQ ID NO: 51305 - DNA, 869 bp, Heterodera glycines
  Genomic contig location: Contig_ID=SeqID_20737; Location=473..1341; Strand=-
  SCN-specific regions: Sequence locations=1-321,343-354,376-425,448 -475,505-505,588-591,625-634,665-710,851-869
atgcatatttacgtatgcgttctttatttcgggttattaaatcaaagtcttctaggatttggattattttgtacaaaacttatgttagaccgttattggaatatgctcctgaggtttggaatccatctcttctaaaaaacattaaaaaaattgaaaaaatgtcaaaaatatttcaccaaaagagttcttttcaaatgcagccttccacccattccataccaacaaagattagaataccttcaattgccgacacttgaaagcaggcgaaagctgtctgatctgttcatggctcataaaataatttatggccgaacagatctgaatccctttgaaatacttaaaccttctaaacgctttaacattcccttttatagacttaactcgaaatataaattaggcaaaaaatttatacttttgcggggcgggtaacaaaaatttggaaccaactcgataaaaagcttattgaaataaactcattaaatcaatttaaaaataaaattaaaactatttcattttccttaaatttattttattcatacttaattggtcttgtttttgcttttattcattttttattatttgatttttaactttaaatatataaaataaaaattatataaaaaagggaagaaagaaaataaatttctaatttattaatataattggaataagaaatgaattaatatttgctaaataaatcttctggtcccaatttattttattaatttttaatacataccagttaaaaaaaagaaaaaaaaatgaattttgttctttaaaattttacaaaatttaattaattttcagaaaaaaatataaagaacacaaataaattaaattatttaaaaaacaaaaaagccataaataaa

SEQ ID NO: 51306 - DNA, 1012 bp, Heterodera glycines
  Genomic contig location: Contig_ID=SeqID_20739; Location=594..1605; Strand=-
  SCN-specific regions: Sequence locations=1-209,232-263,285-312,334 -515,543-548,572-791,813-869,903-915,937-1012
  Gene Ontology: Mol. function=electron transporter activity; Cellular component=cytosol; Biological process=phospholipid metabolism
atgtccactaccactgacgttcagcacaagagcatctacgactttaaggccaacgacatcgacggtcacgagatcagttttgacaaataccggggcaaagttctgctggtggtcaatgtggcgtccaattgcggcaccaccgagttcaactacagccaactgaagcagctgtacgacaagtataagggcaaaggcttcgcggttgccgccttcccgtgcaatcagttcggaggacaggtgggccgagttggcaccgtccgacgctttctttctttcctaattctgaaaaattttgcattttatgcttatttaaaaacgaaatactttcaaaagattccattaatacagaataaaactcatttgtcaggaaccgggcaatgccaacgaaatcaaagactttgtgcacaaaaagtacaactttgagccggaccttttcgagaaaatcgacgtcaatggatccaacgagcatccgttgtacggctttctgaagaaagagcagcacggcacactcatcgacgccatcaaatggaacttcaccaaggcaaggggaaggcacaccacaacaaaaagagtggtgtagcgcaaaatattaacgatgttaaccgtctctttggtcattgatagttgatttttgcctaattaccccattagctaggctaatagagggcggagggaggccctctcgactttcttttaccgtttgttctctcattttcacgcaaacattggccgttctgatctttctttctttggggataatgccgattggtcttaaaacttctttgatgaactgttttggttttcagtttttggtcgaccgaaatggcaatgttgtgcagcgttactcgcccaacacagagccaagggacatcgaagcggacattgagaagttggtggctgccgcagcctaatcgcaaaaaccatttgaaagaaaacgaaatacgatgatcgacgagaccaaaaattaaatgatgttcatttaagcaaatttctaaatttactttggaataaa

SEQ ID NO: 51307 - DNA, 165 bp, Heterodera glycines
  Genomic contig location: Contig_ID=SeqID_20739; Location=126..290; Strand=-
  SCN-specific regions: Sequence locations=1-45,82-165
caaaaattttcaatttattattgctgagcaagtggatatttaagcggggtttccttttgcaattaattaattgtaattaattgatcgtctccccaatggcttcttcactcaccattgaaaaacgctgcaaacttttcaacacaaaacaaatggaatgccaattcg

SEQ ID NO: 51308 - DNA, 414 bp, Heterodera glycines
  Genomic contig location: Contig_ID=SeqID_20741; Location=796..1209; Strand=+
  SCN-specific regions: Sequence locations=1-414
atgcccgaagggccagtcagcgaaccgcaaatggtgcgacacatgcccgaagggccagtcagcgaaccgcaaatggtgcgacacatgcccgaagggccagtcagcgaacagcaaatggtgcgacacatgcccagaagggccagtcagcgaaccgcaaatggtgcgacatatgcccagaagggccagtcagcgaaccgcgaatggtgcgacacatgcccagaagggccagtcagcgaaccgctttggcgcgacacatgctcagaagggccagtcagcgaaccgcaaatggtgcgacacatgcccgaagggccagtcagcgaaccgcaaatggtgcgacacatgcccgaagggccagtcagcgaaccgcaaatggtgcgacacattcccgaagggccagtcagcgaacagcaaatg

SEQ ID NO: 51309 - DNA, 845 bp, Heterodera glycines
  Genomic contig location: Contig_ID=SeqID_20742; Location=808..1652; Strand=-
  SCN-specific regions: Sequence locations=1-40,69-95,136-208,332 -400,423-500,522-608,668-754,787-845
atgggcaaattatcttataccgtaggtttaataaaatatgcttgaattttttcttttaattattgtaatgattttttttacttttgcatgtatggatttttttagtatttatttatatattttatcaatttttaacagatatacaacaccagctcctcagcgctccagcgagtccgcccgtgaaatggtggcacaacgggcatcatgctttttattttgaaaaaattttttaacttttcatttttcaatcagtaaaattcaatttttttctttaattttagattgttttaaaattattagatttataatattattatttaataaatttttacttcttctcagtcggaaattgctttgtttcgttgtccgttagcaattagaggctatgcggtatttaacattatcaaagttagttgaaaaatttggaatttggataagacatgaagatgcatttagattacttttttattaattactcgttgatatatgaggtttttaatttttacaaatttgcaatctttccttttgaattgatatttaataattaagaaataaattttctttttgcattttacactttatattttttttcgaatttccttttacgctataaattataattttaatatttttgaaagttttttaatgtttattattattttttaaagtttttgaaaatgcaaatattttgtaaaccaataatttttaacttttcaaaaaatttaacaaccagcaaaaataaaacctttttctctgtcttaaaatttgttttaaaatggtttttaacaatttaaattatttctagaacagtgattaaattatgagaatttaatattttaaataaa

SEQ ID NO: 51310 - DNA, 117 bp, Heterodera glycines
  Genomic contig location: Contig_ID=SeqID_20743; Location=325..441; Strand=-
  SCN-specific regions: Sequence locations=1-117
atgcgccttatgggctgcgtgttgggccaaggcggacacaacgggcaggacgatgaggagcgcgagcaggagcgggtcaaccgcgagatcaacaaggagctgaagaaggacaaaaag

SEQ ID NO: 51311 - DNA, 740 bp, Heterodera glycines
  Genomic contig location: Contig_ID=SeqID_20744; Location=139..878; Strand=+
  SCN-specific regions: Sequence locations=1-187,216-240,262-267,289 -338,360-467,526-587,613-711,739-740
atgatctgtcgaaaggcccaattaacgccaattcctacggtatcgccaacaccgtaagaatatttgtcatttctttcttttggaaaacgaaaacttccatttgcaaaaatggccttgtttgtacagccgttgcttggttttctaaacgtaatcttcttcgttttttgcttgttgtcgaattgtaccgaaataattatttatttacttattaaaaagttggcatttttatctcgccataaaatttctaccttttctttttgtggacagtaatttcataataaaaaatgtcggacgaattattttttcaccaaaatcgaatgtttagcgaagacggaataccaacaaccttttgaaggaaaattactttaatttattgttattaatgaaattagcaccgaatctttcgtccaatagacagttaaacatttgtcgccactgatttcgaggttttcgtgacaagcggtgacatcccaataattttttgggaattccttaaaataaataattgcttttaaaattattttagtccaagtcttgaaggattgattattttatatgaggtttagctaattaaaaatgtttacttgtcaaaaaatgaattttatttaattttttctctttcgcttattcaccattctcttctgaacgagatacgtcagatataggcctagtttgatcaagttcatggggtctcaacatatttcgttggtactcactcatcttcatctttgattcgacta

SEQ ID NO: 51312 - DNA, 605 bp, Heterodera glycines
  Genomic contig location: Contig_ID=SeqID_20745; Location=344..948; Strand=-
  SCN-specific regions: Sequence locations=1-236,324-605
ttattggggcatcatcttcggattcgctgttaaacagcagaacaaattggatcgatcaattctatgtgaaaggggcacttatgcatatgaaagtgatagcaatatttggattaacggaaaaagaaatggaacaaattacaaatattcctacgttgttggtgataccgtaggaattggcgttcatttaatcactcgacagctctttttcatcaaaaatggacttcgtttgggttagcaaataataaataatataattttacgattttaaattacaatttggttaattgtctattttatctaatttattttatgtttaaaataatcaaaaatcccttaactttttcacagatacctctgatcttttggttgatccatcttttgctgatggttctctttatccattcgtttctttgttttattctggtgaaaaaattgaggcgaattttgggcccaataatcggaaaattttgtcgtttccctgggtatttaagactaaaagatgaaaatttgcaaaaaaaataggtttttttccaattatctgctaaaattcataatgatatttataaactcgaaaaaactaattattgagttaaatgcaaaataaa

SEQ ID NO: 51313 - DNA, 849 bp, Heterodera glycines
  Genomic contig location: Contig_ID=SeqID_20746; Location=774..1622; Strand=+
  SCN-specific regions: Sequence locations=1-4,27-202,230-413,436 -457,494-503,571-645
gcctctacaaccaccacaacgacaacgacagaagaacagccgagggttgaaaaattcgccaacactccgccactcatttgtatcctggacagcgcgtgcaattagtaaattttttttcaaattttattcactgttaggccagcggaaaattttttgagggattcgatttttttcgggcaaattggcactaacaatcctattcattttattaaatattatttttttttatcatccaattttcagcgcaacaaaatacccaacggccaagctgagtaagcggttcaaaatcagtgaggactgttcggaattggccaaacgcatcgaaatgaaatcgacggacgcggattggcagatgagcttcgagttcatgaacggcttcaaatacgcggcttttatcttcgatttccccatgctcgggggaggaaaaggcgggggacagtgagcagcagcagcagccattttaacaattaatattttattttaaattatttaagcatttttaatttatttttattcatttttttaaatatatttctttttcatttttaaattttgtttttatttttatttaatatgtatttgtcatttaattcatcttatttaaaaatttaaaaaagccaaaaaaagagcaaaattaaaattgccaaaaaaaattgtaaatcttttttaatttttttattatttaagcattttcaattacatttattttaattgtattattcagtcgttttgtaatcatttttcaaattttatttatatttcacttaatttatttcttttcaatatttgtattataatcttttttaatcatttattttctttaatatgcatttatcatttaaattaaaa

SEQ ID NO: 51314 - DNA, 92 bp, Heterodera glycines
  Genomic contig location: Contig_ID=SeqID_3658; Location=177..268; Strand=-
  SCN-specific regions: Sequence locations=1-92
acactgcccgccttggggcaaatttggccgactccttcgggagtcactctcccttcggacgaacgaagaacttcatctcgtcaacaccacgg

SEQ ID NO: 51315 - DNA, 2036 bp, Heterodera glycines
  Genomic contig location: Contig_ID=SeqID_3660; Location=1..2036; Strand=-
  SCN-specific regions: Sequence locations=1-342,367-739,761-963,1015 -1119,1141-1189,1211-1330,1352-2014
ttgttattcttacattaggtgcgcaattgctcaaaattgctatttgagtaccgaatggatttggttaaacgaattgtgaattgtctgatcaaaattgccccaggagaaaacattgagtatgttttattactaattgttaaggctgcgactttagtgactaaagatctcgaaatagttaactaaaagagtgagtaaaaatgccaaaatagtggcaaaaagttcgaaataatgacctaatttttagccaaaaattaagtaaaatattttttattcaccagttgcagttgaaaatgagtaggactgagatttttaagggcaaaaaaccaaaaataggtacctaacaaataattttaaaaattaaaaattcttgccaagaaaatgaatttttgagaaaattttttcattaattaggagtgtattttataaaaatttttgcatttatttttaggggtgtatttctctgaaattttttaagtgatttttaggtgtgcaatcttcgtttttattgcatttttattgagaaattttccaaaaaatgccgaaatagtgacttttcactattttagtgacgaagctccaaaatactgatttctagtgaccgataatgacatcagaatcgaaaatttttaatgcagaaatgcgttttttgagctttcacagccctattaattgtatttggtttatatttccaattgaatctttcagtgggtggcgttgtggcggaagcatttctttacaattgttggcccaaaaacttctcacggccgacgaccggcgaatgttggccaaccaggacaaaggacttcagactttcttacgcaatcaacaccaaattttctgtgtcatcaaaggcattgtttcaatgcgaaaatggagcactgtaaacgaagaattcgcacggaaaagtggaggaaagcccccgcggagccattgctttttccaccgattgcatcccgacgggtcaaatttaattcaattttttatttaataatttaaacattgatttaatattatcgtatatattttgacaaaatgtttcagttgtccgttggaagcgcacatttgttcgtacaagcattaatattacattgttgtcgattatgttggtgatcatctcgctttttgttatggctttatttcgattgtccttttgttattatgcaaatattgtctttttattattgtaataagaaacacaacatataaaaatatcttcagaaatcaaatccctatactattatacaatacgatgtaatttgttctgattttattgccaaatttatttttttttgtatttaccgatttttttattttagtgaaaatgaacagtcatcataaaattcttttcctcggcgattcctccgtcggcaaaacttcgctggttaattcgctctgtggcattggctcaccaccgcaaagcacgctcggctgcacagttcaggtgggtcgttgttgtctgtgccttgtttcggtaaaacgttcaattgcttgggccaaggcatttgattttcagtttggagttctttgatggtgccctcccttttcgcagattttcccccatcagtttcaagccggaactccgaatgaggccactgaactgttggagttttgggatgtgggcggctcaaattcacatcgcaaggcgagtgcagtgtttatggacggggcggacggagtcgttttggtgcacgaccttaacaatgtgcggagtgagcagaatttggcactttgggtggatcttttgtatgctcaaatgtgaggagacaatgcaaaaaaaagggcgaaacgatgctcaaaacggcacagcactcgccaccgtcgccatgggctgaactcctcgcgattggtctcctcgcccaacctaagcatgagcgacgcctcctccatcgtatcgccggagaggagctttgacggcggaagcggggagcgctttatcgcattggacatggacagagtttacaccatcccaattctcattgtcggtgggtattgtttaaattcttattttcaccaaatgtaaatgtaaccagtttcag

SEQ ID NO: 51316 - DNA, 1179 bp, Heterodera glycines
  Genomic contig location: Contig_ID=SeqID_3661; Location=832..2010; Strand=-
  SCN-specific regions: Sequence locations=1-144,169-223,247-797,820 -955,978-1179
atgtccaataagcttctgccggatgagatgtactgcagcagatacaaagaaattaagaacgctttcggcaaaaggatcgcttcggtaatatcttcaaaattttttaatccgtagaattggaagctcgctgagattcaatcgctcatttatttttaataatttttttaagttggtaggtttctgacaggtgtatgcgaaaaccaaaaaacttcgaaaatgaaattacttcctttttcacattttttatgtacttcatctttcctgccatgtgaaatatttttgtagagaagaatagtgaattttataaattaaagtttttttttgtggaataaataaattaattctgaatttgctgtttatttagcttcttttatttaaggcgtggactgaaaagacggaccctagcaaattcgtttacgaagattgcgggattgtcgcgtatcttctcgaactttggcaaagttacggcatcggtccctccaaacaatttgctgacctcggctgtggcaatggactgcttgtctttctgctcagctgtcacggcttccgtgggttgggcttggacgtgcgcgaaaggaatatttgggagcaatttcgtatgcaaggagcagatttgagagaaacgaagttcgatccctcctcccgcgattccgttgcggagcatttgaaaggggtcgactttttgatcggaaatcatagcgacgaattgaccccgtggataccagtgatcgctgcaaggtgtcaattttcatcctcaaagtttttcgaatccgttaacattttcagacttcgttgcaattttttccttttgccatgctgcacttatgatttttttggcaaatattccaaaaaaatgccatccgaaaaggctttggcagccggggcgccgaagggaattgcggaacaacactttgcctacattgaacatatttgccaccaactcggtttcaaagtggaaattgatcaactgaaaattccttctcgaaaacgcgtaattttgtcgtattttattaaaaatgtccggtcattcggctttatttttagaaatgtttggtcggtgttgtccctgccgatggccttggctcatcggagcgcattgaagccgccatcaatggccttttatctttggctaaaattggcacaaaggacatttttacgcctcgtccctccaaagaacag

SEQ ID NO: 51317 - DNA, 616 bp, Heterodera glycines
  Genomic contig location: Contig_ID=SeqID_3661; Location=3572..4187; Strand=+
  SCN-specific regions: Sequence locations=1-399,422-616
atgcctaagcgttcaattggatctgaagacagtgaggatgaacttagagaaagtccaagtgggccgaacggagagtcaccatgtgccaaaaggagaaaatgcgtcgaatttgagccagtcaggatttgcagcataggaagcgtggtgagttttaactttttgtataggtaaatcaagttttacttaagaaagaaatcgaaaatagagttctgcttgcacagcattacaaactttgcgaaagatttcgactgaaggagaagatcagattagagttggagaagcgaattgaagggtttgaacgtcgtcagatccaagacgatgcggtgatgtgtatcatcaaccgatactggaacagagtgtgttttagttagatgaaaccattttagttcatcatatgttatctaatttcattttcccaatttagttggatgaggaaattcaacttttgttacaacgatttgacagagaaacagcacaaattgacactgagatgaaaggtggacaattgaccttgtttagcatacctaaactattagcaagcaaaccaaagggctttttaatttttgataaaatttaaataggaattaaacttaaataatgaatgagttgagcctga

SEQ ID NO: 51318 - DNA, 623 bp, Heterodera glycines
  Genomic contig location: Contig_ID=SeqID_20750; Location=30..652; Strand=-
  SCN-specific regions: Sequence locations=1-184,211-455,582-623
atggccaaaatgccagttgtgatggcatttataagcaagcaaagcatgtcgatgacggcaatgtaaaacatgaactaattgaaaattgatataaacaattaattttggtaactttttcaatatttattgcttctcttctgagacattggcatggtttcaattgagtttcatgccacggaataagaaaacaattaaaaacttttcttaaaagcaactaatcattaagggtattggttattattcggttgctctgacaagggaactcacgaactgtaagccaaaaagtgggtatacatttggtaccattggatacagcaggtcgacttctattgtgaatttttatattagcggtgtgtgacgaaaaataaaaaagttatgtggcctcaaaaaccgaaactaaggcctaagggcccattcctagctttgttaactttctattaatttccaaactttacttttattattattatttttttagcttattttcactaaataaaaattattatacatttttttagtctaaaatgcacttttaattatttagttatattgtacattaattaaaacttattattttttatgttgaattcgaaccggagctccaaaaatgcaaatttaataaa

SEQ ID NO: 51319 - DNA, 810 bp, Heterodera glycines
  Genomic contig location: Contig_ID=SeqID_20752; Location=1726..2535; Strand=-
  SCN-specific regions: Sequence locations=1-98,123-226,268-540,562-810
  Gene Ontology: Mol. function=structural constituent of cytoskeleton; Cellular component=intermediate filament; Biological process =cellular morphogenesis
atgggcaacggatttggaggcggaatgggcaatggatttggaggcggaatgggcaatggttttggaggcggaatgggcaacggttttggaggtggaatgggcggcggaagcggcggtggctatgggtacggtaaacgtcgctgatgaattactgtgttttacattatgacgacgacatttcattatgctcagattgtcttttttttacaaaaatgaaacttttttgtatttataaatgaatatttaaaatttaaaatttatataattgcacaaagaaaaaagaagttttggcaattttaaagtgcccggaatttttacagttattttgcacaaggaatattcccaatttaccagcgatctgaaaaatccaatcactttcggtgattaatttttgactttcttctaaaagttcaatttatcttctagtttcaaaactgtaccgacttttcagacgtcaaacatattttcggagtcccaccgaaatttcctggtcatcgaccaataaattcgaaaataacggaccaataaaaaaatatcgctttgatttattttcagactactcctaacgacctctttcccgatcagggatgggcgaaacttcgagcttcgtgcttcgaaaacttcgcgttttttgggcttcgaacttcgagtttcgggtaatttacccgaagtttcgggaaaaataacccctaaagatcgagttttcaaagtaagaaatacacccctaatgattggcttatggtaaagttaatttaaatatcattatgaactttttgtgcagcaaaaaagtcgggtgaagagtaaaataaa

SEQ ID NO: 51320 - DNA, 871 bp, Heterodera glycines
  Genomic contig location: Contig_ID=SeqID_20754; Location=560..1430; Strand=+
  SCN-specific regions: Sequence locations=1-130,154-499,523-569,634 -752,774-871
atgtacggcgggtatgctgtacttagcggaggaagggttagcgactccttctccgacttgacgggaggtataacggaagaatgggacttgaagagtctcgatgtcgccaaacgaagggacatggaattggtaataaaaaaatttaaaatataagccatttttcctaaattccgcaaaggagtaataatgaacccgcttaagcagagccagatcaataaaaaaaatttgggattgtatgccaagcttggccaagctctggtaagaaaagcactgacaaatgagtggaaatttaaaatgtttagctctgatttgtaacagatattcaccagttgtggcaatccctaacaatttttcgtgttttcatcaaaattttcgcaaccagaatgccgggctcaaaagtgtacgaaacggaagtcgacaatttaattgttttttgccgaaaatttttttattttttccggaggcatcgactgcacctgaaaagctatcgattggcaccaaaaaaaaaaaaaaattaaatttggctgagtttaacagggaaaggctcattgattgcggaatttaggaaaaatctcggcataaagaagaatgataatttaatgatttttaatattcaaattaaacatttttaaagatattggtaaagcgtcctccgaacagtggcgttaaaaactactctgagaactgtgtatttggctgcgccacgggaccagtgaatagcgatctcacgcgagcagggctcgttgaagtaattttcaacttacaataaattcttaaaattaaaaaaatttcacgaaaaaacaactttcgcaaatattgctgcaattcgttaataattttgttgaaaaactgtgccttttcaaagaaagaa

SEQ ID NO: 51321 - DNA, 117 bp, Heterodera glycines
  Genomic contig location: Contig_ID=SeqID_20755; Location=22..138; Strand=-
  SCN-specific regions: Sequence locations=1-22,47-117
atggaccaaaatgaaaaagttagacagaaaatgaaggaaaaaacaggacgaagaattgattcattttgtattttttatttgatcaaatttatttgtttgttttcatttttgcaccat

SEQ ID NO: 51322 - DNA, 419 bp, Heterodera glycines
  Genomic contig location: Contig_ID=SeqID_20756; Location=55..473; Strand=-
  SCN-specific regions: Sequence locations=1-46,68-129,179-237,276-419
atggcaagtgcagcgaatgcatatgtgaacagttggaagaagagcagaaaaggacaaaaacagggggacaaagttggcacaagttcatcgggggcacaaaaaagccctgaaatgggagaaattggtttgtaaataaataaaaacaatgaaaaatttaaataaaatttaaaaaatttttggaaagcaattttccaaaattccatgaaaaaaaaactcataaaatcaaagaaaatagtcaataaatattttttaattgaaataattaacaaatttaagaaaatccattggaatgcaaaattgttaagcctatcttgctaattgaggaacgcgaactccaaatgagttcagcaatggaagcgattaaatcagtgtaccgcgactttttcttatggggcaaggggaaatatttaaaaaatacg

SEQ ID NO: 51323 - DNA, 1260 bp, Heterodera glycines
  Genomic contig location: Contig_ID=SeqID_20757; Location=1428..2687; Strand=+
  SCN-specific regions: Sequence locations=1-40,62-83,106-180,204 -211,234-235,257-275,316-601,623-643,672-723,747-1260
atggtccgaaaaaagcaaatatttccttctgaagggaataaagctaaagaccaacaaattgatgcagaaagcattgaactgggttcacagctcccattaaaaagcggtttgaagggttcgaagctccctgataaaagcggtgaaaatgataattgggttcaaagctcccagaaaaagcggattgaacaatacaaacaatttattgatatgattgataaaccttcaacttctcagcaatgtaaaatgaaagaaattgatagaaatgttaattatcttgaaacaaacagatttgaaaacaggaaaagaaaaagtgatacgtttataaatttagacgaaattgatttagatgaatcatctaaaataagtatttgtgatagaagtcaaggttcaaacagcactgaaaaaacattatgtaaaaaaaatacccaaatgaatttaaaagatttagtcaaacaaaatcccattttggagggtgaaaacaaaactaaagatttgtttaaaagaaaaatggttggctttttatttaaaaaagcggaggaaaaaaataatatttcaaaattttccctgcaggattttaatattgagtgtttgttttgtaaagctcttcattttccagaagaaaaatcgataaatgcaaaagggaaatttaatgaattttatttatgttgcaattatggaaaattcgaaagattaattgggttttttgatacttatcctgaagatttaaaaactttattttcagaagaaaataatttacacaggcattttattgaaaatataaggaaatataacaattcatttgcatgtgcttctttagcatgtaatagattttctttttctacacccggaccaagttgctataaaatttcaggtcaagtttatcacaaatttaattcaactgctcaaccaatagaccaaaattctttacctacaaatggtcaactttattttcttgacagtagtgaagcacaaaatgttcgattgaattcttttgaattaaatgagcacctcattggaaaaatagaaacatcgcttagaaaaaactatccatttgctaaagcttatgaaatgatgaaaaatgttattaacgaacaaaaaacattttcggacaaatctattttaaatgaaacacaagaagtgaaaatgtttttgagttttaagaatggttttgaccctaatcgatataacattcaacaatcaaacgaagtcgctgcaattatggtatgcaatggaatgatgaagtcccgcctgcaaatttag

SEQ ID NO: 51324 - DNA, 137 bp, Heterodera glycines
  Genomic contig location: Contig_ID=SeqID_20758; Location=1445..1581; Strand=-
  SCN-specific regions: Sequence locations=1-137
tcttttgcggtcactgagcccgaggcgggctccgacgtgtccaatgtgtcgacgagcgccgagcgtagtgaggacggcacattttatgtgctgaacggtgccaagaaatggatcaccaattgtggcgttgcgcaatg

SEQ ID NO: 51325 - DNA, 511 bp, Heterodera glycines
  Genomic contig location: Contig_ID=SeqID_20759; Location=286..796; Strand=+
  SCN-specific regions: Sequence locations=1-105,137-154,179-198,220 -307,405-489
atgtccttgcaaatcggcatacccgtccttggaaacggagcatggatgtgggagcgttataattttaaagtaatttattcaacattatctctaaacattaatagctttaaaattataattatagttattaaaaaaagccaaataggcatatttgaaaaattatataaataaattttatcaattcgatgattattgttctattattattttaaaatcggccgccaattgctccatattaagacagtcccgactctgcagtcgacgattgcaaaatttatttgattcgctttggtattaattcactatcttataatatttatatgagaaaatataaaaataaatttatacagaatattgttgagtagaaattaattaattttaattaaatcatcatattaaaaaatgccaatgtttaacaatttctgaatattaactgattatgttgatttaacatttttttctttcattatttaattttatgcaatcaacaacacaacaaaaaattaaaaca

SEQ ID NO: 51326 - DNA, 873 bp, Heterodera glycines
  Genomic contig location: Contig_ID=SeqID_20761; Location=869..1741; Strand=+
  SCN-specific regions: Sequence locations=1-86,133-177,211-317,368 -420,442-494,516-530,575-823,854-873
atgccaaagaagcaacaaaaggatgcaattgttgacaacaacaaattaccgacagaacaacaacagcaaaatgatggtgatatttgaaaaaaaatttaattttttattaagtatttttattttagttttattggagcgcaattcgaatgaaattgaccagcacaaattggatggaattgatgataataaaaataataatggaaaacaatttggtgctaaaaaggcgtttgatcaatttgaaattgaacaaccaaaaagtgttcaaaaaaattggaccgacatgagaagcatttggacaaaaataaaggcacgcatggaaataattttttcaataaataatttaaaaatttatataattttttaaaaacgttcctttccctccaatcattccacggtttttttttttgtaaattaattaagagagaatttttattttatttccgaatgttaatacacagattttgttttttgtttacttatcttttagtaagataccaattaaacttttgtttcttatgtgttaattatgcaaaaataattaatttataattttcaataaatcttattatattttctacatttagaccaaatttttggctccttatcaaaatcgggttgttttccactggtcactttattccattgtcatcacagcaatgttttatcaagtgaattcaaaaaataattacttgaattagaattaattttaaatattctttttcaggtccaaaattacattcaaaatttgtgggactttcatcggaaagctgacgaaagagaatggaatggttttgttgagagcattaacacacttttaagtgagtaaattttaaaatgaaaattttaattaattcacattacatttgtctccta

SEQ ID NO: 51327 - DNA, 1075 bp, Heterodera glycines
  Genomic contig location: Contig_ID=SeqID_3662; Location=171..1245; Strand=+
  SCN-specific regions: Sequence locations=1-2,24-468,490-643,667 -1001,1028-1075
  Gene Ontology: Cellular component=integral to plasma membrane; Biological process=transport
atgttcggctttttgtttgtcgtcttcctcattctgattgttacttgttctgaagcaacaattcttttagcttacttccatctttgcgccgaggtaattatttttaaacaataatacacaaaattacgtgaactgcaataccgcgtgggatcccgcaaactttaaatgcttgattgcgtgattaatcccatgtgatcttgtccagcaaaaaaaaaattttaatttgttaggattaccattggtggttccgttcctttatgacttccggatttactgctgtctatttgttcatctactgcattcactacttcaactcaaaactcaccatcactggtgtatgtgttcattgaaaactgagtttcaattactattcttaatattttaggtcgtatctaccatcctctacttcagctatacttcgatttttgtctttttgttcttcttaatgaccggttagaaaaattttggtatcttaattcatttctcttcagggaccatgggatttttcgcaacttattggttcatctacaaaatctacagttcagtgaaagtcgattaaagatgtaaatttgatttgtgattagaatacatgttaattttttttggtcattggtttttgagcaatgatgggcttctttcaatgtttaatatatttttgtttcccttgtcttaatgttttttttataaatgtgattagaagtcgaagttcggataactatgaaaggagatattccccaaaaaatggcatgggacgagtcaatagcactcgtacaaaaggcaactcgtacactgttgtacaaaggaaacttgtactaaagtcaactcgtaaaagcttaagcctaaacctagatccaagcaagcataggcctagcctaaaccttaggcctaacctaagcaattgtatgagttgtaaattcgatttaaatcaaagcaaacgcgagtcaattttgggctcccagtgtaaataattttttttttattcagaacgccaaaattctgcataaaattttttggggttttcccttgtaaaaacgcaagagccgatctcgagttaaaatatgtataacttccaaaa

SEQ ID NO: 51328 - DNA, 151 bp, Heterodera glycines
  Genomic contig location: Contig_ID=SeqID_3662; Location=7123..7273; Strand=-
  SCN-specific regions: Sequence locations=1-151
agcgaacgaaaaagtaccacataagaaagttctgtgcgcgttgcagtggtggcagaatggggcgggcatttgcctggggggttgttgtgatcgctaactaacaaatttgtcattgtattcccagcggaattgacggtaaatttcttgatta

SEQ ID NO: 51329 - DNA, 709 bp, Heterodera glycines
  Genomic contig location: Contig_ID=SeqID_20762; Location=117..825; Strand=+
  SCN-specific regions: Sequence locations=1-149,172-416,438-581,603 -665,691-709
atgaaaagggaaggcaacggacgagaaatggttgtaggaggtgagcagaccgctgagcagcacaatggaaaggaccaagcgaaggacggcacattgggaagagtcggagggatggagacgaagcgaactgcgaatggccaagagacggtcggcacagatggcgatgatcagcctgtccaaatagagggaaagtgccgaattaagagcgatttgaaaagaatgactgaccaaatggcaactgcggaacaccaattggccaaggccaccaaatggacgcgaagcgacagataaagcagacggaagcgcgggttttggccaaaagagtcgaattgggccaaagcggagggcaaaaggagcagcagaaagagaacatcgcaaaaggccaaagcgatgagaagggagtcggaactgaacaaagaaagtgccaatatggcaaagccaaagaatggcaaaaaaaatgccaaaagaaaggcaaagaatggcaaaaaagggggaaaaaggcaaatgtgcttttttgacgaaccgtctccgaattgagcctctgccggggttaagcagaaccaactgaaaaggggtagcagtaaatggaaatggaggagaagcaaatcaaaaacacttgccaagttgagaaaattgccgacgaaaccgaaaagaaaaagccaagggaaaagaaaagtgaagaagaaaccctagggggggggggggggta

SEQ ID NO: 51330 - DNA, 460 bp, Heterodera glycines
  Genomic contig location: Contig_ID=SeqID_20763; Location=838..1297; Strand=-
  SCN-specific regions: Sequence locations=1-120,145-423,445-460
  Gene Ontology: Mol. function=DNA-directed RNA polymerase activity; Cellular component=DNA-directed RNA polymerase III complex; Biological process=transcription from Pol III promoter
gtggaaactgtcagcaaacaattagccgcccacgtgtacaacttccttggcaaggacatgctcacgtcgggcagcacgggacagcaaatggccgcctatgtctattttggcccaatttactaccagaaactgaagcacatggtcatggacaaaatgcacgcgcgagcgaaggggccccggttggcattttattacaatgactgcaattggtttatggggtgcatttttcagcgctgttctgactcgacagcccaccgaagggagggccagggacggcggacttcgacttggcgaaatggaaagggactgtctgatagcgtatggcgcgtcgatgctgctgatggaacggctaatgatctcctccgatcaattcagtgtgagtacagtaattccattcgcaaatgactccattttcgcctcatcttttgtcagatggatgtttgtgccgagtgcggtttga

SEQ ID NO: 51331 - DNA, 2590 bp, Heterodera glycines
  Genomic contig location: Contig_ID=SeqID_20768; Location=268..2857; Strand=-
  SCN-specific regions: Sequence locations=1-256,278-288,311-341,375 -1202,1224-1684,1706-2061,2083-2590
  Gene Ontology: Mol. function=transmembrane receptor protein tyrosine kinase activity; Cellular component=integral to plasma membrane; Biological process=transmembrane receptor protein tyrosine kinase signaling pathway
ttaacaataaaacaactaatttaaccaaccgtttgcatcgatatgtcccattttgcagcgaaaatttaaccccttggaccacagttatggcactttttctgctttacttgataacacttctgtggatgtgcaaacgtataataaaatgaaatgaataatttctttatttcgtttttatagatggaaaaaacatttgtcacccaactcctgattcaatttatccttatattggccgacttaaacaattaaagagaggtaaaatttattttttataatacgagtcactcttatatattttttaatttcaaagcgttggaccatttgttggtggatgacatgtattttttaactgaataaaatattgtttgtctgtcattattatttaagcaatatcgaacttactgatataaaactcggccaaggagctgttggctttgtattcaaaggggtaaaatacgaaatacattgagaaatggcgctattttttcgcgccagccctttttgataaaagttatagcttgtaatttataattctagatccgcgataattacttttttatttcaacattcagtacgttgttcccaaatcacaaactcggttcaagcaaaaagtattcgccgctgtgaaggtacggaaacttaaattaaaaaaaacagcttgggatgtgagggatttaagtttttagtcctttttcgtaaatatggaaaaaagaaaagtgcctccgatgggagtcgaacccacgaccttctgttgtctgccactgagtggtacaagacagatgctctaaccactgagctacagaggcgatcaacgaaatatttttcagatgagttatcccatgccccaaaaaagcattggcttattagaagaagcagcgaggatggcacgattgaaccatgcgaatattgtacgcatcattgctgtaagcaaactgtgtgttgtgagctattcgactcgaagaatattcgagctaacagaaatgccggtcgactttttagtgtcttttcatataattaaccattttggcaggcatctctgtttttttgaccgtttgtatttgggatatggaacattcagatcattctccgcctttcggccaatgttcgcaatggaatggcttcatggcgggagtttggctgagtttttccgggaagagatcagggtttgtttgacgatcaaaattttgaccggaaggcttttcagtgcaaagaggatgaaagagaaaggccgcgtgtgtttgtccgtgacattgtgcacgtgttgactcaagtgggcaacgctctgaagtgttcccaactcaaaattaatcaatttatactaattttaaggttcttacacgaaagtcgtgaccttcagggcaatgaattcgctcacggtgacgtggcagccagaaacattttgctgactgaaagaaatttgagcaggtgaaaggagccaacattcaacattatgattcttcttgttagatgtgtcgcaaaattgggcgattttggtttgccaattgactttggtccgcgtctgccaattccttggcttccgcctgaaatcgtctgttcaacggaccgtacaaacgcaaaacatagaccagagagcgatgtttggttggtaaaaaataaactaatgcggcaattcaactaaaacaggatgtttggggtcctttgttgggaatgtgcaactttgggcgccgaaccacactatcagcaaacctttgatgaaatatgcgactcctttcgtcttacccatcgtggtcttccgcttcaaaaggaatgtccacctgactagttagtgttttatctaacaggctatataggattgtacgggaaagggttttaaaattccgttacctagcttaaactgacaaaactattattaaaacatttcaaggaacctaagtttttgaagaatgttagtttttttgggaatttagctttttcccggcttccctacgtggaccggatcggtcccggggtcatgccgccgagcttaggagggcagcagcgtcagtcgcacgaggcgggggggggcggtcgagaaaaaagggttgaagaaaaaccgaacggatctccccctcctccttccaatccctaaaagtttttggaaaaagcgcgcgccgtaaaaaagttggtttgaaaagcaattttaaaaaaatggtcgaccgcgaaaaagtttctgcgggagggggggggcgcaaagcccttctccgatgtgtacaaccctaggcaactgggaaaggaaatgtaaatttcctgggggtatctccctccttatcaaatttcatttaaaagggacttatagcttcgccgatattttgaaaatttatcactgttcaactgtttagtgccgcttttgtgttggactgcttctcggagcagcatcgtcggccccgtttttctggcccaacaaatgtcccttcatcggccattcgtcgccttcgtcatctgagcgatattttcaaacactcaaggggtcgtcttatatacactcatattttgttttcattttgtttttcatttagcccatttcaaagtggtgcacaatgtatctaactgcacttgtgctcaacacagatgtaatgtgccattgccggtt

SEQ ID NO: 51332 - DNA, 1672 bp, Heterodera glycines
  Genomic contig location: Contig_ID=SeqID_20770; Location=122..1793; Strand=-
  SCN-specific regions: Sequence locations=1-35,57-661,684-691,727 -981,1003-1025,1047-1080,1102-1255,1280-1297,1347-1389,1412-1472,1504- 1593,1615-1672
gtcattttcccatggcgtcgttttgcctccgttttccccgtggcgccggcgcccgccgctgtgctcggcgcagcattccgccgagcattttcatcaacaaccatcgcctgctgttgctgcattcattcctctcatcattattatcagcattgttccttccgcttttgccgacttagacgagcgaaaaacggtacggtagtacaacaggatactgtacagagtctacagggagtcctatcagggaaatttagtattttttttttctgaaaaactaaattttacagtactattacattaaaatcttagcaactttgaattccgcttcgctaccaatgaatttggaaagcacttgtccctttaattcaataattatttatgattttgttctccaaaaacttatcgtgcttgaatttttgaatttacatatgtattttagggcagaaatttggccaatttatttttcatatatttttcctttttctctgaattattatttgtcattaatatttttcgagaggctgtgtctggtaaaaatttcagctaaccctggtaataagttgtttttttaaacttaaattgggacagagtcacaatgcaattacttagtggatcatactcgggattatgtttccgggtttcagtctcgagttttacggtgccaaaatacaatataaaatgaaaagtaaatgagaaataatgtttatttttatttagataaaatattatgctgtaatatttttatcggagaattgtgggacaattaacaattaatggggggggggggcaaagtgttccttcgatggctcttccatttttattccatttttacaccaaaacgaaatctgctgatagttttttgccgttatttgttgtgtttagcaataaaattgtgtacacattttcacttttgttggtggtgaatcgatttgaccgtcacaaattaattgctttttttccattaatcatttaattacaatttgtacaatttttaaataaaaaactattaaaaagtcagtattttcattaaaaaatctttgtttctaaattctttacaatttttgtgtaactttttggctgtaaatttgttaaaattaaacttttaaatattcataggacaaatgatgttttcattggtcttatttgatgtttctattttttcgcattgagcaacaatttttatatgaaaattcttaatttttgtcgttgaaaaatttttgtcgttgaaattgttttttaataaatggaaacatttttgattttattaattattattttttaagtcaacccaattaataccatttttattttcaaattttaaatttttcaaattaaaaaatatattttttctagcgctttttcttcgaagtgcttccacatttgatagtacaaatcaccaacaaaaatcttcttcggaaatgacccaacagcgggagagcgacgatgagcagcaactttacgaggcacacattgccaaaatttaaaaaaaaataaaattttaattttccagaaagccgtcatccagctgaacgccttgcaaagcaacgcacaaacgttagtattggcacgaactcaacaggaaacgcggccagaatggagactggaggagaccaaggaattcatggacattctcggaatttcggtcccattttattatttaatttggtttcaataa

SEQ ID NO: 51333 - DNA, 1032 bp, Heterodera glycines
  Genomic contig location: Contig_ID=SeqID_20771; Location=533..1564; Strand=-
  SCN-specific regions: Sequence locations=1-204,236-282,304-354,415 -698,722-754,783-860,882-944,966-1032
  Gene Ontology: Mol. function=structural constituent of cytoskeleton; Cellular component=spectrin; Biological process=body morphogenesis (sensu Nematoda)
tgattaggactcataaagtgcaatagagccaatgcatttgtagtctcgagaattttaattaagatttacagaatctcgttgtcaaggtctgattggtgatcaacaaatatttttttgaaaatttcagcatacttacatcacccttcaggggttcatgacgttcatgttcaaaaaaaaaaattttctagaaaaaattgttatattcatttttaaaagaaaagaaaatgaataaaagcaatttttaggtgtattttttgaaaatttgaaatacattcctttgggtgcattttccccttcctttttattaaaaaaatttcataaggccaatgtaagggttatgtcagattttagaagatattttcataaatataataaaatcttttaaaaaatttctgtaaatttttttcattttttcagcgatggttacgtcaccctgcaggagttcatggcgttcatgatcaacaaggagacggagaatgtgcggtccagtgacgaaattgagatggcattccgcgcactcagcaaagagtaccgcccctatgtgttcgcggaagaactgttcgcggtgcgtttttaaaattaactaattataaatgtaattttggcatgtttttgttctgcaggaagaatatttaaattaattgatggaattttatttttaaatgaattttatttgggttttttcaagattttgattcttagtgatttttaaaaagttggaatggtaccaataaggaaaattaaagattttcactaaaaataatatttttacataaaattttcggttgcggggggtctttaggggttgctgcccctcctggcaccgtttttatttgtctaaaaatttttgatagatttctaattttatctttaatattatattgccccctccctttttttttgcagaatttgacccaggaacaagcgcaatactgcaaacagcgcatgaagccctacgtggacgcggcgtccggccgtaccattgaaaatgcgctcgattttgaacagtttgtgcactcaatgttcatgaac

SEQ ID NO: 51334 - DNA, 847 bp, Heterodera glycines
  misc_feature (838)..(838): n is a, c, g, or t
  Genomic contig location: Contig_ID=SeqID_20772; Location=1..847; Strand=+
  SCN-specific regions: Sequence locations=1-53,76-308,348-433,455 -467,489-738,763-847
  Gene Ontology: Mol. function=structural constituent of cytoskeleton; Cellular component=cytoskeleton; Biological process=actin cytoskeleton organization and biogenesis
tgtggccaatgcaatttttgtgagtttattccatcttttttgtactttgattaacccagaaataacacagaaatgtgacgtcgacctacgtaaaactctctatcagaacattgtgctcagcggcggttcgacaatgttcgccggattcggcgacagacttttggccgaagttcgtcctccccttcctcagggacggacggttccgggggagggtacgcgggatacgtacccccttccccccatacccctccacattcggaactcgcctgtcggcaccgccgggacgcggggacgggacaaacgccaccaaattaatcaaattttaaaaagaaattttttataaaaaagtcaagaaaacaaataatagtaattcgtcataaaatttcgaaaaccgataaaaattcttcaatttttttcttgaaatttcttataaataaattttcttagatttcacgaaaaatttcttttgtaaatttggaatgttttttaatccccgcgcgagattttgaggtaaagccgccggacaaatcctgttgctttaaaattaaaaaaaagtagtccacacgaggatggtatcccctcccgaaatcccgggactgtcccttcccttcccccccctccctttttttattcccattttccgtcattcacttccctttcgttttgccagatgaaacggctctgtccaaaggatgtcaaagtgcgcattttggcgccccaggagcggatattctccacttggattggcggttccattttggcgtctttggacacattccgcaaaatttgggtgacaaaacaacagtacgaaaataacggaaagataatcatggcacgngaaactttt

SEQ ID NO: 51335 - DNA, 533 bp, Heterodera glycines
  Genomic contig location: Contig_ID=SeqID_20774; Location=1409..1941; Strand=-
  SCN-specific regions: Sequence locations=1-18,53-276,299-299,324 -338,366-468,501-533
atggcactacaacacaatgccaatggaagaagaaaattgaataatggcattttcttaattaaaattgattcactgataattatgaattgtatgtcttcgtgattgccgcggcatatttatatttgtgaaggagatacttaatggacagttatatgtctacaagaatcggaaaaaataattagggtaatctttgtaaatacaaaacaggaaaaataaataaagtctaattttaaatgaataataaaatgaatttttcgtgaatttaatggtccttgcatatgaataaaatatgaaaaaataatgagttttttcttcataatattcaatgacgtaaaaagtattatttaaaaataaaataaattattgtttgagcttttgcattgacatttgaaaagcatgtgaatatcatttgaattacaatctaaagcagatgaattgattgacgtcaaattaaacgttattacgagaaaattatattcaaatgaatattaatattatttgcaaaattggaaaagaaaaattattataataaa

SEQ ID NO: 51336 - DNA, 1365 bp, Heterodera glycines
  Genomic contig location: Contig_ID=SeqID_20775; Location=76..1440; Strand=+
  SCN-specific regions: Sequence locations=1-49,93-121,143-302,327-1365
atgagaaaattcatcgtgagtattttgcagtaaattttgaagaagcatcattaattaattaattaattaaatcatcattaattatttaattatttttgtaaatttatacttaattttcaaatgaattttctttcttatttttattaatgttattaactaaggaatgctttaggaacagctttttcagcggcaagagcaaatgttggccaaaattgacgagttacaaaagtccgtttttgcattaaaagaaggacagagctcaattggtgggttaaatgaatgcttaattgaattaatttgtgaaattattttaaattttcattttcattggggaaattatcggaagtttaaaaaatttattgacacaaaaatagggttcgagccccgtggcgcctatcgacaccgccgggcccgaatttaaccattattttttgaaaatttgacccaaaatggcaaaatctgcgattttcggcgcaaaacctctactaattcctgtttttgcctccgtcgctgaagattttggaaatattactggtgcaaaaaatttttgttggcccgaagagcaagaaaaaaaaaaagctcttcgagtgccctcgccgaaatttttttgtggatacgggcctggcccagttttaggcaataagccaatgtatcaaattggcattgaaagcgccgctatgcgttttcgtcgggattttttttgagttactaaatttttgaaaattcacacagtttaatagggaaacgaatctttattataattcctaatctgggtggttttgttattcgataactcagaatttcaggaaattcgactttctcgtgcccaactgtcccctttggttggtgccaatttggtgcggcgtttggaaaagtgtggcacggccggcgaggcgatgaccgaactgttgaacagcgtcgttaaaatgtaccacatcattgaaatgtaagtccggtgggaatccgtcacggagtacctacccccccctcccccccccccctcacaaggggtaaaatttctaaaaagaacagccaaataacgggctattaaaaagacttttccagcatttactcccccttcccaagtctcaaaaacccaaaattatgggactatccgttttttatcttggacatcttttgaagggcttaaatgcaattaaatttaaatcttcaaataagagattttataattattagaattttaacgcagaaatctttttttgagcccctttattcaaagcaaatgcgatttacaagccaagtcatcaataagcacttcaaaaactttacaggtataagaagcgaaggaaagaattggacgagcgattcaacgaagtcaaacgaatggcggatgcaattaagtga

SEQ ID NO: 51337 - DNA, 1063 bp, Heterodera glycines
  misc_feature (112)..(112): n is a, c, g, or t
  misc_feature (117)..(117): n is a, c, g, or t
  Genomic contig location: Contig_ID=SeqID_20776; Location=51..1113; Strand=+
  SCN-specific regions: Sequence locations=1-60,124-641,663-849,979-1063
atgtacaaaattcggtcaaaaaatttattgagcccgtttattaataaggtgagctatgccattatttattatttatttatattattatctttttttccattattttcttatntaatntaaattggtttatactggacttggaaaattgattttttgacgctttccggcgctttttagcaccgcgaatttttccattccgccactttttggcgccgttgttttccggccattttttttcattgtttgcggaatccagttctagtttagcctctatatggcgttagtttttttgttgttgttgcgtattttccttttttttgcactaaaagcgcttacgataatcacattgctgtacgattttctaacaaatattacagtacgcgttttacagttgaacacgtacagtaattattgggatatcgccgcgtgtcaccccaatttgctcatctccaactcggcatcaattaatgctaatgccccactgaacaaagcacagcagctactaaagagcaatatcttcacagctggcgctgcgattttggcaactttgcccggatatgtgcgcaaaagtgtagtggtcaagcataacgggaagaacagcggtaaatgatggtgacgaatgttcgagagtcaatcccgggttttctcaattcgagaatttctcggcctttttttatctttcatagccttgacggctcgagatctgtttttgttgattagaagtgctccttatatatttctgtcgtaattacctaaattattttatcatttaaattgccaaaaatggaaatggaaaaaactttttcgacaaccaatgctaatgataatcaaagagttatttagttaaagatttttatgtttaattttgcggtttttaatttatttttattttagttgaaaattaattgtattttcttgcataatttttgattttaatttcattgttttgtttgttttaggcttttgttctgtgttttccaaaatttcaattccaaatggatcatttttctattacgaagttacgattctgcacaaacattacgagtatgttaatagttaataa

SEQ ID NO: 51338 - DNA, 92 bp, Heterodera glycines
  Genomic contig location: Contig_ID=SeqID_3663; Location=15..106; Strand=-
  SCN-specific regions: Sequence locations=1-92
atgaggaagatgacaatgttgatgcagcccatgaatgccgccacgtgcagcggtgccagccccgaatgggtggtggcatcgacgctggcatg

SEQ ID NO: 51339 - DNA, 59 bp, Heterodera glycines
  Genomic contig location: Contig_ID=SeqID_3664; Location=807..865; Strand=+
  SCN-specific regions: Sequence locations=1-59
atggcaaataaattaatgcgcattgcttttgctttcactccaaattcaatggatgaata

SEQ ID NO: 51340 - DNA, 231 bp, Heterodera glycines
  Genomic contig location: Contig_ID=SeqID_3664; Location=1799..2029; Strand=+
  SCN-specific regions: Sequence locations=1-123,152-231
ggagtaggcaaaacggtcgtcagccgaaacgtcgtcgaacgaatttttcgaccataacttttttctttctcaaccaaattaaacattcttggtattattcgaaagcattcgaaaaatgctattagcctgcaaattttccaaaattttttatttatgcacaaaaaaatcagagcaaaaaaagttcgaattactggggtttttgattcccttctgggcataacttttttgaaa

SEQ ID NO: 51341 - DNA, 548 bp, Heterodera glycines
  Genomic contig location: Contig_ID=SeqID_3665; Location=1232..1779; Strand=-
  SCN-specific regions: Sequence locations=1-178,200-249,286-548
atggggaattggtcggtaggggtcagttggccaagcataaaacatcataacatttttcattggtggtaaatttttataaatttggcatcattcgaaagctctacatgcttagaagcttttggtaaacaacttataaaaaagttgcaacatgaatactaactacgggcctgaatagttttaataatggcctttttgtttttaaaaaaaattttccacataaatattttacttaaaaccaatcaattagagataatttaaaaaaaaagaatttttttttaaatttttgttatctttagaaagattatcgaatttcactgcccattgtttcgaaaatgagagaaaattttgtggctaaatttttgtcgaaataattgggcaaattgaattacccatccctcacacattctctgtgttagggggttgtactatgttttgcccgcaaatataactaaatttaatttgtttacgcggccggtacattctgttcaaccaaatttttggggcaatgtaatttgatatttaaatgaaaaaaattaaatgataataaa

SEQ ID NO: 51342 - DNA, 3829 bp, Heterodera glycines
  Genomic contig location: Contig_ID=SeqID_3665; Location=399..4227; Strand=+
  SCN-specific regions: Sequence locations=1-205,228-359,381-500,525 -555,577-652,867-1096,1133-1182,1204-1473,1500-1570,1594-1785,1818 -2126,2148-2252,2309-2619,2641-2863,2903-3194,3217-3218,3317 -3399,3579-3579,3615-3651,3673-3829
  Gene Ontology: Mol. function=structural constituent of cytoskeleton; Cellular component=membrane; Biological process=protein targeting
atgacgagcgtttaggcgccgcttcgcggtttgaattttctactacaatcatctcgtttaaaattaaaaaaaaaacatactattttcaataaaacatccttaaaaatgaattttttcttgtcacttttcccaattttccgtccgtccgtcccacatgagcagcagcagcagaaagggtgtggtggtcgtgaaaaaaaataaataaactcctatttttggcaatgtgtgcttccgtccgtcccaccccccgggggttaagttaataatcgtattgatttggtgggaggctcgggattcagctgccaactcggccgggaacaacagtgcacagcaccagcaataaaatgccccaataaacattttcctctcccctctccatagtccccccccacatttgtttgtgcccatatttttgtgccgtctgtttttttgtcagggatgaaatatggtggtgtttttcagttttttggacactccaattttcggaaaatctagaaatcataaaaaataattaaattaaattacataccaaatttgacattcattaacttgtttttgctttgatgaatacaaaattcgtgattactaattaatccaaaaatcctaataaattcgtattttcgagttttttaatttttgaaataattcactcaaaaaattaatattaaaatattttaaataattcttattttattattttatgatttttaataaaattttcattcaataaaattaatattaaaatattttataaaattttttattttattgccctataatgtttaaagaaattttcttccagtaaaattaatattaaaatttttaattctaattttattatcatttaatttttttcatttaaatatcaaattacattgccccaaaaatttggttgaacagaatgtaccggccgcgtaaacaaattaaatttagttatatttgcgggcaaaacatagtacaaccccctaacacagagaatgtgtgagggatgggtaattcaatttgcccaattatttcgacaaaaatttagccacaaaattttctctcattttcgaaacaatgggcagtgaaattcgataatctttctaaagataacaaaaatttaaaaaaaaattctttttttttaaattatctctaattgattggttttaagtaaaatatttatgtggaaaattttttttaaaaacaaaaaggccattattaaaactattcaggcccgtagttagtattcatgttgcaacttttttataagttgtttaccaaaagcttctaagcatgtagagctttcgaatgatgccaaatttataaaaatttaccaccaatgaaaaatgttatgatgttttatgcttggccaactgacccctaccgaccaattccccattggctacgaagcctgaaactatttaaggcgttaaaaatcatcaaatgttttaaaaaaatttcttgccgagcttatcggcgccggcgcctcattaaattgaattaattaaattactttaaaacctttaaaacgtttaaaaggaattcttatgaaaaaatgattatgcgcccgtcctccatttttcagaatgttctcagactctgaggatgaagcggatgatcaccaggcggccgcggcggagcacgcgcgcgatttcaacgagtccatcacgcaagggctgcgcgactcggccgtcgtccacctgatccacaccggggagcagggcgtgggcggcaaaagcagcagctcaatggcatttgacaccacggacgctgacctggaggcggtgatcaaacgagcgcaggcaatcaataatcaatcaatcatttgattaagtatatcactgagacataggcaattaactaattggtacagaaactaataaataaaacacagttcatatgtcgggcgggaccctttttactcttcgaaagcctaatttttttttattgtggttgcacgccaaattttttgcacgctttggctgcaattaaaaaatggagagaagcggggtccggcacatgcctatttcgacgatggaaaattggaattttttgacagaatttataaagaaaatcgtcaaaagtttcccttttttacaagccctaccccttgcaacagacggcctttccccccccccctcgaataaatgcttttatttttcagaatgccccagtgacaacggcattagccgattccagctttgtggagaatgggaatgacgacaatgtggcactgagtcgccacgatctgatccaaccgaggtccttcctttttttgaaataaaattattttataaaataataaatttaaaaatattttttatttcagcaaattgttcatgaaaacgtgggtataagttgacaaagtttacttctttttttttcatgttttgatatttttttcgtgttttgtgttttaatcccgccaattttttattcaaaagcaattaaaattgtaattaaattattcgaattgattatcccttaaaatttttttcttccctggtgtggttttatactaaagtgccaaatgtgaattggtttaaattagagttcaacattttgaaaaaagcatggattcctggacaaaaatacaaaacattcaggctaactcgaggcctgaacctgagtttctggaaatttgttttaaaaagcaaacagaggtttgaaaaaaatcaattaattttgaacacctaaataactaattacataataaattctttttaaatctattctaatcattttttgaaaacttgaaaaaaaacatcggttatttgaaatgataaattctaaggttttgtctaaaaaatccaggttgccgaaatatggcaggacctgggttcaggaaaaaaaccaagcctgggtccaggtcgagctctagtttaaatctaaattaaaattttaaaaaaatatattttttccttttcgattttatttggcgcttttcatattttccccatttttctatacatacaattcactagcttttccgtctgtgttttgtacacttttttttgcttttttttcacacaacccattgtaattgttggcttaattaccccccccccccctaattaagctttctcgtctcatttttggtggatgcccgcgggggcgcaatgcgcggctgccgtcacagcggcgttcgtgtgattattccaccgcgcaaggcagcggcaccaattcgcatcacatgccgttacctaaagaaggtgaattaattaattaattgatcctttaatttcaatttttatacttatgaaattatttttgaatttgaattttcatttgaatttattatttataatctttgttttttttaattataactttttcgttttaattaattctaacaataattaattagcttcaattattttaattgttttgatcacttatgatcattcggcttaatacaaaataaaaattaaatttatttttgaataaaaaatttattcaatttttatttatgaatattatttttaattttgcgagaaaatcccaattttttaagttataataaacacaacaatttaaaattcttttttttaaagtaattattatattatttgtaatttctttattaaataaatttaccattttctcaaatttttaaaattgccaggaaaaactgactcatccgccgccgttgagcgagggcgaagcgcttgcctcgcgcattttggagatgggcccgcacggggccaaattccttggcccagtgattctcgaggtgccccattttgcgtcgttgcgcggccgggagagggaaattgtgattttgcgctcggacgatggccaacattggaaggagcaccaattggaagccaccgaagatgccgtacag

SEQ ID NO: 51343 - DNA, 1120 bp, Heterodera glycines
  Genomic contig location: Contig_ID=SeqID_20777; Location=85..1204; Strand=+
  SCN-specific regions: Sequence locations=1-732,754-819,843-855,890 -1066,1117-1120
atggatccgagaaacggcttttacgacaaaaatgaggacaaagtgactctggccattgatgtcattgtggggcaagcagaaatggacagaccaatttctgctgatcaaagcaaatcgaaagggacactttttatggacattgaaaaagtgtcacaatttgcgcgagaaatcatttggagtgagcgcaaaagcgaaactgtgacgtgcttagggggacttccatggaaaatatccgttcaaatatttacgattatgggaagtgccgtcaaatgtttgagcctttttctttgttgtaccgctccaaaagaaggtgaaattcaaataatcatttgaaattatatttaaatttaagacgaaaattggagagccgaatgttcggcaaaattccgaattgtttcgcaaatgagcggagttggggaattcagaaaggaatttgagcacactgtttttaatagcgaaacgaactgttggggattccccgatttcatcacatttgcggtgagaggccaatttgacattgcttaattgacctaattatgacaattaaggaattaatggacccgggccgaggcttatacgacagagaggaggacaaagtgacgttggccatcgatgtgactgtgatgaaagagcgaaagggcacaaaacgaaaattggccgttggaaatgcccacccaatcattaatttgacataattctgtttttgtctcccatttttctctcattgaattgattaaaaataatttaaaggattgctttttagaattagtattcttggactggctaaatactaatagaaacggtgagccccctgttttcttttaaactttttctttaaaatttacactttcaatgaaattaaattttaaaaaccttttttcctcaaaattccagtccaaaaaattctgacgccggctacaacaaagaaattgcaaattttcttttgaaatagaaaaaaaaagtaaaattccgtaatggattttgaccacgtccatcatgtagagagagtaatcgatttactcataaattttcgggattttatggcccagccaagtaacagtttcagaaaaaatataaattaaaattaaaattttaaaatattttgataatttaaatcaca

SEQ ID NO: 51344 - DNA, 910 bp, Heterodera glycines
  Genomic contig location: Contig_ID=SeqID_20779; Location=702..1611; Strand=-
  SCN-specific regions: Sequence locations=1-6,147-292,326-627,650 -845,880-910
atgccgaggaaggaaaatgaagttgaaagcaaagtcagagaaagaaatgcaatggaaggaggtgagagagaggggagaggaacgaaagaaaacgcaaaaggaaaattagagaaaagaaaagacagacggaaagaaaaaaaggaaagtcggacgaaaacaaaaattaatgaacatttaatcttggccaacgaacagactttggttgaggctgtttgtggttttggttagcttcacgcaagcctatgcatttagtgaatggttggaagcgtacgccaatcggcgctgggcggaaagagggaaaacaaacaaacaaacaaatgtatatctaaaagaggcttccatcttgcataccaaggatcggcacgaggaattttgatctttttttgtttgatttttcgcatagaattcagagtaggagttggacataaaaaatacggacttaaattttgccaaagaattaatctattcaatgcattgtaaatgaaataagcacggctatactttataaaaccagatttctgggtaataaataaatttaaaacgggagaagccgtatttaacccaaatcagttcaagatttattcccgacacctttgaaagttggtaaaaatattttggtagaggaggatataatatattattaaaattacggtgcaccccaaaatctcgccgccgaaatctcgccgccaaaatctcacctcctcaatctctccgtccttaatctcaccttcccaaatctctcccaaacaaaatatcacctcccaaatctcacccccccaaatctcaccacaaatttcaaaaaaaaaatttcaaacttagaaatttttcaaggaaaaaattcttagaaaaatttttttataaaatttaaataaaaaaattgttgaaaaatttttcagcaatttttttttga

SEQ ID NO: 51345 - DNA, 1485 bp, Heterodera glycines
  Genomic contig location: Contig_ID=SeqID_20783; Location=57..1541; Strand=-
  SCN-specific regions: Sequence locations=1-4,26-167,211-265,297 -701,723-849,873-1181,1204-1485
atggcagggaatgtgagggcggagggccaaaccaaaaaaatgatagaccatttaatggaagaacgggtcggccggcgatcattcagaagcggagccatttgttttcttttctgatcagtcaaagagcggatttgtgttaaaagtcacagggaagtaattttttttcattttaaatgtgttttgttttcttaaaaatcatatctatttattttggcatttcgttttccccggatcacacggctcttcagtcagtgcttttaaattcctctttttctctctctctctctctctccctcctttttcctttttcttaatcattaatttttgtccttctctgctcattactgtaatttcgttgcaaattgcgtctgattactctttaaaagccattccattaatgggggacagagtttaacatgaaaaatggttgaaagtcgtcgcgcgcttcggctgggtcgccctgtccaaataaattacctccgtttttgatggattgtcaatttccccccccccccattttgtccgcctttttctcctcacttttcgcattatttgttcttgtgaaatccaaaattaatctttgtcctcgacttttgacctgtccgatcattgagcattatttacctttaattaatttgcgcaattcgtttgtgtcggcggtttaattcgggtccatttggacattttacgctcaaagaacaaagaatattttattaaattcaattaacgatgataaataaatagaattggttcattttagttttacaatttcttcctttttatttgtttaacttttttaaaattcttttaactccaattcttccccattttagcttcttcaaagccaagtgaattcggcacgagggattttgatggatttgctgaccgccaatcggagggatttgtccccggacgttgccgcgtgtttgaaggcggtcaccgcgctgctgaaccccgccgcttcgcccgctgctcagcaaacgtacgctgccggcggatgcgcaaatgtcggagcagcaaacgccgccgtaagtgggcgaaaggaaaagccgatgttcaaaagcaagtaaaatctcgtattttactttttgctagtggaaaaatctgacaaattattgcggatgaattaattataaacggacgcattaatatttttaattaattgccatttttaacattgccatttgctcattcattctttcaactgtttgccaatgtgttgattctgttcagctgtcgttgactgaacttggcgtgccgtccgtcgtggagagtccgtacagtggcgaagtgcacgtcgcatcggtgggtccgatttcggccatttgccatttgttgttttcctttttaaatttgaaattccaatcaattatgaaaccgcctaattgtctatgaatgaaatttgataccaatgcgcaaaaatggaagaagagctttgcttttgaatccaaaaatgccggtggcttcttaagttacataaataaa

SEQ ID NO: 51346 - DNA, 232 bp, Heterodera glycines
  Genomic contig location: Contig_ID=SeqID_20783; Location=198..429; Strand=+
  SCN-specific regions: Sequence locations=1-141,164-232
ggaaaacaacaaatggcaaatggccgaaatcggacccaccgatgcgacgtgcacttcgccactgtacggactctccacgacggacggcacgccaagttcagtcaacgacagctgaacagaatcaacacattggcaaacagttgaaagaatgaatgagcaaatggcaatgttaaaaatggcaattaattaaaaatattaatgcgtccgtttataattaattcatccgcaataa

SEQ ID NO: 51347 - DNA, 2386 bp, Heterodera glycines
  Genomic contig location: Contig_ID=SeqID_20784; Location=157..2542; Strand=-
  SCN-specific regions: Sequence locations=1-228,285-366,434-519,558 -606,628-645,682-931,975-1044,1066-1137,1159-1192,1252-1325,1348 -1369,1392-1677,1706-1806,1847-1913,1950-1959,1986-2072,2094 -2192,2229-2386
  Gene Ontology: Mol. function=protein binding; Cellular component =basolateral plasma membrane; Biological process=intercellular junction assembly
ccccccgaaattggcgcactgcgctcgctggtggagctgtacgtggacgagaacagtctggaacggttgccagacgccatgctccgttgcacaaagctggaacagttggacgcctcctccaacaagctcttcctgttgccggacgagctgggcgaactcggcgcacttgtggacatcaccgtgtcccacaactgtttgcgcgaattgccaaattccattggttcgtgcaaaatttttcaattttttttttgaaaatttcttataaaaaatttataagattttttcttgaacatttctaagtttgaaagtttttttagaaaaaatttggggcgaaattttgtcctgtttcgtttcctcaccccttcgaaaaattaaaaaaaaaaatattttttttcaaaattatcaatagaaaatttttatttgaaaaatttttcgagcgattttttacaaaaaattttcgatgaattttcgaatggacaaactaggtctgctcttctgtcagttcaaaatatttgtcagaaaattatttaaaaaaattttttatttcattaaattaacagtaataaatttcaggtcgcctgaagcggttgatgattcttaagtcagttttattttatttatttttttcggaattttaaatcactgacatttttcttggattaattggcttaaaataatttttgtatatgtattttttttacaaattttagagccgacgacaacactatcgacaccctaacgccagcaattggcggctgcacaagcctgaccgaggtgtacctgcagcagaacttgatcggcgaattgcccagctctgtcggcaatttgaaggcatgtaaaaaaaaaagttctaaaatttttcaacttccaaagtgccgtaatttatgaaaaaataattttgtcagacgccaaagcaagaaaaaaagccgacaattaaaatattaatttttaaaaaaaattttttgaaataaaatgccaattgatacacaaattttctggacaattaaaagtgggagaagttcgtttcagttctagcgatcacccttgaaatttttagaaaatttatgaaaaaaaatgaataaatttccgaaaaattttcaccgagtttttcaaaattttatgcttaattaataattattcaaatatttttccaaaaaatcgctgaagaatttttcaaagatttttttcttgcaatttttataaagaaatttcttttttttgaaaaatttataggttaaatttaaaaaaattgttggggagggttgagggaacgatacgggagcgaaaactaatccgggaggggggaagaacccaccctaaatccgccctctccaaaaaatttatacaaattttttttcccattccaggccctgcaaacactgaacatggaccggtgccaactgcgccgtgtgcccgctctgttgggcgaatgtgcctcgctgaccgtgttgtccatgcgggacaatcagttgcacgagttgcccatggaaattggcaaattggcacgtctacgggtgatggacgtgtgcaacaaccgactcccgcatttgccctacacggtcagccagcaattgatgattaattggttggggaaatgggggttgatcaatttcaattttcgatggaattggcgattggtcggtctcccaccccctgaattttggaaaaaaaattcccaaattttaattattttttttaaatatatgtcgagaattgctaacagttggacccaattgggaagcagtattcattttttgcagagaaaattttcgaatttgtaaattctaaaaccttttttctaaaaagaaaattaaaaattttacaaaaaatatttaaaaaaaattttcacggaaagtataaaaaaagattaaaaagagaatttttatacgaattctcttaatgtttttattagcaaaaaattctttatttaaaaaatttatagaaaatttccgaaaactaaaaaattcattttttaaatttttcactgggtaggttaacggttttttttggagcgaaggcatattgatgcactccgataggtgtcgtccgggtatagttttagaatttactcaaaattttcaaggtaacaaaaaacaaaatcttccccttcccctgatttacgatgtgcctgtgatagaaatgccttttttgtgccattcggttcaaatccccccccctcccctgtttgtcccaaatttaaaaaaaaaaattttttttttcatttttttgcagctaaatgtgctgcacgagttgcaagcgttgtggctgtccgagaaccagtcccaagcactgctccgccttcagccggacaccgacccgcggaacggcgtcaaagtgctcacctgctatctgttgccccaacgggacgcatccgttggctcaaatg

SEQ ID NO: 51348 - DNA, 383 bp, Heterodera glycines; identical to SEQ ID NO: 51114
  Genomic contig location: Contig_ID=SeqID_20785; Location=507..889; Strand=+
  SCN-specific regions: Sequence locations=1-20,42-275,297-383

SEQ ID NO: 51349 - DNA, 742 bp, Heterodera glycines
  Genomic contig location: Contig_ID=SeqID_395; Location=511..1252; Strand=-
  SCN-specific regions: Sequence locations=1-121,166-233,255-295,317 -358,405-713
atgaaccaacaattgccgaataagcacaaaagagatgaattgaagcagcaaaagaagcagaaaaaggtcacttttcaggagccaacgaagaaggaagaaaatgcaggagacaaaacggaggtaattaataaataaataataataataattcgtaaatttaaaaatcagaggtcgcgttgtgcgtattcctaagacttgtgctaattttaaaaattccaatatggaaatttatgaaaaagttagaaattttccatgcgtttcatattcaaagtttttaataaattttctttgccaattatttttctcaatgaaataatttttttttcgtagaaaaaacaattaaggcatcaaataatcgattttatttttattttctcattattaaaatgattttttaatttttagtatcaaaacagggttaggttactaatttgaggcttttgtcgtttcttaggaaaaacccgcaaaaaattcttattaacaaatcgcattaaatactccataatttccagaaatttcccaggtctactctctaaaactcttttaaaaactgtcaaattttgaactttttagacaaaattaattatgtaattgcactaaaactccaattttttcttacaaaaattggctaaaaattccgaaatttgtggagttttggacagaatcttttacttcgaacacacttctgtggatttcacctcatctttttacccttttaaatcaaattaaatatttaaataaa

SEQ ID NO: 51350 - DNA, 6685 bp, Heterodera glycines
  Genomic contig location: Contig_ID=SeqID_395; Location=1455..8139; Strand=+
  SCN-specific regions: Sequence locations=1-78,103-152,182-202,255 -271,293-604,663-717,739-878,906-962,984-1094,1116-1307,1329 -1411,1433-1763,1785-1921,1950-2209,2231-2457,2479-2483,2526 -2540,2562-2735,2757-2848,...
  SCN-specific regions: Sequence locations=...2888-3619,3641-3696,3719 -4052,4074-4491,4513-4817,4898-4918,4949-5142,5164-5223,5245 -5317,5339-5715,5737-5875,5898-5926,5948-6040,6064-6685
attaaccttaataatgagaaaggacttaatcagcaacagaatcaatcagaaaaattagattcaaatgctttgctgtccaatttttattatttttattaatatgtagattgggttaattatatgattaaccagaataaaagaagatacacaagtttatattaatatattataatattttattgaactctcttcatacataagcttaatattaaatttaatttaatttgaattaaaaataaaattcataatattttcccagtaaatatgcaaaagttttctaatttattaaatatcggattattacactttaaatttctctctgaaaattgccgctgtcaaaaagagttaattggcattggtactgaaatatttcgtgccgactgtgcttgcgttttgtgccaatggcactcaaatacaatactcagttgaccgcgaataagtgacaaatcaatgagcacaaagccaacattttatgtttcaatgcctggagggcattgactaactgaagaaatgggcctttgtgccgagtgttttgcttctcggcattgaccattcgcaagctgctaatgagcgaggagcaccaagagttcattcttcaagttagttaattttttaatgaaattaattgtgatttattattcctttaattaatttttatttttcttgaaaaaagaagcgaatattttttggaaatttaattatttttcatttgtccctaaaggccattgcttttgacaatgctgaactgctcgccgagcttttggctgcgcggcctctgctggccaattgccatgacgcggacggaaggatgccgctgcaccacgcggcggctggcggacacgcgaaatgcgctgagattttgctcgggtccggaggtgatttaaaatttttaaattatttttaaacttaatccccctttttctgaattcattttttccagctgacgtcgatgccgttgccggtccgcaggacacagtcaaaactccgctgggattggcctccgccatgggccattgtacggttgttcatctgctggcagaaaatggtgctgaccttttttatgtggactcggatggccattccgcgctccaattggcccaaatgggtggccatgaccaagtggccacgctgttaattggcataattgaacgaatttatgccgaggcggaacggaaaaatcaggcaaaaattgggaagcaaataaaaatggggggggggggaaattttcacttccatcggcaccgccggccccttgtccctaaaaattatctggaaaaagcgatcgcaaaaaaagtggcttaatggaggactttgtaaatgtttgatctccccccccctcgtctgggcaatttactgataatttgaaaaatcattttgcaaatttgtcggttttatataaattgtgccttttcagaggctttgtgctgcttgtgttgatggcgaggtgggccccgtgttggacattttgtccgatttgggcccgaaaagcattaggaaacaaattttgaatgggcgatatccgggcgaacaaaagtcggcactgtttttggcggccgaaaacggcagggcggaaattgtgcgcgcattgctcaccgtacagtaccattccatcatttttgagcccagcggagacacggtatggacataaatgtgaatttattactatatttggaaaaggctattaattttgcttcataaaattctttttttatgtttaccaaaaatttttcatttcggttggccttaggccttttatttttttgaaaagtttccagtcataaaatcctttccattgttagcttcttcatgccgcaattgcctctcagaatgtggcaactgttgagcagattttgcacaaattcccatttttgatggatgccgtaaatgaggaaaagaatttgccattgcattgggcatgccggtaaagcaaataaattaattaataaaagcatctaaataaatggttagtttctctcatttccgatgcggaaatgcgcgcgtcgttcaggcacttttgagcgctgaatatcccgcggaggaattgaaatttttcgcgtttcggcatgaccgcgccaattgttcctttggcaatggcactgggacaaacgaacggtgtgaggatggctatttgtttgtctgtgatctgaatgctgttgatcgggaggggagaagcgcgtaagtgacagaagaaaacaatggaggaatcactgatcggagggggaggagagggaagtgatcagaaagggggataagtgatcacaccattgatcagagtgggagaagtcagtccgttcgaaatttatttgaataatatagaggtttgaaataaaaaaatggagaaaaactggcagagaatttgagccaattcatacaatgcaacaattcaattttaacaggttctttttggccgtaatggaaggccattctgaagttgttcaactgctcgctaaggttgtcaaataaaataaatataataaacaaagaaaacataatttaatcttaaactcattaacaaaaatttgaaatcttttgagttttactaattttataaataaagcaatgaattccataaaatgatttcattttctattaaagttcaaattgccaatttccaacggcacgcgccaccgcagagaaatgctcagaattgaggagaagcaaaatctgatggaacatccaattttgtttgatggacgagtaaatggcaaaactccactaatggtacaaaaaaagccattttgaaaatgtttatttttaatttccctctaatcttaaaaggttgcttgtgccaatggttccactgaaattgtcaggtattttcagtttattaattaattccctttctgtttatttttaaaatatttgcttgacaaattcaattaaattgccaatttttcatttacatgaggccaaatttgatcagaatttgtcagaggaacgtttaattgttaaagtgggaaatgaatcagaacacaaataaactagcaaataataatttccttgcagttgacaattttgtcgtaattaattggccattcaaaagaaaaataacaatttcacgtcaatagcttatgttttctgctcagaattttggtcgaacaatgccatgtcgacgtgaattattctccgccaatgagcggcggtgccggagaaagtggcggcggtgctttggccgaagctgcaaacagtggccatttggaggtgctccaagcactgttccaccaaggggcttttgactacggtaaccgtactctgagagggcggttggccaacgatagtgggcacagtaacgcggcggaaatggtcggccttttcctgcaacaattggtccatcatgacaacgaaaactgtgtgaacagtgcaaggagtccacggcaaaagaaggaacatgggcaacaacagcagcaggtgaagaagatgaataaatggtcattggctaattatcttttgcatttcaaggaccattctctagcactgccctttgtcgagagtttgttgaatgcctccaacaaagtgccattgtcggaccatttgccgtcaacaaaaggctgccaattgaattggcaatccaccggcattcgagagcttcgctcagaatggatggtcgatgcagcgcttaaactgaacccgcaaattccgcgccatttaaggtcgccgggttaataaatgccatggcattggcactttctccgctttaaaaaacaaaatttataatttagtaaatcattggcacttaatgccatctcacgcatcgatctgtcctccaatcagttgtgctctgtgccccatattctattcacccatttgtcctcgctccgttcattggacctctccaaaaattgcattccgcgctttgaaataccgccggatggtgcgaattggcaaatgccgagtctggacagactttgcctggacgaaaaccaattggaggaactgcccaaacaggtggacaccaacactggcatttgggcatttagctaagagccatttcaaagtttaatcccttcaatttaaattgtctgttgctctcagctgttctcttctgtccactttcctcgcctttgctttctctccgccactttcaatcgcttgcgccgattgcctccgtccgtttggacagcgccgcgtctcctcgagttgcacttggccaacaatttgatcagcgaactgagtgcggctgctctttctcagcaggaattgcgcaggggaagccatttgtacaggggcacgggcaccggaggcgcgtcggcggcacgcatttcacggcaaaaacagcgtgaggcggtggacggaaggtcagcaagggaaaccgagtcaagactgggccgaaaatccgagggtcacgagtggcaattaagacgcgtctcgaacaatcaaaatttgagtgttaatttggctgctgatcagtgtcaaatttggttagcttagatcgaccgaaatggacgaagaaaatcagcgacaaagtcggacaatggcgaaacggagggaatccccgacacagcaccaacagagcagcagcagaagggagtcaaggggagtcgcagctggcgaacagcaaacgacgagcaaaagccaatcgacggacacggaggaggacaacgcaagcgcaactccgaggggagcggcgacaaacgcagcaacggtcgtggagatggacatccacaggtgggcgagaggcgagagtcagtctcgaccaaattcattcccacaaaggcaacattcacaaaactgtgagtgccattcattcaccagcgaactatggctgttttatcgcaaataaaaaaatttacaatttcggtatttctgaccaaaaaccgtaaaaaaaagcataataattaaggttaaaaatattaagaaagaaatattaaaaagcataaaaatttaaaacaaaaataaagcaaatcccatatttttcgaaattacattaattttaaaaaatggaaataaatatctgacagattggtcgacaatttttaaattttagggtgaatatttggcaagagaaaatccacctgtccaacattgacgaagatgggccgacggtggcgaacgaagaagcgaccggcgatgaattagcggcacagaaaggcaatggcagtggcacaacgcgcagtcaaagccaactccaacttctgaacctggcacaaaacaaagtcatttaaaggcactaaaaccctaaaaaattagcgttcgttcagtttggccgaatgcccacctgcttggcctgctgctgtccccgtcttgccaagttggacctttcctccaattcgttgtcctccctcggccccgtcggctgtttgccgtcggcactgcgccacttggatgtgtccaaaaaccagctggtccgtctttttgggggtgaaaatccggctcagctgaggcaaaagctgcgcttttgcgaggctcagtccgaatttggaattgccggtgcgaaaatggacggcggtggcggtggaataacggcgggcaatatgccaatgccaaggcattcgagtgagtgccgaaaagacaccttaacatttgtgacattgctctcttaaggaagtcgctccaaatccgtggccagaagccaacgttcgttgagcgttgtgcgaaagagcggcggcggcgttggccgtgctgaacagcttcaaaatgagcaggaattgttgctgagctgctgcgtgcacaaatcacactgccgttttgaggcacttaaaacgctgaatttggcacaaaattcattggaatttgtggacattttgctgccaatgggcggaggttgaaattaatttggagaattttccgaatttattttttaattgattgaaaactcaaaaatgaaaatttagttttaatgccaggaaacaacacattgttttccggcactgtttcaggtgatggtgagaagctgttcaattggagagaaaattccgaattggtaattaattacattttttaattaactcaaacacattttgaaatttctgatcaaatgatgtttgataatcttgcttagtttattttacagaataattaccttttgtaacttattaatctattttttctctcttgtttttgtctaaaattaagcgcttttaattacaagattcatctcttttgttgtcgtttatcaattttaattgttattaaaaatttcagcttaagccatatgtgctgtttccttcgttgaccaattttgacctgtcgttgaatcgaattcgtcaacttccgaccacaatttcattgctcggctccttggccatgctcaacttggccaataacgtggagctggacagtctcgtgcccgaactcggccttttggagcgcctgtggaccatcggcctcagcgggtgccaactccgagcggaggaacccacgctgcaagcgatggtccaagcaggaagctacaaaacgggcgaagtgttagcgcaactccgacaacggcttgaaaagtgatgacattgccgggggtaataagtgtgataaattgtggcacatatttaaaaatggaaattccaaggcgattttcatgctgccccatttctctaatgtcctgatgatagctgtggcaatttcgagttagttttttcgtttagttcgatgccgtacccaatgctcaagctgatgttgcttggtgcctcgtctgtcggaaagagcacacttttgcaacaaattcgccttgaggggacactgtcgaagaagc

SEQ ID NO: 51351 - DNA, 1508 bp, Heterodera glycines
  Genomic contig location: Contig_ID=SeqID_396; Location=119..1626; Strand=+
  SCN-specific regions: Sequence locations=1-26,49-75,98-496,518 -614,637-831,854-1382,1404-1508
atgggcggagtttgtggaaaaagacgaaaaaattgggacaaagaaatggactgcaaaatgggatacaaagatgtagaacaaaaacttttaaatggcaatgcctttgcccatttcagcgcgagtaccaatccgtccagcggtgtttcttcacccggcgctgtcttttcctgctgttgtggaaagtgacggacggtgacattgcgttggccgacctgcacgactttctgctggccattcaggcacaggcgccgaacagttacgtgctaattgtcggcacacattcggactttgtgcgggagcaacctcatcgtttccccagtgactatttgagccaaatggacaagcaaatccaggtaaattgagcagagagataataaatgattagaaaatcagggggaaggcctctgatcagtaaaatgattggaaaactataagaaatgatcaatcaagataattgataactgctgttgaaataaaaccaccaaacactcgaccacaaattcaataaaatattcatctgtcgcttaggctgttaggacaaaggggcgggcaaaggatgaccacagaaatttgggctaagaatggacaaaaggagcagagggaacggcaccgaatatgggcagggtgaagaagggcgagacgaatatccaatttaaatatttatttcaaatgaaaggcacaaaagtgagtgatgatttagggattttggtccccttttatagcagaaaagaaacgtgggaggagcacttttggggaacaataagtgggaggaggcgtgggtggagtactttttttaggaaaagaggaaagaacatgatgaataattggacagaaaaacagaaaggacagagaattaccaaaaaaaccacaaattcaacaatctcacaaaatcgatcaaaggccaattagccaattcaattttttccgtcggccactgtgccgacatcatccaaaaatagcggtgaaaatttctcactgcttttcctttttgagcaacgcttcattttgggtgccgatccggagaagaacggcgttccacgagtgcttggatctctttacatttcgtgttgctcgcgcgaggatgtcagatcgttgtgtgccctcatttacacttgtgccacagaaattcggcaattttcacggggtggaggcccggcacggcagcgccttttggcacagaaagttccggcttcgtttgtattgctggaacatattgtggccgcaatggtcagaggacaaactccgttttttgccagttttgctttaaaatacttttgattcagtcagacgaatttcgtgccgttggcaaagagccaataatgcatttcaacgaattttggagtttggccactgatcggttggctcagttggaagaacaaaaggagcagcagcaggacaaaaagactagcaccacgaagcctgcctctggcactttgcactttcgtggtgcccaggactttcgtcaggcgtgtctgttcctgcacgagaacggtccgacttacccgtag

SEQ ID NO: 51352 - DNA, 1634 bp, Heterodera glycines
  Genomic contig location: Contig_ID=SeqID_397; Location=267..1900; Strand=+
  SCN-specific regions: Sequence locations=1-767,789-1050,1072 -1127,1149-1231,1255-1443,1467-1634
atgcaccaaaattcggtcatcgagtccgtcgagctgtacaccgcactcaaacgggcagttcgccacaacttggcggtgactttcggttaattttaaataaatttgctcccacataagcttctcctctcttccggcatttctcggccctctgtcgaagtgtccttcaattcccacttccgtctcttccgccagtgtgtcatgaatttgctgcgaaagttcgaattggccatgccatttcaatatggtcgaatgagtcttttggcttcttgtctgcctgatgaatatgtgcttcgtgccgattacccgggctcaaaagttttggtaaaaaatctcttttttttaatatctatttaaatgctttgttatttcgctaaagatccgaaataaatttgacaaattgcgcattcggtggaactccgaaaaagaaacgacaaaagcaacggaattagtgccgataaaatcgacacgaccaatgcctataaaaatgtcgccaattcgcaattatttgcagcacaggcgactgtcccgcgcagtggcgacgtcaattgacaatttgaacagcacaaaattgacggaaaacaacggaacgggcgaaaatgaggagaaaaatgctgatctgatcaagattttggcagttgatcagtgcaaagaggtgaggaaaagccaagagcaaaagctgattatgggtgatgaattagtgaccaattaatagcaaaagcctaatctaatcattagtagtatccattgacaaatatgatcaatcaaacgacacttaatggtacaataaaagctgttagaaaaagctaatcattactgatcatttgataagttgtagatagttttttttattagcaatcacagtaatgaaagttttaatgacaataaactaataattatgatcactttatcattactcgcaaaaaatacggatactataggcttttcttctctaggagtgtcttcgtcgtctttacgttatgcattacattccgcccggcttttgggcccgtctcaccactcggctgctcgatgacgaacgcgttggcaatgtgttgaccaaaatgttgctcatttcccgtgcttctcctctaccgcagcagcagcatatgatgtcgatgacggagactgatcagcaacaaaaacaaccattggcggcactttggagcacagaggcaattgttgcggcattcggacgagcattgaacgcgggacgaatggtcaatttggcacagcgaccatcgatcagacggtgattattcgaatcacaaaggattaaaaaaatttcgataaaattcggactgagtgaattaccattttgaagagacgcttccgccgccgatgaaatggaaaatgtgccggaggaagagacttcgtttattgttgtgaattcggcggaggaaatgactgaggagttcgccttcaactccaataacaaaggcaacccgtcatcgtcgtcgtcgtcgggcgggacggtggtggtcaaatgctgcgagcgcggcgtggaggcgacggacgaacgttgccgcggcacaggcggaggcatcggaaaagttggggaagaactgggcaatgtgctcgaatggatgttgtggcgaagcggtgttgaggtgggcgaggcattttgggcagggtag

SEQ ID NO: 51353 - DNA, 330 bp, Heterodera glycines
  Genomic contig location: Contig_ID=SeqID_398; Location=5..334; Strand=-
  SCN-specific regions: Sequence locations=1-81,103-238,261-330
atgaagcagctccttttggagaatgcgacagctgctggacgattggccaaatggcggaggacagcaaatgatccgctgaacggagcaaaagggacgaaaagcactgatcggagacatctgagaagagaatgcgctaatcatcagagttggatcatgccaatccaacaatcatcaacccaattacctcaattccgcgtacaattagcaccactccgttgcttgtgccaaccaataattgctcctcttcctccccctcgtcgcccttttcgttcctccatctttctttatcagtgccgaaagtactcaagtccatcacttccaacgcagtaa

SEQ ID NO: 51354 - DNA, 359 bp, Heterodera glycines
  Genomic contig location: Contig_ID=SeqID_398; Location=1..359; Strand=+
  SCN-specific regions: Sequence locations=1-74,97-232,254-359
ttcattactgcgttggaagtgatggacttgagtactttcggcactgataaagaaagatggaggaacgaaaagggcgacgagggggaggaagaggagcaattattggttggcacaagcaacggagtggtgctaattgtacgcggaattgaggtaattgggttgatgattgttggattggcatgatccaactctgatgattagcgcattctcttctcagatgtctccgatcagtgcttttcgtcccttttgctccgttcagcggatcatttgctgtcctccgccatttggccaatcgtccagcagctgtcgcattctccaaaaggagctgcttcattcgtcaaccaaaaaagcgcccttgt

SEQ ID NO: 51355 - DNA, 1361 bp, Heterodera glycines
  Genomic contig location: Contig_ID=SeqID_398; Location=460..1820; Strand=+
  SCN-specific regions: Sequence locations=1-289,311-318,348-488,514 -554,580-622,645-881,912-1115,1151-1361
atgatatcgcctcattcaccgcccaacactgaaaggcattcctccaagaagcgatcactgctgatcgaaaaatcccgttcaataatgctcaaagcaactggtggtgctgtagccggaactgctgcaggaaacggcgaatgccaaggccaacggccaaaaatgagtgcttcaattccagcggaagaaggaaagcagcagcagcagcaggtgaagcaatagttaaacaattgagaagatgaatttataaaattatatgactagattttgtaatttttcagttaaaaaattattattttgctaatgaatgctttttcttgcaaattttaaattaatttgaaaaattattagctgatttttcgtataggtggctttcgatttactaaacgcgtcagtttcggcggtagacgaactgtgcgaaacggtgcggagcggaatgcgcggcatttttacgtccagtgaaagtgccgaagtgcgtggcacagtcgccgataaaggaggaggaggagaagcatatttcattagcattggcaaaggatataggtgagtaattaagcaaattttttaaatgattttttgattctattgaaacaatttctgaaaatatcgtttcttgtgaatgaagtttaatttaattatttcaaattgtgtttaaggcctcttctgagtcgatttgtaagctctgctgaactaaaagcattgccaaataaacacagcgaagaaaactgtgccattttctttcggtcaacgacagaatggacaacggatcagcagaagaactgattgaaaatgatgcttttcaaaaaagagcttgtaaataaatattattcaatatctcaacagatgctttttgcgcatatgtaaataaaagctaattaactgcgaaattaaatataataaatatatttatttttgttaagacaaaaaacacaaaaagaaaaccattcattaacaaggcaaatttttaaaaccgtcaagaggcttaaaaatgtcaaaaaaggcaacaaaatggcgaacataaacctaaaatggcaccgcgccgacccacatacctgcttaacttttattaattaactcagattcgtagttttttggccaatttgctaagaaattggggcaaaattaataaaaaatttatagttaattttttattgccaaaaaatttgggacagtccaaatttttgaattgaagtttttctcttatttttttttgcttgacttttcataaaattagttacattttttagtttttcgttgctggcgtctgtgccaaccaaccaaaagaagaagcagaagagccgtggtacatcaccatgatgagaggcagtaaagcgagaaagtgccagcgaatgaaaagcggctga

SEQ ID NO: 51356 - DNA, 1689 bp, Heterodera glycines
  Genomic contig location: Contig_ID=SeqID_398; Location=1604..3292; Strand=-
  SCN-specific regions: Sequence locations=1-282,306-368,390-446,468 -571,598-735,759-838,860-910,932-1307,1331-1689
atggttaatatttattcaaatggcttgtatttttcaccggaattgttttttatttatttatttatcgataaagaaaaattgccatcagaagggcggagaccacttactctgatgactgatcacaataaaatagtctcagagtaagtgaataaatatcgagtgagatcacaggttaaaacaaacaataatgaaaaaataaaatggaagtcaaagtcaaaaaaaaaaaaatgcctcaaaagttaataattgctttatacattggtgctttgagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaatgacttatttcgagtatttaggttagttcttttaaacagaatttgggtccaaatgtgtaaaaccatgtaaaattttgtaagtagttaggaggtcaaaaatttttcttcgtttttcaagagtagctaatttaaaaaattggagccgttggtcatagggaatattttttccaaaaattttgtgggacagagggggggggaaattttgaaaatttgaatgcaatttgttaacagattttcaccaaaaactgcctaatttttgcgattttaagccatgcaacgactttttttgtttataaaatgggtttttttacggcgcgctttttaaaaaattttttgaggataggggggtccggaaaaatttgtaatttttaatgcgagttgtttacagatttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatattgttgaaaattacaaagatttctcaaatttctttgattttttttaaacttttccaaatgctcattttcaaggacgtccttgccattcaaggacggattccatccctgatcttaatattttcagaattgctacgtataattaaaaattcagctcgatcggttcatgtgaagtggtcaaactcccaaaaatagggcgtccttattctaattgaacacactgtatagcgccgaataatttatttccctttttggcagtgggcacttgagtctcgctggaaatggatatttctgtcggacgaaacccaactcgtagtaggccaactcgtactgtttttcgacaaaaaatcgtcataacttttgttaaagtcgaccaaatttaacattcttggtatcattcgagagcatttaaccttctttatctatctgcaaaatgcaagaaaattttattgcttttcaaaaaagttatgaccaaaaatcgtaaaaaaaaattttttttgaatgtgatttgccagcagcgacatcagccgcttttcattcgctggcactttctcgctttactgcctctcatcatggtgatgtaccacggctcttctgcttcttcttttggttggttggcacagacgccagcaacgaaaaactaaaaaatgtaactaattttatgaaaagtcaagcaaaaaaaaataagagaaaaacttcaattcaaaaatttggactgtcccaaattttttggcaataaa

SEQ ID NO: 51357 - DNA, 842 bp, Heterodera glycines
  Genomic contig location: Contig_ID=SeqID_398; Location=3352..4193; Strand=+
  SCN-specific regions: Sequence locations=1-353,375-842
atgtccttgcaaatcggcatacccgtccttggaaacggagcatggacgatggcaaccctgtttaaaccattttggatcaaaaatctgaaactcgaaaaatttggattttcgaatttttgttcgaattcagatccggggttcgaaattcgtcgaaatagatgccggattcgtgatcagcggcgacaccgaaaaccctgggaaacttgctttcatgtcttttgaaaacaaaaaaaaattcttcaaaaaaggggggggtaccatcgaatgtattaccaaattctctacaaattcgagtttattggtcctttttagccaaaatgcaacaaggtctcaattgggcaacacgacaaattttgcgacacctcagcagagcctcacaatgactttttcaacgccgcagaacaacaacaatttcaacaatgagataaacacacagtgggaaacacgacgaacacacaacacttacaaatgtccgttttcagaaccgtcgtgaagaggacgaggacgcggcagcagacagtcacaatggaaagcagcagccaagtggcgactgaagttgacgcggtgttcagccaagtgctgaatgtaagcgaatgccgtgaaagatggcaccgcttttctgacaatgagggggtttcaattcgtatttttccaggccaccccccccccaccagaaaaccaaagaattgtacacctttcacgttttagatccctcacatggacaacccgatcgaggagctgaaacgacaaatgcagaaattattcattcaaaaagagtcggaatgggccttcaaattgaacgaggtgaaaaattgcaaaaattcattgaaaaaatttacaag

SEQ ID NO: 51358 - DNA, 568 bp, Heterodera glycines
  Genomic contig location: Contig_ID=SeqID_3666; Location=189..756; Strand=-
  SCN-specific regions: Sequence locations=1-460,484-568
atgtctgtccaaccgaagctagtggtcattaattatccccttgggaattcttttggtgtatttctgaccgagccaaagccaatggaatggtcattaataaccccttggacgcattttgactgtataatgcccacggaagtgtcaataatatcccacttggaattgaggtcaagctgtgagtcaatgggggtgatttattgtgacagtgtgcccatgcaaaagaaccaagtcaaaggacccttttcgaagggacagatagtgtgtagctgttccctattgccggttaactttcagctgtgagtcaaaagggtgattaattgtgacagttgtgcctatgcaaaacccaacatcagatattctgggcttgagacggcgactcattttagtggtagtgtggcatagcatgaacaatttagttggcaacctggccaaatggtggtcgtataacccaaaacttatttgagggggtggtggtgacatggtgggcgactaggagggggtgggaaaataggtacttggggtcataacccaagcctaatgaaagatgaagagttgtagaaaaaataaa

SEQ ID NO: 51359 - DNA, 275 bp, Heterodera glycines
  Genomic contig location: Contig_ID=SeqID_3666; Location=1477..1751; Strand=+
  SCN-specific regions: Sequence locations=1-11,43-101,259-275
aaattattccctttattatgtttaattatatttttaataattgtcaaaattgaatcagaaaagaaaacgctgcaacaaaagtcatttggcgaaatatttggagaaaaatgggaagaaaaagaagaagaaaaaagaaatgaactcaaaaaaagagaaataattgcaaaatattataaaataaaagaaaaaataaagcaaaaaggaagaaaatattcagcaaaagaatggaataaaattgacagaaaaatagcgaaaaaattgggaacaaatcgaaa

SEQ ID NO: 51360 - DNA, 626 bp, Heterodera glycines
  Genomic contig location: Contig_ID=SeqID_3666; Location=2483..3108; Strand=+
  SCN-specific regions: Sequence locations=1-14,46-57,79-95,118-118,232- 380,443-626
atgaaattattccctttattatgtttaattatatttttaataattgtcaaaattgaatcagaaaagaaaaaattgcagcaaaagtcatttggcgaatatttggagaaaaatggtaatgttattttataagttaagaattaaaaaaatatatattttttttaaaaatattatttataatttattggattttttataaaaatccacaaaaaatagttaataaaaatttttttaggaagaaaaattggaagaaaaaagagaaacaattggaaaatattataaaataaaagagaaaattcagcaaaaaggaagaaaatattcaaaaaaagaatggcatcaaaattatgccgaaatttgcaagtgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacacaagaatggagtaagccgagaaacaattaagaaatggaagaaacaatttggaattaacacaacaaacagcgcataacgaagaaagaaaaaaattaaaaagttttgacaa

SEQ ID NO: 51361 - DNA, 640 bp, Heterodera glycines
  Genomic contig location: Contig_ID=SeqID_3666; Location=5100..5739; Strand=-
  SCN-specific regions: Sequence locations=1-62,84-151,174-247,269 -305,327-534,557-559,581-584,606-640
tttttggttgctatttatagaaggggtatataaagggagtgaaaggaccatttgattggtacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtttggggacgaaaagtctgatagactgtgaaaatgctattaaaaaatttatagaaataattaagggctcggggtgtccggggcttcttacaccggacacacggttgaaaatattgtttcgacctttaaattcggacgtgaaattgaactgaacgagtttcgaaaaaatcgtcgtgcattttatgaaccagaaatattttgcggtttaaatttcaagcggggtaaaagcatgacagcgttaattttctggaccggtaaagtcataattacgggaactaaaaacaattctgaaatagaggaaatgtatcatcatattctcccctatttgaaaatggctcaaaagaagttagggagacgataaaaatttttcatttattgg

SEQ ID NO: 51362 - DNA, 3579 bp, Heterodera glycines
  Genomic contig location: Contig_ID=SeqID_3667; Location=84..3662; Strand=+
  SCN-specific regions: Sequence locations=1-463,503-507,597-841,864 -1442,1465-2082,2104-2117,2139-2791,2813-3251,3274-3392,3414 -3460,3484-3552,3575-3579
atggaaaattataaattgatggattatcaaacgactacttgccaaaaatttggatttacgaaaaatattacggaatttcggatcaacccggacgtggaacgccccgatgaagcgatgaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaataagctggggcagagcggggacggggatgaaaataagaaaatgctgttgctctcggagcctattacgatgaaaattacatgcgttacaatgcccagtggagaggggccgaggaatgtccacaaatttgactttggattcaaggaacaccagcggatagggtaagtgttttaataaaataaaattaaaatagaaaaaaactaaaataaaaaaatcaataaataaatttaaaataattatttctaaaaaatttaatgaagcacaaaaaaaaaacttaaaatatttatttttaaataatttaattaggcaaaaaaaagtaaattttaggattgtgaatactgataataaattttgccttttttacgcactggcgtcgtcgatgaattatttaattatggaccgttttgaatttaatcgatttatgaaaaatattgtgagacagagggatgcagctattgagcttttacgtaattgtggaattgatggaaacgaaattagttatggtgtggagcaattgccgaatgttcagaaatattgggtgggttaaatgaaaaaatgcaaaattaataaatttttcaggatgagatttacccaggaaagtaccgggttgtggcatttgagaagtcagctgatccgcggaaatcgatccgtgttttgtggaaggcccctatgggacgagagaaggtcgtaccgatatttttggagaatggtcactgggatggtctgaagaattatgtctgctttttcaaccgtgggagaaagttctgcgttgaatgtgaatgtttttacgatcaggatgtttatcatacgatggattgccgggcgagatgttattattgcaatagagtggggggaatgccatgtgaaaaggagagtggagtgaagattgaatgcccgaagtgtcgacgttacttttacaattgggagtgttataattatcatcagggacatcagacttgcaaattatggaggcgttgcgttatctgtgacaagacttatcgatttaacccgaagaaggaacatgaatgtggtgagacttattgccagctttgtagtgtgagccatgaccccaagcgggggtgttatattatgccgatcgaggagaaggaggaaaaatatgtctacagaattgtagtttgggtaagttctacaaataaaatcaacaaaaataagtctttaactccaggattcggagacttcgcaggattctatttacaagggggaccagaaggagcatgttattaattatatttcggtgagagttacgtgtacggaatgctgtgatgacaaaaacaggatgaattgcaaaatttgtggggagaagaggatcaaggattggagcgaggcggagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgataccgcttatcaatggattgaaaatttatgaatttaaagtgcgaaactcgaagaaacattcaatgctgatatggagagactcatgcttattaatgccggtgaaactcgagtcgcttaaggcgaccttcaatttgggctgtgaggacaagccctttttcccgtattactacaataagaaagaaaattatggagtttgtttggaacatctgccaccaatggaggactattcaccggggtctatgaacaaggagaaatttgcaaaatttgaaaaatggtaagaaaagaaggacaaatcataataaaaattctttttcaggtacaacgagaacaaggggacgcccttttatttggatgaagaattgagaaattattgcagaaacgacacggagatattgctgttatcgattattgagttcaggaggatattgattaacgatattactaagggatttgacccactaccgaggagttgtacgaatgcgggggttgcgatgaatatttttaaggcaatgtttttgttgacggagcagttatcgattgtgccggagaagggatatgagcggtgtgatagagcgagtgttatggccattaagtatttggagtggcggagcaagcgtgatgagattgagatacggcatgcggggaacggacgggaggtcaaagttgggaattacaaattggatggatttattgcgaataacggagctagggacaaatgcatcgaggttatgggatgttacatacatggatgtatgagctgttatgacccggcagcggaactgattggaggaaggacggcccaggaattgaatgatgagacgcaggagagattggcggagctgcggaagactttggacgtcgaagaagtttgggtaagtttatttgacatttacatttttattgtgaatttttagggctgtcaaattgagaaggagctgaaaaaggatgaagagatgcgggacttcttcgacgacagagggaatgagaaagggccgattgatccgcggatggcttatgcgggagggaggactgggccgatgaaattgtatgcaaaatcggatgagaagaaaaaaattagtgtttatgatattgtgagtctgtatccgtctgttaattacgttacagcttacccgattggattaccgcagattattatacggaagagcgatgagattgatgttaattggacgagaccagaggatttgaagtataagggattgtataaagtgagggtcaacccgccgcgggggttacgggttccggttttgcagctgaagtgtgatgaacgattattgtttccgtctatgttggagatgtgcgtcaaaatttaagaaggagactacgagatgtaattacaaatgccctcatgatggggcacagcggagatacgtggcgacatatactagcgttgaattggtaagaatttctaagaaaaaatttaaagaaaattaggacatttttcaggcaaaggcgttggaatgcggttatactgtggacagattttatagagcgtgacactacgaagaggaggcggatgatttattcaagggatacgtgcgattatttttgaagctgaaggaggaggcgagcggttttccgaagggagttgagacggaggagcagaaggatatgtggagagaagaatataaagaaaaatatggaatcgaaattgagttgactaaagtgaagaagaatccaggattgcggtacataagcaagttgatgctaaatagcttatgggtaagaaaattaaaaa

SEQ ID NO: 51363 - DNA, 656 bp, Heterodera glycines
  Genomic contig location: Contig_ID=SeqID_20789; Location=1153..1808; Strand=+
  SCN-specific regions: Sequence locations=1-193,297-656
atgtttcgtcgttcggtcaccaattcgcttcttccttcctccggcaatgaccatcgacgccattctcatcagacaatcacagttgttgagaatagtcggcaccgacgacaacaaaaggaggacgacgaccggcggatggacgcatcggaacaattggcaaaggaaaagacgtgccgatggagcgacattttggggggatggagcggaaatggcggaaaagggagggacggacgaagggaaagtgacggcggagacagcgcggaagaggtgggaaaagaaagggacggaaggaaaagtgccaacggaattaccaatcgaaattaattaaaaaagcatcgtttgggcgatattttccaaattcggaggggggggggagcagctgctaattgctgcttctgctgctccattagtagtccgattgatcagcagaaaaagcgtttcagctaatcgctgcactgaaaagcctccaaagcaccggaaaaatgacagaaaaagcggcggaagcgcagacgaaaggggccaaagcattggcaaaatgggcgagcaaaagcaaaaacgaagcgatggcggacattgtgggaagggtcagcgaactgatggaaatgcacgcggagagacagcggacattcgccaaagactacggccattacctcaaa

SEQ ID NO: 51364 - DNA, 667 bp, Heterodera glycines
  Genomic contig location: Contig_ID=SeqID_20790; Location=1152..1818; Strand=+
  SCN-specific regions: Sequence locations=1-192,215-227,258-667
atggtggcgggccattccctggccaccaacagcgggtgtgccgcggtgtccgctctgccgcttcaccacgctgttccgcctccgttctcctcgccgctggtcgtgcagcagttcaaccaacatcgccatcagatggcacttgcgctggcaggcatcaatgccaatgttagacattttttgattacattggctgatcattatggaccaattagaaattcaatcgtttgtccttcattatctcatttaattttaaaatagctgttttctgttttccaggcacataattccaatgcctttgacgccgccaccgccgcagtgccatttcaccaacagtccaaccaaaagcatgaacagagttgttctactgaagttccagcggtacaacagcaaattatgagcacagagtcgaaacaaaggcagccaaattcaattggaaatgtggtaattaaataacaaaacgtttcgccctttgaaaatgaatcggttgtttttctgttaaacagcaaaagacggagcagcagcagcacttcttcgcctcctccccgtgcaattcctcgtcgactccgccaaattcgtcctccgcctcttccaccgcttctctcactcgcttaattctttctttccttccaaacaccgtttttccgccgccaccttcctctcatgctta

SEQ ID NO: 51365 - DNA, 388 bp, Heterodera glycines
  Genomic contig location: Contig_ID=SeqID_20791; Location=87..474; Strand=-
  SCN-specific regions: Sequence locations=1-388
actacatcattcctacaccagacgttgaacgtggcatttggatgtaacgaacaaatctactctccacgtgagtaaactgtttcgtagtgggcgcgtctgttaaaaattctttttagactacatccttcctacaccagacgttgaacgtggcatttggatgtaacgaacaaatctattctctccatctgagtaaactgtttcgtagtgggcgcgtctgttaaaaattcattttagactacatccttcctacaccagacgttgaacgttgcatttggatgtaacgaacaaatctactctccacgtgagtaaactgtttcgtagtgggcgcgtctgttaaaattctttttagactacatcattcctacaccagacgatgaacgtggcattt

SEQ ID NO: 51366 - DNA, 1301 bp, Heterodera glycines
  Genomic contig location: Contig_ID=SeqID_20792; Location=1562..2862; Strand=-
  SCN-specific regions: Sequence locations=1-559,581-833,859-996,1018 -1301
  Gene Ontology: Mol. function=acetylcholine receptor activity; Cellular component=nicotinic acetylcholine-gated receptor-channel complex; Biological process=synaptic transmission
atgccccgttgggtgcgcttcgttttccttaaggcacttttttcgcaatttcaaattcaaatttcaattgatcacatggccaatgaatgctttgtttggcttttgctctgttcagcttatgccccatttgctttgtatgaaaaggccgtcgcccgcaattaatcgtttggcgtggcacgcgacggacggagccgactcggacggtctcaccacccttcccggggttggccaattcactgtgccgctaaatgtgtcatcggcacaccacccgaattgtccggcggccggcaaaagggacaacaaaatggagcaaaaaagtgggacaataaagcatttgtgcccattttctcgtggtaatgagagggcgggtgggggcgacaaccggcgaacaattacaattttggaattttgccgtttttaattttctaatgttccgtttagacaataatgaagctgagtcggctaaaggcgaagcgacggaggaacaaacggaggaaaacgaccggggaaaagccaccaaagccatcccattgagtgccgaagcggtaaaatcaaaacggcaaaatgccaaaaataaataccaaatgaatgaaggtccgtgcagtccattcaattgagtacattacggagcacatgagaagggaggagaagcataaaacggtgagtcagccgaagcgattaaaaacaattgcatatggtggcgcacgaacgaaaactaaaaataccgtacccagcgcaaagctactgtaaattccgcaaaaaacgacaaaaactcagggattggtctgagttagtttgttttttcccttttattttattttttatgtattccgaaattaataatttaattaataattagttcccatttcgctgttagcaccgcgacgattggaaatatgtggcaatggtcatcgatcgctttttgctttacgtgagtcaatggacatttagagataagcaattgcatgaagtatttgtttgtcctgctgctggacattcataaatttaactaataaacacgaacaaaaatgggagaaattagccacggctttgcatattcgaggagaattgtaagggaatgccaaaattggaatgggtgaataatgccaacgatttctcccaaaatgattccccccccctccctaattagtgccccttttccgttttgggtgtttttcggcgtcaccttcggcggcacaatcggcgtgctgttgtccgcgccgacagtgttcgaatcggtggaccaacaggcggttctgcaacggctcattcaggcgtacaacagcgggggacgactttga

SEQ ID NO: 51367 - DNA, 354 bp, Heterodera glycines
  Genomic contig location: Contig_ID=SeqID_20794; Location=199..552; Strand=-
  SCN-specific regions: Sequence locations=1-354
atgtcttcaatcaatcctaatgatttcctttccccttcaattttagcggcagcggatttcaaaatgcaagcgccagattggggcaactacgacaccaacggaaccgactacgactacatctacaacaactcggacgaacgggacaactggaacagcgagcaggccggcgtgttcagacatttagtgacccaggtagacgacgcgttgttcgatgaattgttttaatagaaattctcttttcagctcggcaccactcagactctgcagaatttggcgctgcccaccttcgtgctggaacgacgctctctcctcgaaatgtacgccgacttcttcggtgaatacattgctttttaa

SEQ ID NO: 51368 - DNA, 915 bp, Heterodera glycines; identical to SEQ ID NO: 51017
  Genomic contig location: Contig_ID=SeqID_20795; Location=62..976; Strand=+
  SCN-specific regions: Sequence locations=1-20,42-275,297-552,574 -807,829-915

SEQ ID NO: 51369 - DNA, 1042 bp, Heterodera glycines
  Genomic contig location: Contig_ID=SeqID_20797; Location=233..1274; Strand=-
  SCN-specific regions: Sequence locations=1-164,187-503,525-539,561 -1042
tgcttggctgctactggcacggctgtgagcgctgttttgatcccggcgacaaactggtggacgccaaatcatgcagagaactgaatgaggagaccaacctgcgattgatgcagcttcgtgaaggcgatgtggacggacaaggcttgcaggtcgaagcagtttgggaatgcgaaataaatgcgcagttggcctgcaatgccgaaatgcgagcctttttctctgatttggggatggacagagggcctattgaacccagaggagcctattttggtggaagaacgggcccattgaagctatttgcagagccaaaggaggacgaaaaaatatcagtttttgatatcataagtctgtatccttttgtgaattatacgtgcgaatatccggttggtataccgaccatcatacggccaatggccgatgaaatgtgcgttaattggacacggccggagcagttgccataccgcggcattctgcgtgttcgagttgtccccccacggggtctgcgcgtcccggtgctgcctgtaaaaattgacgagcgacttttgttttgctgttgtcatcattgtgcaacgatgtttcgcaaaaaaagcacgcgccgcccacataaatgtccacacacggatgcacaaagatccttcaccggcagctacacgcatattgaactggaaagagcacttgaacacgggtacaaaattgatcgtctttggagagcttggcactatgatgaatggtaattgtctttctgtttaaattgtatgcgatattttttttctctataggagcgaccaaatttttaaagattatgttagactgctcatcaagttgaaggtttgtctgcagacttttgacccatctgtttaatcatgtgtttttttgttaagattgagtctagcggtttccccgagggagttagcagcgcggatcagaaacagcgctatgctgatgagtatcggcgcatttacgaagtaaacattgaattggagaatgtgaaaaaaaatccggggcttcgattcattgcgaagcttatgcttaacagtctctg

SEQ ID NO: 51370 - DNA, 63 bp, Heterodera glycines
  Genomic contig location: Contig_ID=SeqID_20797; Location=1496..1558; Strand=+
  SCN-specific regions: Sequence locations=1-63
gctcatacagatgcttaaaacatttcttctccttttttcacatgatcacacaatcaatggttt

SEQ ID NO: 51371 - DNA, 608 bp, Heterodera glycines
  Genomic contig location: Contig_ID=SeqID_3669; Location=609..1216; Strand=+
  SCN-specific regions: Sequence locations=1-162,185-608
atggattcgttccaaggtaatatatgtttcgcttgataaacataaacgaacttagggtcaattggttgtcctgtttagttccgtgttttgatagttataggtgaatccgttgaagaaattgagcaagatggatcattcacttcgttgtacatttctttggacaaatcaaaagaagtgtttggggaatccgaagctagggtaaacttgaggccattgccacaattcgaatccattggactgagaacgcgtgtggccaaatacgcggaagcaaacgaaaaatgtttattgaccaagtccggacccgaagaatttaaagaacacacaattccgattcggcgaatggaaggcatagaaaatggcattccgattatagcgaagggtcgggaaaatggcattggtatttacatttcgcttttttaacttgaataatttccaattcagatgcaaaacaggtcataaagcccgtggctggaccggcagaagcgacagacatttccacaaaacagcagcggatgccacgaatgcaagtcgccgccacccctcctacggaaaagccgaaaacacggaagcgaaagtacgaactcgactttttccttagcttctcataa

SEQ ID NO: 51372 - DNA, 356 bp, Heterodera glycines
  Genomic contig location: Contig_ID=SeqID_3669; Location=115..470; Strand=+
  SCN-specific regions: Sequence locations=1-270,292-356
atgccaacgcatccacgcggcaaggaagcggctgaactttggctgaaacacttccgaagggaattggaagagggacgagagaggcgaaggcaaatgttcatggtcgcaatgcgcaaacaattggacataatccgacggtaccagcaaggcaaactgcccaaagaggagttggatgcccttttggaggaggcacgacaacgggacgcacaagttgtagaacaagtcaaattttaaacaatttttgattttagcgtccagacaaagagcagtacgaagagaagattaaacaacacatggcaaaggcttatttcgaagatgttaaaaacgtacaccttttaacattgtttcaattgtaa

SEQ ID NO: 51373 - DNA, 658 bp, Heterodera glycines
  Genomic contig location: Contig_ID=SeqID_3670; Location=359..1016; Strand=+
  SCN-specific regions: Sequence locations=1-658
atgtttgccaacgcggttatgtacaacagtaccggacattatgtgaacaattacgccaaggaaatggttgcgtacgcattgaaatgcattgaggtgagcagtcaaatccaaatcattcatctcatcaacttcttgtctatgctcaggttgttcagtttcctaccggccaatttcacgctccgccgcccagtcgccagagcaatggcagttcctccgaggggggtgcaattggcggagggggagcagcaaaatttaccattgcttgggcaacaactctgattaagccgaaaggggtggaccaaaagaaggcaaagggtcgcaatgacgaagagttgaccagcagcagcagccaggacaaggagagggaagtgagtcaatcaacctacgcaaaagccaatcgtaaatgcaagcataaaagcgacgttttcaggcagatcaacgcgatgaggaggaaacacgtcgtcttttccaacgacgtcgaatgtataacaaaaagtacacatttacgtctacaatttaatccccttctccaaatttggtgcatttcaactgctctctctccctttattcatttatttgtgctcaaattatcatactgaaatgcgacacttactaccactcattattgatgttagcaatttgtattttccattttcaa

SEQ ID NO: 51374 - DNA, 250 bp, Heterodera glycines
  Genomic contig location: Contig_ID=SeqID_3670; Location=1931..2180; Strand=+
  SCN-specific regions: Sequence locations=1-250
atgccagccactgctgctctgtgggtttgggaggctgatcgcgactacgaacgctgggaagggtcgcgggtgttacgtgagcgccgagttccaaaatttgtgctcccgcgaacggtgcggattcgctatgttccgcttgcatttataaacttttttagattttcgattggtctgactttgattatgctcaacagatgagaaaggctcctaccggttaaggaaaaagactatttacctaatacatatttga

SEQ ID NO: 51375 - DNA, 842 bp, Heterodera glycines
  Genomic contig location: Contig_ID=SeqID_3671; Location=720..1561; Strand=+
  SCN-specific regions: Sequence locations=1-294,316-325,347-387,409 -778,802-842
atgcaggtgtttgcaaattatgcaatcaatctaattgaggtaatttctctaaatatctaaaaaatcattaaatgattacagatggaaaacaaatgctcgcttaaccgcgttcttattgagatggtcaaaatagaaaatttatggagtgaaaaatcttcatccgacaattattttatacaagcactggcaaaaagtggcttggaagcatttaggcgcaaaatgtgtgaagttttttggcaaaaaaatcctacaattgttcaatgtgcggcatttttggaccctgcggtcaatggattattgagtcaaatttgccattcgaattctaattggggaacccaaacaatggttatgagtcgggatttttgaaattttaaatgtataagaatattaagatatttgatgtaattgtcagcgccgctaaagagcgctttccacaatgcacacaaattgccagaaattttgaactttcaccgagtttgtcatgctttcaacagactcctaaaagttgtatcgaagcagaaatgattttttacagaaatctttgcgagtcccttggcgggaaaaagataaatctgcttgatttttggaaagaaaattcaaaaaaacttcactttttgtcttctttggctatggagtttttgtcaattcccgcatcatccacatcttgtgaacgaatttttagccgtttttcaccgctggtttatgattatcgtcgtaatcgctttgaccctttcacaatttcacgccttatttccctacaatcattgtttcgcgatacttaatttatttttaaaaaaatatcgttaaaacatcgtttggcgttgtgaacatcgttataatta

SEQ ID NO: 51376 - DNA, 1882 bp, Heterodera glycines
  Genomic contig location: Contig_ID=SeqID_20798; Location=1106..2987; Strand=+
  SCN-specific regions: Sequence locations=1-507,537-953,975-1065,1088 -1608,1630-1882
atggaaagtgattcgaatccgcaacaacagtctgtgcctgtgcagcaattgccgtccgacgcttcgccccaaccgcagcaaaacggcggcggagattcggcggacaaaattgggccggaccaaatgcgtttgttgagcgcacagatcgccgcatacaaaatgttggcccgtaatgagccggtccctcgtgcactgctcagagaggttcgtacaagtccaaatcattcatcgtcggattggcacagtgccaattttgcgggtgtcgaaaccgcaatttctccgattttgaaatccatttgttttttaatgggtttgtttaattaaccacgtaaagttcggcacttaactttccggattgaattacatctgggtcttggttttgccggtgatttctctcaaattccgaatttggctctaatttgccggtctacgattcggagtaaagaaagtcgtatggttggagacccaaaaacaatcgaaaaacagtattattttaaaaaacggatttttcttcctttattttaacccaatttctcagcttttaatggcactcaatccccacaacaaaactttgattatttggatgtgtaggggggtacaaaaagcgatgaaaaacccataattttgcaatttttaaccaaatgtttaccattttttgcacaggtgagcgaccggaaacgggacgacacattgccgctgccgtatgagtatccgtacgaattgccggacgggcgcaaattgccgtacgatttgtccaaaattttgctgatccaccagcagcgtacaaacacacggacaacggacattccgacaccgcctggcattgacccggaagtggtgctgcgcgagcgcgagaaccggtgccgtttcattttttcggacaaaacgcttttttgaatttcgaaatgtgcaaaattagttttcataatttttgtcgaagtcaatcaaataaacatttttcatgagggaatgaatgggttagcaattctgggctttcacctttctcacttgtttaatttttcagtaatttctaaatttttttgtggaattttcagcttttgcacactcttcaaaatgttcattgtttgtgcacattttgcaggattcaaaatcgcatcggcctgcgcatccaggagttgcaatgtttgcccatggacatgccgccccatttgcgcatccatgccgaaattgagttgcgtgcactgcgtttgttgaacctacaggctcaggttggcttttgccgggttaaatttcgacagggggttggatgatattcaaaaagggcaaaaaacagccattccgattcatattactttaaaaaggggaggaggtgaaagttgtcagcggtcgcagtcatgggaaaattggaaatttttgggaaattcgggtccgtccgccccaattgatggcaaattttgtgatttttaatgaatttattacgaaaaattttcactccctctgttttttttgttgtatgtttgggtggaaaaagcctaattcaataagttttcgtatttaaactcgaaaacggggtgtaaaatacgaaaaattcgagaaattgttaccatggatagcttttaatttcataatttgaatttgcccccaggtccgtgccgaggtgatggcctgtctgaagcgggacaccacgctggagaccgcgctcaacccgtacgcgtacaaacgcgtcaagcggcacacactgcgcgaggcgcgggtcaccgaaaagttggagaagcaacaaaagcaggagcaggagagacggcgacgccagaagcaccaggatctggttgcaggtctggttttgatgacgaacattcacgaacaaatttttttttttgaaattcgaggcagcttcatgccccctccccgaaaatttgaaaaa

SEQ ID NO: 51377 - DNA, 753 bp, Heterodera glycines
  Genomic contig location: Contig_ID=SeqID_20799; Location=59..811; Strand=-
  SCN-specific regions: Sequence locations=1-236,269-410,433-473,495-753
atggtgtgtcagtgaagaaaaattaattcgccatttgcttgaacttaccgaacgcggcgcatttgacacggacagagaaatttcactcgtaaaattaaatttcgtaaaaacattttcaatctcccagtacgattttaattgtagctgtttttcgcgctttgttcttttttgatgaatttgcatgtcagaatttgtgtcgcgttcaatccgatgccaaaatcagtgagaaagtgcaggaaaaagaacaatgtttatttattttattttagcttaatgaaacggaaaaagccgcaaagaaaatcaacaaatgtaacgaaaaggaaggaaaagggaaattgaaaaaaggtaattttgagagggaattttaaattaaaaaaatgattgataaagagcaaaaaggaagcgatttggaagagaaattggaagaaaatcggaggacaaaacgaaaagggaggacggaaacgaaagcgaaagagacaaagggcgaaagagagacggacagagagacagcgtattggaacgaatattgggacgaggagcaacgacgatggatatgtgagacacagcaaaagccataattggcaaattaattggccattaagtgccttccttaaggcgtcgaccctttccattgtctcgtcgatgagccgaaccaaattgagcccaatttcggattttcggctaatggcactcacaaaattctttacgttttggccatcgacagcggtgggtcaaatgatttaaacaattaaa

SEQ ID NO: 51378 - DNA, 841 bp, Heterodera glycines
  Genomic contig location: Contig_ID=SeqID_20799; Location=1364..2204; Strand=-
  SCN-specific regions: Sequence locations=1-841
atggataaagaaaataaaaagcgaaaaggtacaaaaagatccaaaaatcccgaaaaaacttcgaaacaaagagaggaaaaccaaaacaaggaaaatgacgatgaatttattcatcccccaaggagacgttcagcgaggtaaaatggaaactcctcgtatttattattaaccaaatataaattcaggttaattgcaatttcaaaacctgctttatcgagtgatttgtcggcttcggctgaagattttgttcatggaaaagggacgaaaaccgcaaaatcggaggtgtttggaacggatgctcttttcggtgtctcttcggcttctttcacttcgcctttcaattcttatttgacttcatcagttgaacccatcaaattgtcttcagatgaagcgactgtttcttctaatcggtcccttacaaagagacttaacgcaacaaatattcaaaatgcccaatcggttttcgaatttaaataagtattagttgatctttgatctactcagctcggtgaaggaacttcgaaggcgactttacctctttcttcggatgacgatggcgaggaggacgaatggggggcaatggaattattacacacggacaaaacggagaaaaaagtaattgaggtaacggaaaataaatgttaatttgtcactatcaaataaatacaatttttcaggtcgaacttgatgaaaaacactcaggcaagtgaaaaacaatgtcgtacaattagcataattatctgattgatttttcagatttgttcaaactgcagataaatccgttgaaagagagagacgcaaaagaagcggaggaaagggcaaaatgggagcacgaaattga

SEQ ID NO: 51379 - DNA, 884 bp, Heterodera glycines
  Genomic contig location: Contig_ID=SeqID_20800; Location=397..1280; Strand=+
  SCN-specific regions: Sequence locations=1-208,230-381,403-638,685 -719,741-745,780-884
atggcccatggcgaaaaggcgacgacatcaggcggaaatctgaaggccccgccaatggaggtctacctggaatggattgccaatgcatgggactcgcttccaaagcaaatgattgccgactcttttttgacgtgtgggattagtaaggaagaaaaaggccgacacgacgacaaaattcacgtttttaaggtcctcaagaatgttaacattttttgaaattcttatttttagccggacggagcaattcctaatgggctcgctattttgaagcaacgccgacaggaagaagatgtactgaaactggtggaagaaatcgatttaagcgaagacgaaagcgacgaagaaattgatgcagaagtttcctaatattttttttgttaatgttttattaaaacaaattgttcaatagtttttgcacgtttctgacttcaaaagttttgaaaaaaaatttttttttgaggggggcttatattcgaagggggcttctactcgaggggggcttctatttttcaacccccctacaaggggggcttatattcgagggggggcttccattcgagggggggcgtataatcgagtaaatacggtatatattttttttaaaagaaaatcaatgtcattatttcggtatgtttaacaattatattctaaaattaatttttgattttaaatgttaaatataatgtattgagtcaattttctaccaagttaatacaaatataattctttaaatacttaatcatcgataaaatttctaatattttttatttacttattccaaaaaacacaaaattaattggctgtttaaaattcatacgtgaaaattggattatgcatcgcaaaaatgttgcttcagatttttgcatttaaaaaaatcattgaaa

SEQ ID NO: 51380 - DNA, 159 bp, Heterodera glycines
  Genomic contig location: Contig_ID=SeqID_20801; Location=90..248; Strand=-
  SCN-specific regions: Sequence locations=1-159
tgattaaaaaacgtacaacaatgattagaagaggtgcaacagtgattagaagaggtgcaacagtgattagaagagttacaacagtgatcagaagaggtacaacaatgattagaagaggtacagcagtgattagaagaggtacaccagtgattagaagag

SEQ ID NO: 51381 - DNA, 212 bp, Heterodera glycines
  Genomic contig location: Contig_ID=SeqID_20801; Location=607..818; Strand=+
  SCN-specific regions: Sequence locations=1-212
atttagaaacgggcgcaagcgcccgtctgaggccgcgaagcggccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggtgcgtagcgcccgtccaaggccgcgaagcggcctaa

SEQ ID NO: 51382 - DNA, 869 bp, Heterodera glycines
  Genomic contig location: Contig_ID=SeqID_20805; Location=146..1014; Strand=+
  SCN-specific regions: Sequence locations=1-75,98-516,538-835,867-869
atgaaaaccggaataatattaacgttattaatcataaaaaattcatttcatcaaacttttttctctaaattagaccaaataaaatcatttaatgaaatatttggccacggatggtccgatggagaagagcaaattggagaaaatcagactgaactggccggcacaagtcaaagtcgtcgaaatgatctggaaagaaatgatttacaatcgcgaattgatcaaagccaaataaatggacatcgatacggtaagcgattttaatcggttgagccttggcccgcaacagtcggagggataatctttggacataaggtagatgctcttggatcagcttgaatttaatggattgatttgcatgatcaaatttaatgcttgatttagcgcattcggttttgaatagggttggcaccatgggtatctgtcatccggcacccggacagatttggaaaattgagatattgggactccaataaatcgtaaaattttaatcattcaataggaccaacggaaatagactaaatttgttaaataaatggttgtattaaatagtgaaaaatggcctttagataattccttctccaatcacttcgaaaatgtaaagcaaaaatattctgacttggaaaaattggaaattgtaaagaaatttttcgaattaaaagcaaaacgagtagcagcgaaagataaagcaaaattaaatgagcaaattaacaaagaaattgccaacgaattgggcacaggagtgacaacaatttacaattggaaaagagaatttaatattggtgagttaaatggaaaaaaaatcaatttacttagtagtaattaatgaatacattcgatttatttagattaaaaatatttatttaaaacaa

SEQ ID NO: 51383 - DNA, 836 bp, Heterodera glycines
  Genomic contig location: Contig_ID=SeqID_20805; Location=1171..2006; Strand=+
  SCN-specific regions: Sequence locations=1-163,186-201,276-571,617 -702,724-836
atggaaaattttgatgaaactgagaaacaaaaggaaattgttaaattgtttaaaaaatataaaaagcaaaataaagaaaaaacgaacctcgaaattgctaaagaattgggaattcatcaaaataaactgttggaattcagaaaaagatttgacccaacctataaaagtaaataatttgagtaaaataagggaaattatgggtaaataaataataaataatttttaaaatgtaaaaaattaaataaataaatattaaatttaatttaaaaaatattcccaaaaaacagaaaagcttcttgcgaactcagaaaaaattgcattagtgagaaaatattacaaattgaaaagaaaattcccagaattaagccaaaacaaaatagccaaaattttgaagattagtaaaaatgcattaattaaatggaagcaacaatttggcaatcaatttgaagaacaaggtgaccaaatttaaaagattacgatgaatacagtaacataaaattacagtaaatgcccgggaaaatgacggtgaagcgaattccgaagaagacaggcattttttttatttgacagcaaaaattatgtaaattttattttaaacaattttattttttatttagtccaaaaaatgtctcatccaaaaatgctgatgagacaatttgggcatggaacaatgaaacacaaaaaagaagtcgaaaatgaacaaaacttattgctaaaattggatgaataaaaaagaagggatttaaaaagggaaaaaatgagagatattttttcgttcataacaaagtattttgtcgaattatttcatagacggtaaaaaagaaaaaaaagcgaca

SEQ ID NO: 51384 - DNA, 550 bp, Heterodera glycines
  Genomic contig location: Contig_ID=SeqID_20807; Location=565..1114; Strand=-
  SCN-specific regions: Sequence locations=1-333,355-550
  Gene Ontology: Mol. function=protein binding; Cellular component =nucleus; Biological process=development
tgtccatcaacaacaaagtgccaccgctgcgtttgctgtcctccaccaaacgcagcaaatgcaaccgcagcgcaccgtttgcgggcatggcaacggcggcaccattcacttgtggcatttcattcgcgaattgctcgaccagcccagggactacggaggctgtgtgcgttgggtggacagaaaggaaggtggaaaaagagcaatgataatttgaaatgggaccaaatttgagagagaccgttaagggaccttcaaaatcgagtcgtcccaccatttggcgcgtttttgggggctgcgcaaaaatcgggcggcgatgaattacgacaaagtgagtgggaaaagcctttgccatttgaaaccttttgcaattgttttgtctgatcagttgtcgcgatcacttcgccaatattacaaaaagggcatcatccaaaagccggagaagaagcagcgattggtcagttcgttaaggaaaggggaaattggcacaatcaaacaaaaaaatgaaacgaaaccaaaaaaggtgtacaaatttctgccaccgtacaatcag

SEQ ID NO: 51385 - DNA, 602 bp, Heterodera glycines
  Genomic contig location: Contig_ID=SeqID_3672; Location=352..953; Strand=+
  SCN-specific regions: Sequence locations=1-53,75-182,294-335,357-602
atgccacaggtcgacgacagcgattgttgcattgaaatgcgggtacttttcgcttcattttaaactatcagatttcaggttgagtgtttagttgccttctcagtgcctttatttgtgcgattttcgtgtgcctccgacaaatcttttgccgccaatttgcttaaatcacatttcctcagttgaagtaagaaggaaaaacagaataaacattcaattaacaaaaaaaaatattttaaacaaattttataaaaagttaaaagtaaaattattataaatataaaaaataaaaataatatataattctttatttataccttgtttatgatatattaatcagtgaataaaattattcattttagcagtgccgcctttttggcactcaaaaacggccaagttcagtacgcaatttgaaagtggcggcagaagttggcacagtgtcctcctcctccattctgttgcgctgggacactgccgatcgtgccgacatttactacgtttactggcgcggccgaaacgcggcggaatggagcaaccgatcggcacggaacacgacgctaatgaggattaatgtggacgcggcaatggtcgatgaggtgcattaa

SEQ ID NO: 51386 - DNA, 379 bp, Heterodera glycines
  Genomic contig location: Contig_ID=SeqID_3673; Location=208..586; Strand=-
  SCN-specific regions: Sequence locations=1-62,94-121,145-233,277-379
atgagatcgacagaaaatggaaaattttgtgctatttgtcgacacaaatgtgcagaaaatgaggaaaagccaagaaaagaaaatgcgatgtgttgtacaataaaaacaatttgcatattgcagcaccagaagaagccagccccgtattttgtgatggaagggggggggggggagagaaggtgaagcccgataaaagtgagtgactcattttggaattaaaaaagcaaaaaccgaaattaaaaaaaaagaaaataaaatatgattattttaaatttacaagtttgtataaatatgtccttctgcttattattaaattgttcttaagaatatggtatattttgtcagaaaagcattgaaaatggattcgatactcgtttaa

SEQ ID NO: 51387 - DNA, 3409 bp, Heterodera glycines
  Genomic contig location: Contig_ID=SeqID_3673; Location=2505..5913; Strand=-
  SCN-specific regions: Sequence locations=1-49,74-213,235-243,285 -731,761-776,801-911,933-1047,1078-1081,1172-1189,1211-1269,1299 -1929,1951-2345,2367-2375,2593-2780,2810-2820,2842-3069,3093-3409
atggacacttatgttgttgcattaacaattttaattcaaggtatttagctataataatatttaattttaaattgattgactaattatacacaaattaaagaccaaactttgacgtgcaaaacaaattctacaaaatgcagacgatcaactacagaagaaatgctgcacaagcaaatcctttctggcgacctttttgcaaagtttatgctgataataatggaaaaacatctgaaggtcgaaaacataaattacatataaataaaaattaaataaacattttataacgacactaaaaaaatcagaattcaatgaggaagctcaagagtcagcggatgggccgcagctcaaaaatgccgcggcatcaccaaaaattattgcggcagcaacaaaagcaattttagtgccaattggcactttttttgtccaccaaacgcagtcaaagagagcgatggcatcggaatgcggtgacggagagtgccaacagtgtgacaacattggcaaactcgaaaacaaaatttcaatgatcacaagcaaagggcagaagaatattatacggtatttgtgtattggtggggcgttgattacattataagggggttgatatgattaaaaaaagaatgggcgggtgtgccttggtagctcaatggtagagttgcacatggaatgtgtgaacgagtgggttcgattgccacccgaggccaaaaactttagcatttcttattataggatgtatttacagaatataattaagaaaaaagcagagttaaacataatagaatatttaaatcattattaaaataattggtaatatttcagaaattaattaaaaaggaatatttcgagtgaaatcataacttatcagcagctattcagtgatcattttgcgatctgggattgaaaaccccaagatttgaaaccgatttttgccggaccgcaaaaatattttatgtgccatttaatgtattaataagtaaaaactctgaataaggatttatttcaggcagtcattttttgatgcctgcgaacaaagtttcattttacggacccattaaaatgtttaaattttatttatttaaagggcggaagaagaggaggaagaagaagagaaaagaaaaagtgaggaggaagaggaggaacaacaacagcaggatgaagaggaggaggaggaggaatcggatggaacaaaaaagggaggccaatgggaaaagcattacggcaaaggcgccatgggcggcggaccgtgcggcgccaactgcggcaaacagtgcccgcgccggtgctgctgctgctgtgtaaatttatcaagaattattttggaattactttcaccgaataatgtgccagttatgaagtgccaaaagcaattttcattgtccgttaagggatgcgcgaaagaatgcgagcgaagcgaaaaaggagcagacaaaagcattttgggtccaattaataggcagcaaagcgcacagaaaaaagtgccgttacgggtaagacgaatgccgatgttgaaagagaatagaattttatgtattaaaattaaacaccctcataagtttttttttgatcattccgtccaattttttcaaaaaaaaatcaaccgtaatttttctgttatttaaacctgtgcggtcatcgtttattttaatcctttaaccgctgatttttgcttttccttttcgtctttaatttttttgatgcttttctatgatcttatcctagtgatcgaaccgaggtttttcaaaatgaaagaaggcatcgctggttaaaaaaaaataattttttggtcaaaataatgaagttattaaaaaaacattttttcagctgtttaagccgttctttgcgaggaatgccaatttcggcgtgtttaacagcccaccaaaacttatcggtttcaacgacaaagtggcggagaagcaacggtcatcagtggacgaaagtttggaaaatttgaaggagagacttggcaaaatttcgaacaaactcgacttttggaagacgaatttgttgcgaaagcctttgcaagcgattgacgaaagcattccaactgctgctgatcaacagcaaaaggaaacaagtcgagctgatcagctcaaaatgttgaaggaaggcgagtgatcagaagaaaattgttcaattaataacccaaaagagagacaattacagtaatcagcaaggaattggcagcgattacggtaacggaaaaattgacaaaaacacttttggacaatggcgacgaaaatgtagcaaaggatggagatgggcggaacagcacggcgacagcacaaactgtggtgagagataaacaataataagaacaaatccgatgaacaaaaattggtggaaagctaaattaaaatatgacaatttagctgggcataagcaacatcagcattacatcatcaacttcaacaagcacttcgaccacaacgacgacgacaataagtacaacaacaccaacagcaacagtgacgagcagtaatagcacggagggaacacagcaacaaaaacaacaaatgccgatggaaataatcaaaagtaaaaggaaataaaaaataaaatatatttaaaaataaaaaatggtatggaaaataaaaagcgagattgaaagcatcggcaccggccttttcctcctcatcggccacgactctctccacaacgccaacagcagaagggggcaaggcaataacaacaacagaaatgccatcgcaaaatgggacgaaaaatggcaccactgctgcacagcaaattgaccaaattgtcacttcaccagttcaactgattcaaacaacaacaacaacaacaacaacaacaattagtggtccaaaatataaacagttataaataaatatttcgcttaatttgcagacattgatttaacaacgtcatcaacaagtacaccaacagctgctgtcaatggcactcttttcacattaacaacccgccaacttcaaacggcgtctgctgctgaacttccgacaccgccgccatatgtcccagcaaatgaaccgtcgaatatgccggtaagaaaaaagaagtgcaaacggatgggccgaaactattaaaactttgataaaattaaacttttttattgtttggtgtgatgaagatagttaatgtacgttcggtaattgtgcaagaaatggcgccgacggagaatgccacaggcaacaacggaacggcaaaatcgacgacattaatgtcattaacacaaatggaccaaaatggcaatgtcaaggcaaacggtggagcatttattggcgattcatttaaattgagattctattagcatttatatcgccaacaacaactccagtaacaataaggacacccgtgccacaaactgttgtcagttcaaatgaaaaaacaataacagagcaaaacgcatacagtatgaaaaccaataattaataaa

SEQ ID NO: 51388 - DNA, 785 bp, Heterodera glycines
  Genomic contig location: Contig_ID=SeqID_3673; Location=6867..7651; Strand=+
  SCN-specific regions: Sequence locations=1-148,170-205,246-275,298 -358,380-732,754-785
atgtttaagtgtgactgtaatgatgccgaaaagaaagatgaaaaatttaacaaaatatccggcaaagaggaaaatgacgaagaaagcgtacaaagcgatcagaatgttgcattgggagtggatggttctgatcagcaaattgatataaaaattaaatgattttatattaggatccggtcaattaaaaaacccaaaaaaatttgcgattttattaatttatgttaatgaaatattaaattataaaacctacttttggtgatgcaatgagggaaatgttttgctttccatttaattttacctgctgctgatagttgaatatgtttacataatttaagaacggattataatttgtttgatgaaaaatggatttattaagataaagctgaaaaagtgatcagagttcgggaccggattttcaatttttgcttacaccataaacattcaaaaattgtttcagtttatttgcttgaaaattaaaaaaaattattcagtgatttcattagaatcttttttcatgttaatttataaatttatgtgttttcgaaagtttttgggaaacgcactacgtttaccggctcccggacaatcggacagtggacattccgacaaatggacaatcctacagtgaggatttgtttgatgctcgttggtctcgactcgagaaaggtcttctcggttcgtggtttttctagctcggtctcggtgttcgagactcgagactaaagatttaattttttcacattagtaaaatgagatacattgaattaaattaattcgacatttta

SEQ ID NO: 51389 - DNA, 682 bp, Heterodera glycines
  Genomic contig location: Contig_ID=SeqID_3673; Location=8037..8718; Strand=-
  SCN-specific regions: Sequence locations=1-636,658-682
atggccaaaatgcggcaaatgaatgtaaaatgaccatttacacggtggccacattctttggccaactgctcatggcgttatttatggtcacattaattaatgccaaaagatggaaatattgagcaattttataatttatatgtttcagttttttgtctgcataactgcaacaaattttgttgacgagcacaacaatcgcttttcctatgtccaagaatggtttaatgtctcatcggcccaaaatgacattctttttttcgcaaattttaaccagaacccatgggtaaatgacctttccacggtggtcatcccagcctggtaacaaaacaccaaagaccaaatttttaattaattttttcattttcaggttgcttttgtgggcttcgtcaaaattgcgcgaaatcattagcaaacaattgaaaattggaaacgaaaaatcgagaaataccattcatgttcatcagattatgacggtttcggcacgaactcagcaaatcaaaggaatttgccgtcgttgaaattcagaggaatttaagaaaattataagactgactttttgagaatccacttttttaattgtgaaatcttttttcaactttacaaatttgcacataacacaaaagtcaaagtgcactgaaaacatcatttcatttaaaaagtattttttcgctttccaaataaa

SEQ ID NO: 51390 - DNA, 891 bp, Heterodera glycines
  Genomic contig location: Contig_ID=SeqID_3673; Location=9349..10239; Strand=-
  SCN-specific regions: Sequence locations=1-104,133-156,178-207,262 -581,629-891
atggacccggttaaaaacttggatcctgaaacagtttattgcctaaatatccggacccatgcgaccctattttaaatgagtttctaatattttttgttttcgagaaatttttaaaaattttatgaaaattttctccccaacgtgggtgtttgtttcctgcccgatctccgacttttctctccccgttcgaaggtcggggaacaacacaaattttaagaataaattttggtaaataaaaattattttttgatttaaaaaaaaccattttggaggtgctttttacattttttgtgaaaaggctagaatatggatattccattgtatgagaatttttgaatccccattttgacaatttttaaagcaaattttcttttattttattttgtttttgcgggggattttagttaatatcttggaaaacgcatatttggcgtttctaagtgcgtaaaagcactctctctctctctaataattaaataagccgccggtttactgaaaaaaaatcggcgtaagttaaataaaattatttcacaaattatggcattgaattgccgccgactgaacagacaaaatgccaaaacaataattaaaaaataatatgtatacctaattattaattaattattttcagtcattcttttatccctgttacatcacttccacactctctcccctaatgggctcctccgcctccgcgccgttcttttccgcaatggccatgttggccaattcgaatttgtgcccctttctcttcgctttggccattggcattccgtctgcagtgctgtactgctcgctgttgctggtcatcgtcgcgaacttcaaacacttttcgtccccttttttcatcctcattatcatccgtgctattctagtaggaaaataattaaa

SEQ ID NO: 51391 - DNA, 211 bp, Heterodera glycines
  Genomic contig location: Contig_ID=SeqID_20812; Location=1..211; Strand=-
  SCN-specific regions: Sequence locations=1-211
ggcgtttaatttgcaaaaagacactgtgataattagcaggtaatacattaattggctttttccttcctcaaatgataatccttttcttttctcctttcgtcttgcacaaattttgcgttttccgttggaattcgaaaggcactcattggagaagggagatcatcccgaaatccgagagggaattgcccacgcgcgacaatggttcgatcgt

SEQ ID NO: 51392 - DNA, 406 bp, Heterodera glycines
  Genomic contig location: Contig_ID=SeqID_20812; Location=398..803; Strand=-
  SCN-specific regions: Sequence locations=1-198,221-406
gtcgcttcatctcccagcaaagtgccctcgcgaaagttttgcgctgtgtgtggtctttttgccggttacacttgcgttcgctgttccgcccgcttttgctccattccctgcaaggacatgcatttggacacgcggtcggtgggcgaaggccaatagacaaggatatcttttggcccaaaattatcccaaattaataacgagaatgtttattttatgagaaaaagggaaaagaatgaaagtttttccttccgaatgcaaggaatcggctaaaacaacaacgatattttgggttacgccggaatccctcccccccccccccccctctttttttgatctcactcagtccaaagggtttaattttcaggtgtttgaaatggactgtatgacattgcgcatccaatttaat

SEQ ID NO: 51393 - DNA, 645 bp, Heterodera glycines
  Genomic contig location: Contig_ID=SeqID_20813; Location=274..918; Strand=-
  SCN-specific regions: Sequence locations=1-103,125-397,419-645
atgaggataaatcctcagatctgcgagccctgttttattgtaggtaaataaattcagttttattcagatcacagaattgtaaatttaaatggcaacgcaaagtaactttggaaaatttcaacagcgttcaagtcgacaatccagtaaattagtgttaggagtttgtttagtttagggaattaatgtattaaaggtcggatcatttctcaacaacccacgaaatgctttgatgaagcggctaaacgacggcgcattcagcaacaattggagtcacttgagaaagtccgtttattggcggaaaatgatgcatttcccgtttttcaggataatttccaagaggatccccacgcgaatatcacttggcacaaagcggcaccaaaatttgacgatgaaatggtttttggagacaaagaaaagaaaaggcgaaaacggaaaattgcgtcaccctcaaaagtcagcggagcggagcaagcaagtgaatggaagtcgggggaagagaaatgaatcatttgatcattcagcgaaaaagggaaagaaaattgtggccgctttgacaaagacgcgatttaggaagacatttgctcaacttttggaagaagcgcaggtaaaccaaggcaaaataggggcgcgaattgttaaaataaa

SEQ ID NO: 51394 - DNA, 1004 bp, Heterodera glycines
  Genomic contig location: Contig_ID=SeqID_20814; Location=195..1198; Strand=-
  SCN-specific regions: Sequence locations=1-408,430-430,453-1004
atgaatgttatacccacttacaaacaagcatgtgcgtctgcagccaaggatattgttgtgctccgccctttcgaccagtgggtcaatgaaaatgacccgtgagtagaataacattcctcggacaaaaataaacccattatgtgttttttagtgctgcgttgttcgacctagaccatttgagagatcaattcggcgaccgagtgctttttctcgcgagggtcatacgttcaaatggacgggcaatccgttgaacatgttcatgcacgtaagaattaaaatgaagcattgctttaaatgatgagcaaattgttggtgttttttatttaacattttagaataaacttacaacaaatattttgttaaaactaaaatagttcctgattcaaaaaatgttttgtgatttaaaagtggaaagatgggatggggggaccagcctggcctggaagtgtcccatttttaaacgatttggagctcaaaaaacgcatttctgcattaaaaattttcgattctgatgtcactatcggtcactagaaatcactattttggcgtatcgtcagtcatcatttattaattttgattcacgtttaggtgcgtcggctgcgccataaactcagcaacgaacacaagggagtgactgtggacaccgtggagcgttaccagggtttccagcgtcgggtgatcattgtcagcactgttcggaacaacgaaaaggaggacattggctttttgatgtcggacaaggttgtttaatccagttctaaaaacttggtgttaatttcaacgcttagcgtttcaacacaataatcactcgtgcggaagagcttttgatcatcgtcggaaatgccaaagtgatgatgagggactcgtcttggatcgttttgaaatatcatttttcctaccaaaatgaattaatttttttatccttttacaggatgatcgactattgccgcaaaaacggtgccacagttgacatgccatcggaagcggagcttttcctacactga

SEQ ID NO: 51395 - DNA, 66 bp, Heterodera glycines
  Genomic contig location: Contig_ID=SeqID_20814; Location=1625..1690; Strand=+
  SCN-specific regions: Sequence locations=1-8,31-66
atgaacgttatgaagactggagaagaacaagacatcaccaatttcaaacttgggaaaactcaaaag

SEQ ID NO: 51396 - DNA, 60 bp, Heterodera glycines
  Genomic contig location: Contig_ID=SeqID_20814; Location=3357..3416; Strand=-
  SCN-specific regions: Sequence locations=1-1,23-60
taaaaaaccaaataattttgtattattttcacttgatataaattaaaatttgaatttttt

SEQ ID NO: 51397 - DNA, 861 bp, Heterodera glycines
  Genomic contig location: Contig_ID=SeqID_20815; Location=850..1710; Strand=-
  SCN-specific regions: Sequence locations=1-85,107-225,247-475,497 -566,588-700,722-758,780-861
atgatcccttaccagacacttttctcagggacaaaattccaaagcgaaattatacacattaaattacttttcaaaaagccaatacaaattttaaatatatatcgtccaccaaattgtaacgttcacaatacaaaaaagctactcaaatttatttcggatcaaagcgattccgaaaatatcatatactgtggggattttaacatcccaaacattttatgggatggaaataaggtaaaacatataaatgatcctatgtcaaatatgctgattgagtttatgaaccaaagacaattgaaacaacatgttaaagaaccgaccagagaaaatacgattttagacttagtaatgactaatgaatcggaattaattaatgaattaattgtattggaacatttttcaacttccgatcacaaaatggtcggatttaaaataaaagaaaaattcagccgtaataattctaatgtttatagaagagattttaaaaatattaatttttcgaaattaagtcgggcgattcttgaaaatcgtattgatttatcaataaactcagtgtacaccgttgatcaaaaatataaagaattcttaaataaagtactgaaattatatgatacttttataccaaatagacctctaaaatcgataataaaacaatcgtatcctcaaaaaataagagatttattttcagagaaattacggttacataagcttgtaagaaaatttcctgaaaaaagtgaaatcattttaaattacaaaattatttctagggaaatgaaaaaacaattgcacaaattaagaaatgaacaagagtcaaaaattatttcccaggggcaaaattcagttaacaaatttattcgaaataaa

SEQ ID NO: 51398 - DNA, 401 bp, Heterodera glycines
  Genomic contig location: Contig_ID=SeqID_20817; Location=257..657; Strand=+
  SCN-specific regions: Sequence locations=1-11,34-230,254-401
atgaatgtaaataaagaagaggaacgactggaaaagaaagtcaccaaatgggctattatgctaaccagtgaagacaaggtgagcatgggcattcctcagtatgggattttgggtaatacataatactgaaaaattgcggtaaaaaggtaaaacagaaacccataaataattcgatggttttgcaaaatctaagtcagattcgcaatttagcaattttttttactggatttatttcagagaaagttttaacttggaatcgcaattctgcaatactaccgggcccattctgcaatattaccggattttgaatcttttcttatagattgaacatgccttgaggcgattggatcatgttgagattaacttacaacttttgtcttcgactggttggagttttttaa

SEQ ID NO: 51399 - DNA, 832 bp, Heterodera glycines
  Genomic contig location: Contig_ID=SeqID_20818; Location=772..1603; Strand=+
  SCN-specific regions: Sequence locations=1-26,56-256,283-291,313 -696,718-832
atgacccaaaaagcgaaagcagcgacgcatcatcagcagaagaagaagaaagagcgaatggaagccgcgggagaaataaattccatcgcttcgctttttagcggggaaccggcggatgtgaaagtgaatttttatggggcgattaaatgtggcatttttcgagacggaactgcgaactgtacgaagtttttgatgagttcaagaagtgtccattttttggtaggcttgctcgatagatagcggattagctctgctgtcctgtcttttcaaaaactgaaaaattgtggactgatttttcaaaagctttttccaccagcgaaaaagaaaaatcgttaaaaaatcgaatgttcagcggaaaatatttttttttcaataaaaaagattaacaattttttcaaccacgagcgagtcgctgcggaccgaacggccatctcaggcgttctcgatgagcttggcatcgagagcccgatcactgtttacagaatgggttccccggaccaagcaaagacaggtcaaaaccgcccgcggttgatgaaagtaattttcggctgctcaaaacatcagagacaaacctttggctcaatggaacaaactgcgcgctcaaatcagtcaaaaactggggatgagcaacatcaaaattcgcccttcactcagccaagaggaactcaaggcccgacgtgtgctgcaggaagagtgcagcagaaaaagaaaggaagatggcggcgagtgggtggtttacgctgacaaagtgatgctgaggtcagacattgcggcatttaaaaataacaccaattggcttgctgttttaccaaatcacattcataaaacatta

SEQ ID NO: 51400 - DNA, 129 bp, Heterodera glycines
  Genomic contig location: Contig_ID=SeqID_20819; Location=366..494; Strand=-
  SCN-specific regions: Sequence locations=1-129
atgagagagtgctggatctcagtcccagtcatacaaaacatttttgatgaaggaggtagagaaaacaatttcaatagagagcgcaatgggaagggagtagttcatgtctcttcttcgctgattcttttg

SEQ ID NO: 51401 - DNA, 1207 bp, Heterodera glycines
  Genomic contig location: Contig_ID=SeqID_20819; Location=716..1922; Strand=-
  SCN-specific regions: Sequence locations=1-58,92-127,150-317,339 -534,562-955,1063-1159,1183-1207
atgtctaaaataaagtccttagggtaattacaatccaattttatcaaattttccagcagctcttcagggtatttatttattttttgagatctgatctcctaaaatttttgcaccatcacctgatatgaattttttaaattaattccatagaacactttattaattagcatagttattaaggttttgtgatagctaatgtcgtacaaattcaattaaaaaaattttcggatgctttattcagataaaatattatataaggatttatccagtattaaagttggtaaataattgctatattttcttacaagggtcctcacaacaaataataaatttatataaagcatattgatttatattggcggatttataaaacgcgctggcggatttgtaaaacgtgcatggtgggggtgcgcatggtggcggatttataaaacgcgctggcggatttgtaaaacgtgcatggtgggggtgcgcatgggtggcggaatttataaaacgcgtcagcacgcatatatatgcgtagttacttaacagaaatatatttatttatttaatttttttctcaaaaagttctcttttcacgccaatttcctgttttcgtttcaataaaaattccatatatacctaaaatgccaatcacagatcaaaatcacggaaaattgaaaaaatccgtgatcacggccagccctgctgtgtaccctttgtcactgcattttgcctagcattccacggtgagggaaccaatcaatctctcaccgcttccctgattgactgccctctaccctctactttcccacactcactctcttttctctctttaatcaccgctaattcattagcccaatctttggattcaaaataataatttaatctttagaaactaaatgaaggaactcaagttacgcagcaacacactgccaatgagaagcaaatggcacaaatcattgagattttggatgatgaagaggaaatgggggaagaggaagagaaagcgaaaaacgaagaaaatgaaaatgaggagaaatcggaggacaaacggagaaagaagagcaagaagaaggacgactgctatgtttactacaatttttaagtgttgaggtcaaaattgaacaaagtgcatggatcggaacatagccttttatatttttgacaaagttttgcgtataaatatgcaacaaaatgaaaagtgcctttaaattctaataaa

SEQ ID NO: 51402 - DNA, 100 bp, Heterodera glycines
  Genomic contig location: Contig_ID=SeqID_20821; Location=820..919; Strand=+
  SCN-specific regions: Sequence locations=1-31,53-100
ttaacacggcgattcaattttgggctccaagtacaattaagttggttttttcgtcttagtggtctgtgagttagtcaacaaaaaggggtctcaggttcaa

SEQ ID NO: 51403 - DNA, 1090 bp, Heterodera glycines
  Genomic contig location: Contig_ID=SeqID_20822; Location=70..1159; Strand=+
  SCN-specific regions: Sequence locations=1-323,347-798,822-825,864 -1090
atgtacacataccaaacttcggaaattgaacgaaagctgagacactacggtgttcgtgcactcacagttgatgcctaccaggcacaggagtgcgatgtcatcatcatagtgacaacaagatccaagtattccgagatgggatccggaagaacggacaacatgcacttctttgaagacgatcaacgggctactgttgctctctcaagagcccgccacgctgtcttcatcattggagatttggtttcaataagtgcaggacaagtgtggaagcgcttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccagaatcgccactttcctgcactacagacgacagggccctcagatcaagccggtccatctggcagcggtggtcaacaaagaggtgcgcctactttggcaccacagtatggaagaggtcaaggaagacgtggcccggacaaccagtggatgcactacggcggaaacccgaaacgacagaagggtggcagacgctgaactcacatgacgtcctgcgggtctcacttctctccttttcttcaatcagcacggtatgtctttcggtcataatttttattattaattagttgggtaattttccttttttgacccctatcatttaagcactttattttctttcattttctctgcactcacaagcttttcgatttcacccctccttagcttccggtgttcgcaccatttacactgtgattccttgactgcaatggcagaaagtgggatgattctgaaaaggtggcacgcctcaaggcatgccttgatggtgaaccaagacgtatctttgataatttaatgcctgcccacaaagcaacttcttcggaagccattcaaaaaatcaaggaaaaccttgacactccacaaa

SEQ ID NO: 51404 - DNA, 164 bp, Heterodera glycines
  Genomic contig location: Contig_ID=SeqID_20822; Location=1604..1767; Strand=+
  SCN-specific regions: Sequence locations=1-33,55-164
atgcccaagcctcaagaggctcttttaacagatcaaataatcatcctcaaaatgacagaagatggaacaatcgcacttccagaaatgacagacgatggaataatcaaacccctcaaaatgaccgacgctggaatgctcggccagtttgcaactactgtgggaag

SEQ ID NO: 51405 - DNA, 946 bp, Heterodera glycines
  Genomic contig location: Contig_ID=SeqID_20823; Location=164..1109; Strand=+
  SCN-specific regions: Sequence locations=1-160,200-212,270-284,306 -366,388-658,680-762,790-868,890-946
ttggcgaaatgtccgattttggctgagttggcgaaatgaatgtttttggctgagttggcgaaatgacaagttggcgaaatgtcatggagccccttgtcgctcgccaaagaagtcaggcccgaagaatcgtcactcgcccgccggacgtggaggaggacgctctcagacgccgcgcaagaagaaacaaccgctgaagaaggtgccgggcccgagcagtcgcactcctggtcgacgcgtgaagaaaccgtcaacgaagaagtcgcctgctcgccgtgccactgagacgaagaagaagccaacccgcaagactgccggtggacgtgccaacaaacagacgaagtcgcgtgggcgcaaaacaaccaagaagacggaccaggaggaggagcgcgccgactccgaggcggaagctgcaggatctccgcgcaacagtggacgtgagttgaataggggtgtgggaatggcacaatttcaattgtttaatcctaatgaaattgaattttcagattccgaagagagtgcctcggggacgaagaacaaaccaactcgcaagagcgctgctgctggacgttccacgaaacagaaggcgtcgcgcggaggacgtgcgggcaacaagaaggcgcaggaagaacgctctgaatcgccaactgaatcgggctctgatcgcgaggaggatgaagaatgaatgagccagccggagaaaatgctgcttcacgagaccaccgcgataataacactaacccccatttaaaaaaagagaaattgtatctctatgtatgtatgtatatattgtatgtccatatccctgtggcattgtcttgctgaatgtaattctcccacaaatggttgttgttctatttaaatatgccatatatatgtgtatttttaataattgtaatatgtttgccctgtttatgcatgttttatggtcatttattctcattgctga

SEQ ID NO: 51406 - DNA, 1719 bp, Heterodera glycines
  Genomic contig location: Contig_ID=SeqID_3674; Location=54..1772; Strand=-
  SCN-specific regions: Sequence locations=1-213,250-409,432-680,703 -998,1021-1368,1402-1503,1525-1719
atgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagcaaaatcatcttcagactcagacccggaagatgaatcaaatgattatgaacatgaaaatgaagacgaagtagaagaacaagaagaagaaaaggaatatgaaagtgacaatgaagacgaatcgccagaactttccttgaatgaccaaatacaccatgatcgtataccatttgtcaattaccgatcaagaataaagcttccacctcaaacgcttacgcattttaatggcaaattctcccaatggcccagtttctgggatgacttcaaatcctcagtggacaatgacccaaatttagaaaatatacaaaaactcaaataccttagagggctcttacatgatgaaccgtacagaatagtgtcaccgtatccccttacaaataaaaattatactatcgtaataaaattactaaaatcaaggtacggaaacccccaattaatcagagaaaatcttcatagcgaattacgcaacctcaaaagacccactgaatccacaattgaattaagacgatttattttgttaattgaccgaataattttacaaatgaaatcacaaggggaagacataaatcaccctcaaatcaaacaatcaatcgaaacgaaactcccctataacattagacttaaattgagggaaaaattcaaaatttattcaacaaaagaaataatggaatttatgaacgatcatacccaagcacgtgaagacatagaaagaatggaagaatcgaatcgccaaatccggaatttcccctctaatagaccaccccaaaacggagtacagagacaattctatccaaatttcccacacaatcaaatgaaaccaaacccacggaatcaacagaacacatcttcctctccttttccatatacttctgcacttacaacgaaatcaaacccagtacgcctggcacagtttaaatcaaatccaacacaaactagaacccaaaataaaatattttgtcgcttttgcgaaagagaaaaccatgcaagtaaagaatgcaattttaattgtaaatacaaacataatactctcctctgtacccgaaaacaaactcagtacaaagcgaaagagcaaaaaaccaaagtgaatatggctcaaaattacgaaaatcatgaagagacacagacattcatgacaatggattatgataaaaatttctataattatgaggaagaagaattacttatgactactgaagtcaatgtcatcaatccagacaagcctaaaataaaaaaggaaataattttatttgataatgggtcacaaaaaagttatataaccgaagaatgtgttcaaactcttcaattaagtacaattgaggaaaaattattagcaatttccactttcaatcaaaataagccaaaaataattaaatcaagactagtcaaagttggcattaaaacattaaaaggtgaaatagagtacataacactacaaacagtggaaaaaattactgatgttacaaaaatggttaataaagaaactgttgatgtacttggaataaaaatcccgatcgctaatgcatgtcctcaaattctaattggaatcgactattattggcacttcatg

SEQ ID NO: 51407 - DNA, 217 bp, Heterodera glycines
  Genomic contig location: Contig_ID=SeqID_3674; Location=2835..3051; Strand=-
  SCN-specific regions: Sequence locations=1-217
ccaagtttgaggtcgacacaataaacatactcttattaaaattgtgcccaacttggtctatttgcctggacgaaaaccggcacgactcatcgctctccgatcggtcccgaccccctacgttcccccgaccggctactctgcgcgcctcgcccatttcatccccttcccgtccccttcaccccgcagagttcgacgcaaattttttgtcgccacgaca

SEQ ID NO: 51408 - DNA, 591 bp, Heterodera glycines
  Genomic contig location: Contig_ID=SeqID_3674; Location=2563..3153; Strand=+
  SCN-specific regions: Sequence locations=1-104,126-473,501-591
atgggcttggtgacccttatacttccggatgacgagcagttgcgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaattcttgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacgggaaaaagggggcacaaaaacggtgacagtaa

SEQ ID NO: 51409 - DNA, 94 bp, Heterodera glycines
  Genomic contig location: Contig_ID=SeqID_3674; Location=3265..3358; Strand=+
  SCN-specific regions: Sequence locations=1-94
atggcaaaggaaagggagggcactcgagcaggcgcggacagggagggcactcgcacagacagagagcagcgaaggccgggtgcagtgaaaggcg

SEQ ID NO: 51410 - DNA, 102 bp, Heterodera glycines
  Genomic contig location: Contig_ID=SeqID_3675; Location=2318..2419; Strand=-
  SCN-specific regions: Sequence locations=1-102
gtcggaataaaacatcattcccctgcttgtctactgtttgtcccaatttctattttgccaaaatttttgccgggccgaatttgcctctgtttggtcccgaca

SEQ ID NO: 51411 - DNA, 324 bp, Heterodera glycines
  Genomic contig location: Contig_ID=SeqID_3675; Location=2469..2792; Strand=-
  SCN-specific regions: Sequence locations=1-157,192-204,228-324
agattttacgattaaccaaaatcaaccgcccgcctttctcagcacagacaacccggaatgaggcataagaaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatgggaaaaaccttaatttaattggaaatgttccccctcttcgtcgttctattcaaaaaagatttgtttgtttacattaattcttattcatttctcacacaaaaatgtattaatca

SEQ ID NO: 51412 - DNA, 1162 bp, Heterodera glycines
  misc_feature (355)..(355): n is a, c, g, or t
  Genomic contig location: Contig_ID=SeqID_20824; Location=796..1957; Strand=+
  SCN-specific regions: Sequence locations=1-26,53-690,727-820,842 -1092,1115-1162
atgaacaggcggtaaagaaatttaaaattaaccttaaaaatttttattttccaatttttacccatatttcagttggatttgtagcgacgtgtggatggacattcttccatcttttgaccgtccccaactcgggctcaaaatggcactgctttcttatcgtttcgatgcgctggtggacacgcattttgatggcaaaaggacggaattaacgctttggagaccaatcgcaatttgcaaagagaagaatattggactagaagcgagactgtgtgtatgtatcgatggcattttgtggaatttccgatgccggaccgtccgctgcgcaacaaaatcccgattaacgaccttcggatgnagtaatttctagggagtccaattatatggaaatccatatttttttcctggactgtgggaggcctgaaacgcatgaaaaacatgtttttagcttggtttgaagcttctaggaaggatttctatatccatattttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaattaataaattttagcttttatgttttttttcttttaaaatgattgcacgtaattgccgaaaaaattcgagaccaatttccgagtgttgaccgactaattgcaaaacgaaagccttcaaaaaatttggaaatgtatctcatatgcaatttcaaccaataaatttgaagaaattttgcactcaattttgaaaaatttatttccatattttgacatttttgccatttatttccatattttgagatttttgccattttatgtccatattttgcgatttttggtccatatttttggactccctagtaatttcaattacatatttatttgtttatattaaagcatttttatttattttttcagctacattgaccattccgtca

SEQ ID NO: 51413 - DNA, 110 bp, Heterodera glycines
  Genomic contig location: Contig_ID=SeqID_20824; Location=111..220; Strand=-
  SCN-specific regions: Sequence locations=1-67,89-110
ggaaacattatgactttgcttatcaccggaatccttcgcaaatttgcacttacaaaattcccatttactgcatcaaattcttctttgtcgtcatggtgtaaagctgagag

SEQ ID NO: 51414 - DNA, 51 bp, Heterodera glycines
  Genomic contig location: Contig_ID=SeqID_20824; Location=1159..1209; Strand=-
  SCN-specific regions: Sequence locations=1-51
tcccacagtccaggaaaaaaatatggatttccatataattggactccctag

SEQ ID NO: 51415 - DNA, 296 bp, Heterodera glycines
  Genomic contig location: Contig_ID=SeqID_20826; Location=240..535; Strand=-
  SCN-specific regions: Sequence locations=1-78,101-296
atgcaatgcgataccggggaagcaaatactcaagttttaaagattgtaggtaaagaagttttttaaacgatttctttagaattttttagtcaatatttaaaaaattaaaagatgagggagctgaaattcgcagttcacaaatctgcaatgtacaggctaaaaacatgggatttcacgggatatggacactaattgcgctaaaaaaattttctctatatttaatgaatacttgaaagtcggaattaattttagctttataaaaaagaaaaatacgcaatattttatatcagaataaa

SEQ ID NO: 51416 - DNA, 133 bp, Heterodera glycines
  Genomic contig location: Contig_ID=SeqID_20830; Location=1191..1323; Strand=+
  SCN-specific regions: Sequence locations=1-133
atgaatctgacgaatgcggggagtttgaagaagaatacaacggaagttctgatgccgttttttgctcggacgaagcacaaaatgcagaaacacaaatcaagcagcaaaacccgatcgaaaaaattcacaatat

SEQ ID NO: 51417 - DNA, 922 bp, Heterodera glycines
  Genomic contig location: Contig_ID=SeqID_20831; Location=84..1005; Strand=+
  SCN-specific regions: Sequence locations=1-8,38-167,203-220,242 -243,282-299,333-508,545-824,847-922
gcaaatttttgccaacaacagcaacaacactttccaaatccacgcgattcgtcaacaccaaaatcaaacagcaacggatcatcaccatcatcaatcacatccaataaaccattttcatcatcaaattgtcttggaaataaaagtattgaaaatatgaatgacatttgattattttaattgagtttaaattaattataaaaaacaaaaccatgagaaagcattaaatttttaaaaattcaactcacaaaatattttattaaaaaacaattttgttccaaatgaattaaaagaattttgagaaaaaattaataatttaattataatttaaataacaataacactccttggatgtgaagccaatttttcaattttgaaaatctcattgatgccttaaaaagcttaataaaaaagcctcattataggtcataaaaaattttattttcggcacataaatttgggattacatataagaaatatgttattttttaagcagatcgccatcataaaacttaaaataacttattttaataaacacacatttattacagtatacagcacacagtcgtccagtaatactgtggtggccaacggtagtggtgccaaccgttcaacagcgactacagcggcatttgtcgccgaagatagttgttgcaaccaaatgcgcggcgagttggtcgcgcgcaactcggtcgccgagcgagcggagaaggcgtccagcgtttatgagaatgtggcgaccggcgagcgtcgtgaagctgctaaaccagcagctccacgagaagctaattatgatgctaatgatggtgctaatgaccataattatgagcagcagcagcaacatggcccgccacaaaatgaccagggcggtgaacggagggaaggcccaaagggggagatttggtacgaatttggatgcgtctga

SEQ ID NO: 51418 - DNA, 758 bp, Heterodera glycines
  Genomic contig location: Contig_ID=SeqID_20831; Location=1772..2529; Strand=-
  SCN-specific regions: Sequence locations=1-5,28-122,271-612,643 -712,735-758
atgaaaggatgcttattaacttcttcattatttgtgtttttgataatcatcttaattagtattaattatgttggatcagaaaagaaaaaattggaaaaaaaatcatttgacgaaatatttggagaaaaatgggaagaaaaaaaaaacgaagaacagaaaaaaagagaaataattggaaaattttataaaataaaagagaaaattaagcaaaaaggaagaaaatattcaaaaagagaatgggaaaaaattgaaagaaaaatagcaaaaaaattgggcacaaatcgccgatatatttatgaatggatcaaagaattgggattaaatcaaaagaatttttacaaatcaaaaactgacgaagaaaaactcgaaattatactgaaattcattgaaatgaaaaatgaatttaaggaaaaaggaagaacatattcgaaaaaagaatggaacaaaaattatgaagaaatttgtaagaaaatcggagttggccttttcataattaaaaaatggaagaatcaatttggaattagccgaaaaataacaatggaaaaagaaaaaacggagaaaatgaaaatgtattggcaaataaaaggagaaaagccgaaaatgagtgacaaggaaattggaaaaatgatgaaaattactagtagaacaattgcatattggaagaaacaatttgggaaagaatatgtaatgcgaaattaaatggatgaaactaagaaaattggaacaattttgccaaaaatgaccgaagattaaataaa

SEQ ID NO: 51419 - DNA, 765 bp, Heterodera glycines
  Genomic contig location: Contig_ID=SeqID_20834; Location=29..793; Strand=+
  SCN-specific regions: Sequence locations=1-84,114-174,207-224,246 -273,303-765
atggcattggcacagcgtcataacaggtgggtgctgtggctgctgggttgggtttgtgcattgtgacaaggagcataattttccttaaaaattaatttgtttttattggaaaattctaggaaatttctaaaaaaatgaaaaattgttactcactcccgtcaaagattcactagcaattttttttaaaattaaattttattatttttgacgatgcttttccagagatcgtccgtcgtcgtcgtctcgtaataaatatgccaactacagtgaaacggacgaagacgatgaggaggatgaggacggcggacgttatgatgaggacgaggaatatgacagtgacttggccgacttcattgacgacagcatggtggacgacatgcagagggaggactttgaggagacactcaagtgggggcaagcccaaccatttgtggaatttaccaaaacataaaaatttagcggatttaacaaaaaaaataatcaacgattactttgctttgtgcctaggcaaaaactaagcgggattttttaatttttgccgtttttacctttttataacccctaacaaataaatgttgcaaatgttccaggatcatcaacccgcgctacaacaaggagaaatggttggcccgcgagcggatgattgacgaccgtcgcatggacgcgcgcttccgcgacgtggaggcggaggagcggcactcgtcacggcttggccttgtcgaggacttgcgggaggccaagcggggcagcaaagcgctcggctaa

SEQ ID NO: 51420 - DNA, 186 bp, Heterodera glycines
  Genomic contig location: Contig_ID=SeqID_20835; Location=1321..1506; Strand=+
  SCN-specific regions: Sequence locations=1-186
atggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgactcg

SEQ ID NO: 51421 - DNA, 155 bp, Heterodera glycines
  Genomic contig location: Contig_ID=SeqID_20835; Location=1448..1602; Strand=-
  SCN-specific regions: Sequence locations=1-155
atgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 51422 - DNA, 835 bp, Heterodera glycines
  Genomic contig location: Contig_ID=SeqID_3677; Location=883..1717; Strand=+
  SCN-specific regions: Sequence locations=1-121,180-331,353-394,427 -632,654-835
atgcaaccacttcatgacgacgagtcgtcagatccaaaagccacccccaggcaacacttgaccacaagcatggccaagatgcgttgtatgttgtatcgtaattaaagcgtaatatagatgcatattatgtaaataattgttttttgataaaattatttacataatataaatctatattacactttaattacaatacaacatacaacagacagtgcgcgcaccgccggcggatctgaagcgggaaacggcgtcaacgagttcaccgcgtacgcgcgcaagcgaaccaatgagcttatgtataatgaataaaattttcggtttatttttgtgatgggatgtaaagaggggaagggaacattcatgtcattcattaattaagccccacgcgctctcgcttttctctcatttcttttaccttttctactgcactattttcttacaccgtctgtctggcaaagagaacgctcattaattaagcgtttttctctcgcttttctctcatttcttcccttatctattgtactattttctttcactgtctgtctgacaatgacaagaaaaaaacattaagcggggccaggccgttttcgtacgggccgttttcgtacgaacacatgtttttggactataacttttttctttgccaaccaaatccaacattgttggtatcattcgatagccctatgtatcctctattagcctgcaaaatttcgaaaaatttcgttaaggttcaaaaaaagttcgagccaaaaaatttggaaaatttggttttttgaattctcatctgtctgctggtacgagaagttcaaggcgttataatttttttctttattaa

SEQ ID NO: 51423 - DNA, 1519 bp, Heterodera glycines
  Genomic contig location: Contig_ID=SeqID_3677; Location=2184..3702; Strand=+
  SCN-specific regions: Sequence locations=1-42,64-106,128-381,403 -560,583-645,667-733,756-1215,1249-1483,1509-1519
atgccgttgttttcacgccaaattatttggttttctctgctgaaaatgttgtgccatccaaaaaggtaatgaagcaaagccaaatttatgcgagaaaattttgcgaaaaaatagcttggctttttgaatttctctgagcatttaactgtcataacgaatgacagtttcactgactgatctgaggccggtatttgatcaaaaagattgagaaaatgatcggcggactttttaacacaaatttgttcgaactgatggaattcggatcgccatgaaatttacaaattactaataagttaaggctattttttaactggaaagctttatcgttcagttgctgatcattctaatcagagctgatcagtgatcactcttctatcggtgatttaaaataaatttcagatattttcgttctctgtttatggtggtttttctgcttggcgtccatctgttcgcactttgtgcagccattcacaacattcgcaccgcattgcccgtgctggcgggttggaatttgggggcttgggtcttaaattccgcgacaattttttcgggaaatttggaattttctccccgatttctgacatttctctccccgaggattggagaggaccttagtatatataaaatcgttcgaggtccaaagatttccaagtacagtaaaaatttttcggggtggggcgaaagccccgaaaattgtcaaaaaaacactcctcgaggcgacccattcgtcaaattgtgtgaaatgcagtatttatgtaatacagtacttttcatcggtcatactgtgactgcctacaaattgtttcttcgccaacgacttgagccctttcttgtgcgaccatgtttcagtgctgtgccaactttgcacccatcaattatacactgtattcaaatgtacttatcttttacaaaattttgctgatacagtatccattgttgttacaattctttcagtaccgtacccacagcaataattgtgcttttcgtcgtttggctgatcatcgattcaaacactaaccgaattcgacttcgatcattatttggcttcctttctctgatcactttttgctatttttcatccgcgcatcgtttaagagtgatttttttttattttggcgttttgttttgatcaaaaatgcgaacagaaattaagtctcttctcatttttcaaatcaaagaaattcagagaaaatataaattttcaaaacaaaaacgaataatttaataattaaaataatatttttatatggaagagaaatgccaaaaattttttttgtaaaaaaactaagaatttcttaaaaaattctagtttatggccttgggtaacaagttttctatgccgaaaagacctctgtcccttctcggcagataaaatggcgtcctgtcatcagcggtatactgctccaactcgcgctcggctttctcatcctccggtggtctcccggttctgatgggttccgctgggtttcggaaaaagtaaatgttggcaaaatttttctgaaaattttaattaatttta

SEQ ID NO: 51424 - DNA, 1959 bp, Heterodera glycines
  Genomic contig location: Contig_ID=SeqID_3678; Location=462..2420; Strand=+
  SCN-specific regions: Sequence locations=1-196,236-406,435-511,536 -676,698-936,979-1243,1284-1358,1396-1595,1617-1768,1800-1807,1832 -1959
  Gene Ontology: Mol. function=purine nucleoside transporter activity; Cellular component=integral to plasma membrane; Biological process =purine nucleoside transport
acagaatctgccattctgattgagccgtccattatcacaatgaccgcgtccgaaattcattgcatgatgaccgccggctttgcatgcattgcgggcgctttattctccgcttatatcgcacttggggtacacaattaaatattaattgatccgttaattacattattaataggtcaaggggaagcatcgatttttgttttatattttatgattaaaaaaaaaactaaaattatatctattgaaaagctctaactttctgttcatatacgtgttatttttcagtttttaccacgaaattcttaaaaaaaagtataaaaatttatatgtgaattataacgtatttcctctaatattgtcccctccaacaaagcccaaaaatgggaggttgaaaaacccccgaggcctctattaaatatcttattaattttatttaacaaaattctgggccatggattttgcgtttttcagggcttaatgactcggcacgaaaatcgaaaatatggcaaatgtcatttaaattaattaaaataattttcaaatttcaaagaattgtccaatccatctgttgtccgccactttgatgaattctgcaatttcgttgggcatctccaaattggtctatcccgaggtggaacattcacagcataaggaggccgaagtgcgtgtgtgggtttggcacaaaatgtgccactgatttgaaaattagggttaatcgccgatccgatgcgggggttgaaaatttttattttctcgacttttatgaaaactttactccccgatgaaggtgttgcccaccaacatttttgtctttaatttctcgagccattcctgacaaattttgttgtcttcctcgatccccaactttgctctccgagagtcagagcttatcccgtttgaattttaaatcggaatgccaaggatttcttgtaatcacggaatttatttcaaaaaaaaatcaaaataatattttatttaattcagaagatgaaatttgccgagcgagacaatgaggagacaattttggagtgcattacagcatcctcaattcgtacggtaacacagtgtcattcatttcaaatacagtaatcgccccccccctatcctgctgactccgcccggttcagtcccattttgcaattgccattggtgccaatttggtcacttacattgccctgttggcatttttgaattcgactattggttggcttggctcaatggttggaatagcggaactctcattcaatgtatgtattatattggactgtaatgtactgtactgtatttttcaaaataattggtcgagaattgtggatttaaaatttttatgagagtcgagactgaggaaaaatgccattttctattaaatatatttttcatttatatttcaatatttttcagaaaatcctcggcttttgcttcttcccattggcctgggccatgggcgtctctgacgcacaaaacactgaggtaaaactggacctgatcaatgctttatgtaatcataaaaagctgatcgacactgaaatttcatgcttctttgaccttcggggaagaaattccccccaaaaaaaaaaattgaaaaattttctatcgattttccatttttgtattaattgcttaaaatggtataagagcaccattaaaaattgatgttaaaaagaattatgctaatatgtctttctgctggttaaaactcatttttaggctattggaatctttttttataaaacagaaaaaaaatgaaaatttattatttcaatagtcgtcgaaaataaatttttttgaaaaataattttaatgagagcacattaaataataaaaaataaaaattcatgtgctaaggtaatgttggacgaaacgatgaaagtggctgaactgatgggcatcaaaacggcactgaacgaattcattgcttaccaacgattggctcaaatggtgaccaacggcacacttaatggg

SEQ ID NO: 51425 - DNA, 233 bp, Heterodera glycines
  Genomic contig location: Contig_ID=SeqID_20838; Location=92..324; Strand=-
  SCN-specific regions: Sequence locations=1-233
atgctcgtcgactctctccgtcccgccactctttcgtcttccaaaaaacgttcagcgcattccatggacgacaccgaccaattcattggccacagtcccccgcacaaaaaacaactaatggacgaggaaaatgaccaaattttgacacaaaatacaccaaatgattcattggaccggcggaggccaattgcctttgccacaaaagcaattcacgcggggaatcggccagaaca

SEQ ID NO: 51426 - DNA, 419 bp, Heterodera glycines
  Genomic contig location: Contig_ID=SeqID_20838; Location=1298..1716; Strand=-
  SCN-specific regions: Sequence locations=1-304,326-419
gtaatgcttcttcgtcctaccgtaccctttgtgtccctctcccttttcctactgttgttccttttcatcgcttttccttccaccgatggcttcggagtcgaaagggctgtacgtgataaacgcggatggccttgggattggatcggcaaacaagcatgcaaaacagcggcaaattgcaaatgcaagtgagtcgaaaaagtgggcaattgcgctaaaaatgatttggcatggaaatgggggaggggggggggggtgggtcaaggctgatttggcaaaaaggacgacgacgatggcacttcacttccctttttagggatggcaaaagttgggccaaatgtgtaaagtcggaaggctacgcggccagcaattgttgcgacaaaaattacgtgtgggcatgttgcgggaagaagcccaaacaa

SEQ ID NO: 51427 - DNA, 1203 bp, Heterodera glycines
  Genomic contig location: Contig_ID=SeqID_20841; Location=20..1222; Strand=+
  SCN-specific regions: Sequence locations=1-588,632-869,908-1000,1022 -1203
ggtagacaaacagacaaagatcggacgcaacccagagttggtggacgtcgtcctgcattcggtgatccacaggtcgtcctttgctacttcataaatttgaccaaatgccaattttaaagtaatatgatttctcgcgatcactctgaaataactggcgaaacagacaacaaaggcaatttacggtattacattttggaccgttctttgaatgggacatatgtcaacgacacgagggtaacattacaatttttctttttcaattattcctttctgttcaacaggttaaagaaaaagttttgctgaatgagggcgacctgatcaaattcggccatgtcaatggggcagccataaatccgggcgaacacgcgcctcaacaatcggccgagttcatcttccgcttcgaacgtgcgctgccaaaattcgcctactttggctactcacaaaagggcgtccgagtccatccgcaccatcaaaatgagcacactcacaatcagcaacaacagcagaggagggcgtatatgcaggtgcagaagcgcaaatggcagggaaatggataaacaaccgctgggaagaaaggaacggcacaaattttaacaaaaaatacataactaatgaataaatattaaataaattcttcatttttcaatgagtttagatcaattccgaccgcattttgcccaccgaagtgtacgggtcattggctccaagtggtggcgcgagtgccgccgccgccgttgggggtgccaatggcccaacggtgccaagaccaatcgcgcctggcggtagctgtctcgctgctgtcactagcagtgtttcggtggttgccaccaccacggcttgcccctcctcgaccggtgctccgcccacttgcgctgccccctccttcccttttctcccctcctcttccaatggtgtaacaacatccgcttctgcaactgttattccaaggtgtttggccaccacttctgttcacaatagcatccaaatcgcccaattaaacgccatggcagcagcgacgacattagcaaacactgcggcggcatccgcagcatcaaataacgcggcgcaacaacaacagcagaggcatcagtccactgggggatcggccgacggcacgacaaactctgctgctaccgcctcagcattgaacgccttgaaccaattgggacttacatcggccactgaggaacaggtcgagttgat

SEQ ID NO: 51428 - DNA, 108 bp, Heterodera glycines
  Genomic contig location: Contig_ID=SeqID_20842; Location=238..345; Strand=-
  SCN-specific regions: Sequence locations=1-108
tcaaagccccaacttggcatttggaggcctggaactcaattccgcttgacccaattatcaatttgataaactctatgcctcgccgtattgaggctgtgatcaaatcac

SEQ ID NO: 51429 - DNA, 611 bp, Heterodera glycines
  Genomic contig location: Contig_ID=SeqID_20843; Location=713..1323; Strand=+
  SCN-specific regions: Sequence locations=1-55,104-216,238-243,293 -517,539-585,609-611
atgacaattcgacgttattcaggtcattcaattaaaattattcgtgtttaatacctttttaaaattctaattaaaaattattaattttataaattaattaaaagtcaataattaagggccccactaacaatcttttactttttggtgccgaatgtatctgttaaaaaatggcaatattctaaattccttaaaaactggtgacttttacattccttttattggattttattaagaatttgacagaaattaaatatataaactttagtttatttttaaacttaaatataaaattggccaaattaagtcaaaacactcaccgaaagattttttgtatcataaattttttttttggtttttatccaaattaagcatttatagtatgttcgatagctcaatgtgttattattattctgccaaactttttccaacgcccggaggagcaaaaattcattcttataattcatttcataattaataatttagctttgcttatttgcaaaacaatagcggtcaattatcatcagaagaatgctttggagaaaaggtatttattaattaaaccaaatattttccaataaatatttacattttttagatggtttataatttga

SEQ ID NO: 51430 - DNA, 636 bp, Heterodera glycines
  Genomic contig location: Contig_ID=SeqID_20847; Location=580..1215; Strand=-
  SCN-specific regions: Sequence locations=1-120,142-170,197-636
atgccaacctccgctgcaactgatgaccacaagttcaagcagtttatgttccggcataaaaacggcagcctccggcagaacggccaattattctgacaagaaattttcaagcagtgcttctgaaaagaaagcaacggcacaacaacaattggaaatgaaagcggtgaaaaaggaggagaaagaggaggaggaggagaaagtacagaaaacagcaaaagaacgggggaaatgccaagcggcgaattctccgctaatgacggtaaagcatgagatttgtgacgaagcttcagtgcatcacacattttaattgttcaggagaagaagccaattatggccgtcaaaggcatttcagtgctttcgggcggaactacgccaccggcacaaaaaggagggccctctcagagcggcggagggcgtccgttgtcggcggactccgactcggagagtgccaagtcatcatcaatggttggcgaatcgcgacgcaatcaccacacggtggtcggcgtggtcagtccgatgcagcaccaacaggagacgacgttggaaggaacagtgagagcgaattgtaccgaagagggaggagaaacagcagagaatgatcagccgatcggagagaaacggcacaaaggcaattag

SEQ ID NO: 51431 - DNA, 791 bp, Heterodera glycines
  misc_feature (23)..(23): n is a, c, g, or t
  Genomic contig location: Contig_ID=SeqID_3680; Location=3901..4691; Strand=-
  SCN-specific regions: Sequence locations=1-361,383-525,575-768,790-791
tagtcggaatgccgtcctcattntgcgttttcagcttacatccgaatgggcaaatattgcataattggcgagggttcgatcattcgtccgccctacaaatatttcagcaaaggtaatgggcaaatgaattccttcgtcttacatatttctgattatttttccattttaggctttacgtattttcccgtccattttggtgattacgttttcattgagagggtaacacattaaatgagtaattaaatgcaaagaaatttttatttatttttccgttgggacatcattctgaagggtttttaccaattgtttgtcgaggagggtcttcttttcaactccccacccccatttagtacctattttattttccccttttcatttcttcagggctgtgtggtcgttgccgcttacgtcggcagttttgtgcacatcggtcagaacagcatcgttggacagaactgtgtggtcaaagactgctgctttattcagcctgacagtgtgctaatgcccgacaccgtcgtccccccgtaaaatttataaatttaataaatattcgataattaaaataacaattattcgtttattctttttataaattgatgcggaattctggcaacacattcgggaaaggatcacagattcaccaacttaagcacaaattaattgtttttagcttttccatcgttggcggtaacccggcccgcgtgttggccgaatggcctccgacgtgccaatcgctgatggtcgatgcttgtgccggcttttttgacaatttccagccagaaacgacgatg

SEQ ID NO: 51432 - DNA, 2267 bp, Heterodera glycines
  Genomic contig location: Contig_ID=SeqID_3680; Location=1480..3746; Strand=-
  SCN-specific regions: Sequence locations=1-244,266-448,470-855,886 -976,998-1208,1230-1528,1550-2267
cttccgtttttgatgcttccgaccatcaaatggctcaatggcccttccgacgactgtccctcctccaaattgtttctgctcgactccgactccttttcgctgtttcgtgtgaatgacaagccccccggtggttccgctgctcatttggccggcccttccgctttttctgtcgaccctttggtttcgtcttgttccccccttttgcagcggcaggaacaggtaaggagaagaacttatccaaccggtcttcaaccatccgttatttttgcaggaattggtccgtaccttctccttggaccacaccagggacaatcggctggccattggcttcaccagcggtcggataagcgtcgtttccgctaacacacaaccgggcgtaaagttggtgcaaattcaatgcatttggcgagcaaaagctctaattttaaggtatttgcgaggcgaagacattcgggaggcgcagaaaggcatcaattgtttggattggaattttaatgattcgtcacgactctgtgcagcctatgaaaggtaaatgcaaactgtgaattcagagttgggagaaatggggcgatgtacagttggggatgggggggatgtggccaagtagggtaacgcgactgacgaaatcaccattttccattttataatttgtgatctcatcatcaggaaacacgtccttttcccaagttaaaatattcgtttaattccatgtttaggaatcgtggtactgatcatgccgtcgttgtgtacgatttgaatcggacgacgcgcaatgtgcgagaagtgccaatgtcaattttcgaggctaattttgccgaaaaagtgctcagtgtctgttggttcaggttcctcccctgcttctagttccaattttctcctccaattggtttgctctttttagagacgacccaaatttgctgctgatcaacgcaagtcgcggaattcgaattgcggacattcgcgagcacggcaatttccacagcactttgagtgtccaaaatccgttgatgggcctttgcagtgagcccaactttggctttcggttccgaaaaatgaattcattcactcagtcatccattttcaatttagttttgcttgttttgctcacaatttggtttttgtttacgatcggcgttctttgggctctgcgccattgcacgaaattgaagcttgtgtaagtaaatgggtgttgttttgtctttaaatgcattttaaataatatttttattgaataatgggagtcggctaatataaacaaaagatggggaagcgacagccatgaagtaatggtttttggattatttagagttattctgttctttcattgcatttttcgcccttttagtcaaattccaaagtgttaaacaaattggcgtggcacaaccgccgtcttttccatctgacagctttggccaaagattgtggcaatcttttcaatttttccatttcatcctccgccttttctgaccgtcaaaaaaatttgactggcgctgccgacccatcgtcgaacatttacagtcaattggacccatcacaacggaagggactcgacattgatggtcactcatacggagttcatttttactcggtttggattgttttttgatttaacttattgttgtaaatcattctttgaattcagctgcccggaatgtcgtctttgacctccttcgactggcacccgaccatcagtgatcggttggcacttttacctgtccaagaaaagccaatggcttttgcccattcgattgcctccacgaaacgaattgccataattaaagtatgtcttgcttcttatttttttcactagttttctgttgtgtttagcttcgtgatgacgtcaattccgtcatcggtccttccggtgacttttgcatttcggcggggccgcagctgaactttgaaaacggcgagaaattgttggccaaacccaactgcacttctgacattgacactgaaacactgttcaaacgacgggtgctcgccggctacggctacggaaattcactgaacgcattggcaagtgagtgaaaggcattcattcagtcattatttgttccaaaaaagcactgctcgaatattcgaagaaggccattgagagagatcaattcgcttcggatgacttacgcttttgctgggattggctttggatgcaattccaatcggcagatgctaacgaagtgcagaagaattacgggaccatgtgcgaagcattgtttggatgtcctcaattaatttactttcattttaaggttcgctggcattaa

SEQ ID NO: 51433 - DNA, 644 bp, Heterodera glycines
  Genomic contig location: Contig_ID=SeqID_3682; Location=333..976; Strand=+
  SCN-specific regions: Sequence locations=1-361,383-392,414-644
attcttcaaattctcaaaattcgcccttcgccaatgtttccaaacacaaattccttgtcaaattctccccattcggattctttcaatagaaattcaacctcaaaaaggtgggaggaaacaattgcttgggtcactcacggaaagcgattgtcacggcgaattctaaatccgtcaaaggatttttcggacggaggttgccccggggtgccgatgggttcacccagctttctttgatcactttagcgcttgttgcggagattatcgctcaacatttgcctcgttatgtgttatctttgaattcttttccccaagttcattcgttggctttgaagaaatacaattgggagactttggaaaggttagacagagagagaaggggggatttgcctaacaatgaaattttaaaaattcaaacgaagtttatttttctcgacgcaaccccacctttttgaaactaatttcagttgtcatttgctatttaaggaccgttttacgccatttgggcatccatatctccacagagcatatcgaatctttggcaaatgccgaagagggaaccatccaaaatttccttcccattcttcgatcccaaattgacgatgccatttccaaacggcactttcgaccctcttccaccagcagca

SEQ ID NO: 51434 - DNA, 1046 bp, Heterodera glycines
  Genomic contig location: Contig_ID=SeqID_3683; Location=590..1635; Strand=-
  SCN-specific regions: Sequence locations=1-12,34-960,983-1046
gaatcgctcggctgctccgtcgcctcttccgccaaccttcaactccgctcgcgtctgcttgacgctgccttggccatgcacaatgccctcggggtgaaaggcgcgtctctttgccttcgcttccccaaattctctccacccccgcgttcgctgactgcgttttgtgttcagacattggccgtgtccaccacgtgccgctcgtttctcaacccggcacgactttgctggtcaccgtccgactcgtccccgaaggccaaagcgacgaggtgcaaggcttggccatgcgatggatgcgcatggagaagcttttccgccgtcgtcaggcgtgtcccgcgcttgaggtgatggacaccggcggttgggctgtgttgcgctgacaattgtaactttcttgaagttcctctcacgcgaattactcccactgctcaacttctacgaatgttcgttggttccgctggagcccggcctttacgtcgcttacctccgcctgcactcctcgctcaactctatccatgtgctggtgcccgacaacctcatctcctccctcccatttgcaagtataataatcaaccttttttactaattgccctttaattgtctccccaattagataatttcccttttaagacgtccgttcgaattcgcacgtcacccgcgaagaatgggcccttctcaagtcgctggcggaggcggacgatgaaaacggagtgccattggttatggaaaaagctctgccggagcagcggagtttctacgagcagctgagcaaggcgtcgagcagagtttgtcgttggcaaaccaacggatgccaacatttgcagttcagttggtcaaccatttggaattggactcagaccaaatcctcggcacgcgtctttttcggcatcgtctcgtccaactcaacaagtacgtctcgctcattttggtgatgccgcgtgcggaggaagtgtgtcaagtgaatgcctgtgcaaagggagcggacaacggctcggccgtcgcaactttccgcggttgcgtttctgtgccggtgccggtcttccaaatga

SEQ ID NO: 51435 - DNA, 828 bp, Heterodera glycines
  Genomic contig location: Contig_ID=SeqID_20851; Location=75..902; Strand=-
  SCN-specific regions: Sequence locations=1-192,216-358,380-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatttttt

SEQ ID NO: 51436 - DNA, 428 bp, Heterodera glycines
  Genomic contig location: Contig_ID=SeqID_20852; Location=411..838; Strand=-
  SCN-specific regions: Sequence locations=1-223,245-428
atggagacttctttgttctcctcctcatcatgttcagcagcggttgaagatgatcagcagcagcaacaacctcctgcagctgatcaacaaccaacattggcgcccgattttgctactactgctgatcaacaacaacagcatccgccattgacgatggcacaggcgctgatcggcggcttccagccggctgtctcatcggcggctgatgctgctgatcaccaccacatcaatgaactgacgcttccgccacaccaattagcattgtcctcatcaccagcaacaattacgtcatcctcgttgatcatggcaccggactttggcgctgatcaatccgcagaacaacaacgacaagttggagctacggcagcaacgatggccaacggcaattgttcagcggcgattggcagcgaaatggcggcacaaaatcg

SEQ ID NO: 51437 - DNA, 768 bp, Heterodera glycines
  Genomic contig location: Contig_ID=SeqID_20855; Location=1473..2240; Strand=+
  SCN-specific regions: Sequence locations=1-152,188-745,767-768
atgcgcgatgcgcgatgcgcggccgcggtttttttctgtgcgcgctccagccctgctttgcatgcaaattatcgcctgcagcaatttgtttcgtggaaagcaaaggcaactgaatcatggcttgccatcgctgtaaaaaatgtggcaaatggaaaaattaatttaaagtttaaatatttttttaattccaggaagttgccagcgattcagaaatttttgatgccctcttcaaaataacattttacgcggaagtgaaaaggtaaaaatgatcgggccattgttaaagtgatcactgaccattgatcagagccaaaatcatctgaaaaaagtgatcaaagcccttagggaaagcattgcatatttcgaaagtttgaacaaaaatccctaaaaattccatttctatgctaaattccgatgctttgtcaaatgagaccttttctcgttcattcatcagtcattttggaatagcttttcgatcacatccaaaatttcatatatttctttttgttaataaaatttccaacaaaatttttcaggtggccaaatgggttggaagtatacaaatttcggcatgaaatggccacaatgggctggtcgctgcaaatcaaacaactcgacgtggacgagtggcgctaacggagcagagaaaagtggatatgagaatggaatgggaggggattaatgggaatgagcgatttgtttaaccaatttttttttttcacatttaacactttttgttgaaaaaacctttgcttttcatttttatta

SEQ ID NO: 51438 - DNA, 211 bp, Heterodera glycines
  Genomic contig location: Contig_ID=SeqID_20857; Location=75..285; Strand=+
  SCN-specific regions: Sequence locations=1-65,90-211
atttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagcca

SEQ ID NO: 51439 - DNA, 356 bp, Heterodera glycines
  Genomic contig location: Contig_ID=SeqID_20857; Location=643..998; Strand=+
  SCN-specific regions: Sequence locations=1-51,78-106,128-356
gaccgcgagtactacgagatcggccgccccttcttcgagaaggccggtgtcgcgcacaaggtggacttccgcgagggacccgcggtggaccacgtcgacaagctcctcgtggatgaggccaacgtgtgggcgttcgacttcgcgatcggcgacgccgtcaagcccaagtacgttaagtaacacgagcagatgctgcgcctggtgtaggtcggcggcaccatcgtgtatgacgacacgctagtggtgagcaccgtggtgatggcgcccgacacccccatgtcggacctcgatcgcaggttctccggcgtcatcagggaccgtcatcgtccgtctctccgccgaggaacgcatcgagg

SEQ ID NO: 51440 - DNA, 825 bp, Heterodera glycines
  Genomic contig location: Contig_ID=SeqID_20858; Location=351..1175; Strand=+
  SCN-specific regions: Sequence locations=1-741,787-825
atgtcaatttacgggttaaatcacgtgtcaattcacgggttaaatcacgtgacaatttacgggttaaatcacgtgtcaattcacggtcatgatttacgtgttaatttacggtcatgtaagtttaacttacagtcattattcacgtgtcaatttaagggttaattcacgtgacaattcccaggcatgatttacgtgttaattcaaaatcatgatttatgtgttaatacggtaatgattcaaatgttaattcccgggcatgatttacgtgttaatacacggtcgggattcacgtgttaattcacggtcatgtacgtttaatttacagtcattattcacgtgtcaatttacggcttaaagcacgtgtcaattcagctcattattcacatgtcaatttacgggttaaatcacgtgtcaattcacggtcatgatttacttgtaaattcacgggcatgatttacgtgttactttacgggcatgatttacgtgttaattcaaaatcatgatttacgtgttaatttacggtcatgatttacatgttaattcctgggcatgatttacgtgttaatacacggtcatgattcacgtgtcaattcagggtcatgtgcgtttaatttacagtcattattcagtgtcaatttacgggttaaagcacgtgtcaattttttatgtaacaattctttattaaatatatacaatagcatattaaatcattaggagtatgtttttagtgaaattaaagagataaaaaaattttacttttaattttccaaatttttaaatttatttgtctacaacccaatatctgtcttaagttaaaaatttaaa

SEQ ID NO: 51441 - DNA, 1046 bp, Heterodera glycines
  Genomic contig location: Contig_ID=SeqID_3684; Location=473..1518; Strand=-
  SCN-specific regions: Sequence locations=1-115,137-311,333-582,604 -867,889-1046
atgccgaacgaatgcagcggagaatgtaagtggcatttgtcaatgtttgaatttctgccgcttttctcaatttgagtggccacggaatgggcgaacactcgcgcaaattcacttccaatgggaattccttctgcacttttgaaggtgtcaccagagggacacacaattcgaagaacaatttacgattttgagggttaatggaagtcgccgtggaaatcgaagtgaaagaaacgacggaaaacgaagggacagatgaagcgaatggcacggcaaattcaaagccgaaaatggcacaggaaaagccgaaacggcagcagggggaggaggaagagtaagcgaggaaaacattggcagggagtgtgttgtggggactgtccgattttagccttttattggtgccatctctctctgccggcgaatttggccaccaccaaaagcatttcgccgcttctccgattaaaacggatgaggtacgattaataaaatcaaattgattttcccgtcggttgttcttcttccattcttcgcttcttcagctgcgccctctcccccaatttcggcactcttttcgccacaattcgccctcctcctcttccgccgccgtcggttctctccgccaattgcttcgcttcgacccctgccaatgtttcgacattggcgaagtgctcagaatttgtttttgagttttaaaatgcaaattgcttctcattcttttcaacagtttcgcgttcgaatggcggcggctcagcagaaaattgagaatttttgttcattgaatttggacaatgtgaaattaaagcaagaaaatggacaattgagacaaaagttggacaaaagcgaacatcggtaggaaaaggaggacaattaaaacacaaaaagcacacaaaataattctgaaggatcgcacttttggaggcgtcgcttttggaacggaacgaacgattgaaggaaatgctaaaggaaaatgtgttcatgagagcacaattcaaaaaagtgcagaacgaattcggaatgcaaacgctgaacgaagtgttcaatcggagggg

SEQ ID NO: 51442 - DNA, 2385 bp, Heterodera glycines
  Genomic contig location: Contig_ID=SeqID_3684; Location=2030..4414; Strand=+
  SCN-specific regions: Sequence locations=1-34,69-200,226-467,506 -543,567-700,722-832,854-976,998-1058,1080-1098,1151-1477,1501 -1532,1554-1707,1729-2385
  Gene Ontology: Mol. function=calcium ion binding; Cellular component =vesicle membrane; Biological process=axon guidance
atgagcgacgaattcgttgtggccaaattcgattacgaagcccaagaagaaagggtaaaaccaaaaactcaaataaattgggcattattttgatttttttggtctttttggtcaggaactttctgtgactaaaaatgaaaggcttaaattgctggacgacactaatccatggtggaaagtgagaaggaattcgacattcgaatttttaaaataatttttaaaaaacaggcgatgaacgcccgcggccaaattggctttgtcccaagcaattatatgcaaaaagagtcaattggtgagagaaggaaacggacaaaatcacttgaggaaatgaaaagttaaggcgagaaggacaaggagaaccttcgctcggcaaatcatttgagcaacggacatggaaaggttaattagtagccaattaaccctaattaattaattagtgtcccattgaatccgtccatgcgttttcctttatttctgttttccattcttcccctcccctttcagaggctccattccgtcgccgtcgttctgttcgattacgccccccaaagggttcgttttttccaaatttgaattcgcttggccaaattggcccatttgccatttgtccgtttaaggacgatgagttggcactgagaaggggcgtccgactgcgcgtgttggacaaatcggcggatgggtggtggaagggcgaggaggagggggccggggcccgccggggatggttcccctcaaattacgtgagggaacagccggcggacgacgaattgccggaactcagcgaaaacggaacgccaaaaatcaacggaattggcacaacggcggaggcaccgcaaacgcagcacagtccggacagagttttggaggtatcggcgggaaaaacaaatggaaaagcgcgggacggacagtgcaaaaacaaagggcaaattcggggcaatttcgaacaaatttccattcattttaatttgtaaaaaatttgaacatattttaacaatacgaaggaatttggccagaattaaaaaaccctccatttccataatggcttttaattttacattattttattaggattttatataagttctgtcaactttatcgaaaatttcatttaaaaattcataataaattcaaataataaaacaaatttaatcaaactttgcctgattattcccttatattagcaccatcttttcaccaattgattaggcttttcactttggcatcacaaagttatggcctttgatgaaattaaattcccatttattgaatgaattccctccaatcatcttaattgcactaatattcccaattgtttcctaatctttgcgccgatttgcttaataatgccgtgccttttcagattgtcctctgtctttactctttcgaagcacagaaccctcaggagctttcctttgtgaagcacgaacggttggacattctcgagcaccccgtggatgtgagccgattaatgggccactaattaattaatttatttattatggcaattaggatcccgagtggtggatggccaggaaccaatatggacagacaggtcggtctctgtctgctggtggccgttaattcgcttccccccagggctcgtccccaccaattacatcgaagtggtcgaccaaaaccccaacaggggcgccttcgactcccccggcgtaagtgccgcgcctccgtccgtgccctcctcttccctttcgcccgtccctccctcccctcggccaaactcttacattgacagttccgactggtggttttttttactagatttttgttaattagttaatgcattaagggaccaactgactgggccctacgcgcgacagccgtggcaagtgaaaacggagggagggaaacggcacatttagcaaaggcatagcccaggggtttaagccgactccccccgaattccgtccattctctgcatttgggcgtggcttttacctctcggcacgcccattctctaatggcgaaaaagtgcaggtattacggtcacataacacgggaacagtcggacactctgctgaaaacgcgcggcgttgagggcgattttttggttcgaaaaaatagaatgtttggcatttcttcgaaattttaatttttaggtgcgcgacagcgaatcgaagcccggagatttttccatttcgctgaaagactcggccaaaaacaaacacttttgggtgcaattcgacgccgcgagcgcccaatttataattggcaatcgccgattcgaatccatggaaaaattaatattgtgagcaaacggaaagccaaactgtggaaatttatttgaaattcactcttaggaattatatgagttcgccgatattcagcgacggaattgtgaaccttttcctgcggaaacctttaccaaaa

SEQ ID NO: 51443 - DNA, 2040 bp, Heterodera glycines
  Genomic contig location: Contig_ID=SeqID_3684; Location=4323..6362; Strand=-
  SCN-specific regions: Sequence locations=1-141,164-260,282-297,319 -500,523-643,665-732,788-935,978-986,1132-2040
atgcttttggctttggacacttacatgccaaagttttctcgacgaaatctccaccattttgcccaaatgatcgtcattttctgtttcattgttctgaccgttctggtgctgctaaaatatgaagtgagtcattttgagagagaaaagtgccattttcaaaccaatcgatcgacgtgtaatgccgtgtttccaacaatacattcgccatttgcccattaatttccctctctctcccccccccccccccattattccattccttcttcccatatgctaaaaagggtcaagcgacggtgctggtgatgaaccagctgggcaacgttttcatccagttcacttgggatgcgtgctatctctccggcaccgagttgatgcccaccgttttgcgtgcctcggccatggcgagtttttcgctggtcgcccaattcggtgctttgatcgcaccggcggtgagtcactggcaattcaaaatcaaactgatcatgctaaaacccttggaagttcttttgttgctttgtgcgtccgttttgcttctgtaccttccctccaccggcctttgccacgcttttcatttcccctcgggcgattgtcactttcacagttttgccaattgctttctgagtgggcatcgactcggtgtgccaattgatggcaatttgctggtgccatcccatgcgttcgttgtaatttggcactctctctctctctttgctttccctatgttttgctatatttttaattaattgcccaaaatttggccccagggcccatggattcttttcatcaatctcttcggcgtcattttcctcgagttcacttgggatgccaacgttttgtcggcggttgagtcaatgcccactctgttgcgctcttccgcccttggcagttgcagttgcatcgcgcgagtcggcggattttttgcgcctgtggttggctttttgtttttttatttcttttctctttttgtttgttttgttaacattgccaattaattaacaattactaattttatttaattatttataattgtattagttcaaattttaaagaaatttaaatgaattaaaaattgaaaatattaaaagaattagacaaattcggttaaattatttataaattttaattaattttgctctgattgaattcatatttatgactccccccatttgtcagttggttttcttcaacgagcattggggtgccagtgcctatttgaccgtttcacttttgggaagtgccaatttattcgtctcgtggatgtggctagtggacacgaaagtaaaaagaaacagtttaaaattcgaaatttgaattgtcttagggcgtcgatttggacgcggtcattttggacgaggaaagcgccgaaggcgaagaagcaaagaaaagttggacgagagaaaaccaaaaaggacagaacagtgagggagaaatgttcttgagaaaagcgtaacgggtaaaaaaacgaacgacgcacgaatactgtattgttgtaaaaagtacgatacttacaaaagatagtcattttactcagaaatcagtcgcaatttcattccctcgggccatttgccaatcgctaattgattataagtggatgtactcacaacataattaatttatcagctttaaaatgtcaaatgttctgttgctttgtatacaaatattaatgaaggagcaaaatttccaattttcacccaaatgctctcgcaattccgagaaaggcaagcaactattaacgaaagtgctccctaattacacaattaagcagtgttaccatgttttgtcttgtctgttattttatacattcaaacggatgagtttttggtttttaatttgaaaatcaaaaaaatgaaaatgaattctttggccttttgtcccttttctttggcggttcattcgctgctcttttggtcagctgtttttccccctcacttttctgttccgtcgtttattttggtaaaggtttccgcaggaaaaggttcacaattccgtcgctgaatatcggcgaactcatataattcctaagagtgaatttcaaataaa

SEQ ID NO: 51444 - DNA, 513 bp, Heterodera glycines
  Genomic contig location: Contig_ID=SeqID_3685; Location=1072..1584; Strand=+
  SCN-specific regions: Sequence locations=1-97,119-362,384-404,426-513
atggaggagggaacggtcaaaatatgggatacggtggaggatacggtggaggatacggtggaggatacggtggaggatacggtggcggtggctataatcagtgtccgcttggccaaacggcggacggaagtcagtgaatggggcaaaaagagtgggggaattagatgggaaagcctacgcctaattaacccttaattgggctgatgactcactgtcattaaaatctcttatgaaagatttaaaaaatgtgataaccttcaaaccgttcactcattttcagcttgtgatggcctcaaattcttttgcatggatcccaaagagaactgttacaacggcatttgttgtgagtgcttccccttccctccctttggccccatttaaccgctttttcctttttaggccaaccttcccaaaaccccggcttttacggctgtccgttgggcactttcgccgatggcacttgcagcggcagcctcaaattttggtgcgccgacccacgagaaacatgcgtaa

SEQ ID NO: 51445 - DNA, 379 bp, Heterodera glycines
  Genomic contig location: Contig_ID=SeqID_3685; Location=1640..2018; Strand=-
  SCN-specific regions: Sequence locations=1-330,358-379
cattgttcccgtaccatagccgttcattgtttccataccgtagccgttcattccgtagggcattgttcccgtaccatagccgttcattgttcccataccgtagccgttcattccgtagggcattgttcccgtaccatagccgttcattgttcccataccgtagccgttcattgttcccataccgtagccgttcattgttcccataccgtagccgttcattccgtagggcattgttcccataccatatccgttcattccggtgccgataccgtatccgttcggtatgttcccgtaaggcgatgttcctcccgtaccgtaacctccatacggatttgtgttgctgctgctgctgctcccttgctgacctttttaaaaaaat

SEQ ID NO: 51446 - DNA, 290 bp, Heterodera glycines
  Genomic contig location: Contig_ID=SeqID_3685; Location=1764..2053; Strand=+
  SCN-specific regions: Sequence locations=1-290
atgaacggatatggtatgggaacaatgccctacggaatgaacggctacggtatgggaacaatgaacggctacggtatgggaacaatgaacggctacggtatgggaacaatgaacggctatggtacgggaacaatgccctacggaatgaacggctacggtatgggaacaatgaacggctatggtacgggaacaatgccctacggaatgaacggctacggtatggaaacaatgaacggctatggtacgggaacaatgccctacggaatgaacggctacggtatgggaggcgg

SEQ ID NO: 51447 - DNA, 680 bp, Heterodera glycines
  Genomic contig location: Contig_ID=SeqID_20861; Location=202..881; Strand=+
  SCN-specific regions: Sequence locations=1-27,52-162,204-231,288 -378,488-501,556-593,616-680
ctatacatttattttcattttgctatggtaacaccaaatgggggaggaggacggtgccgacgaattcggcacctttggctgtccatgtttctgctgttgttggtaattgcaaccactgcggcactgttgggactgttgacacccaggtgaaaagaaaatctcattaattcaaattaaaataataattttatttatttatttaagttggcaagttgtttatttggaggtaagaaaatttaaattttagaaaaatgaacaaatataatactttaaatttaaaatattaagatgatagacttttgaccttcaattgcattgattctctatatttttccaacaaaatcttaaaaaaattgtgtgaatagcaaattttcatccattttattaaaaataaattaattaaatttttcaatgtttcattaaaatatttacgaaattattgtttattgtaaatattttggtcaaatattatttttataaattttttcgtcttttttggtctttttaaatattttaataaattttggtatttttcgtaaatatttatttaaatatgtatttaggaatcaattaatttaggatggtcgtactgaacatcatcatggtttgtggttggattgtaagcgcgacttttcatatgactacggcagacctcgtgaatactatgagacgctacacag

SEQ ID NO: 51448 - DNA, 1079 bp, Heterodera glycines
  Genomic contig location: Contig_ID=SeqID_20863; Location=139..1217; Strand=-
  SCN-specific regions: Sequence locations=1-84,129-228,251-335,373 -411,441-669,710-912,1004-1079
  Gene Ontology: Mol. function=polynucleotide adenylyltransferase activity; Cellular component=cytoplasm; Biological process=mRNA polyadenylation
atggccacccaaatttgcgttctgttcccaaatgcgcctttgtcctttttgctatttcaattcttcgccatttattcgaaatggtaattaaaattaaataaaataaaataattttaattttattttttggagggattgggccaatgagccgataaaattggcccaattggcaccggcgactctcaacaaaaacgtgcgcaattggcgcccctttttgggacggagttcgatgacagtgatcactccgacattccctcaacaaaacgcaactttcaacgtcaacaaattcactctcagaaaaatagtggaggaattggagaacggtgggaaaatgcaaaaaaataattaattaattaattgaaattttatttagccaatgaaatattagcggaaaatccccaaaattggagcaaagtttttgaggaaataaaaatagaagaaaaataccggcactttgcggtaatcgtttgttcagctgttgattataaacggtactcaacaaattgtgcctttcaaaagagtaaaattcgccaaaaattatttgaatgggcaaatttggaaaagaattcctcccaattggacaattaccatttgatgccgcaatttgagcagaaaacaaagtgcaaaatgttaccaaagtgtgcccattaatccccaaattgtttgggattgctaattaattaattaatttagccaagggcccgctttttgcactttttggctcgtcggtctttcgctgaaagcgcaaaatggagaagatgataagcatttggtgccaatttatacactcgatttagccaattcacaacaatcggttgaacaatttttgatggattcattttttacggagggacaaacacttcaaaaaaggtaattaatcggacataaatgagagaaatgctaaaaaaatgcattaattaatgcaattaattgcttacaaatgaattaattaacgcaattaatcgctaaaaaatgctaattaaggcattaattaattaattaaggatggagcaaatgcaaagcgacggcaacggcagcagaagagacttttaaaaaggataagcatttgaaataataaa

SEQ ID NO: 51449 - DNA, 617 bp, Heterodera glycines
  Genomic contig location: Contig_ID=SeqID_20864; Location=29..645; Strand=+
  SCN-specific regions: Sequence locations=1-326,348-617
atggtaatactctcagggatcttaaaaatctgttccaatacaaaacacaatgtgaacgaatagaagcaatgaaggaaatgaatccaaaatccgggtccggtcgggaacccggacccggccaaccctaggagttttcaaattcaaaagttatttaaaaaaaactaatttaggctgaggatgctttgttgtccgaatttgtcaaaggactggcaacaaattttgacaagtttttacgattgtttttatttgagaaattccaaaaaaattattggcaaaaatatgcggcacattttggcgttgtgtatttgatgaaaaagtattggcaatgtgatgagaatattttaaatggatctgacgaagaatgtcaattctatggcaaatatttgcatattttgtacgaatatttattccgacttaatcttgaaggtttattttttcattattttagaaagaattgccattaaatatgataaaaccaaatttgggatccttcagtggaattggaactcaattttttttttttttgcgggacgggatcccgttgagattagccaatatctcgcaaaaacatcaatagtgatgagaattatatttattataaaccccgaaatatttaa

SEQ ID NO: 51450 - DNA, 589 bp, Heterodera glycines
  Genomic contig location: Contig_ID=SeqID_20865; Location=204..792; Strand=+
  SCN-specific regions: Sequence locations=1-32,54-105,127-498,525-589
atggcacaactgatgccgatgattccccaaaaatggcgcagaccagtgccatggacatcaaaaatttggcaccaagaaaataggcaggctaacagggatgcgattagcctgtaagcaagaaaaaatttcacaacctgccaaaaggaaaaccggaaaattcaaaaataaccaaaaaaattttttgtaatgtttttaatttttcaaagattttaagacagaaaagttgaaagaagttgggttgaacagtgaaattttttaatttttttgacaattatttaacaaaaatgattttgaaatgccaattttagcaattcattaatcgcatctctgcagcgaagcctaaacccaaaagacagagaatgtgattacaaaaatgagagctgttagttagcccatgcattcattagttttattgcaaccatttttattgtttccattgaaagagatttgttgataaaacaaaaacggcattattggacatcttaaaaaaattgtgcatcctttttggttttttgaaaaattttgagaaaaaaataatgatagttacgccttaaattttgaagaaaaatttttaaaaatgataaaaaaa

SEQ ID NO: 51451 - DNA, 530 bp, Heterodera glycines
  Genomic contig location: Contig_ID=SeqID_20866; Location=54..583; Strand=-
  SCN-specific regions: Sequence locations=1-99,124-241,283-349,373 -397,419-530
atgccaattaatgagctgattttgcaattggcaattgacacagcgaatgaatggcaaacaaatgaaagtgccgaaagaataatacaagaaaattttgacaaaaatttaaaggaaatgcttaaaaaacggaaatcacgacaattgaggacggtcgatggaaagccaaggacctgagaaataacaagcatttgattatcgccctttcaaaattcgatgattcgctcaattgggaaagttattcaataaaataaattatatatattttttattaatttaaatttagattgatgattgcttatttactgaatttgttataggaaaaacgacaagtattgacaaattttttaagaatgatgaagaagattcagagtcaaaagtagcacatattggcattttgtatttgatgaaaatgaattggcaatgtgacaaaattgatggaaaatttgatgaatacgaacagagagaatgccaaaaataccgtagatatttcgacattttgtatgaatatttgagccgaatttacgttgaag

SEQ ID NO: 51452 - DNA, 561 bp, Heterodera glycines
  Genomic contig location: Contig_ID=SeqID_20867; Location=636..1196; Strand=-
  SCN-specific regions: Sequence locations=1-129,156-159,181-232,254 -297,320-561
atgactacagaggaagtttataatacaaatcatattttgaatgagccaaaacaacacattctgaacggtgactgtggcgtttcaacgtcgacggctgttaaatcgcagcaaatcaatgagatgacgagtaaagactactactttgactcatacgcacattttggaattcacgaggtatttacttggccgtggatttatattttgactcattttttaagtcactaaaatataattgagcaaactccaggaaatgttgaaagacgaagttcggacagtgacttatcggaacgcaatttaccacaaccgtcacctcttcaagaacaaagtggtgatggacgtcggttccgggacgggtattctttcgatgtttgctgctcgcgccggggcaaagaaagtttttgcggtacgcttttgattaatggacgacacattaatgatgagttttggccctgctcagggtggaatactcgaaaaatggccacccaatcgaaaaaaatcatcaaagacaatcagatggacggagtcattgaggtcatccacagcaaaattggaggacattga

SEQ ID NO: 51453 - DNA, 400 bp, Heterodera glycines
  Genomic contig location: Contig_ID=SeqID_20869; Location=109..508; Strand=+
  SCN-specific regions: Sequence locations=1-168,190-400
atgaagcccgctttattactgatatttatttttcttgtattttatttccaaatttattctgcaaattcgactgaatgcggtggcattccgacgggtaaaatgaaaacatttaaatatacttggcagaaactggaaccgaataaaccagtggaaatcaaatattctgcttccaaattaaaaggaaaagaagtgattttgcaacaaaaaaaatgccaatttatttcgaaataattacaaaagagtataagtttgtttaatggtgccattcttaggtgccatttttacagatttactggcaaaaatggtgaacccgagaacaaatgtgtgatcatcaaaatttatagcaacgacagggttcgccaacatttgcggaccgactttttgcgggtgaacctgttaa

SEQ ID NO: 51454 - DNA, 180 bp, Heterodera glycines
  Genomic contig location: Contig_ID=SeqID_20870; Location=260..439; Strand=-
  SCN-specific regions: Sequence locations=1-180
atggtaggtaaagctgattttctggaaaactaataagcaacaattatcattacttgagctgattaattgataattttaagattaatatttcagaattttaaattaataggggaaaagagaatggtgcgaagcagattcaatgagaaataatgtgcgaaaacgtgaaaagagctgaataaa

SEQ ID NO: 51455 - DNA, 1633 bp, Heterodera glycines
  Genomic contig location: Contig_ID=SeqID_20870; Location=592..2224; Strand=+
  SCN-specific regions: Sequence locations=1-111,204-227,280-448,470 -541,585-675,697-847,870-1055,1077-1279,1324-1342,1379-1440,1462-1633
atggtaaaactgggctgctgaaaacacattgacatattttgatcatcaaaattacttgtttaataaacaagaaaaaaatacaaatgaattttacacccaaaatatttctatattacttaatattaatcaattatattaacatatttaaccaaaagatttacaaaaaaaaaaattaattatataaattatataattcattaatttgatcaaaattattaaaaaagccgattaatacaaataaattaaagaacattaaatttttatttatatttttattttgagaaagattttttatgaagaaagttttataatataatcgctgataaaaacaaatgaacattattattcatttgactaaaacatcgtctcccaacaataaaaagaaaaaaacccccaagaaataaaaaaatttcaatgacatgagcactgtgaaattaaggccgaaaagataaatattttaattaattatcaaaatacttaaagaactaaaggcgatcggtgtcggcctgttattttctaaaattacaaaatctttgatggcatataatttttttacatttattagaaatttagaaaaaatatttctaatgtacctttcgatgcagatcagcaaaactcaattgcaaaccgtagtcagacataatattattttacaaatatatttaggcaaaatcatttcaaatttaatttaagtttgattttattgataatggtggattttaaaatagttgactttcatatttttttgcttactttagcatcttatgcttttttgtgcttattgacattatttttttaatttaactaaaacatcgtcgcccagcaatgaaaaaaaaacccctatgaaataaaaaatttccttgaaaacttcaaggacaaacagcacgtgtataaaaggcatgataaatatttatttaatacgttttaaataattacccaaatgattaatgaattaataaagtcaaatacttttaaaaaaacttaaattatccagaatcttggtccttacaaattagcgtttaatgttttaatcaaataattttctaatgatttctatgaaaacttttcaaatgtttgtttctgagttgacaagcgaactgtgagaatttttaattttttaaacgaatccatagtcaaatcttgagaaagttgtgagcgtttccgtgaatcgttatgtcagtttccctttctgattatttcatattcgccattagccattataagacacgtatccatttttcttttgagaatgactaatgaaaaagtccaattatttccctattaaatttatttacaattttatgaattaaatacaaaatatttgtgaatgtgtttactttgcttttaattcatttaattttaacttttttttaaatttgctcacttaggggaaactgtcaagattacaaaaaaaatttaatttctttgcatttgcttttcttaatatttgaatattttacgttttacataaactatttatattcgttatttttattggataatcaatcttccgatgtttgatcaacatatcattatatttggctgaaaatcattcttcaaaaaacaaccattcgtagacggagtaccaattcattttcccaaattgcctttttgctggcaaaaatatcggtta

SEQ ID NO: 51456 - DNA, 312 bp, Heterodera glycines
  Genomic contig location: Contig_ID=SeqID_20871; Location=395..706; Strand=+
  SCN-specific regions: Sequence locations=1-245,267-271,293-312
cctcaaatgccagcacattcactgctacaaaaaatggcctggccacaagttcgacacgttcatgcacgtcactgtagccgaacagcaaaagcaacaacattccccaaaactatgtgctgcttctgagcatggaacaaacaaatcccactgcttttgtccaccattgacggatttggattcactgcacaaaatgttgcgggtgaaaggcgcacgccgagtaaccgtacagccttggctagcagtaaacggagaaacggagaacaacacgaacaacagcaacaacagagtatcaggaacaattgcagctgttgc

SEQ ID NO: 51457 - DNA, 1131 bp, Heterodera glycines
  Genomic contig location: Contig_ID=SeqID_20872; Location=177..1307; Strand=-
  SCN-specific regions: Sequence locations=1-973,995-1131
atgatcgacaattttcttctagtgaagccgccaaacaaatcgatcaataatgtgtccctgcttaaagcggtactccaaaaagatttccctgaagtctttgaagaaggactgggacactgctcaaaggcaaaggcgcatctcattttgcggtctgatgcaaagcctatattttgccgagcccgcccaattccacatggcgccatggaagctgtgaatgccgaattggaccgtcttcttcaaattggcgcaattaagccaatcgatttcagtcattgggccgcaccgatcttggccgtaaaaaagaaaaacggcaagacgagagtctgcatcgacttctcaactggcctcaacaatgcattggaattgaaccggcacccactgccaaggccggacgacatctacgcttcactgaatggcgcgaaatttttctcaaatttggatttgcgcgatgcatatttgcaaatggaaatggatgacaaatccaagcaattgtgcgccatcaacacgcatcgcggactcttccaatgccaacgcctgccattcggagtcaaatcggcaccggcaatatttcaacatctgatggaccaaatttgtgccggtatcccaggtgtattcgcgtatcttgacgatggattaatcgccacaaaaacgcttgatcaacacatcacggcactgtacactctttttggacgcataaaagaatatggtcttcgcatccaactggacaaatgcaaatttttgcagcccgaacttttgttccttgggcatattgtgtcagcaaatggcattcgtcctgacccatcgcgttcggacgctattcggaaaatgcccgcaccgatcgacaaaagcacgctccgatcattcttgggagctttgaattattatggcagatttgtgaaatgcatgcgtgaattgcgtgcaccgctcgacaaactcctccaaaaggacgtagtttggaattggacgtccgaacagcaaaatgcttttgaaaaagcaaaggaaacgatgacgtccgaccttctgctgacccattacgacccggcacgcccaatcgtcgtatcagcagatgcgtccaaagatggaatcggcgccacattaagccacacattccccgacaaaaaggaaaaagtg

SEQ ID NO: 51458 - DNA, 4641 bp, Heterodera glycines
  Genomic contig location: Contig_ID=SeqID_3686; Location=53..4693; Strand=-
  SCN-specific regions: Sequence locations=1-509,531-1422,1444 -1573,1595-1760,1783-1833,1858-1865,1887-2414,2440-2490,2514 -2539,2561-2680,2702-2731,2755-3240,3583-4482,4504-4561,4584-4641
tgacgacgattcagtgtacgttgaaaaaccgacaattcagtgtcagaaaatttggcaaaaaaaattccaagtcattgcttttcttcgttccaatcagcaaattttcgacaaaagaggcacctatttatatttgtggattccatcaccacacaacacggatggccagccaatttgggatgtttttgttagtgaaatttggcccattttttcgacaaacattcaccatttggacttttacaatggtgatcatttggaccatttgcttcgtcgcacttcgccgacaattttcactgatctcaatcagttggtttcaatcaattccgttgatttgttgcctgatgcaattgatgattttgatgtgccaaatgcaacggctggccaagcattgtccaaatggttgcactctccgagaaaagatggccaacccaagcgattgcattgctttgatcacaacgaacaagggaacaccaattgggtcaacaatttcaaggaggtgtggtccgggagggagcaggacattgtccaaatgatcaccatgggaaaagcccaagtgatgaatattttccaaaaaaattggccagatttcgcgaacaaaaatatcccaaatccgctggccatccgtggtgtgtggtgatggaatccacaagtctaaattggtgcctcttttgtcgaaaatttggtgatttgaacgaagaaaagcgatgacggagtgatcgatgtaactgcaaaaagggaatgaatgcttttattgccatagctcagatttttaattactcaatatgaaggcatttaaagcgaattttgctgcgcaacaacggtcgtcgggccatggaaatggcacaaatttgtcatccatctttacataaagtttcggttctggtcctttgtccttgcgaatttcgattgttttccaaattgtcaattcgcttttgccatcgaaatgttagtccaccaacgcattgaaacgtggcgaaagaagtgccaatttgaggccgagttgggcatgggcaaacgatgggaaaatgtccatccaaacgtcgttgcaaatccaaaatgggtgccggattcgctgcaaacaaagtgctggacacattaaggctgctaaatttcccgacacgagagtagtatatagcgtcaaaagcgagcgggttccgagcgggtgtttaccgcacaaacccaaacctacgggaggggtgttttcttttgaaggtgccgcccgctcacaaacccaaacctacgggaggggtgttttcttttgaaggtgccgcccgctcacaaacccaaacctacgggaggggtgttttcttttgaaggtgccgccggctcacaaacccgtgcctattggactacatctgaagctgccgccaagaaccaaaccctatgggaggggcgcagccctttgaagttgccgccccatcaaaacccaggaggggaggggggtgtttcaaaaccaaaacctattggaccactttgaagttgccgcccgctcacatcctgagcctatgggatattctttgaactctgccgccttgtggattttaatttacccaaatccgtgcgggtgttttttcaccccgcaccgcgcagcgccgcgggaaggtcatcaatcatcctcctgtcaccaaaagtgacaggtgaaggaaattcaatttttttcttttgcaaatttaatcctaatttctaaaggctaaatccaaactacttagacattacattattcgcaatcctgagatttttttttgtgatgctttttctgatcctgaaattaaaaattcatttttgaaaatgtgccaaaacagtgcgtggttttttttgcatttcctctccacccgccccgcgccgcgatgccgccgccgcgaaatgtaatcgataatggaatttggaagtgaattaattgatattggcagaaagccataaataattattgaattggacaataaaatccaatttaaaagtaaaatcgaaaataaagaaaaaacttttccaaaagtaggtcacctgtcaggtgattgatgggtttttatttctcttccattatttcgcaatacgcacgtgactttttgttcagttatttcgcaatatggccttctaaattaggtcaactgtcaataaaatgtgattgattggtctcttatttcgcaatttccccccattattcgtaatgtgcacgtgacttttagttttttccaaatatttcgcaatatggcccctaattttgcaaacctgtcacaaaaaaaaaaaaatgattgatgactttcgaaataaggaatatccaaccgatttttgcacggtttttgaataaaatgtgacagctgtctaccgaaatgattgatgacccccttaaattaaggcaaacccagacagtcacgtgactagacccctccccctttttgcctatttcgcacacccggcccaaattgaaaatcattcaactaaatagttggatttcattaaactctcttcgcgctctaattttaattcactccgctctattttaattaaattaattaaatcttctattaaattcccgtctttttcttttctaatctctcttcactctttaattttactgcatcaatttcgcggtttttgttttaaaatgccttcaaaacgcaacggaagctctgttcaatgcggaccgtcgaccaaaaaatgggatttccgttcaatcgggtaagcgttaataaaatattaaagaaaatattaagagacaacgtaatcgttttctaccaattaaaaaataaataaattttaggaacaattttactgaagaaatggaaaattataaattgctggattaccaatcgacaacttgcgaaaaaatttggatttacgaagaacattacggaatttcgtgtcaacccggacgggggacgccctgatgaagcaatgagggaagcgatcgacgacatgataaaggtggcttttaagactacggaagaaaaaatgaagcgaaaagtgcggatgtttggagtggcaattacgggtgccgggcttgctttcccggtgtgggtgccgtatcgggcgtacccccagaacaatgcggatgttatcatggaggagattaataagctggggcagagcggggacggggatgaaaataagaaaatgcttttattatcggaaccgattactataaaaattacttgcgtgaccatgcccagtggagaggggccgaggaatgtccacaaatttgactttggattcaaggaacaccagcggatagggtaagatttttccaattaataaaaataaaataaaaaaatagaaaaaatcaataaataaatttaaaataattatttctaaaaaatttaatgaagcaaaaaaaaattttttttttaaagaaaaaaatgaaaaaataataatttaatgaaacaaaaaaacagaataaaattaaaaataaagaaagtaaaaaataaatttaaaataattatttttaaaaaatttaatgaaacaaaaaaaaatttaaagaaaaaaatgaaaaaaaagaataaagaagatgtaaaaaataaaaataaacttaaaatatttatttttaaataatttaattatgcaaaaaaaaatataataaagtaaattttaggattgtgaatactgataaattttgccttttttacgcactgacgtcgtcgatgaattatttaattatggaccgttttgcatttaatcgatttatgaaaaatattgtgagacagagggatgcagctattgagcttttacgtaattgtggaattgatattaacgaatatagctatggtgtggaacacttgccgaatgttcagaattattgggtgggctttaaaaattgagaaaacggaaaattaataaatttttcaggatgagatttaccccggtaaataccgggtggtggcatttgagaagtctgcggatccgcggaaatcgatccgagttttgtggaagggaccgatgggacgcgaaaatgtagtgccgatatttttggagaataatcactgggatggtctaaagaaatacgtctgctttttcaaccgtgggaggaagttctgcgttgaatgtgaatgtttttacgatcaggatgtttatcatacttttgagtgccgggcgagatgttattactgcaatagagttggaggaatgccgtgtgaaaaggagagtggagtgaagattgagtgcccgaagtgccatcgctatttttacaattgggggtgctacaattatcatcagggacatcagacttgcaaattatggaggcgttgcgtgatctgtgacaagacatatttatttaacccgaagaaggatcatgaatgcggagagacttattgccagctttgtagtgtgagccatgaccccaagcggggttgttatattatgccgatcgaggaaaatgaggaaaaagatgtctacagaattgtagtttgggtaagatttaataaaacaacacgttaacaaaatagatattgattttcaggattcggaaacatcgcaggatacaatttacaagggggatcagaaggagcatgtaatcaattatatttcggtgagagttacgtgtacggaatgctgtgacgacaaacataggacgaattgtaaaatttgtggggaggagaggaccaaggattggagcgaggcagagggacatgacccaacgaaggattttgtgga

SEQ ID NO: 51459 - DNA, 497 bp, Heterodera glycines
  Genomic contig location: Contig_ID=SeqID_20874; Location=230..726; Strand=-
  SCN-specific regions: Sequence locations=1-192,215-497
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgataataaagcatcagagtgctaaaattgacttgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcggggggactgcccgaaaacccaaaaaaaaatttttt

SEQ ID NO: 51460 - DNA, 1316 bp, Heterodera glycines
  Genomic contig location: Contig_ID=SeqID_20877; Location=111..1426; Strand=+
  SCN-specific regions: Sequence locations=1-447,470-1092,1114-1316
atgcttctaaaacttccgatatttttgtactcttcccgtcagtttttccgtgccgttgcttttgtgagtgtttaaaatgccattgatttttcttttaatttcccctatttcttcaacaggttcggcctcagcagcgtcttctgtccgtccgtctctcgtcgaccgccgccaaaacgccggtccaggagttcggctttgagtatctgaagcggcagatgaacctgggcaggccgttgtcgccgcacttgcaaatttacaagccccagttgacctgggtgatgtccggcgtgcatcggatcctcgcctgcatcatgtccggaggtgatgggcaccatgtaatttgaacatataaaattgaggcgtaatgagtacctggggtgtatatatccccaaagggtaaaaattccttaaaggcaagtcttatgtttttgtaaaaaaatttggcgctatattaaaaatggtcaattttgaaaattttttcaatttttttttgtttttttacacataatgatgaatattaagtattaacagcacaattatggtgaataaaatgtatattcacgatttttatccaaaaaaaaatttacaaaacaaaagggtcccccctatggtttttgataaaatacaaaatctatcactttataactagcgccaaatttgcttaataggcccaaataattgtcatattcgtgatcagcgacctttaaaacccccgggtatttggtttcaggactttttaaacaaaaaaaaattttgaccaaaaaaaagttgaaaacatttttcaaaattgaccacttttaatatagcgccaaaaattttattgtacgagtgccattgactcagcgcacccaaccccatttagtaaaattaaaacttaaaatcgtggttgcgtgtcgaatttgataatttttcccccaatttaagcgcttttggtcggcgttttcgtttttggcatttgttcggtcgatttcacttcgttcgcggaacggcttaactcgtggaatttgtggcgaccggtgaccaattcagtcaaatttgtgatcgcctttcccattgtctaccacatactcaacggaatccgatttatggtctcatttttacatttaaatacacataaattgaatttttactatccaaattactatcattttcaggcttttgacatggccaaaggcaccgaattggcgtccgtttaccgctccggctatttggtgatcggcttgtccacgctcatttccctgctcattgtggccaattcgaagcatttgacgaaggaacagttccaacagaagtacaagaaggaagcgaacaaatag

SEQ ID NO: 51461 - DNA, 1310 bp, Heterodera glycines
  Genomic contig location: Contig_ID=SeqID_20878; Location=233..1542; Strand=+
  SCN-specific regions: Sequence locations=1-78,103-346,368-445,467 -779,801-839,864-894,941-953,976-1041,1077-1310
atggtggcggagggattgccggcggatgatggtgattacaacaacagtttcatggacaccagtgaggacagtcgggacggtgttggtggtggtggtggtggtcatgctgcaatggtgccaatggatgctgctgctgacctgttgatgatgtccaacggtggtggacagcatgcaaccaatgggaacatgttgttggttggcacaccgccgactagcacaacaatcattgatgaaccggtcggcgaaattggtcggtttgatctacataaatcagggaggtatatgggggaacgggggtgtcagatcctcaaatcacccgcgaaaattgggaattttggatatatattttttggcaattgggccgaatgacgcggcgatatcaatgaaaattgagagacttttgattgtgatgataaaattgcagatttggtcatcatcgatggtgtggtggcgggtgactttgcggatgagcaacaccaacaggaggacgctgtggcacagcatggtggcttcacaaatgcgaaggaacgggatcaggcaaatttcccaaaaattaattgtatacatgaaggaagatatatggctttcatatctccaaattttgaatttcacttttttttttactttcagtttgagcgctaccgaaatttgttggaatttggtcatcacatttcacaatttgcgctcaaaacggatgccgaggaagggccgtgccaaggctcggcaccactccgacagcgaatgaatgtatgttatttttgatgttggaaatactgttattgttttcgtcattatcaaggcatttgtagtcaagccggccaattggagtttaattcatcaaaaaataataataaaaattaaaagaaacaaatatgaattttctatgagtgtttcaaatattttaatgaaattgtatattttttcaaaataaaatttaaatggtttctttaatttttctagaaatttttaaaaaatcctaaattcggaagtgttttttacagcaactttttgtggtgcggcttaattggacctccatccccctataaataaaaatttttgttttgaaaattaaaaaagtaggtatacctatgtatggtacggtacgtttggatccaaaatctttgatatttactccgtatacaataatattttactgtataatcccgcattttcaggaggccttttcgttgctgtgctatcctgacccaactcaatctgctcatgccaatctgtttgatcaaatccaacgggatttggttgccaaggcgttgaatgcggctattttaggcatattttttttgccttcctaa

SEQ ID NO: 51462 - DNA, 403 bp, Heterodera glycines
  Genomic contig location: Contig_ID=SeqID_20879; Location=215..617; Strand=-
  SCN-specific regions: Sequence locations=1-53,165-330,353-359
atgtcatcattcacgacttcttcatcagcggacgaattttctcctctccaacgtaaaaaatttgttaaaattcataattaaaatacaataataaaaacatttttcaataattaaatttgctaaaattaatttttttttttttttaaattaatttttcatttttagcaatttttccaaatctgagcacatcggaggaaatgagtgttctgattgccagaattgctgagctgaatcgagccaaaacaacggagccatctgttgccagttctgaagtgtttggacaagacggatacggtagggaattttgtataattgagtggatacagtatgaaaattatacaataaaagaaatggttttgaaatttttaaaatcaaagaaattattttgaaatttattaataaa

SEQ ID NO: 51463 - DNA, 178 bp, Heterodera glycines
  Genomic contig location: Contig_ID=SeqID_20880; Location=2124..2301; Strand=+
  SCN-specific regions: Sequence locations=1-148,170-178
attcgcatttaaacgaatcgatgcatttcttttcatttttcccgtgccaattgtctgtttcgatgtcaaattatgctccgctatttcgatacagttgcgattctgtccgctggagtgagtgaaagaaatgctaacgagaggagcggactggcttgaacagacgccttccgctttgtgc

SEQ ID NO: 51464 - DNA, 708 bp, Heterodera glycines
  Genomic contig location: Contig_ID=SeqID_20882; Location=127..834; Strand=-
  SCN-specific regions: Sequence locations=1-162,184-202,240-304,384 -468,492-561,629-708
atgccggaccggaccggactagtattttcaaaaatgaccggattccggatcctctctcataatccggtcaatccggtaatccagtcaatccagattttcgaattgccggaccggattgccggatccagaaaaatccggtaccggatccggtccggtccgatctttaaaaataagtttaaaaagggtatagtttaaactttacacatacatacatacatacatacatacatacatacataaattacgatgactaacttctaaatttacaggaaaatagaaaattcctgtaaatcttatttgaatcaaaaaaaaaatatatatttaaaatattttaatttaactatttaattttaaaatatttatcacttttatattaaaaaaatgttaaggattattcagcggccaaagccttgcacatcagtgacacggataaacgcaaatattttcatctcaatgtgagaaaatctgaaaaattttaatttaaattatttcccctcctaattaggcacattttgggtacgcctgcggcgctttggagttgggcacttttgcgtctcagcgaattaaagtaaaaaaatgaatttttaaaataataaaataaatatttacattattttttagattatttcaaaaccatccaagaagaaacagtcaatgaaaagctccgattgtaaatatttatgtgtcgggaacaaaagcaaggcatga

SEQ ID NO: 51465 - DNA, 540 bp, Heterodera glycines
  Genomic contig location: Contig_ID=SeqID_3688; Location=203..742; Strand=-
  SCN-specific regions: Sequence locations=1-115,137-320,342-383,405 -421,447-540
atgaccaacagctccggtctgagaacctcggcgatgttgcggccaaagatcaccgtgcgacgggcggcgatacattgccgaagtacagcaaagaccaactgcatcagcgggcacaaaaaattggggaagccaaaacggctgagcaccaacaagtcagaataaaaagcggttatcatcggcatttctcgaacacacttaagagtttcatgatttggcacttttcagcagaatttccaaaatgctgtcgctgatcagcaacagcaccaagcagcggccccaagcgcgttcaaagtcgaaaatgcagttgggcatgataaccaagagcagcagcagaaggctgctgaacaccttgaaagcaaatttgtggcgagtgggaccaagtcaaaactgatgaacacagatgcccgaaagaatgtccatgaacagcagcagcagcaggcggtcggacagcaagcagttcagcaaagaacggatgaattgcgtcagcatttggaacagccatcaacgagtgcgattgaaggtagcagttggaccatgtga

SEQ ID NO: 51466 - DNA, 526 bp, Heterodera glycines
  Genomic contig location: Contig_ID=SeqID_3688; Location=849..1374; Strand=-
  SCN-specific regions: Sequence locations=1-526
atggcgagcgaggagcaattctgctccgaatttgatgcggaggtcgcccggggggatggcaaaaggccgttgagaagaatcgtcatcaggtttgttgtgtgtgttgtgcgcaaagattggtgcgcaagatgacctttgtactgtggaccgacctcttttcagcgggcggagatgggcggacgaagaaagtgccgcgcgcacagccttccttataaatgggactcgcacagcgcaaaatatgccattcctcaccccattttctcacagtcgcaaaatgagattttattgctgtccaatcacaaagtctccccctccccgaccgatgggtaaacctcactcatccatgcattaaagcactcactcatcagttagcattttaaaatatggcaacgactattttttccgaaaaattttcctctgtgttgttttagctttctaattacgattaatttttcaatatgcctatataaaaaatttaattgtcacttatttcagcttaaaaccaaactcgaaatttaaaaaatga

SEQ ID NO: 51467 - DNA, 1882 bp, Heterodera glycines
  Genomic contig location: Contig_ID=SeqID_3690; Location=34..1915; Strand=-
  SCN-specific regions: Sequence locations=1-106,133-187,490-493,516 -599,627-821,843-844,877-1043,1147-1152,1204-1324,1353-1625,1653 -1769,1792-1882
atgacaaaacgaggacagactgagcaggacgatgtggtggtggtgacaaagacaaacgacgatcggatcggacgatcggttggctgctattttcggttctctaatgaatcaagaaaagaaaagaagagaattggcgaatggatttcacaaaatgattttttgcaagaaattgataaagaaaaaggtcaaaaaataaatttgttttttttaaattaaatttatttttataaaaagcgttaaaaaggatttttaaattaaaattcaaaaataaaataaaataaatcattacagataaaaacaacgcaatcatatttattttaattcattaacaaattttatttatttttttaaaaagtgttaaataatcagagattttttggattaaaatttcattaaatttatatcattacagatgaaaagaatgaaataatattaaccaatgttaattatattaacaaaattaaactatttaattttaattatttttttgtgctttttaaaattcaggacaaaattgcttagaaaactttgacccttaggttttttttttaaattaatttgagttcgaattatgatcaatcttggcctcattttttgagtgggtgtttttgttgttgttactgctggtgattgttttgctagcaaaaattgattgccaaaatagcagcagcattttgcctgctgctggagtaaaattggtgacagccgcttcctgctgcaggcaatcggctgaattgatctgacaaccggtggaatgatgatgcacttaggaaaaggacaccttttgtcagcactaaaacatttttccaaaacatttcatctcaatattttaaatgataatcgcttaaaaattattatttgtaaaattattattttctagcatataaacattaaaaaataaagaaaaagtgaaaaatgcagcgtcgcagggaaatatttagtcggcacaaaacaattaaggatattaatgaggtgcgttaattgttttgaaatcaataattacttcacgataacaatgaggtgtgttaattgtttttaatccataatttattaattcatctattgattagttcaacggttaattaattttaagcaatgagcttacaaatatttaattcatttgattacttaaacctttaattaattttaaacaataattttaaaatattttaaaccattcaatataatcatataaattattatcaggattcgggaatgtcatctcgagatttgcactccgtagactccgattcttatgtgaaaggcatgcacgaagaaggccttagcgaacgagttcggaatatttgcgtacaatctgagaaagtaattaaaaattaattttaatatttttacccgattcctaattttcatttaagcctcctcattctatgccgcaaatgccgacaccaaccgccaatcggaggccgacgaccttttcattgccacgtatatttacacaaaaaaagaaggacgttatcccattggcaggttagactcgggaccgagattttgctcgggatataattcaagtcaacaaaaatgtcgggattagggtcaggaaggataaaattttcgggatgggattcgggacgtccaggaacatccctgtttggtagaaatccatctccaatttaaaagaaaaattttttgcgacccattaaccgggttgcaatttacccacgtggtctgagtcgcgctatatctctttgttacagtaccccatctaccatcagcagctgatacagttccagcgcctgtcaccagctcgtcggtggatgaacatcagcagcagccgcagttgtcaccgggcacaacaacaaccacaacatcggcatataacacgggcgttgacactggccaagatcaccgccagccacactaa

SEQ ID NO: 51468 - DNA, 639 bp, Heterodera glycines
  Genomic contig location: Contig_ID=SeqID_3692; Location=1378..2016; Strand=+
  SCN-specific regions: Sequence locations=1-107,142-187,232-307,350 -365,412-462,484-497,526-639
atgtccaaaattcatatttcaggattagctaatcctctccctaatgtttcactggtacattttccgggagccattatatttagagccccaatctatataagttatccataaataattatatttaaattcattttattttttctgtaggatattgttgtactgccgctgttggttcaatgcctaaaggtaaataaaatttgaaaaaaaaaattaaattattttttttaaatagcggttttaccaatttcaaccaacaaaacaatctcaagcggcaacagtaataacattgccaagttggttgtttatcaaaaaaatacatttactttttattattgttttttatataatagcgtagaattttagcgtttttataatttttataattgtaaagtttttagaattaaaaaaatagtgtttagaccgttatctccaccatcatcaacaattgctgtctcagcttctgaaacagttccaccaatcccttctattctcgtgattgaactgaacaacaacaacaatcacaacgatgatgtcattgaatatgaccaattacgcctaaacgacattccatccactttaattgggcacatttcatcacattcgcaaccaatgccaacaatttttggtgattttttttga

SEQ ID NO: 51469 - DNA, 894 bp, Heterodera glycines
  Genomic contig location: Contig_ID=SeqID_20886; Location=528..1421; Strand=-
  SCN-specific regions: Sequence locations=1-172,194-450,509-515,538 -639,665-791,813-894
atgtcgtcgacgcagtgtttaatcaaattttgtaaagtggagcagagcaaggctaaatacgtcaacctttacggtgccccttttgttgtaaccgtcactgtcctgaatactgatggtttaccccgccgacgaacgaccaaaggaaatgcccctccaattcactcttcacaatcccacatcttcaaaattaacaacaatgacaactactgtcttttttatgccttggaactgatgcggtactattcgctctacaaacgtggaattattacgcggaacaaatggagatggactaacaacaaccaaactactgttctccaacaaaaagttcaacttttactccgtgatgctgggattccgacaactgaaccggaatacgatgccgagatttacatccatcaagtgcaggggttgtggagcacaaaatatcccggtgattatttttaaaaaggcatttataaaaatttatttattttcaaatgaaaaatagatttatatttttacaaattttcaggcgaatataaaatttttattttcaatgattaccaaactcgtccaatcacaaaatcagacgtcaccgattaccaattccctattctgctctaccaccatgacaaacacttcgatggcatcaaaaccctttccaaattcttcaataaaaattattattgcctctcttgcgaaagtgtctacgaacgaaaatcgagacactccatgaactgcacgtcactatgccacggctgccgggaggtgggcgttgactacccctgcgaagcccaacaaggctacttcaaaaaatgtttacactgcaagaacaatttttacaacaaggattgctatgaacgtcacctacacaaggatttgtgctccaaatttcaacgctgcgaagagtgtggg

SEQ ID NO: 51470 - DNA, 1682 bp, Heterodera glycines
  Genomic contig location: Contig_ID=SeqID_20887; Location=379..2060; Strand=+
  SCN-specific regions: Sequence locations=1-502,525-728,750-801,825 -872,903-1163,1185-1201,1228-1428,1461-1651
atgaggccgtggacatttggcctggtcaagcccgacggggtggccaacccaattgccgtccgatggcttctcagcgcaatgcattgtgagggctttgtgatcacaaacggtgtgtgcgtgggatcagcaccgtcttttgaccaattcgtccaagttcccccttcgttttttgcaggttgtcgtctgacgctgacaccggacttggccggcgagctgtactcaagccatcaggtgaggaatgagccgggctcgtaatcagcaaaatttctgggtcatgtcagttcgtacaaagggttttgtatggaattttggctcttccagtttacgcgtccacaatgggtttaacgccgtccaatgagtgaccactctgacttttttagatcataacttttttcatacttggtcaacccaaacattcttggtatcatttgaaagcttaaagtttaggaaatttataaatacaagaaaagacaaatacttatactatgaaaaaattacaataagaaaacctgaaattcataaattttcacgtatattcaagaataattttgtgtctgatgcctttatccgggaattttgctatacaaaaaatccctaaactttaagctttcgattgatactaagaaaacttggattgaccaagtaagaaaaaagttattgtctaaaaaagtgagggtggtcactcattggacgcgtaaattggaatagagccggaattttttcaaaaaatttgagagatttgacaaaattttacaagtgtgcgagaaaagtccacgcagattttttggaagaaaattctgaaatttaatttaaaatgtaaaaaatgtacgaaaccccaaagtacgcacacaacgccgctaggcacactcggcaaaaatttaaaaattttttggaaaactccgtaatataatttaacaataaaaagattggcggggtgggtcctcaattctacattactctgaccattttacataatacaattgatactgacttgttttttttctaggctttttcccccgatttttaatatttccttgcacctttatttccatccagttttttttaaggatgccttttattacggacgtctcatccggcacatttgcagtggaccgtcggtggcaatgcgaatggaattgcgcaagttgaacccggcacagaacgcatttgatgaagatgatgaagaaggcgacgagcttcacggcttttcctcctcctcctccgctttccatcggtcggcgacggaatgccaagaaaatgcgaaaaaatttgacccattggaggcgatcaatcggtggcgcactttgcttggcccgtccaaactgttcgccaacatttatttgagcagctgtgccgagtttgatgagatcaaatgcaaaaatttgcgccaaatgttcgcagtgtcggacaccagaaatctttgtgaggaaatttttattatttttttacattttaaatttggggttggaatttgacatcctcacaaaattttgaaggccatggctccgactcgttggactcgctgtgccgggaattcagcctttttgaagtggacatgaagccggttgagaggccagaaattgaactgtttgcgcttgatgactacacattgacggaagcggactatcaaacagacaacaacagaaggaatcaagatgaggaggaggaggaagaaaagggaa

SEQ ID NO: 51471 - DNA, 57 bp, Heterodera glycines
  Genomic contig location: Contig_ID=SeqID_20887; Location=67..123; Strand=+
  SCN-specific regions: Sequence locations=1-57
atgatgatgttgctgacttgcagcagccggtcagccttttctcctttacaatccttt

SEQ ID NO: 51472 - DNA, 67 bp, Heterodera glycines
  Genomic contig location: Contig_ID=SeqID_20887; Location=2220..2286; Strand=-
  SCN-specific regions: Sequence locations=1-13,39-67
tttttaattttttcgacaaaaataaataaaaatattcatgttgcacaacggactcgaaccaacaccc

SEQ ID NO: 51473 - DNA, 1483 bp, Heterodera glycines
  Genomic contig location: Contig_ID=SeqID_20888; Location=889..2371; Strand=+
  SCN-specific regions: Sequence locations=1-271,293-575,622-809,832 -968,990-1054,1077-1228,1251-1437,1459-1483
gaagttaccaaacagaaactcgacatatccagacgggttaccttatatattgattaagcaatgcgcagatttattggcacctatcataagtgaactctttcgaataatcttagattatggggaaatcccaaacttatggcgtacatcttttatcattccaatttataaaaaaggagacaaatcgaatccaaataattaccgtcccatctctctgacatgtactttatgtagggtttttgaacgactattagcatggaacattgttaaacatcttgagaaaaataaaattttaactgatgaacaatttgggtttttaaaatccaggtcgaccaccacacaattgttggtctcccttgattatttttataaatcaatagaaaatggacaaaatattgatataatttttatagattttgaaaaagcatttgattcggtgccaataaatttgttaattgttaaacttcagaacataggtatctgtggaaaaattttgaagtttctccaaaattttcttatatgcaggtcatatcaagttaaaattggagaaaacttttccgaaagctttagaacttattctggggttccacagggcagtgttcttgggcctcttcttttcttggtttttataaatgacttactaattatataccagctgcagtcggaattaaattatgccgatgatgttaaaatttacatttcgcatgataatgacacgaaaagggatttactctctttagcgttggctaacttagccaaatagactaaagacaatggcatagccattgcgcatgagaaatgcgcagcattatatttaggaaaaaataattctagacatgagtataaaattggcgagaaagtaattttaagcgtagattgtgtccgtgatctgggggttttggttgatcaaaagctctcatttaacaatcatatttcaaaaattttaaaggcggcctattacaaggcatatcaaattttaaaaatattaaaaacaaggaatatcaataccttaatcctagcatataaaagctatataaggcctcacctcgaatacgcaagcgaagtttggaatatctccttaaaagaacagagtaaaagaatggaaacggttcaaaaatttttcacaagaatcgtatacaaaaaatgtggcctcaaggctgcatcatatgaaaaaagacttgagatttgcaaattggagaaattaagtaatcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccgtggaattgcttacccaaaacagctatagaaatcggaactttagctaaatttaaaaattttgtgaaagaattttatttagaaaataagtcctgagtggta

SEQ ID NO: 51474 - DNA, 766 bp, Heterodera glycines
  Genomic contig location: Contig_ID=SeqID_20890; Location=756..1521; Strand=+
  SCN-specific regions: Sequence locations=1-61,83-320,342-581,603-766
atggtttcgtctcatttgttttgtattggtaactttatggttgtttttctggtcatgtttctggttttgtcttttcttttgtctaatcataacaacggtggaaaaccagaaattaaactgaacagtttctggttcggctcatttctttgttaaccagaacaacggtggaaaaccagaaattaaattgaacagtttctggtttggctcatttcttttgtctaatcagaacaactgtggaaacccagaaattaaactgaacatggtttcgtctcacttgttttgtattggtaactttatggttgtttttctggtcatgtttctggttttgtcttttcttttgtctaatcataacaacggtggaaaaccagaaattaaactgaactgtttttggtttcgctcatttcttttatctaatcagaacaactgtggaaaaccagaaattaaattgaacagtttctggtttggctcatttcttttgtctaatcagaacaactgtggaaaaccagaaattaaactgaacatggtttcgtctcatttgttttgtattggtaactttatggttgtttttctggtcatgtttctggttttgtcttttcttttgtctaatcataacaacggtggaaaaccagaaattaatgaacagtttctggttcggctcatttctttgttaaccagaacaacggtggaaaaccagaaattatattgaacagtttctggtttggctcatttcttttgtctaatcagaacaactgtggaaaaccagaaa

SEQ ID NO: 51475 - DNA, 803 bp, Heterodera glycines
  Genomic contig location: Contig_ID=SeqID_20891; Location=615..1417; Strand=-
  SCN-specific regions: Sequence locations=1-215,237-412,435-482,519 -523,545-686,708-803
atgccaatggaatcgtcgtcgaaccggcgtgaagaatttttggaaatagaactcaaaaaggtccgtgaagaattggcggagtacaaacggagggaaatgtgtgccatcaccacgcccaaaaaggtttgacatttttgtttcaatttcaaattttgaaatttttttggttaaatagtgatttgctcacacaccaaagtgattgaatttattgagaaaaatgaataaatcccaaaaaagccaaaactcacctgcaaacaggagatttttatgggaagagaaaaaaaaaataaagtctgaatttgagtttggacggccaaaaattttcgggttggtattcgggactgaaaagttatggaattcgggcaccaaactctgccccaaacccaataacctctcacatgcacaggccaacaaattttggcccattttcctttatacaatacctaataaaaatgaatttttttttacaatttcatgtttccaattttatataaaattttattttacaattttaaattgcaaattttgttttttaagaaaggaatacttaaaaaaaagccctccgctgaatatcgaccgtatgttttcgacaatttccacccaaaacatcgtcgaaacaaagccgagccgacttcctcctccactgccgcactggacatttttgacggtcagcaggacaatgccaacccaacaacaacaacgcttggctcgtactatgatggaggtttgcttttgaatttgtgatctacaaaaaaggataaaattaataagttttaagttttttcgacgaattttaaaataaa

SEQ ID NO: 51476 - DNA, 284 bp, Heterodera glycines
  Genomic contig location: Contig_ID=SeqID_20892; Location=664..947; Strand=-
  SCN-specific regions: Sequence locations=1-89,111-111,140-160,182-284
attatgagccacccaatttggcaaatcggtctttttaaacgcattaaagaagattcagtcgattgcttggagtgtaagcaaaaaaacgttattaatttttcatcttcatcattttttggtttaaaaatatatttgaatactttgctatactttgaaagacttttttattaatacagaattttttgaaatttcctaaaatccgcaatcctgcgcaggatcctgcagattttaaatgcaggatttgcaggattgcaggatttgcaggattaatcctgccggatcct

SEQ ID NO: 51477 - DNA, 62 bp, Heterodera glycines
  Genomic contig location: Contig_ID=SeqID_20893; Location=1671..1732; Strand=+
  SCN-specific regions: Sequence locations=1-62
gttcttctcgcttggaaattgtcgtggattattttttccaattttatggcgaagcttttcag

SEQ ID NO: 51478 - DNA, 58 bp, Heterodera glycines
  Genomic contig location: Contig_ID=SeqID_20896; Location=1651..1708; Strand=+
  SCN-specific regions: Sequence locations=1-58
aaacaaatttaaaaaacggtcgcgaagcgcccgcccaagcccaacaaaatttgaaaaa

SEQ ID NO: 51479 - DNA, 1796 bp, Heterodera glycines
  Genomic contig location: Contig_ID=SeqID_3693; Location=694..2489; Strand=+
  SCN-specific regions: Sequence locations=1-170,321-445,473-590,612 -664,686-706,736-751,777-931,953-1125,1164-1221,1243-1354,1376 -1530,1558-1562,1584-1606,1628-1796
atggaaattaattttgtgattattttcatcttatttctaatcgtactaattgacggaattgatgaagatttgtttaatgatttgtggaaaaatcttaagccatcgacctcaaaaaacatcaaaaaaccgatatttggagaaattaatgcgataaaggaagaaaaagttgttaaaaatgaaaatgatgaacaaggaaatgccaatcaaattgaaatggaagacataaagccaaaattattacaaaatattaaaaaggaaaaaacattggaagaacaaaataataatttaaaaataaaaattaaaatgccaaaaattgaaatggacaaattaggcgaagaatcatttgaaaatgagtttaatgaggaagctgatcagaatgtttcgtctgctgatcacaacgattctgttgatcaagcgtattataatattatggtaattcaacaatcctgtaaaaaataatttaaaaattcaatggttctaagttttgcatttctaaaaattttaatgatttaattaggagtctgaaacaagaaatgaaatgaaaattttgaataaatttaatttaatgaaaacggaattgcgaaaagaaagtgtttataaaaatttgacaaatactcaatttgaaggcgaaattgcgaaaaggttgggcacaaatcgaaacaaaatttataaattgaagaaaaaattgggacaattaagagagagaatggaagaaagtgaagaaacaaaaatggaactgaccagaaaatttgataaaatgagaaaagaaaaaatttgtgggtttaaatatgacgagaagaaaatatcagtaattgaatgtgaaattgccaaaaagttgggcacaaatcgaaacaaaatttaccaatggaagaggaaatttggtaaaaaaaacaataacaaattcactttatacttactgtctcattaaggtataataacgaaatttttatttacaaacgaagaaaaaatagaaaaacttgagcaatttgaaaaagtgaaaaaagaatttataaaaaaattcaatttgaaaacaacaaataaaattgaaacaaaaattgcaataaaattgggcgttttgtggcaaacaatttttaaatggaagagaaaattcggtttaaccactcgtaatattttaattatttatatttaaaaaaaattaaattgcttttattttaaggaaagtccaaaatttattcggatgctgaaaaattggaatatgtgaaaagaagtaaagaaatcgcagaaagaaactcaatgttaagtgagagaaaaattgccgaaaaattgggcatttcaaatgacaatttaagacgatggaaaatgaaattcggcactaaatcgatccgttagcattggacaaaaataattttattcagtgacaattgggtcaatttgacaatgtagagaaaatcagagtactacagtatttccttgtttctttttttttgtaatttctctcactttcgcgtactatctcttcatttttagctgatcaaacgcaactgcgtttacctcgctttataaaattcgttttttttaaatttttataaaaaaatacatctattggcttttaaaaaagattatatttattttaactttttctactaattttgaaaagtaaaaaatttcgtccattcttgagccttgagccagccgcctatcttaaggtgtgcaaattttttaacagaagcccaacaaaaagcattcttcggatcggttttccgttagaaaaacaaaaaaaacgaattgttaattcgttaaattttgcggtctttagggattgtttttatatttta

SEQ ID NO: 51480 - DNA, 1262 bp, Heterodera glycines
  Genomic contig location: Contig_ID=SeqID_3693; Location=4154..5415; Strand=+
  SCN-specific regions: Sequence locations=1-14,36-277,309-497,519 -531,560-571,606-678,701-1003,1080-1138,1170-1262
atgccgcaaattaattttgtgattattttattcatatttttattcgtgctaattgatggaattgatgaagatttatttgatgatttatggaaaaaccaaaagccatcgacctcaaaaaacttcaaaaaacaaaaattcggagaaataaatgcaataaaggaagaaataattgttaaagatgaaaagtatgaacaacaaaatgccaataaaatagaaatagaagacacaaagccaaaagaattgcaaaagattaaaaaggaaaaaacattggtggaacaaaataataatttaaatagaaaaataaaaatgccaaaaattgaaatggaacaattggaagaagaatcatatgaaaatgagtttgatgagcaagctgatcagaatgtttcgtctactgatcagagcaactctggaaatgatgaggattacaataatatggtaatataatagacaaaacaatatcattccttgaaaaaaatgttgaaaattcgctgaattctaaaaaatttttctcttaaaaaggatttctttagaatacagaagaaataaatgaaatgcaaattgtgaacgagtttaatttgaggaataataaattgagaaaagaaaatgtttataataaaaggacaaatactcaatttgaatgtgaaattgccaaaaagtttgacacaaatccggacacaatttataaattgaagaaggaattgggacaaaaaagagtgaaaacggaggaaagtgaagaaacaaaaatggaattgatcagaaaatttgataaaatgagaaaagaaaaaatttgtgggtttaaatatgacgagaagaaaagatcagtaattgaacgtgaaattgctaatgaattgggaattaagcggaataaaatttacaatttgaagaaggaatttggtaaaaaaaacaataacaaattcactttatacttactgtctcattaaggtataataaagaaatttttatttacaaacgaagaaaaaatggaaaaacttgagcaatttgaaagaataaaagaagaatttaaaaaaaaattcaatttgaaaacaacaaagaaaattgaaataaaaatcgcaataaaattggatgttgtgtgggaaacaatttttaaatggaagagaaaattcggtttcagcattcgtaaatttttaatttataaaatttaaaaaattgctttttaggagaaaaaaaacgttactcggatgctgaaaaattggaatatgtgaaaagaagtgagaaaatgaaaataagaaatccaatgataa

SEQ ID NO: 51481 - DNA, 1338 bp, Heterodera glycines
  Genomic contig location: Contig_ID=SeqID_3694; Location=19..1356; Strand=+
  SCN-specific regions: Sequence locations=1-35,60-213,239-586,618 -681,705-947,970-1338
atgcaaattgtgaacgagtttaatttgaggaataatgaattaagaaaagaaaatgtttataataaaaggacaaatactcaatttgaacgtgaaattgcaaaaaagcttgacacaaatcgaaacaaaatttataaattgaagaaaaaattgggacaaaaaagagtgaaaacggaggaaagtgaagaaacaaaaatggaattgatcagaaaatttgataaaatgagaaaagaaaaaatttgtgggtttaattatgacaataataaaagatcagtaattgaacgtgaaattgctaatgaattgggaactaatcggaagaaactttacaaatggaagagagaatttggtaatagattaatgccataattggatttaatcattgtctcatttaaggcataaaaaagaaattttcattttcaaaagaactaaaaatagaaaaaataaaactaattgaaaaattgaaagaagaatttactaaaaaattcaatttaaaaatgactaataaaattgaaacaaaaattgcaataaaattgggcgttgtgttggaaacaattcgtagatggaagagaaaatttggtttcagcattcgtaaatttttaatttataaaattttaaaaattgcttttttaggagaaaaaaaacgttactcggatgctgaaaaattggaatatgtgaaaagaagtgagaaaatgaaaacaagaaacccaataataagtgagagaaaaattgccgaaaaatttggtatcgacagactgagcttaagacgatggacgaagaaattgggcaccaaatcgattcattagctttagctgtaatttggaaaattaatgggcttatgtagaaaaacatgtacaagaaattttaaggagtttgccaatgtcaaaaaaaatatgaaaattttctcaaaaaatgggtgtcactcaagccgcctagggatttgttccaaaatatccccggttttaagccatttttctggttctcagaccactctgaaggagtgttctgattatcgcagcgcaactgacttttctgtttagcataaaaagctactcttacatgaattttttcagattttttgtggtttctaggaaatttgtgagttatcaaaaaagagtaattggaacacccatttttttttggaaaaattcataatttttttttggcatttccaatctccgtaaattttcgtgttcacaacagccttgttttatcgatacaagtgtcgctacagatttactgttgttataatcttcttcatacaagtgaaatttatgcggttatgctttgcgattcaactgctgatattccccctgcgagaattattgtttatccgaaaaccga

SEQ ID NO: 51482 - DNA, 1193 bp, Heterodera glycines
  Genomic contig location: Contig_ID=SeqID_3694; Location=2258..3450; Strand=+
  SCN-specific regions: Sequence locations=1-81,103-320,342-727,751 -991,1013-1193
atgcctcaaccgttgccgctgagagacatgccgcaaattcaccatccaccgcgaaatgtgacatcaatttggatcaaattatggttgctttttctcagtctctgggtgtttcttcaaggaattcatgttcggcaaattcaacgtgaatacgccgtaccacaatttgccgatccgccgccaaacgtgccgtatcatccaccagaaaacgttccggtaatgttgggtcttgtttttcttgcgtttctcatatttccggatgctttttcaggcaattcaaccaatgcaacgaccgcggcagctgagagacgtgccactatacgaccacccgccgccaaacgtgccgtatcatccaccagaaaacgttccggtaatgttgggtcttgtttttttcgtgcgtttctcatatttccggatgctttttcaggcaattcaaccagtgcaacgaccgcggcagctgagagacgtgccactattcggccacccgctgccaaacggaccggtaatttcataccctgtcttacacctaacaccgaaacatcttttcttaagcaaatgcatgccaaccccccgagagtgatggaagcgatccgacggctgggcgagtggagaggaagaccaacggacccaagacgtccgcctcaatgaatgaatggaattccaatttgataaaatttgttgtttgttaattttttgaattgataagggttaaatcccattacctaaattgtttaaaaattattaaaattttaagaaattagatgctaaaccttaccatagacaaagattatgaaaaaacgaaaagaaatgacgaaattttcggaatgtttcttctttttgttatttatggactttactttttgtgttttattttcgcattaataaggtgttgttgaaacggttaattcttcatttattataccccattttgttgaaaattcgccaccattatgccctgcccactccccgccgaactgatcaaggaaataattgatgctcttccccctccaaaaacacatcggcttctgctcgtaaattttgtttaggcatcctttgttaaatgtcggttctattccatgatgagaagattgtttcgctcagatcatttattactaccaatggcccaaagaacaggaatttatttatttttcgatatttttattccccacacaactcaccaaagatataaaatttaa

SEQ ID NO: 51483 - DNA, 766 bp, Heterodera glycines
  Genomic contig location: Contig_ID=SeqID_20898; Location=595..1360; Strand=-
  SCN-specific regions: Sequence locations=1-635,657-766
  Gene Ontology: Mol. function=transmembrane receptor activity; Cellular component=plasma membrane; Biological process=cell surface receptor linked signal transduction
aagagctgataaattgagtttttatttgtcaagattggcgatgcttatatgattgtcagcggagtcccgcgcgagaatggcaattcccacgtccaacacattgggggacattgcgctaaaaatgcgatcggtgagtgcttttgcgttttattaccaaatttgatcattgagattttgtcgcattctccatttccttttcagtttgtcaccaacttcaaagtggcccatcgtccggatgatataatgatggtccgaattggcttccattccggatcggtggcggctggcgtggtcagtttcagaaaaaattaagaattaaataatgaggaacggaaaatgatcagaaagactaatcagtaagtgccggcaaaaccaaatgattgatcgatcgatcggtcactgatcagtccatttaaggtcgggttggccgcacctcgttactgtttgtttggtgacacagtgaatatggcatcgcgaatggttcgcggggaataattacaacgaaatttgacaattttcaatttaaggagtcaagcggagtggccaacaaaatccaagtcattagctagcccattagcaaataattacccaacattataatggaatgtttgcccgttcagataagcgagtcgtccagcaaccttttgaaatgcttttaccaccatttcattgtgatggagcgtggcaaaattgacattaaggcactaattgatgaaacgatttgcaaaattttaatttggatttgttaagggcaaaggcgagtgca

SEQ ID NO: 51484 - DNA, 1935 bp, Heterodera glycines
  Genomic contig location: Contig_ID=SeqID_20899; Location=1..1935; Strand=-
  SCN-specific regions: Sequence locations=1-52,74-96,118-377,495-1935
  Gene Ontology: Mol. function=protein tyrosine kinase activity; Cellular component=integral to membrane; Biological process=receptor guanylyl cyclase signaling pathway
gcattttttttgccagggatacatgcaacaggcgcccgaaatcattcgcgaattcattttcaccaaaaatttgccgcaggggtgccaagcagcggatatgtacaggtgggagtggggaggatgttgattgatcccattttgtatagaacgatagccttgtaatcagcacacttcgatcattagggggccgaagggggggggggagagaagagaagcggacccgatcaatttcaaagggtcactcagaagccaaaaccccctttattaaacatttattcaatcaattcagttttgtttcagccttggcatggtgctctaccaaattttgttcaaattggagccatttttcgagcgcaatttgcccccttcaagtgcgtttttctcttttgtccgtttttctttttctcttttgtccgtttttctttttctcttttgtccgttttccctttttgatcattccataatgtcttctcttttgttaaattttcttttttaagaaattcttcaaaaaattgctttggccagcgaggacgaccaaatcattcggccgagtttccccaaccaacaacaaatcgccgcttcggaggaggcgtacaatttgcaattgctttcggcaataattataattaactattcgtaattttaattatgccatttaatggataggccctggaggcatgttggttggaattgccggagatgcgtccgaacatcaaacgggtcaaagcgatcgtaaacgcaaatttgaagtcgaccggaagcggcagtctggtggaccaaatgatgaaaatgatggaggatgtacaaaacttttctgctcataatccaactaattactattaattacccccccccccccctcccccggttacagtacaccaccaacttggaacagttggtcaaagagcgtaccgtacttttggaggaagcgcagcaacaagcggaccgtctgctcaagaacatgctgccggcgtatgtgctaaatcaagcaaaatgaagcaaaaacaaaaaagcgcatttctttagctacgctaattaattggggaggctatttaatagcggcataaattcaacggtttgaggcttaaaaagtcttcccgctgatggtcgtccttgaaaaatgaaattaacaaaagcattttgtaaatatgaaaacaatggtttatggatgggcaccccgcagaatcaggcgctgggtcggcaccattagagtctttcttaaccactttttcgtgcagttccgtggccgacgatttgaaggcgggtcggtcagtgccgcctttgctgtatttgggtgccaccgttttgttctcggacattcgcggtttcacgcgaatggcgagcagttcgacgccgctgcaagtggtcaatttcctcaacgatttgtttctccggttttgacgcgattatcgccaaacatgacgcgtacaaagtggagacggtaaggcgggagaaagcgcggggaaagggggcggagatcgaaggcattgccacattgtctaattaggaagggattgtcacattgtctaattaggaagggattgacacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcacagagtctaattagtaagggattggcatataatctga

SEQ ID NO: 51485 - DNA, 881 bp, Heterodera glycines
  Genomic contig location: Contig_ID=SeqID_20903; Location=303..1183; Strand=-
  SCN-specific regions: Sequence locations=1-387,413-550,572-619,641-881
gtggactgccacgcgtgacagtcattgcttgatggcgtcaacgcgtttggtgttcgttcggcgagtgttttcttgccccaaataagctttcaatgtttgttctaataatttttttggtattttacggttatctgtactcagggcattttttggttgtgcgggtcatcctcgtgacattgtgaagcgattttgtgtataaaatgtgaattttttgaaaaatggattttgagttttttcaaatccgggattggggttcgaattgggtcaaaacagatgccagaatcggtttccccgaccttgaaaaccccctaaaacaagtttatttcaaaaaaatgttttttttcaaaatctgagtacagataaccgtaaagaaccattttttataatttcctctttgattatttgcattttaagcattcgcggggcatcattttcaatccgttgaacccgaccaaacgtattctcggcagccgttgtagtttggcatcaattcacccgccccctcaacaacaacattggtctcgaagtaacccatcttttctgtattttttacttgtaaacccccaaaaaacttaacaaattttataagtgcctgatcgcccgaccctttccgacttaatttttgaagtcagcagaaacatcgaccgacaagtggacgcagcgaattgagctcggaatttcgtgcactatgaaaattttgaggattcgatcatacaattctcttttttcgattcattcaatatttaaaaatatcattatttttcgtgaaaattgttatttatttatgcgattctggtaaagtattaatgaatttcgtatttttgaagccttaggaatgtaattttaagactttttcgctaatttttatttggcgggatttc

SEQ ID NO: 51486 - DNA, 1208 bp, Heterodera glycines
  Genomic contig location: Contig_ID=SeqID_20905; Location=245..1452; Strand=+
  SCN-specific regions: Sequence locations=1-103,125-490,512-526,548 -1024,1046-1053,1075-1182,1205-1208
  Gene Ontology: Mol. function=heat shock protein activity; Biological process=response to heat
atgtccataaaagtgccaactttggagggtgacatcatcccgttgaacatcaagcacgtgaccaaacctggcagcacacaacggtgggtttcatttggatttctatcaaggaatttggctaatttcgagctcgatgtatgtgaacttaatttcctatcatttcaaaataacaaaaactcacaaaaacaaacaaaaaacagaccaaaaaaataaaaatacatttataggtttctcaagttttttaaaggtaacttctttaaaagtgttgaaaaaaggaatcttggaaaaaattatgtatcgacataaaaaagtttaaattgaaaatgtagacggcccaggtaattaactgacaaacaagcgttttgataaattttactgaatttatggacttaggtaaatgtaaaaaggtggacaaattttgtttactttgcagcgcccttatgagatgaatacaattaatagtggagtttccccccccccccatttttcgaaaaatttcttttgtttttaaaaaggacacgtatactttcccttatcattatttccttttttccagaatccacgatcgtggcattccgaaccctaaaacgggcaaacgcggcgacttggtggtggagtttgacgtgcgcttccccgattcgatagcgcctgccgcgcgggaactgatcgccaatgcattgccacccaactgatcggacgaacggagggccaaaagacgggaaagcgaaagaatgtgcatttgaaatgttcaattgacaagcgataaaagccttttccaatcctcaattccccaagaaatgagtccacttctccacattctgtggttctattttatttagttttattatggtgtttcgtttttcaataattttgtacatttaatttctgatggttgagagagacgtataccaaattctaccaacaatagatttgctatgcttgcggcgctgcaaaacatcacaatgctgggttattatttcgggacaattgaatatcttaaatttggtagtaaaaagagcaagaaagcatagaaattttttattttcagggtgggactgcattttttgatctgcattatttattgagtttgaattcgtcattgttgtttgtccgtcaatggtttttccgtagcgaatgaagtacgtacctttgccttgggcaatgaatgctttctttcgctcgcttttttgtctctttttggccaacca

SEQ ID NO: 51487 - DNA, 131 bp, Heterodera glycines
  Genomic contig location: Contig_ID=SeqID_20905; Location=1962..2092; Strand=+
  SCN-specific regions: Sequence locations=1-131
aaaagataggccactgtttttatgacttcgccaaattccgcttttcgccatgagagtccggaagacgtcgttttcgacctgttcaaattgcctaaccgtgacgaagcgtcgattggcaaattgatttcagt

SEQ ID NO: 51488 - DNA, 228 bp, Heterodera glycines
  Genomic contig location: Contig_ID=SeqID_20906; Location=276..503; Strand=+
  SCN-specific regions: Sequence locations=1-228
ctgtgttcatccgtgcattgcactgattacgcgtgccattcgcaatcagttgatcattccgaattggacggaattcaccggaaaagtccgagaactttttgaggaggtaaaaaatagaaagattattttaaaataatgtcaaaataagattttgttcagtgccgtgcagaaactggtggccaagtggccacttacattccccaattggcacgtgccgacccggaaaag

SEQ ID NO: 51489 - DNA, 525 bp, Heterodera glycines
  Genomic contig location: Contig_ID=SeqID_20908; Location=745..1269; Strand=+
  SCN-specific regions: Sequence locations=1-284,306-445,475-479,501-525
atgtgcctgatcgtcgtgtcggttgaccatcgccctgcgcagcagacgccagctggaccacttgccgtgacgaactgtgtgcttcgcacgggtgacggccaccgcgttgaagcctcgggatggcaggcgcatgcgggtacgctggcggccttgtgtgttggcagtgcctactggttcaccaactgcttggcccgtgccaaataccagcgactggactgctggtttcgcattggggttggaggccccaatgcgcttgtggtgccgcacgtggccccagaggtaagttttttttttaattttaaattgatatttcttttgcaatttatgtttaagtttccggcaaacgttccaccaatgctgcccgttcaaattggcgcagggcgtgatgcggtccgggtgctgccaaacgtgaccaatgctggtgatgaacaacgcgcggacgcggaactggacaacaacaacaacaataatgtgaggaaatgatctttttattatgatttgtataattttattgctttacgatga

SEQ ID NO: 51490 - DNA, 2165 bp, Heterodera glycines
  misc_feature (46)..(46): n is a, c, g, or t
  Genomic contig location: Contig_ID=SeqID_400; Location=1..2165; Strand=-
  SCN-specific regions: Sequence locations=1-525,547-664,686-869,891 -1230,1253-1800,1823-2070,2110-2165
  Gene Ontology: Mol. function=ATP dependent DNA helicase activity; Cellular component=nuclear telomeric heterochromatin; Biological process=DNA replication
tggaattagagagaaaaatgaccatgatgaagtaaagaatttatgnatgcgcggtatgtttgccgcagggaagcagtatggagaatttttgaattgcatatgtatgaccgaagccatagcattatgtctttgcctgtgcacttgcaaggtgaacagatttgctattttgatgagaatatggaagaagaagagattagagaacgtcttgcaaacggttctgagttaatggcttattttgaactgaataagacaaatgccctagcaaagactctgttgtatcaccagataccagagaagttttgtttcaagaaaggaaaatggactgagagaaagacacattttaacacaattggtagaatggtgaaagtgtcgccggctgagccggaacgataccacctgaggctattgttgttaaatgtgagaggagcatgctcctatgatcatttgaaaatagttatagatttgaatggcactgttaaagattgtgaaagtttttcagctgcctgtttggaaagaggcttgattagaaatgatgaagaatggaaaagagcattggaagaagcggagacttttgaaatgccatggaaattgagagaattttttgctttgattttagtccattgtaacccggccaagccggaggaactttggaacgtgtttaaagatgcattatcagaagattttagccggagatttaggcaagaaattgcatatgccaaagcttatagagaaattgtgctttgtattatgagggctggaaaaacgcttgccgattttccaaccatggaacagataaatgttgaagatgacgttgaacaagtgtttgatttagcagaagaattagatttaggacaaagaagttatgctatgatgtatgatgaacagagaaaagttactgatgatgttatgcgaagaatttggaaccctgtcaatgaacccgcgttttactttctaagtggaccgggcggaacaggaaagacgcatgtgaacaacactattgtacacatgcttagaggtcagaagaaaaaagtttgtacaatggcttttaccggtatagcggcaactttgttgcctaccgggaggacattgcacaatagatttggattgacattagatatgagtaattcaagtattggtccaagatccaaagctttgcaagaattgaaagaaacagatttgtttatttgtgatgaggcgcctatgattaataaacgggcgctaagaactttggatgagaaattgagagagattatgaataatggaattgcttttggcggcaaagttatgctttggacgggagactttcgtcaaacccatccaattcagaaacgatgccaccagagctgagttggtcaattcgaccgataaaaagaagtgagtattggagattagccaagagatatagattgacaaagaacatgagagctctcgcatcagagcaagaatttgcgagagatttattagaaattagatgtggaaatttgaacaatgaaaatgatgaattgattttgcccgagaattgtatttgtaatggagatttatcagaagagatcttcggcaattgcatcgtttctgagaattggaatgaaatggcaaaaagtgccattttagcaccaaataatgttgatgttagtgaaatgaataatagagttttggatatgttgcctggagaagaagtcgtttatacaagtatagatatagctcaagatgagaataggcaaagagtagatgagtatttggatgagtatttgaatgccttaaacccttcggggtttccacggcataagttgagattaaagaaaaatgctatagttttgttaatgagaaatttgaatatagacatgggtctttgtaatggttcgagaatgaaagtggaagaaatgcagccgaatttggttgtgtgtaagattttgactggagataaggctggtcaggtggtgtatatccctcggatcacattttgctgttccgaggagtacccatttgacttgcataggcatcaattcccattggtgttagcatttgcaatgacgatcaacaaggctcaaggccaaacacttgagcatgttggtgttgatttgagaaaagaagtttttagtcatggacagttgtatgtggctctttcgagagcaagagcttggaataagttgagaattagattagat

SEQ ID NO: 51491 - DNA, 1118 bp, Heterodera glycines
  Genomic contig location: Contig_ID=SeqID_402; Location=1839..2956; Strand=+
  SCN-specific regions: Sequence locations=1-144,166-390,412-688,712 -1118
atgcgttcattaatgtttggcctgatgtacaaatcagaatgtgcctttttcacttatcacaatcagtactacgattcgttcaagtaattaaaaacaaaagtaaattatgtatgtacaatttagaaaaatgggcatattcattcatatgaaaatgatgaaaattttcgtaaattcgtcagatctttaacggctttatcttttgttcggccaaatgaagtcgagggtttttacgatattttatttgcaagggcaccattagaagcctatccgatttttgagtattttcgaaggtaaatctaaaccagggctcggatctgtccttatttgtaagatttgtccttatttcggactattgttcttattttgttcttatttcttaaatatattcataattttgaaattttatggcagaatttcaatattttataaagaaaatataagattttttggccttgatgttcttactttgaaaaattttcgatccgagccctgatctaaacccatctttcatgcagaatccccggaaatgaaaaatttagaacctatataatcagagataatggtggggaagctttatttccagtcgacacctggaatcaccatcagtctgttatcgataatatgtgtaggacgaataatgcgcaggtaaaaaataggtttctgtatttaattgaactaaaacttgtacataaaaaaaaaaattaaatttaaggaggcatttcatctgaatttacgtcgaaaatttcatacaatgcatcctgcattgtccaagtaattcttatgaaattttgtcttaaaaatttcttaggctactacttgtcctgaaagaagaggaaagaattgcgcaagaccgactacgatcttatcatcttgacccaacattgggtttaagtatgcgtccaagaagcaaaacgtacaaaaataacgatgcggctattcgggctttagtagtgcaatttgatttagtacctaacccaacgccagagcaagtgattaatcacttaagggccctacaataccgattagcatctaatgggtttgatcagtggaattagctcatgccaattattttgtagaattgtaaaaataggctgttgttggggccttcagcaagccta

SEQ ID NO: 51492 - DNA, 443 bp, Heterodera glycines
  Genomic contig location: Contig_ID=SeqID_402; Location=3209..3651; Strand=+
  SCN-specific regions: Sequence locations=1-163,186-394,423-443
atgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtcccactgcgccgagggataatcacacttcgggaggcgcgaatccgtctcccatcaccaccgccaccacccacttcagcgccagcacagcaaatgcttgttcttaccttaacttacctccccggaggtcgggagtaggggtgggggggggggtgatttgtggggggccaacaagctgatggacaaataaatatacacacaccctctccaccacaaatggagtgcaatttgtaatagattttgtccaaaaaggcgaccaaattttgatatttttagccaatttcttgaatttttattaacaaattttcagtaaaaaacaataattaata

SEQ ID NO: 51493 - DNA, 468 bp, Heterodera glycines
  Genomic contig location: Contig_ID=SeqID_3695; Location=1..468; Strand=+
  SCN-specific regions: Sequence locations=1-208,231-325,347-468
tggaagtctcctctctggactttccattaatttttcaaggttatgtgaacgacaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgttcccgtcgaaaacaaaatctgagtttaagacgggagcgggcggaaaagttactccgatcggagtaaggctgatgttgttccatttcagtgttcttcctggatagaggaacacctgagttgacttgggtttttcgcccaaggtttccaggcgaattattgcataaacaataaattcccaggaattgcagcccatgatttcatagactgtcttggacttttcctgagcataccaacgataaaaaaggcatgcactgccgcctaagaggca

SEQ ID NO: 51494 - DNA, 1756 bp, Heterodera glycines
  Genomic contig location: Contig_ID=SeqID_3695; Location=2272..4027; Strand=-
  SCN-specific regions: Sequence locations=1-156,178-224,246-246,268 -1369,1391-1756
atggagttcttggccaatggcaagaaattgcgcgtcgtttacgacgccagtgctcacaccagaggaacaaacagtctcaatgcctgtttgtatagaggcccggtaatcctaccggaccttgtcggaatgcttatgcgtttccgatgcccaaaattccctctcctctccgacatccaagctgcatttttgcaaattgctttggaaccggaggacagagaagtcaccaaattcctctgggtgaaggacgccagtaaaccactggcaccaacaaatttgatcacttaccgattttgccgtgtggcattcggagtgatcagttcccccttcattttggctgcgactttgcagcaccatttgaggagtatgaatctccagtggccaaagaattggcccaatccttatatgtggataacacactccttgagtgtgaatccgcagaagaggctttgcataaatatgcagagtccaaagcaatccttaaagaaggactttttaatttaagggaatttgttacaaattccccggaggtaatgaaggcgattcctgaggaggatcgcctgaacaagcctaaggtaaaagtcctagggctcatttggacacagacaaagacgaaattgtctttgagttcccaactaatggcttagaaaaggtggcaacacgccgtcttgttctaagcttccttgcctcattatttgaccctctcggtctaatggggccgtgcattcagcccctgaagcttttcttccaaactctttgggaagaaaagaagggctgggatgatgttctttctgagaaagaacaaactcaatgggaatccttccaagaaaattggaaggatcagaccattagaatcccacggagatcaatgctacaagggaacccatcccttcaattacatgcttttgtggatgcttcgatccacacatttgcagccgcaatttatctaagagcggcagaaggtaaccaaatttcagtttggcttattttctccaaaaatagactcaaacctataaatgcctcaaaagcattaacaattcctagaatggaactcatggccattctaatagggataaggggtcttaaatttatcgccgatcaaattcggcgaccaatttctaatctccatctttggggcgattcacaaatcgctctaagttgggttgcttcaaaagaagcacaaccgaaattcattgagagacgagttaaggaaattcgtactctcaatgaatgtgcttttcattttgtccgaacagccgaaaatccggcggacatagcaacccgaggcgcaaaaccaggagaacttaaggataagtctctctggtggaatggcccttcctggcttaaggaagaccatgaccaatggcctaaagaaatgtaatttaaaataaaagatcctccagaaaatctggaggaagggtctctggataacgaagagaaagtgttcttcgttaataccagaacagaggaactgattgacagtcctctgattgaccccaaaaaattcagctcttggacaaagattgtccaagtgactctctttgtgttaagatttctccgtctgaaattgattcagaaggaatatccttccaagcttttcgagatccgtcgaaaagaaatcgcaaaagtgtccgaaaagggactattttcagcagaagatgttctcctagcagagaaccttctgatccgcatggatcatattaaaagtgctgaagacttcctaagctatccttctcttaaggatagcgaggggatttaa

SEQ ID NO: 51495 - DNA, 702 bp, Heterodera glycines
  Genomic contig location: Contig_ID=SeqID_3696; Location=1679..2380; Strand=-
  SCN-specific regions: Sequence locations=1-319,346-545,568-597,621-702
atgtacattgagacagcccaagaaaacttgggcaaagagctggcggaccaaagtgtccgtgcagacttaattgcagagagacaaaatctctgcaaaatcatttctcttttggagaaatacaatggaaaatgggaagccattttcctgagaataaagggaccagctcttcaggaggaagagcaaaattatagggactttaagccagaaggcaaagccttcatgcattgggtcgaccaagcccgagggcttgtcgacaccattgaaggggccttaggcctctcagagctgggagatgcaattccccagccaaaccagccagcacaagttgtgcagcagcaacaacttgtgcatcagcgtcatgatgtgacgcttccgccaataacattgcccaagttctcgggggaaccccgagattggcctttattttggaagctctttgagacttccgttgaaagtcttcagattgaagactttaaaaagcatatttatttgctgggatgcctcccagagaagtcaattgctcggagagcaattgacttgtatccgccatcagatgaaaattatccaagggtagttgaaattctgaaaaagcggtttggggatgaaaaaacgaatggtggagtccctccaagcggagttactccaccttcccaaaccagcagaatccgttcagtctctgagacaattctcagagtccattga

SEQ ID NO: 51496 - DNA, 556 bp, Heterodera glycines
  Genomic contig location: Contig_ID=SeqID_20912; Location=1102..1657; Strand=-
  SCN-specific regions: Sequence locations=1-122,148-288,311-370,394-556
atgattgcggacggaagtgaggactttgaacagttggagcgttcattgtcttttgaggtgttttttcgagttaatgcaagctaatagattcactcagaacatattatttcttgaaaaagttgtagtttattgaaaaagaaaatcgggtgcctttccgctgaagtatggccccataaccaaaaaaagtaccgaatatcgcctaaatagagtatcaaaaactgttatttctatggacagataaataattgattccaacaaatgtcttctttgctttgtatctggattgtaaataaaatatacaactttttaaatcaaatggtatcgataggcgtcgccatttagtcttaaaattgaacattttggttagcagttaaatattattaataaaattaaggtggctgattgcattgccgcagatatggatgacggggagggattcgtgttcatggaaatgcgcaaggagggcccttccgttgaacttgttgaagaatgaccattgactgtgagaataactggtgtccgataaatgaccaaacaaatatttaaaaaaattaaa

SEQ ID NO: 51497 - DNA, 850 bp, Heterodera glycines
  Genomic contig location: Contig_ID=SeqID_20913; Location=218..1067; Strand=-
  SCN-specific regions: Sequence locations=1-46,68-73,95-249,292 -530,555-692,722-850
atgtctaacgacaaaaaagacgaatcatcaatttcaacgaatacccttgttaacaaagaaaaggcttctattgttcaggaggttatttaattttacattacactcgcattttactcagttcctattccataatttttactatttaagtcatcatttgtcactcctggcattttccgtcgtcgtaaaatgctcacaggcagacaactgaatgatgaaggaaacaatgaagctaaggaaaaaagcgcggtgtttatttacatattatttaaatttctaattatgttttttataggatttcaaatggtcaattgaccaaatcgcaaagatacaacccattgaatttgatgagactgaggagttttcattgccacctgaaaattggtatatttgcgttagtttttttttacactaatttctgtttttagggacccttgtgcaaaattcaagactccacaatttgaaaatattgatcacttttggactcacaacaacttaattgctccttcaccgggactattcgccacaggtaccaaaacattttcttttaataaaaaaggctacttctatacctgctgaaaatttttccgagcccccaacccgagttggaacaaaattgccttttatttgagttgagaattcggaagttattccttttaatagatgtcacatagagttgaacttttatgaatgtacatgccaaaaaattttatattaacatttagcctctgctttacgtcgtgttcaaccgtccgccaattctccaaccacctcaccgtttcagctcgctctttctcctttcggttcgggtccttcctgctcatcgaaatgctctttgtccgaggtaaataaa

SEQ ID NO: 51498 - DNA, 1098 bp, Heterodera glycines
  Genomic contig location: Contig_ID=SeqID_20914; Location=74..1171; Strand=-
  SCN-specific regions: Sequence locations=1-5,27-33,55-139,161-211,233- 258,310-320,342-351,383-660,683-708,733-757,781-840,892-910,935 -947,1032-1098
atggctttggtatttggctttttgaaaaagatatttgtttttctttgttatgttgggtaggtggtacacttaatccacaggctcaatttcacgcagattggcttacacttttgggctttaccctccccagcccattcgcttcatcatcaatttcacacgcttgaaataatggagaaagtgtgtatgagcaagaggacaaaatggaaaacgggcagagtacagcagccacaggtaaaaacagacggcgagaaaagcattgagagagagagcgagggagagagaagagaatagagagggagagagaaaaagtgatatatagcaacagaatagggcagacgagagaaaagcattgagagagagcgagggagagagaagagagagataagagatgaaatgcattgatagagagagtataagacagacagcgagaaaagcattgagtgtctgtgaagggttaaggacagacagcgagaaaagcattgggcagagaaatcgacagtcagagaaacaattttcaaaatcgatgaagcctcacttttccttggggttgcgtaattactactaagctgtggtcagtgtggccactgatgaaaagcggggctctggccatttggccaccctcggcagcagcaggcggaagcgtaacggaacacagcgcaaaattggatacataattaagaatctatttttggcacggcaagccaattatattttacaaatgaataattaaaatagtaaataaaggagtgaaaaggggaatttaaaatttaaaaaaataatccattaagaaagttcgaaacaaatttacgtatatttttctcattaatcgatttatcgtcgatacaattaaaaataaaaatgcacaaattttttattttaaatgatattttaccaagaaaatcaagtccagattttatttttattttttaaatttgcaattgcaggagataaattttatataaaaaaattaattagaaaattaaaatttatttataaaaattcatatgaaaattaaaaatttaattaaaaaagtagcccaattaaaaattaatatgcgcgcgccaattcaacaaaatgacaccgcaaatttcaaataaa

SEQ ID NO: 51499 - DNA, 271 bp, Heterodera glycines
  Genomic contig location: Contig_ID=SeqID_20914; Location=905..1175; Strand=+
  SCN-specific regions: Sequence locations=1-35,57-107,129-213,235 -241,263-271
ctctctctcaatgcttttctcgccgtctgtttttacctgtggctgctgtactctgcccgttttccattttgtcctcttgctcatacacactttctccattatttcaagcgtgtgaaattgatgatgaagcgaatgggctggggagggtaaagcccaaaagtgtaagccaatctgcgtgaaattgagcctgtggattaagtgtaccacctacccaacataacaaagaaaaacaaatatctttttcaaaaagccaaataccaaagccattttg

SEQ ID NO: 51500 - DNA, 698 bp, Heterodera glycines
  misc_feature (681)..(681): n is a, c, g, or t
  misc_feature (698)..(698): n is a, c, g, or t
  Genomic contig location: Contig_ID=SeqID_20916; Location=78..775; Strand=-
  SCN-specific regions: Sequence locations=1-284,306-449,510-512,534 -642,664-698
atgtcttcttttcccgattcaacaaattatacatttacagctgatcaaggtactactgaaatgaccaaagcaatttgaaattccgaaactttggacaaaaattggggtgccatggcaaatcgtacaatttctaggctaggcttaggcttgcttggttgggcctaggcttaagctttatcttgtaaaatacgagttgatttttgtacgagttgccattgaccaaaaaattggataagcccaaaaagaaaaatttaaaaaaaagacaccaaaaaagaaaatttatgtttttaaatttattcattttaaatgcgcatattttcatgctcagatggcaaaaaaaggaagactgcaaagccggacattttggcagatcgaatgaaattgttgctgagcacggccgatttcgccgatgcgcattttttggttgggcaaaacgacaaaaaagaggcaaaaataaaatttaaaaaatatatttaaatttaactaaatttgaaataaaaataatatttgctgaattaaattttaagcttctgcacgcacatcgtgccattctttctgcgtcttccgacgttttgaggcgatgtttaaaaaggaagcgacgaaaaatgcgaatggcacggcacattcggtgggaaaagtaggaaaattcttaattttcaattatcaaataatattttttanaacagttcactcattan

SEQ ID NO: 51501 - DNA, 418 bp, Heterodera glycines
  Genomic contig location: Contig_ID=SeqID_20917; Location=375..792; Strand=-
  SCN-specific regions: Sequence locations=1-21,43-165,187-387,411-418
gaaattcgaatttctcgtgctgaactttcccctttggttggtgccgatttggtgcggcatttggcaaagtgtagcacggccggcgaagtgatgtacgaactgctgaagagcgccgcttatatgcaccacatcattgaacagtaagtccggcgaaaatacgccatgggttacccgcccccctcggggactaaccaaaatctcgccgcataaattaaaaaaaaaatcaaacttagaaaattttcaacgaaaaattcttagaaatttttttataagaaaatttaaagggaaaaaaaatttttagcagtttttttgaaattttataaaattacgttttttcgaaatttttaattccagcgccaaaaaaggaaaaaagcaggcaaaaggtctaatttttgcaatttttgtttcaaaaaactaa

SEQ ID NO: 51502 - DNA, 1335 bp, Heterodera glycines
  Genomic contig location: Contig_ID=SeqID_20918; Location=128..1462; Strand=-
  SCN-specific regions: Sequence locations=1-807,830-900,922-1071,1093 -1335
  Gene Ontology: Mol. function=transposase activity; Biological process= DNA transposition
aagagacagttgttcttgaaaatggtttggctttgtatgcaagaccaaatgatgaaagagaagttgaaatatttgcaaatggaagaagacatgaattagacaacagatgggttgttccgcacaacctatacctgttgaaaatgttcaagtgccacattaatcttgaaaaggttaatagtgttagttcagtaaagtatttgcataagtatgtgcataagccaccagatagagcaagattggaattagaagagaaaaatgatcatgatgaagttaaagaattcattgatgcgcggtatgtttgcccgcaagaagcagtgtgggaatttttgaattgcatggataaaattcggctaagacaactgttactttacgaattccgaaaaaattctaccccaacccaagctcttcgaaatatttgtgaaagtgagggcatgatgcactctctctttctacagttaagcgatggttcacaaaatttcgtgaaggcaatgagcagctcgaagatgaaccccgctccggacgaccacctgctctcgattcggacgacttggagcagcacgttcagcagcatccgtgttctagttcgcgccaacttgcagcagagttcggggtccatcagacaacagtgctcaattacctccatcagcccggcttcatcaacaaaaagggtgccgaattccccatgcactgacccaacaacaaaagcatcagcgagtggtcacctgcactgaacttctcgcccgtttgagtgctggaatgcagctttcccagctgatcacgtgtgatgagaagtgggtttatctcaacaacaaaacggcacaaaaacaatggctgaagccaaacgaattgtgcgagccgacccccaggcgtcttcaacatgcaccgaaggtattgctgtgcgtctggtggtgttcatcagggttggtccgctatgaacttgttccggtgggcaaaccatcaacgccgacatctaccagcaacaactgcagcgggttcatgaccaaattcgtcgtcctccattttctgcaaaattccgcggcggcgtactccttctccatgacaacgcacgcccacatgttgcgttctcaacgcaacaaaaaattgagcaacttcgatgggcggtccttactcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatgttgcccgaacgatgggggaggatcattgatcaaaatg

SEQ ID NO: 51503 - DNA, 348 bp, Heterodera glycines
  misc_feature (192)..(196): n is a, c, g, or t
  misc_feature (200)..(200): n is a, c, g, or t
  misc_feature (209)..(209): n is a, c, g, or t
  misc_feature (212)..(212): n is a, c, g, or t
  misc_feature (225)..(227): n is a, c, g, or t
  misc_feature (232)..(232): n is a, c, g, or t
  misc_feature (237)..(237): n is a, c, g, or t
  misc_feature (256)..(256): n is a, c, g, or t
  misc_feature (268)..(269): n is a, c, g, or t
  misc_feature (305)..(305): n is a, c, g, or t
  Genomic contig location: Contig_ID=SeqID_20918; Location=2134..2481; Strand=+
  SCN-specific regions: Sequence locations=1-348
attttaaaaagaagtaaaatggtcgatgcgcaacattttacccaactgctcatcggaatgatgaactccgaaaatgaaattcgaagtgtctactctttttagtgcatgagttaaatttttgtttaaggtgaggctgaaaaacagtacgaagcgattgcactcaaagacaaaggtttagttttgtgagtcctnnnnncctncgccttttnggnccccttttgtttnnnccttncttgntttcctctgcggatgttgnggttttgcttcnncttgtggcccttttcccgctttgttccctccgtttngtctcgctctttggctttggttcttctgcggcgtttgctgtcg

SEQ ID NO: 51504 - DNA, 677 bp, Heterodera glycines
  Genomic contig location: Contig_ID=SeqID_20922; Location=187..863; Strand=-
  SCN-specific regions: Sequence locations=1-10,32-224,246-283,305 -421,443-677
atgacgatggacgcggagacgaacgacggggaaaaacgtaacggagtggcggccgccggtggtggcggtgatcaaaaaatgtgtgtgaagagaagcgcttagaaaattagaattcatcatcatatcattttgcccattttgttcacaaccgttatttcactttgtgcgtcgattttgtttttgcactttgtttgttttttgttttatttgttggcgcctcacacatacaaatgcttttaaaaaagcggcaaaggggttgttgagacaactcgaattccaacgaaaaattttcaaaattaataatgattcattcatccacaaaattaaaaattattcacacaataccaaaaaagtcatacatgaaaattgtgaaaaagtcgaaattttgagattttttcaatgttactttttcagaagccaaaaaatctttttgctttttgtatggctaataaagcatataaagaacgttcgaatgataccaacaatgttggatttggactaggtcgtttcggcgcgagcacaagtttttggcgctatgattttttctttgccaacaaaatccagggtccactttagaggctttttctaagctattgcttagcgattggacaattaccaaaaaagttataacatgaaattgcaaaaaagtcaattttttgaagttttttcttaataaa

SEQ ID NO: 51505 - DNA, 322 bp, Heterodera glycines
  Genomic contig location: Contig_ID=SeqID_20924; Location=216..537; Strand=-
  SCN-specific regions: Sequence locations=1-23,50-129,167-217,247-301
atggaccaacttatcagtgggcttctcggaggtggcggcggaggaggagcaaattctggtgataatcagccgcagcagggcggcggaggcagtggcaatcagttggcagatatggccggggtaatgaacaattttttttttaaatttaacatatctaatttttattcccccaggaattaatcggaggatttcttggcggtggcgggggaggaagcggcgccttgggaggaggcgcaggcggcggggtaaaataaccgtcgatttctaatttttagttcttagccatttcagctttaagcctaattgaaaatttaaaaataaa

SEQ ID NO: 51506 - DNA, 1610 bp, Heterodera glycines
  Genomic contig location: Contig_ID=SeqID_3697; Location=1624..3233; Strand=-
  SCN-specific regions: Sequence locations=1-60,82-98,120-242,267 -409,431-675,697-902,924-1299,1321-1522,1548-1610
atggatccggaaatttctgataattttccggctgaaaatgagcaaagcgaagaagtgtttattgatgaaaatgaaaacaacctttcaaagcttcaactgactgaaccctccgcttcatttttgcgttattaccaattcaataagggcgacaaaaccgcaaaatgccgaatttgtggagttcaaatctcacgcaaaatgggaaacactacaggaatggacaagcatttgaaacaacacaaaaagtctttaaattttcttttatttctaagttattttcaggtatcacaaaatgtatgcttccgcaaaagagcaaaaaattagccaaaaaagaagtgcttcagtattcaatgaggaatcttcttcccagcaaccattaaaacaaatgaacattgaacatttccgttcgaaggaaaaatggtccaattcacaccctaaatcccaaaaaattgactcattaattttgcgtttcatttgcctttcgtgtgagccaattttgtttccggaaaaaaatggaatgacagatttttgaagagcgtgtccaaggtaaattttttctcttttaatgaactaataaaccattattagttaccggttgaaatctcgcgaatttatgacacaattattagaagaagaataccgaaacaaattcagcattgtaaaggaagaaatttgcacagcaaaatttttgtcattcactactgacaattggcaaaatgtgcgcaaaaagaaaagttttttgaggtaaaagaacccatctaaacattattttaacctaatttaagtttgaccgttcatttcattgactcggattttaaccgaaaatggcgtattttaaccactcagccgatgccagagtcccacaccggtcacaacattagtttacgactcaatgacattcttacaaattttggaattgaaccaaaccaaattcacatttttcttcgcgatgcagcctcgtctatgatttgtgccgttgaagaacttggctacgaacattttgactgtttttgtcacaaaattcaattggtaacaaaagatgattaaattgtataatttttcttttaatttaaaggcactgacggacgcccttgaacatcggactaaaagagttggagaagtcaaagaacagctacacctttgcagggatttggtggcatttttcaaccgatccaaaaactttcaaaacgtttttcaaagacaacaggaattaatcggagctcccaaaaatgggctgatacaggtcttattaattagattgttatacttaattttaatcgtcggttcaggatgttacaacccggtggaacagcagccttttcatgattaatcgaattactgaacaacaacgtccactgagtttggctcatattgactttccggatttgaaaatgcccgattttgaaatgctaaagaatctttcaaatgtaagaaatgatcgaaattatgcttgtaaacaattttctaaggttctgacaccttttgacaccttcaatttgtatttacgttttgggggacgagttcgaggaaaattttaaaaattttgttttcagaggggggggggggttcttggaattttctgagtcccaaaattctgtatttttttaaataaa

SEQ ID NO: 51507 - DNA, 836 bp, Heterodera glycines
  Genomic contig location: Contig_ID=SeqID_3697; Location=3558..4393; Strand=+
  SCN-specific regions: Sequence locations=1-67,89-191,213-328,350 -542,585-596,619-722,758-797,819-836
atggcgacagcagttgcgttgcgtggcaatgaacgaattgtccaggatgggattattcccagtcaaaaccatttaccatgttgcattggcaacatttgtttggcaacatttgttccatggccattgttcggggcagtggcattctcttttaacacgtcttctcggcgtaagcttaattagtttttttatgtaaaggattttatttaaaattttagcgacattgtctttgtcggggcattgatgagcgtctttgaggccaaggaagtaagtattccttcaacccatttcttccgcagaagaattcgctctaaatgattttcaatttattgaaaatataatataaaacctacgcagcccgacactcatggaaagcatttcattaagctttcctaaatttattaaattatgagatttcgaattgagtttgatatggatataaatttgggatttacactgtccgggtgtccttgcatcgcgcaatcccacaattgagccttaacgtataatttacgttaaaaaatcatttgatttaatacgatattaaaaataaaaattttcttcttatgtgtatattcatttgttatattctagcacttaaaattgtttaaagttaataatctaaattaactccaaatcaggaattaaggataagcattaaaaattttagtattcgcggaggcggactataaaatttcagaacaaggaacttaggaatgaatttcaaaaaatcatttaaataaatattttttcaaaattagtctaattaacagaaagtgttattggcaatattccaataaataattgcatctcaaattgttcagaaatttagaaccgga

SEQ ID NO: 51508 - DNA, 912 bp, Heterodera glycines
  Genomic contig location: Contig_ID=SeqID_3697; Location=5335..6246; Strand=+
  SCN-specific regions: Sequence locations=1-188,210-314,359-638,673 -714,744-912
atgtccgattcaatttgggaaatcttcacaatcctggacaaaatcaatttggagtcagaaaaggcctacgtggcgtgagttcgagagatgtaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataagaacaaaaaataatgatataacaaaatggaaaattgtgccataattgagacatattgtcataaagacttaaaatttggctttaaaaaacacaaaaccaagttttattttgtcaatccattttttgttaatgctgagcaaaattttaaactaatactcgcatcaatagtcgaaaaaatttataaaaatgaacaaggaaaattcaaaagcattctgaagctttcctttggttttgaatcattttattgccctcttagatgccctagcgaaaacacagccgaggctttgttccaacatgtcctattaaaagaagaattatattcgtttttctatcctttggatgatgtcataacactagaagtaactataatcccagatgtcgacaatagaccaagaaattaattttataaaaaacaaaattacaagaaattggaaaatcacaggaaagattgttaaacgttcacatttgttagcaatttttgcaaataaactttttaaacgggtgaaaaatttctacatagcggcatttagcgcgccagacattgaaaatttatatttttcattcttagaaatgcttgaaaaaattcaaaaattaccagggcttattatgcatgaatatataaaccaagccttagctatgcaaaaattagaaattggcctcaaagaa

SEQ ID NO: 51509 - DNA, 684 bp, Heterodera glycines
  Genomic contig location: Contig_ID=SeqID_3698; Location=1035..1718; Strand=-
  SCN-specific regions: Sequence locations=1-83,106-327,356-640,662-684
atggtctgtttttgaagttcaaaatttgcttaaaattctcaaaaaaatttttggcggagcatataaaatacaccagacccccaaataaaaaactgaaaaactttttattaatcctattaccccaaaatttttccggttattaccctgttttttagacaaattcgttctttgcttattaaattatcaaaataggtaatcttattttctttaaagaaccgccataccatcaaagtgctttctcagacatttccgaaagtccgttgcttcaaatcacggaagaggagcaatttccggtcgaagcaaccccgatgaggagtcttttggatgtaatataaataaatacaaataaaattttcagggtaacactcttctcccatttagcaactcgatagtgacaaatcggaacgttctgccccttctcaaaaaagcacgtgggcaatacaaaagcaaactcaggaacatgtacgacgggcatataaacgactaggaatcgaaagacctgaggaacgcgaaaatgctcgccaagccctcacagcatcgacgtgtgactcaatctcgggaaagaggagccacaacaaagtcagacaaaatgaaaaaggaagttgtgagaaaattaagagccaaatgtgacgataattgtgatatttgttcaaattttttgaaaaaatatcggcattgaataaa

SEQ ID NO: 51510 - DNA, 524 bp, Heterodera glycines
  Genomic contig location: Contig_ID=SeqID_20925; Location=1620..2143; Strand=+
  SCN-specific regions: Sequence locations=1-326,348-524
atgctgaaaattgttatgattggtggtacagttgtatcgtcagttgcctatcatcactcaattggttaggagtcgcttagcttgccagccttaggtcatatgggccttggcacttcaattcccaaaattttttttgtaccttttgcaagtgtacgactccgccttccggaaattattttttgatcagaccaaaacccggacctgtacagacacggagactcagttaatttgtttttcccacttcagtaccagttgaataccaggccagggtttgcactgagcgagggagtgccagcgaacttattatagagctcaatgagttggatttttccagtttttaaaattgcgaaaattttcaaaatttctcgagctaggcctaaaagtaggtttttcagtttctgaattttaggattttttaacgatttttctcgggaaaacggagagcagttccaaaaaatcgtttttggagttctatcgactggtatttttttcgaaaaaatttcggtttttttccggaaatagaa

SEQ ID NO: 51511 - DNA, 185 bp, Heterodera glycines
  Genomic contig location: Contig_ID=SeqID_20927; Location=215..399; Strand=-
  SCN-specific regions: Sequence locations=1-185
atgctcgcgagaaagagccgaggagcggtaagcaactgccagttaatttttcaaagaatttccaaagttctcggcgatgccataaaaatggctatctcttttttgtaacaaatttctagcgaacaaatgctcgcgagcaagagccggcggagcgtgaagcaactgccagtcaatttttcatataa

SEQ ID NO: 51512 - DNA, 1297 bp, Heterodera glycines
  misc_feature (876)..(876): n is a, c, g, or t
  misc_feature (879)..(879): n is a, c, g, or t
  misc_feature (906)..(906): n is a, c, g, or t
  Genomic contig location: Contig_ID=SeqID_20927; Location=707..2003; Strand=+
  SCN-specific regions: Sequence locations=1-54,76-172,197-385,666 -705,728-1075,1100-1206,1274-1297
atggcacttttactgcttccattgctcgcttatgtggctgctcaggacggcatcaaaaagcagcaacaaaataatggtggccaaagttttaccggcagcgtgaacaatgccgaaattcgtcgggcagtcaatggcactgaggtggaaaatgccaaaaaaaaaaatatgcatctaaatattttaataattattttttctaaaagtttagtttatgcttgagtgccctcgtgccgcgtatttggtccgtactcatatggcacccgattttgagcacccgcaactggtgagaaggttggattggcttcacgacggtgcactggttgccagctatcagcaggtgataagaaaatttaattataaattcgagaaaacgaaaaaaattaccaaaaaaattaaataaaaaatttatttttaaaatcgagaaaacgaaaaaaaattacccaaaaattaaaataataaaaaagttttttttttgtaagaaatatgctaaaaaattttgaatattcacttttttatttttttgaattattctttttaattaaattttaaactaaaccaatataagtaaaaattgcaattttttgttaaaacttttttaaaatttttttttaattatttccaaccctaaaataaatttaaaaaaaaaaattttttctatattttttggactagaaaacaaaattaaggatttttttttaaatgatgaacccattttttcaaaattcatgcattttcccgcctattttcttccaatttccttcgttttttgttttcccgtcttgtgccatggcattgagttttcccattccccacacacttatacaaacacacaataatattgtggtacaatgaagggcaatgcaacacaacccaacncanaatttgcatgccaatgccaacaaccanttcatcggttggggtgatgaaatttgagctgctgggacataattttttgaatattgggataaattgtgagttggagaataatttgatatgtgaaaaaaagggttttttgaagaaatattttagaaaaaatttccgattaaaaataaattttttgcttgaaaatctaagggattaaagaagaaaagagaagcaataaatagttatagaaatttttaaaaaatttagccaaaaacttttttaaagaaagaagggttcaggaaaattcgaatattttaaatgcatttgaatcgaaatcagtagttttttttaaattttataaaataattaaatttataaaattatttatatttagcattttattattaatctttagaaagtttgaaattcgata

SEQ ID NO: 51513 - DNA, 777 bp, Heterodera glycines
  Genomic contig location: Contig_ID=SeqID_20928; Location=642..1418; Strand=+
  SCN-specific regions: Sequence locations=1-116,138-418,440-777
atgttacggcgatcaactggctcaaattggagttgggatgagcgacttccgtttataacattttgctacaatactacaccctctgaggtcaccggattttcgccgtacaaaatgctatttggaaaaccagctaattttcccggagaccatgacataaattggcagaaaaaccctgcctacacaatcgaccaagaaacgtatttgcaaattttccgcgaaaacataaaagacatcatcaatgttgctaaaaaaactgcagaaaattcaagagaaaagtcgaaaatgtattacgacaaacgaccaaatgtgacagaaaacaaatttggccaaggggaccactgtatggtgatattcccaggctcaaacagtcgttcaccgcataaaaagctgatgtggaacaattttggcccatacaaaataattgaaatttcaaaatcctcagcaaaattggttcccgtcgataaaaagaatgcagagccaatttcagtgcctttggaacgtttagtccgagtaccaccaggattaccaaacatttcgaccctcccaaaaggaagaaatgtctatagaaatgtcctcaacgcattgcttacacctaatttgaaattgacagaaaaggagccgaaaaaacggggaaataatggagaaattggtcgaactgacaaaaaatcgataattcaattagggacaattgaatttttaggcggcgatatggaattggacggagaaggcaattacgcactttcatggtcatcgatttgttgtggaaagggtcacgaa

SEQ ID NO: 51514 - DNA, 222 bp, Heterodera glycines
  Genomic contig location: Contig_ID=SeqID_20931; Location=217..438; Strand=-
  SCN-specific regions: Sequence locations=1-65,87-144,181-222
ctgaaaaatgtccaaatcagaatgtacaacaaattggttaactattagaaaataataggatttggaataagtaaaattgtaaaaaatgagcgaatgctaattaaacctaacttatgcaagtggcgagggatccctcaggcttagtttttagaatcttaatttttaaaaaagcacatttttctatttttgggttggggcccaaacgaccccggggcccaaaaa

SEQ ID NO: 51515 - DNA, 730 bp, Heterodera glycines
  Genomic contig location: Contig_ID=SeqID_20932; Location=817..1546; Strand=-
  SCN-specific regions: Sequence locations=1-255,317-525,548-596,620 -647,673-730
atgaatatgtcaactcatcctggtaaaaaaaacattttcaatggccttactttgtaattcaccccatattcccaggaatgtacgaatttttgccaatgtacaccaattttgagccgaacagaacatacgaactgattggaacttataagcccatcatcaaaaccgacccgccacagttcgagacaaactttgtgattatgcacaaatccgagcaaacgcggcaagtgatgaaatggtaaagaggcaataatttggaaattaataatttattcatatgaaattattcatttaatttagaattgaaaattaattatttctagagcccggacgggcccggcgggcttttaccgggcgtcccggtcccggccccgtttttttttggaaaaaaacgggcccgggacgcccggtaaaacgggcgttttttgaacgggcggcccgccccggtcaattttcgaagcccggtcccgggcccggtcaatttgaccgggctaaaacgggcttaaattccgccagcgaaactgcccaaaattgaatttaaataattattttggcgaaatgtctttaattcaaaaatttcaagatagaactttggatttttgaaatttttgggcaatttcaactgttaaaaagaccccaaaatccatatgaaattgaacaacattttcataactttctttttacaaaaaaaaaatttcaaatttcatgaaaaaccaaaaattttcttaataaa

SEQ ID NO: 51516 - DNA, 1216 bp, Heterodera glycines
  Genomic contig location: Contig_ID=SeqID_20933; Location=59..1274; Strand=-
  SCN-specific regions: Sequence locations=1-442,563-1216
atgtcgggcgagtaccgaaacggctacgccgcgccaggcgcgaccggcgctggtgctgctggtggcggaggcggtggaggagcgtacacggaacagcaacgcttctacgacgcggcgacaggcgcgcacggcttttctgagtcgtccagctgggagcagcgggagcattttgagcgcaaaatgcagaagggtgccaagcagcggggcttggtccgagaggggtccgcggcagcactcgtgcgggacgggtcgcggtcgcggattgttgaagggggcgcttcctacgcgaacgggctggccattgagagggtaaggatcgtgtgtgttggctaatgatcctctaattagcaacgtagttaatttgaacctaattagcattaaaaattttgaaatctcggcgagaaaaattggcatatgccaagcgatttttagccgcgcgcgatttctcgatttctctccatttctttctctcttttttctttatctttttcccctttcactctctcaagtcttcatctctttctcgagtcaccctctctcttcctctctcattttctctttcaactcttcattcaccactctatttcccacccatccctttgatcactcaacagaccaacaacggcacttcacaagctaatgctgcatctatcgctgcttctgttactgctacaacctctcacttggcattgctgactgcccgtgaagcattgctccaatgggcccgccatgttacgtccggttaccccggcgtcaatgttgccaacttttccggcagttggaaggacgggttggcattctgtgcccttctgcacttttatcgtcccgggctgatcaactgggaagaggtaatctgactgatctatataaaaaatgaatgggatttaattatttttttctaaaattttagtgccacaaattttagagttaaaggccgaattttggcatttatttcaaattttttgaaatttttttgaacccaatattttcaaaaaaaatttataatcttttccatcattaaattagcttcaacttttttttccagatcagtgcccagaagccgttggatcggctccggaatgcctttgacgccttcgagtcggagttcggcgtagccgaactgctcgatccggaggatgtgtgcgaggtggacacaccggacgagcgctcactgatcacctacgtttcaacaactgcacgatcgattggtggatga

SEQ ID NO: 51517 - DNA, 1412 bp, Heterodera glycines
  Genomic contig location: Contig_ID=SeqID_20937; Location=314..1725; Strand=+
  SCN-specific regions: Sequence locations=1-162,184-567,589-752,862 -1222,1244-1246,1269-1284,1307-1357,1410-1412
atgttcattgacgggattggcaaagatcgtgccgccgctgaacaagcgttggccatggtcggcacacaaaatgcccaacttgctgaactgcttgccgccagtgctgcgcaacgggaagaaatgctcagcaccgagttgaagcagctggctgaattgcgtgaccagctggcagaagcggaagcaacagccgccgcccaccaagcaatgcttgttttccgcaaaaagcgtcaaaccaatgaggacggcgtacagctgaagggtagccaaagggccaaagtgattgcaaaggtgtgacgtacgatcaatggtggatgaccaaatcaacatactaatgggcaattaattagcattggcttagtgtgacactaattagggcgagcttcgagggtctgatggtggattattgtggggtaattaactaaggcggcgaaagcagacagttaaaagagatacccaaaatgccattatgagcaattaaaagttggcaccggaaccctaattttgagggagttcagttgggaagggatgagtgaacaccgcaaatgtaatttgcaacttaaacttgccaataaaaacataatttagtaagataatgtggcttgaattacaggttacacaactggaaatggaagcgcaaaaaattcgtggaatttatgacgccacccgattggaagcacaccgagcaattgaggtattaattactaatcgcaattaattacattgcttattaataatagcaatttaaataactgtaattatgtaattaaattttaataaattaaaatatttctaaaaatataaatgattatactaaaattaaaatttttctgaaaatatgttttaaaattaaatttttaatttcattgatggcactaattaatgcattttttaattgtccaaatgtaattaataatttaggcggcgaatgcgttcacgcaaattgcgcacgggttgctgcaggcgcgcaacaacactcgcaccgcacaacaactgatgaaggaaacgcacgggcacctgcgcggcgttgcggaagcggcaacaaacgcgaaaagtgcaagcaaagcgatgggcgcatcaattgacatcggctgcaatggaagtggctgtgtcgaggtagggggaaaattttagaaaaatttgaaaaattttctgccgtttttttgatattttatgatgattttttataaataatttttctcaaaaaatttctgcaaaaattgcttaaaatttttcatcttgaatgttcatataaaaaattaaatttttttccagaaaaaattttaagtttgacaattttttaagaaaattttgaagtggtgggaacaacaatgattttttgcttggtattcatcatttgttataaatgatttttgttttaaatttattatttttttctataaaatatatttgaa

SEQ ID NO: 51518 - DNA, 1177 bp, Heterodera glycines
  Genomic contig location: Contig_ID=SeqID_20938; Location=1124..2300; Strand=+
  SCN-specific regions: Sequence locations=1-289,311-1177
aaaagaagatcgtatccaaaagtagactggacaacgaacattcgaatcctagccgtttctgttcccctaacaattgggaggcaaacagttccgtaacatttcacttctttgccatttatgtccacaatgcgcctttccgagtaggaaatgatctcatttttgtccaccatgtccataatttgtgcgaaaaactcagctgaaatcagagaaatttgggcacctccgtccaacattgcatccgactgtcgtccgtaaatagaaactttagcaacaattatcttcccgacaagaggactttcatttgaaacgacaaggtcactcaatttgtccgccgcgttgcggaagaaattttcaatttgtggtcggtgctcagcattcacagcacccgccagcaaatcattcggtttttgcggttcgttgttttgttcaacgaggtagttttggcgaagaaaatttctcgacgccgaaaactgtggtccgcttttggttggagcttgacgattccaatttaagggcgcagtatttgtccctgttccgggttgtttggaaaattggttttggttctcttggaagggtcgagattttggtggaaccatacaatttcgagacacgtgatcaattcggccacagttgaaacatgtgacattggttggtttgtttgtgtttatttctggtctggaccaattactggtatagttgtttgatggcacgttattggatgaatatgacgaattcggcatttgccgttgaaaagtttgatttgacctaaacgaatttctggcagccgattgcgttgcttccgctcgggctgcttgtgcaatgaattcatcaaatgtcgctctgggtctgcgtgtcatttcaagagtgattgccaactcgggattagaaatggctcttatgattgaataatcatcgtattgctgttcggttagacccggataagcgcggcggaccaaacccgaaattctgttcccgagctcatcgacactctcgtttggtcggcgccgaattccgcgcattagttggtcgaaagacgtcaattgtttggcgtctgtgtcgtccaactgtcgaataattatccgcctgattagctggtattcatgcgggttttcggcaatagctgaattgtaagccctctctgctttgccaaagcatttcgatcgaagagcgcgaagtc

SEQ ID NO: 51519 - DNA, 2877 bp, Heterodera glycines
  Genomic contig location: Contig_ID=SeqID_20938; Location=1..2877; Strand=-
  SCN-specific regions: Sequence locations=1-1444,1466-2188,2210 -2630,2653-2877
aaaactttgagtttaattctcgaccgaaatcaaaggctggatatgaatgtcaagtaaaatcaacaaacggggcacagtaggaacaattttactgccattgaacgttgaacgaccacagccaaacagttaccgaatgaatcaacaattgtatgagaatgccccgggtaatactgaacggtaccgacctctccgagtcgaaagaccagttgttgccgaaaaccagcatcatttggttcgacaaaacccgccacctcatgcctacgctcacaatgacgattattatgctcagcgatttaaggcacaaaattcccaacaagctccccagttccaaaatcacaaccaaaatgtgccaattagagaaaatcatccgaatcagttcgaacaatatcagcagcctgtccaccccggactggtatttgacggcatgatggcacaggccattagaagcctagacagcttctcgtacacaatgactctgaactctattccgaatttggacggcccagcggatcagacgcagtgaacgcattttttaaacagtttgatgtagcgacagaggaatggcctgaggataaacgacttcgcgctcttcgatcgaaatgctttggcaaagcagagagggcttacaattcagctattgccgaaaacccgcatgaataccagctaatcaggcggataattattcgacagttggacgacacagacgccaaacaattgacgtctttcgaccaactaatgcgcggaattcggcgccgaccaaacgagagtgtcgatgagctcgggaacagaatttcgggtttggtccgccgcgcttatccgggtctaaccgaacagcaatacgatgattattcaatcataagagccatttctaatcccgagttggcaatcactcttgaaatgacacgcagacccagagcgacatttgatgaattcattgcacaagcagcccgagcggaagcaacgcaatcggctgccagaaattcgtttaggtcaaatcaaacttttcaacggcaaatgccgaattcgtcatattcatccaataacgtgccatcaaacaactataccagtaattggtccagaccagaaataaacacaaacaaaccaaccaatgtcacatgtttcaactgtggccgaattgatcacgtgtctcgaaattgtatggttccaccaaaatctcgacccttccaagagaaccaaaaccaattttccaaacaacccggaacagggacaaatactgcgcccttaaattggaatcgtcaagctccaaccaaaagcggaccacagttttcggcgtcgagaaattttcttcgccaaaactacctcgttgaacaaaacaacgaaccgcaaaaaccgaatgatttgctggcgggtgctgtgaatgctgagcaccgaccacaaattgaaaatttcttccgcaacgcggcggacaaattgagtgaccttgtcgtttcaaatgaaagtcctcttgtcgggaagataattgttgctaaagtttctatttacggacgacagtcggatgcaatgttggacggaggtgcccaaatttctctgatttcagctgagtttttcgcacaaattatggacatggtggacaaaaatgagatcatttcctactcggaaaggcgcattgtggacataaatggcaaagaagtgaaatgttacggaactgtttgcctcccaattgttaggggaacagaaacggctaggattcgaatgttcgttgtccagtctacttttggatacgatcttctttttggaacaaatgctttgaatcaattaggatttaaattgatcgacaaagttaacatgaatgtgatcgatttttctccactcgataaacaagcgaattcagcacacataatttatagagtcactcttcttccgcaatcatctacgcttgtcgagttgtcagtcctgcgcgagctggatgataaagaagtatctgtaatcggaagagacggttttcatgaacaactgaaatttgagccaactcttacatcaggaaaaaatggacaacttgttgtcccgattgtcaattattcggccattccgattactttggaggcgaaaagcaatgttgcgcaagttgaacttgtcgaagattggcatgaattagaaaattcgtttgtaacaccattggttgcaaaaaacgctagatattctgaaaaaggacgtgctggaatgattaaagacattctgtaaactcgcattgacaggagttacaaaaatgaacacggtcaattagagaatttaattctcgagttcgaacaaatttttgcgcttgacgacaacgaactgacacaaactgcgataacgcagcacatcattaacacgggaagtgcaccgccaattcgaaatcgaatgcgaccactcgcatttgcacatcgtgaaaaagtttcaatgatgcttcaggattatttgagcagaggattgattcggccgtcaaaatcgccatgggcaagccccattgttcttgtcccgaaacgtgatggaagcttaagattttgcgttgattaccgaggaattaattcggtcacagtgaaagacgcatacccgttgccgaacattgattacattcttctcgcattgggaggaaaaaaatacttctcaaccctcgacttcctttcgggatattggcaaattaaaatggacgagaagtccattgaaaaaacagcgttcgtcacagaatttggactgcatgaattcacggtgcttccgtttggactttgtaatgctgtagcaacttaccagcgattcatgtctcgtctttttgaagatctgatcaatgattttgtttatcttgatgatattttggtcgcgtctgagacgtttgaacaacaaggaagcattgaagattgttttgaacgtattcaggat

SEQ ID NO: 51520 - DNA, 2116 bp, Heterodera glycines
  Genomic contig location: Contig_ID=SeqID_3699; Location=90..2205; Strand=+
  SCN-specific regions: Sequence locations=1-317,358-460,483-545,567 -640,662-767,790-1491,1513-1513,1572-1593,1615-1644,1666-1678,1716 -1892,1914-2046,2070-2116
atgagcacaatggaatgttttgaggatgaggaccaagaagtgcatttaatgttgggcgacgaatgtgcgaatgaaacaccgaaattagccaacggcacatacaattacccaagagtttgtccaaaatgataattatccttataatgaattaatagccgtgaaaaattggggtgggaagagaagtggtcgaaccgctggggtcactttggtggttaattgtccaaggctcttaaacgatgagtcattccatgccattgttagcgggtgctttgttgggtcaactaattacatccatactctcggccgtaatggaaaacaaattattgttaatttttaaaaattaatcataattttaaagagacgaccaaagccaccacggctgaccaaagatcagacattcaaagtgccaccacaaatgactttggatatgccatggtaagaaagaatgtttaatgaatggattgtttaaattattatctttttgactaaattttatgttaaccgaatcagaaatagaatattgaaacactgaaattttttatccttttaatgaatatttaatgaagaatattgaaaatttttttggtttcgaagttatgattaaaaacttagcaatttcgaataaatttaattttgccatcatttttaagtaaggatgaagtgcttcaactgtacgaagaactacaatcgtccggcgtgccacaaataatgagccgctttgaagaagttgtaggcaatctgtgccggtgggcaaacattttgcgaagaaaaaataaataaatttcattttagtgaaattgatcaaaaacgtgacgaaaatgaacggttacaacaccagcaaaaagcgtgagtttgttctctttttgtaattatgtgggtactgcaataatacaggaacaaattacggtattcctactgttttagtgaacgtgaaagctacaataagcggatggcagcattggaaaatgaaattgatcaacaattattgatagctgagaagaaagcacgggatgaagtcggtgatacccggcgatttggtctcgagcttttagagatactgagtctgactaattaacatgactaattgacgacctgttctcgaaaaaacattaaacttaaatgaaaatttccaaatttaaaggaacgtgaaaaattggccaaggaaaaagaggagctgaaagagcgattggagcgcgaaatgggcgacctgcaaacgaacattgaacacttgcaaaaaatggaaaaagtgctgaagaaagaggcacaaaagaacggcaatcaggaaaagttgaaggagaagctggaggcaagaaaaaatttagaggaaaaattaaaattaacaaagattgatagcgattttaggcacaaaaaatcgcaaaatatacactaaaaaggcagaaaaaatagcaaaataggcattaaataggtacaaaaatcctggatatgcactaaaataggcaaataaaaatttttattacagcttttaggtaccaaaacacataaaaacttaatcaaaaaaataataatttggttatatttaaattgtaaatgaaattattaaatattttaaaggttttttcgaataatgacaaatttttaaaccaaaaattttttatcatgaaaaaaaatattttagggaatcaatttttgggaaaatttcttcatttcttaggggtgtattttggtttttattgtatttttgttaaggacttttccgaaaatcctgaaaattggcacattgagcataaaaaaccgaaataggcaaaaataggcattataaaagtcatcgtagatgctcaaagccgagcggaaaacgcgcttttcatgcttatctgtgcgtatcaagtgcgcaaaattttaggcatttgcctaacatcgcatccctagtgataaattttaatttgtttgtttttgcgcaggaaattgcgcgagagaatcgcacactgaagaacaatttggcggagaatcacttggagatgacgctgatcaaagccgagttggcggagatcaaaagcgagtacgaaaatcggacactgctcatgcagttggagcagcagcaggagcagccgagcgcggccgaagcacaacaaatccaacggcagctgcaactgcttta

SEQ ID NO: 51521 - DNA, 1879 bp, Heterodera glycines
  misc_feature (1280)..(1280): n is a, c, g, or t
  misc_feature (1314)..(1314): n is a, c, g, or t
  Genomic contig location: Contig_ID=SeqID_3700; Location=1757..3635; Strand=+
  SCN-specific regions: Sequence locations=1-130,187-199,228-355,378 -561,583-1017,1039-1139,1161-1501,1523-1879
atgaaagaagtgccaattctgttggttggcaacaaagttgacttgcgcaactcgggcggtgatggcacgacgaaagatgagtcatcatcaacttttgtgtcaagaaaagagggcgaaaatctgtcggaggttaaattaaatttatattaaatttaaaacataattatttcaatattatattttttagacgctacgggagaataaaaatttttttaaagaattttattgcagctgttgggcactgatttcatcgagacaagcgcgttggatggcacaaatgtggagacggcacttctgttgcttgtcgggtgagcactccaaaaaaaggcctttggggatcaattaaaatggaatattatttttaaagctaaaaatcaaactgctgcttctgcttaaatataactaatcagttagttatttatttgtcttagaaaaggtaattttgagaattttaaacaccagcagtaataggcaaccggaatttgggtgcccaaaaattttcgtaaattcaaaaaagtatgttaaaatacgcattttgttgaatcttgataatcagtgatacgaatatttaagttctgtagcattagtattgtagtataaaagtaaaattctataaggagatcgttctgaattacgaaccccggaccagaattcgaacaaaaggtcgaaagtccaaaatttgaaattaacatttttggttaaaaatcactttaaatacatggaaacaaactgaaagccatcaatttttcaataagagataatttacgccgtttttgaactaaaaatgctaaattagaaaatttggactttctactttttgttcgaattcgggtccatgtttcgaaattggcaaaaatgataccgaattcgtgattagtgacctcgaaaacccaaggaacttatttttatgacattaaaattttcactgacgcatttctactgacgtattttccgggagccgaatgattccatattaattataggcacagtttgaaaatttgaatgtttggatgattgttttttaaggattaaattttcgggactgcgatttccctgattcttaggaccatttttaatggtactgatttgatcttaaggtcaattattttcagcgaaatgctcaaaacagaggatgatcagttgaaacagactgcaatgatgctgcaaaatggtggcaaatccaagaagagcaaatgcctgagttgtggcaactcatagatcagaagattatcaaccacagtgatcagcggcatcgatcggaaaatgaaactttgacttgngtcacttgaaaagattcagagatttctcccactnttttggtactaatttaaataatgctttataaatttaaattaccaattttccctgaatttcgtgattttaacttgtgttagacaggtccgggtacccgaccggctccagacccggaaaccggacccgaccttttgaaaatccaatactcgacccggtaggtccgggtccaaaaatacactgctaagaatgagggtctgggccagggctggacataactgattttcaattacggaaatccgtaattacggcgatttttaattacggaaacctaatccatcattagggagttccaaaaaggcgccgtatttcgcgtaatccttactcgtagcgattttagctaatatttatgaaaaaaattaggagtttttgggccgggcagtgcctcaaagtttagcatgatttgaaattttgctgtgcgcttttaatgactaaaattaggagatgggagtgattaagttcgtatttgaattaaatttgtgacttgtaaaaacttcgagaaaaagccatttggaaaaacgaacaatcaagtaatggaaatcatatgatatcagcaatcaagagatta

SEQ ID NO: 51522 - DNA, 660 bp, Heterodera glycines
  Genomic contig location: Contig_ID=SeqID_20939; Location=151..810; Strand=+
  SCN-specific regions: Sequence locations=1-596,618-660
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttt

SEQ ID NO: 51523 - DNA, 154 bp, Heterodera glycines
  Genomic contig location: Contig_ID=SeqID_20939; Location=763..916; Strand=-
  SCN-specific regions: Sequence locations=1-154
ctctagagtcaacgcagaattaaagtacaggctatagggaagctattctcgaaggattcggtctccccataaatctgggcgcatcggttcggggggactgccccgaaaacaaaaaaatcgattttttcaagtgtccgtttggggtactcaaaca

SEQ ID NO: 51524 - DNA, 408 bp, Heterodera glycines
  Genomic contig location: Contig_ID=SeqID_20943; Location=1358..1765; Strand=+
  SCN-specific regions: Sequence locations=1-264,286-307,329-386
atggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgacttggtaaggcgctttgacaaagacggctttcgttttgcaattagtcggtcaacattcggaaattggtctcgaattttttcggcaattacgtgcaatcattttaaaaggaaaaaaacataaaagctaaaatttattcatttttagcgaaaaatcaaccagaaaagtgaaattttatcttttttgcttatttttgacataaacttattaatttttaagaaaatttaa

SEQ ID NO: 51525 - DNA, 155 bp, Heterodera glycines
  Genomic contig location: Contig_ID=SeqID_20943; Location=1485..1639; Strand=-
  SCN-specific regions: Sequence locations=1-155
atgattgcacgtaattgccgaaaaaattcgagaccaatttccgaatgttgaccgactaattgcaaaacgaaagccgtctttgtcaaagcgccttaccaagtcaaaaaatttggaaatgtatctcatatgcaatttcaaccaataaatttgaagaa

SEQ ID NO: 51526 - DNA, 365 bp, Heterodera glycines
  Genomic contig location: Contig_ID=SeqID_20944; Location=640..1004; Strand=-
  SCN-specific regions: Sequence locations=1-7,183-203,225-233,362-365
  Gene Ontology: Mol. function=small GTPase regulatory/interacting protein activity; Cellular component=actin cytoskeleton; Biological process=hearing
ccacctgcgccgccaccgcctcctccgccacccgttccaccatctccgctgcccgtgacagcgcctcctgtgcccgtgccaccgcctcctgtgtccgtgcgcctccgccgccgccggtgccaacgcctcctccgccgctcgtgccacttcctccgctgttggtgccaacgcctcctccgacgttcgtgccacaatttccgcctccgcccgtgccaccgcctgtgtcaccacctccgccgccgccgttgccaacgcctcctccgctgccgcccgtgccaccgcctcctccgctgcctgtgccaccgcctccgctgccgtccgtgccaccacctccgctgcggtccttgccaccgccaccgccagta

SEQ ID NO: 51527 - DNA, 819 bp, Heterodera glycines
  Genomic contig location: Contig_ID=SeqID_20946; Location=1..819; Strand=+
  SCN-specific regions: Sequence locations=1-177,203-208,231-243,278 -321,355-358,397-704,726-727,749-819
  Gene Ontology: Mol. function=voltage-gated potassium channel activity; Cellular component=mitochondrion; Biological process =courtship behavior
gtagggcatttgaaaattcaaaagtttcacttgtactttctgaattgcttcttctttccatgctcaggtgttcttcttgggcattgcccttgtgcttttctccagcggtgtttattttgcggagcaaagcgaaccgaacacaaagtgaagaagccgagggaaaaagggggggggggcaaatttaaataaaaatgtaaatccaaaccacattaatttattaattaaaatttcaaattcccatccattttttaaaattatttattattattcaattaaagctgttaattccaattcctaaaaaatttaatttttcgatcacccaaaaaaaataattatttaaatattatttaaaatcacatccccttaaagtttaattttgaattttaaaattactctcccttcagattcacctccattcccgcttcgttttggtacgttttggccacaatgaccaccgtggggtacggtgacctcgtcccgcacggcgtttacggcaaaattgtgggttcatgctgcgcactgatcggcgtgctgactttggcactgccggtgccaatcattgtaaaacgatagttaattaattgattggtgaataatttactaaatgggggggggtcattagtgtttttgaataatccaaaatatatcggcttttttaaaattttgactcattaaaagaatagaaaaaattacgcgactaaacatttctttttctccctttaaaaggtggccaatttcaaacgtttttatcgccaagaaatcattctggccaaaatgtacgagcagaatccaccgccaaaacaggtgagagacattaat

SEQ ID NO: 51528 - DNA, 459 bp, Heterodera glycines
  Genomic contig location: Contig_ID=SeqID_20947; Location=1199..1657; Strand=+
  SCN-specific regions: Sequence locations=1-376,398-459
atggctgaagcatcttcaaacggcaccgaaatccacggcacagccataatccgcggcactaccattttcgctgcttatgccatggcatttttggaacttggcacatttattccgacaattccaattgtggcattctgcgcttcaatagtgtacaaaacttccattcttcaccaaaaccttaagggcattctgttggcccaactgtttggcataataatgaatttgtggccacgtgcctttatgttaattgcccaaattttcgtgacgaaaaatatttttttgttgccaccaaattttatctctggcgcttcaactgcggcattgacattcaacaacatggcaggccatgtgctgattgtggagcgaatatgtgcaactgtttatgtgggcacttatgagagctaccgtagttggacatttacggcactttggctgccaattatggtaaaaacttattag

SEQ ID NO: 51529 - DNA, 480 bp, Heterodera glycines
  Genomic contig location: Contig_ID=SeqID_20948; Location=1..480; Strand=+
  SCN-specific regions: Sequence locations=1-144,166-279,301-374,396 -415,437-480
gaatttaagtataaccttagaaaattcaatgccgcggttatcaaatgtacaactcttatcaaagccacgccattattatgggaatccggaaaaatgatatgtctggggacgaaaagtctgatagactgtgaaaatgctattaaaaaatttatagaaataattaagggctcggggtgtccgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggggtaaaagcatgacagcgttaattttctggaccggtaaagtcgtaattacgggaactaaaaacaattctgaaattgatgaaatgtatcattatattcttccctatctgaaaatggctcaaaagaagttagggagacgataaaaatttttatttattgag

SEQ ID NO: 51530 - DNA, 1414 bp, Heterodera glycines
  Genomic contig location: Contig_ID=SeqID_3702; Location=90..1503; Strand=-
  SCN-specific regions: Sequence locations=1-224,246-745,771-785,814 -966,1084-1146,1182-1206,1228-1230,1263-1287,1313-1328,1350-1414
  Gene Ontology: Mol. function=procollagen-proline,2-oxoglutarate-4 -dioxygenase activity; Cellular component=cell; Biological process =embryonic development
atgaattgtggcaaaagagtaaaactgattacagcagtcgagaatatcacagtaactgatcaatgatgccaagagaaaagtgatcagaccgagcatttatctcatttggacacgcaaaaagcaccataatcaaaaagagatatcggaagaatatcaggacaatgctatgcgatcagtcgggcggatactgatcagtcctgggcttctgatcaatccctaccgcttaaaaaatgaaaataattattgcttttacagccctacctaaagttggcaccgcacaaagtcgaaattgttcattatgaaccgctggtggttgtgttccgcaatgtgatcagtgacgaggaaattgcggttgtcaaacaattggccaccccacgggtaagacgggatctgatcagaatcagataacaaacggactgatcagacaatttatcaaatcaattgggacagaaaaaacttaaaagattgaaaaaagaattggagtaacggacagttataaaattaacctaattaattgggccaaaaaaacattgaaaaaatgattagacaacaaacggactgatcaaacaattaaacataggcacataaaataccgatcagccagatcaaccaaataatcagaaaatgtaccattgagataatgccgtcacagcaaatcgacgacaatttaataattaggggagcaattaagcaaaggttccctgaatcgaaatgcaagaactgaatattcaatcaaaatattgtcaaagattcaggaaaatattgaaaaattgggacattttgccaaaaaaaaaatttttttaaataaattttcagctccgtcgcgcgacagtgcaaaattcgcgcaccggcggattggaattcgcttcgtatcgcatcagcaaatcggcatggcttaagggagatgagcatccgataattgagcgcattaatcgacgaattcacgtgagtggcacaaaatgtaataattaataaatgggcaaaaaataattaaaaaataaattaataattaattaatgagtaatcatttgtttgaatgaatttcaatgaaataaaggataattaaagtttaaaaaaataaattttcaatattacaatatataattaataattggacgcgaattaataggcaattagaattagttgtaattaattgaataattaatttaaatgaattttaacatcaaaatttcacgtgaatagggcaaaacgtaattacaataaaatggcaaaaaaaaaaaaaataattgaataattaatttgaatgaatctcaaagaaatcaatggacaatttaaataaatgttttaatctgttcaaaaaagaaaagtaattttttttttaaatattacagtaatacttagttattgaactctaattaatgtgcaattaggtttcattgttcaagccaataaa

SEQ ID NO: 51531 - DNA, 2378 bp, Heterodera glycines
  Genomic contig location: Contig_ID=SeqID_3703; Location=1..2378; Strand=-
  SCN-specific regions: Sequence locations=1-175,207-1364,1386-2378
  Gene Ontology: Mol. function=electron transporter activity; Cellular component=cell; Biological process=embryonic development
atgctactgctttttgcttccgcttcggtgctccgtgtggcggttgcggacgtgttcaccgccatggttgacttggagaatctgttggcctccgagtcggcctcgacttccgacatcatcgagcagtacattgaggcggagcgggcacggcttgtccagctcagcgagtggggggatatatatattttgaaatttttaaaattttacgcaaggattaagcttgggttcaaaccaggacaaaaatttgagtgccaacatttggagacccacaaattctaggggggcaaattaagaaatttctcgggttttttgggtctcgattctcgagacaatttctcaatctaattcccgattctaaattgagaaaatttctcggttttaggtcaattttcggtgtcaattctcgattcacgaaatttctcgggttttttgtaccttggttctcaaggttttttctcggtccaaattgagaatttttctttttggttttcagttttttttagtcaataattctcggtctctgttttaaaatttctctgtcttttggatttttgtttccgctaaagtctaagcctaagcatggccaattgcaggttcgccgagcagtacgccaagtcgttgacggagtcgaggcacaacgccagcgggcaacagcacagtgtgcagctggagcccggcgaagcagatgtatggcaggcatggcattgtgccaaaagtcatttcgatcgtccctaatattggtcttgggattctgaactattggtttctcacggcctattccatttctagatcacacagattttggcacaaattttcgatctttgctctcttctactcgtttcccttttcgatcactgatctcgaccctaaatcaagggactctcgaacgctaaagaatcggcccaggcaaaattcgggtttttcctaaaattcttggccctaaaattgatctggatcactgactttggttgatcaaatttcaggctacaccaagtatattggaaccgctggaccctaattcatcaccaaattttcataatttttttttaattagccaaatcctgatcactctgatcccgatttcccccaccataaacacaggaggactcggtgatgaacccggtgaacgcgtatttgctgatcaagcggctgacgcgcgactggcaacggatcaggcagctgatgaatgccaacccgggcgatcagttcatcaaaaacatcaccggcgtcagagaggcgaacgcggttagagaaatcgaaaaaccgagatttaaaaatttgaaaatcaaatttttttccaggtaaaatacccggatgacgaggacctggacggagcggcacagggactgctccgcttacaggtaaattaatttgttaatttgattgacgcgctaattatctaccaaaacttttttttgccgggacgggtgtcggccgatcatttaaataatagtaacggtgcatcgacatttctgatcagtgctgatcggaggatttaatcagtttttttgtggaccagccgaacacttaaacaaacgggtcggtcggtcgaatttctgatcagttcattgttgatcaaaggcttcaaatcggttgaaaaagcatgtgatcggttttggtacgaccatctgattttagacgatcaaactgatcaacaaatcaacaattaagtggactttccatatactgatcattcatggactgattaactgatcagaaagcctaaaatttccacaggacacctacaagttgaagacgactgacctggccaacggatttgtggatggtgaaagtgtggccaaggagctgaatgccaacgactgtttcgagattggacgagccgcttacaaccaaaaggtaatcagggcccactcagttacgtcctgtccgggtcaagagtctcgaaaacccaccacccaattatctgttttcacgctacaatggatcatatggattatagatttccgtaattgaaatcatccatgttcagtactggttttcgcccctaattacacgcattacggcggattaattgcgcctaattaggactcacccagttaggtcctacccgggtcgagaatctcgaaccccgcgattttccaatgataatctgctatttttcaaggactactactacacgttggagtggatgcaggaggcgctccgccgcgacccgtccgccgcgctcgaggcggacattctcgagttcttggcctacgcgctctaccagcagggcaaccagaagcgggcactgaccatgaccaagtggctggtccggctggcgcccggccatccgcgtgccgccggtgggtgcggcgcggtggtgccaaaattgggacgtcaaaacacaatgccctggcaattagtagggtgggggg

SEQ ID NO: 51532 - DNA, 532 bp, Heterodera glycines
  Genomic contig location: Contig_ID=SeqID_20951; Location=1229..1760; Strand=+
  SCN-specific regions: Sequence locations=1-232,254-532
atggtgcagatcaccttcaaagaggttgaccgactggaccgccgcagggaagagattctgaatacaatagtctcggcagcgaatattcagggatattttggtaacgctgttgttgagcctttgcaatacttccgcgccgcttcactgacaacgatggagtttgtctttatgcccaacgattacatcgtcagaggaccatcgatacgggacaggatggcatcattcctgcgcccgggacaaacgcagtggggagttgaaaatcctcctgattacggcacaaaacgaccgcggtcggagatcatcggcaagctgaaaaaacgtcttgccagcagggtgagctgtggttggggggaataaatcccggcatcgccgcttggcatcgaccacctccggtggggtgtcaaatagcggtgcgagtccatttaaatgtattaaccaaatttatatgtgaacatagtgtttggtcaacttctatctaaatgctcaggagaccgtatggactagacttctcgaagaagtccagaaggcctga

SEQ ID NO: 51533 - DNA, 753 bp, Heterodera glycines
  Genomic contig location: Contig_ID=SeqID_20952; Location=78..830; Strand=-
  SCN-specific regions: Sequence locations=1-518,540-753
atgatagtgcgaagtccgccattaactaggcagagagcacagaatgcgggaatcattcttaaccaggaagggcaggaaatctttagagaaaacagaaacaatgcggaaaatggactgagacaaaatgaggacgggatgtcagagcattcaaatttttcagaaccaatgatgaacactgaacaaatccatgatgcattgttggacgtgggacaaagaaatgttcgtgatggtgaggaggacaaaggaaacgaaaacgaacaagtggacaatgcaaacggatttggaggtttgaatttcgaaaactttgaaaatttggaagagcgaacttttaatgttcacaacagaaatgtgagtctaacagattttgacgctgggcgtatgtttgaaaatgtgagattagaacgtcagcaaaatttactcccaatttcttttcctattgcgtcgaccccagtggaaaacagggtagcaaaccaaatgggtatggatcaagttcgagaaaattttagtgttattgctagattggaaaaggaattagtgataaacggagaaccgcaaattgtaacacgacagcaacgcaatcctacgtctgtagcacaaccacagagagttatccatcaaatgaatctgggacggcagaatgtacagcatcagaattaccaacatgagtatggtatgcgacagcgtgtagcgccagctccgagcgcaccgattcaacaatatgttcagtttgttgaacaaccaaatatgaacacg

SEQ ID NO: 51534 - DNA, 550 bp, Heterodera glycines
  Genomic contig location: Contig_ID=SeqID_20953; Location=360..909; Strand=-
  SCN-specific regions: Sequence locations=1-306,357-550
atggctttcgactgccgcccatatgcccgaaaaaaatcagcggatggtcatcggcaatttggcgaaattttttgtttatccaatagtccatccggcgcagatggaccaccgtgtcgtcgtccaccttcgccacccattcggcaccggcacagtgccgttgttgccaagtcagggcaccgaaccactgcaaaaatgtttataggcttatgtaaatccgacctattaaattgcgccaaagaattgccaaaacaaaggctttttttctccgtttctatcaattgaaagcaattaattgtaattagaaagtataatatattttgaattaattaaaattaatttttgttttttaataaaatcactttgagatgtaaatgcttgtacttatccacaaagccgtgcaaaaacacaatgtcaccatgctttttctgctcctcttctaatttgtgtttcacatctgccgcttctcctcccgatgggtcggcgataaaaaatcgttgtatttcgcccggggcctaattaaatccaaaattatatttatccaatcaataaa

SEQ ID NO: 51535 - DNA, 1572 bp, Heterodera glycines
  Genomic contig location: Contig_ID=SeqID_20955; Location=42..1613; Strand=-
  SCN-specific regions: Sequence locations=1-57,79-233,255-533,569 -601,623-698,723-919,942-951,973-973,1038-1076,1161-1359,1393 -1395,1418-1572
atggttccttggtggagttccaacccgtccacattgaacagttcaatggagagcattgaagctgctgctgctggtgaacaacatcgtcatgttcgaccagtgcacgcaacaccaccaccagccgatgaatttgacggaattgttattgttgggcaaggagtaacagcagatgcaacggcagcaggagactttgtgccatgttcaacctctactttggcacaatcaattgaacgcgtttttggcaatttgcaacaccagcaaatgtatgtatatgagctgctgggatttttttttttatggctcacggataattctacaaaagggaactcgtacgatactataaaaatattttactaaataaagtcgaagcttatgcctaggccaagcctaaagcttaggcataaggcttaggcctagcctaagccattatacgagttgccgtttctacgaattgtcgcgacatcttttttttgagcacagctatgtgaaacatgaaaattcatccaaatcagaattaactgtacccttacggcaataatatttgaatttaaaaatatcatatttaaaagatttccgtgtgtagataaggccatcagattcacaatttatatttatacaattttaatcttaccaatgcaaaatttatttcaatttttattgtttcgttaaatgaacatttattggtcatccttcttccgtttaatattaataataattaatttcacattttaagccatcctgaaagctatgaagaagcgaagcgactgttggtctttgctggactgtttttcctgctaatgtgcgcatttgtactaatcaaattccaggttgaattagggaaatttttaagaagagaaaatcatcaaaaaatggttctgaaaataccgaaatagtggcgaaaaattttaaaaatattttcttctttgaagaaatcattaaaaccagtgctaaggactttttattcactttatgcaattaaaaaatgattaattttttattataagcgataaaaaaaattggttaaaaaattaattaaagtcaatgcgaaggactttcactttaaccaattcaaaacgattaatttaattttttaagcgataaaatttaatttaaaaaatgaattaaattgtattaaattatatacatttttaatttaaaatgcaattaaattttcttttggtggcattcgatgatgtctttcgctggtcaccagcagtttggctggtcggcgtaatcatttgtgctcttctgatgaatatgtctgtgcaaattaggcgatttgtgcaacgcataaaagaaaatcgccttcgggaaagggtgagggaaaattattttaagaaaatcatcgatttttaggggaaaaaaaaatttttaattatttataattaaaaagcgtaattatttattgaatgtgacataccgtatttcctaaaatagtgcctccgggggctctgtttttcaactcccctgaaaagggggattctattttagggggggggggggctctaatttaagggggaaggatgtattttaggaaatacggaattctttctattcaatttaaaaaataaa

SEQ ID NO: 51536 - DNA, 388 bp, Heterodera glycines
  Genomic contig location: Contig_ID=SeqID_20956; Location=301..688; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 51537 - DNA, 1353 bp, Heterodera glycines
  Genomic contig location: Contig_ID=SeqID_20957; Location=671..2023; Strand=-
  SCN-specific regions: Sequence locations=1-127,149-1289,1311-1353
atgaccaagcgtttgttgcctgaccagcaacagcagggcttccatccgcttcactcatcagtgccaatctacgcaaacgccaacctgcgcggagacttcaatatggagaagcttgtcaagctggaaagtgaactcaggaagggcactgaacgacaccaactgcttgtcaaaggcatcctggaaatgatcaagtcgagcagcactcacccgttggacaacgaattggcacacaacgcgctgacattgttgcttcgcctcgtttcattggatgggatggcgcaggagtttctgaatgtaagtctgtctaaatgcattttcattttgaacattcctttttaaggaggatggagtgaaggcactgctggagatgaagcgcaatccaatttcggcacaaatggtgacaaatggcacgacaacgcctccaacactgaacacattggcaacgcttattcttcgccagtgcatcgactcggacgccgcacttcttcagtcagccttcgaacaaatgatcaccgcaacttgcaatggccagccaatttcgatgcaggaaatcacttcgcgcccaatgagaacgaagcgttatcagaaggatgttaaggtttgttaattttcattcaaaatctgtaatgtaattcactcgctttcagagagttgtgcgcatgttggtccctttggcggtgcggtcgccctcactttacatggacgcggcgaagaaatgcttggccatcaaacaaaacgaaattctggtcaaagaacagcggggtgacgtcacaggcaatggaaatgcagcggcggcttcagaccaatttcttaaaacggttattttcattcgtagtgtcaatatgtaaatgtgcgttattcatattttagcttctgagtcaaatcgtgacggagttgacgcaatttgacacatttgcggacgcagacaaaaacactcgtcttatgcagcctccaaacctgctcaaattgattgccgaagtgcttcacagttatccaaagatggctgttccaattttcatcgagcaatccctgggcgaaaaatcggttcttcgctggatcgttgaacgtttccttctgtccgctcccgtcaacgatttgtccgacaccgtctactgggccaaagccgtggtcagcgagctcgtctcaaattcgtcaagtcagcgcatcaccgatcatgtcgtgggcaacatcaaatcacttctcatcgaatgtggcgactttgactgtacggttgtaacttccgatgagagcaacagcggtgcacatgcgaaatttgcggacaaagtgaccattttggcaaagctgacaatgcatttgagggagtgtttgcaggtgcgcgtaattaaatcgtaa

SEQ ID NO: 51538 - DNA, 186 bp, Heterodera glycines
  Genomic contig location: Contig_ID=SeqID_20959; Location=825..1010; Strand=+
  SCN-specific regions: Sequence locations=1-20,43-81,167-186
atggagctgaagatgaaaagtgccggtgccaccaccagcagccccaaaaacagcatctccgtcatcaacaacgacagcggtgccgtcgccgctttcgctgccgcaacgccgccgacaaaaattgtcgctgccgccaaaccgtcaccgccgccaccgtcgcagcagcaacagcagcagtcgatccgc

SEQ ID NO: 51539 - DNA, 889 bp, Heterodera glycines
  Genomic contig location: Contig_ID=SeqID_3705; Location=135..1023; Strand=+
  SCN-specific regions: Sequence locations=1-168,191-384,407-409,431 -450,472-580,604-889
tgctcatgccgccggtggtctatcgttgagcggagcattgaatgagcaacttcctccgccgccaccactgcgacatcgcgcgtctctcaaccagcaacagcaaccaaagcagcgcaaactttcggcggaccaacgccgacattcagcgttggtggacggcactggcactgacaaacagcagaaaaagcagaggcgccaaactcacgggtgccgggatgagcagcagccgttattgatcagcaacgggcccaaaacgggggcaaataagaaacggaagcacgtggtatgtggtcgaaattaattggtattttcgtgccgtttaaagtgtgtctgttaaagaggaattagtcaaatctgaaaacacggcaagataattagcttttgtcactaaccaaaattttaatttggcttttacatttgggaccaaaatgctattttgtcacgaagctgcccctttttgttaaaactgtacgtgaaactgtccctgtttccctttgccaaaacgttttatacattaacaacaatcgcaaatttgttccaggaaaaggcatcgcgcacgggaagcaacgcgtcgacgacaagtggcggtggtggcggaagcggtgccggtctttacaacggtgtacgaaaatcggcagcggctgttagttcggacgaggcggggaattgtgtgtcggaggacgatgacgtcgacagccatgaagatgagaacgaatgtgttgtaaatggcagcgacgacggaggctggatgaataatcacgtcgaagatggtcagcagcagcagcagcaacaacatgaggaagatgacggagaggcgtcgcagagccaaattcaatcgaagggtccgtcgtccgattacctgcccttctcctccgttcttcatcactga

SEQ ID NO: 51540 - DNA, 653 bp, Heterodera glycines
  Genomic contig location: Contig_ID=SeqID_3705; Location=631..1283; Strand=-
  SCN-specific regions: Sequence locations=1-93,122-149,171-201,225 -256,278-546,570-653
tgtattcgcggagatggcaaaaatagctctgacaatgtgcaattttgtgacccaacctacagtaattatggcaaaatgctatttatgtaaaacaaaaatttatataataatttaaatttaagtggagcacaaaagggcacaacaaaggaaaacaaaacaattgaaaatggtgagactcttcgacattggagcgttgatgatgctgtgttttgctgttgtttttcttatagacaggtgctgcacaccgctgaacggtcctgtcagtgatgaagaacggaggagaagggcaggtaatcggacgacggacccttcgattgaatttggctctgcgacgcctctccgtcatcttcctcatgttgttgctgctgctgctgctgaccatcttcgacgtgattattcatccagcctccgtcgtcgctgccatttacaacacattcgttctcatcttcatggctgtcgacgtcatcgtcctccgacacacaattccccgcctcgtccgaactaacagccgctgccgattttcgtacaccgttgtaaagaccggcaccgcttccgccaccaccgccacttgtcgtcgacgcgttgcttcccgtgcgcgatgccttttcctggaacaaatttgcgattgttgttaatgtataaaacgttttggc

SEQ ID NO: 51541 - DNA, 6317 bp, Heterodera glycines
  Genomic contig location: Contig_ID=SeqID_3705; Location=2176..8492; Strand=+
  SCN-specific regions: Sequence locations=1-553,575-627,649-699,721 -1184,1206-1524,1555-1637,1761-2160,2182-2212,2236-2237,2259 -2393,2424-2585,2626-2681,2703-2884,2906-4357,4379-4448,4470 -4561,4601-4625,4692-5086,...
  SCN-specific regions: Sequence locations=...5108-5281,5310-5485,5509 -5668,5690-5880,5904-6109,6134-6317
  Gene Ontology: Mol. function=protein binding; Cellular component =actin filament; Biological process=hearing
ctgctcagaattgaggtgcaggccttaaaaacaatttcatatttggcaatcagcaacccaaccactaaactaaccagttgtaatccgttttcggctgtgcgccagccccaacgtcgccgcctccgtacgcaccataataagcggtcgaatagtcgcccgggtactgtccatattggtggtgttgtccggcggcggccatcgcaccaacgccgcccgacattccgcctgcagacgcaccactcggcggatagttgccactcgcgaatgctgccacctgttgttggacggcctacaaacggagggaaggggggacacaagcgtgagtgtgcatgataagtgggcctgaccagaaataaacaaaaagatggtatggggaatggccaaacgaagttgatcgaaatgggataaggacatcggtatccgagtcaaaaacataacacaaatgactccttttttgtatcttcctaattcgtggtagaacttctcccaacccatcaacaaacaaaaaaaggaaaggaggcggttggacgttcattttacgccttcccttcctccatctctcatctttcttcccaatgtccaaagcttgcctggtggtaggggctatagtcagttgaatagtcagagtgctgtgaaaagagaaaaaatggagcagataaataaacgaatgagcatggaataatgatggcaaatgtaaaaacaaagaacagacaaagaattaagtgactaatttattgtcggaatggattttcaatatgagagaaaacaaaattggatattagtccaaaaagaaaaaaatgaaatatgcgagttatttattgaacaaaaaatatttgacacggcaaacgtaacagacctgcgcgtattgttgcgctgcggatggcatcaccggcccaactgcggcaccgccacgccctccgccaccgccgcccttaccaccgatgctttcgtaagtgacatggggtggaatcttcgctgacagtgacgggaaaagctccacgtaactgaattgaacgaatccaaggtgaaagacatataatataggtaaaaaatgaaatcatataaaagaacgttgaagtcataattttataaaaatcgaaatgtgactcaatttcatcaaatttttaacgaattgacgaaatttttatcaataaactggacgaagacttgcctattcactaaattaattttttgaaaaatctcgtcttgcgaactgtagggtcgacccccactctctttttaacatttaattggtgggcgtaaatgcacatgtctctttaccggtttccgatgcattcccggtctttgctcattgcctggcgcgcatctgccggtgtttggaattcgacaattccgtctccgcttgaacgaccgtccggcattgtgccgacctataaattgaaattaaagcaaaaattcgacattcacacaatcactacctgaatatccacgcaaacgagcggagaaaagaaacgttcaatgtcattggctgtcagacggaaaggaattccgcgcatgtaaagctaaaattaatatttgaaattaaaatatatagacgcagcactagaatgaattaaaaaccggtaaatagttccttttttactttggtcggtccagcgttgggatttgcattgtatccacctccatagccgccgtatccgtcatcgtaaccaccgccacccatggctgcagcagcagcagcagcaccaccgccacgtccagcaccgtaaccgcctcctcccgcaccaccggcgccgccgggctgtcgcggagtgccgtacccgtagttgggatagctcgggtaaggcgagtatcggtgagaggccggaccaccacccccagctgaatggattaatgagatgatgctgtttggtgagttgattcaacacaaacctccataaccgcctcgtcccatcggacgcccgccagcggcacgctgttcataaccagtcctgacaaatagtagaaaatttgtagtttaatggaattgtgttaaaataaatggaaacttgcccatatgcagccggaccatatccataagaggcgtacgggtcgccggtcgcctgggctaacgccttcagcggaacaatgttgttggtggcacgcgctttgaacgcttcaaaggcggcaccgtcgctcttgaacaactccaaatatctgtagaaaaagggaaagcattaattcaaatagcatccttttaaagatgaattcgtataaaattttatttgtggaatttgtaaatttgttgggggttttcagttgtcgtttttttccaccgcccaaccctccgccatttcctcctgtccatcctctctttccatcccgaccctcccgcattccgtttgtccaatgcgtccaccaccaattttgcaccatttgcaaccccccatccattctttgccaccaccaccacctcctattccaacctcctcgtcatgtgcgagtgagtggggtggtcaaccaaagagacacacacactcctccatcaatggacatctcatctcatcaattgggatgggtcgcgtttggggggttcacgtcacatcatcaacaacagagaatgaatggttggcggaattttcgggttaataaatttttatatattttttgaaaattttaaattttgtgaacgatgaaatcaccgacaaacagtcggcaaacaccgtacctgttccccatgtgttggttgttttgttgcaaagcgcgttctgcctcgtcggcagtgctgaatctgacaaacccctcgcccgtaggtcgcccctctagccccggttccttcccgaacaccacctcttccacggtcagccctgacagtacaacaatggtcatttttcattgtcatgggaaggtttaacaattgtattactacaccaaacacattatgaataaatatataaatttaattctcatgtcgagttttttggaaatggtaataaaacgccatacaatttttgttgaatttgtatcgatatttcgaagttttccaagactaacaaaagccatgcgcgttactaccatccattaagtgaaaatcaacactaattaaattaacaagaaatatttaatgcattaaacaactccctcccggccatttgtccaccaaaaccattggcccgcccgcccgttgcgcgtgccattcattcatccacattgataaacggtttgtgaacagacctcggaaaaactgctgcacctggtccttgttacagttgtagggcaagccacgaatgcgcacaaagcctttgctggacagcgttttcttcatctgagttgtaaagtttcaatttttataagcaaatataccaaacttttctgggaattttcaaaatgtaaatccctaaatcccccagttctcaattccaacctgcatgcgtctcattaactggtccatctcaacgtcgcccacttggaaaactgaattgttttttgattattgtttcgtttattcattaagaaccccgaaatgttggcatgttttgagtatggctcaacaaaccttcgatgtaccgactgcccatcgtctgtcggtctttttgttgtgccacagccgtcgattctctgtctccaaactgcacatagcattccccggtcggcttcccgtccacgctgctggtgaaatgcacgtcgtaaaccgtgaattctgaatcaaatgaattacttcctacatctgaagaaaaccacaaagtgacaaacctccaaaaaatttgcgcacgtcattttcgttggccgaatatggcaacccgcggcatcgcaaaaagcaacttgcatcggtctgcggactttgcggctgttgcgtagaaacgggcattggcgcgttgacctgaaaattgtttgcattctcatgataaatttgtaaattctaaaaagtccgaagggaaaacctgtgtttgtttttgaaaagaattattatacaggttcaagaaattttatttgatggggcgatataatttagaaatgccaatttaaacaaaagaaggtcaaggcgtaaaactggcacaattgattgtgaaaaaatcgttaaacgatgatagagttcaacctgtggttgaactggcgtgaaattctgctgctgctcgccagggtccccgctgtcgtcggcaccgataaccacgggctttgcctcgacgacctcaccgccgtcggcagcttcagcgccattggcattgcccccgttcaccgccgaagtggcgccaacagtcgatgacgccaaaaagctaccatcagttccattcatcattgttttgtcttacaataagtcttgttggaataaaacttcaaaatttgagctgaaatagcaaaaaataatgaggaaaattaagcgcgagtctcgacgtctttctgtgataaagtaattctaaaaacacgaaaagaaggaaaagaatcgacagaatgtgagcatggccgaccagcgaaaggaaaaagcgaaagcttgagagaaaagagaacggaggaggcagaggcaaaggcaatgtccaaatttttaatcgattagcgatgtgcagaaatgtgctcgtggcgcttttcttttttgtttgatggcactgtctaactctttaaagtttttctctgattctcattaaaattaaacaaaatgaaagaaatttgctttaagaagggaatcgttgtaaaaaaaatatattagagtaaattttgttttttcacaaaaataaatttttaaaaatataatttttctgtgttttgcacgctaataacaaacccatagggctgttgaataataggggtcaatggcaacttgacaaaaggcaactcgtattttacaaagtagagtaaaagcttaagcctaggcccaagcaagcctaagcggcctagcttaaagcttaggcctaagcctaggcctaacctaagcaatttgcctttgttcaacattgtacgagttgtcatgacacagaataataacaaattaatttgatcacttctgacaatgagaaaggctatgaaattacgtcgcattcaaagtctctttttttgttgccctttctttcattttcggcttttcccttcccaaatttgcgcttccttttctttttaatctcttcctttccccggaagtctgtgaaacaaaaaagttcatcatcaccaccaccataactcgcgtcattttcttttttgttttatgcatggcgcgggacgcagtcgcagcacaaagcgcggcagatcgaatcgattgtgcggatgagtgaatgaattgaatggatgaatgaaagctgccaccagcagagaatccctcttccaattccatcctttcttttctgccactgtcaaataaattttcttaattttttttattaccctttgccatttcatccattttttttttttgccttttgtatcataatctctgctgattcttctcattgtctgaagaacaattcgttttttcaaccatcacccaaatttggcattttgatccaaaaaaatatatctaataattgctttgcatacaattttatgaggatatacctaataggagaaaaaggggatatcgatgatttgatgaatttgtcgaggaggcaaggtcggatttgtgttggcctttccggaacgcctatttgcttagcttatccccattagctcgattgttggaacagttgtaacatacaatatttttggcaacataaaatgccaaaaccaaatgatgaatcgtttgatttgcatttgtgccaaaatttactccatttcaaataatttctgcaaagcgagtgatcagtgtgatcaaagcgagaacacagaaatggtaaataaatggatacaatgaggaaaagagcagcgagaaaagtcagagacgggcagacaaagtcacgtcgggaatgggtgggcagagattgtcgagaatgacttgggccgtcgagatcaatcggagcagagaaacagcaaaggaatccgatcaaaaagcgttgtctaaacacatccatcactaatcactcaccggggcttttcgaccggagaacggcggcgggggacgacgaggcaaactgcggccggacggacggtgttgagccaacaaaacctcgctcccgcccccgtacgccatcagcagcaattaaaaagccttccttccatcgccgcgaggtttgtccgtcccatggggacaaatgaatgaatgaataaatgtgcgacgaccgcggcggggggcgggggaattcaatcgccacacatattctatggactccgccaaatcgcttgctgcgagcagcgagactcccgtcgcgcccgcttcatcccccacccctcatttgatccccccctttcatcccaattaatcccgccgattttttgctcccccccttttttttttg

SEQ ID NO: 51542 - DNA, 900 bp, Heterodera glycines
  Genomic contig location: Contig_ID=SeqID_3705; Location=5513..6412; Strand=-
  SCN-specific regions: Sequence locations=1-900
  Gene Ontology: Mol. function=heterogeneous nuclear ribonucleoprotein; Cellular component=nucleus; Biological process=RNA processing
atgatgaatggaactgatggtagctttttggcgtcatcgactgttggcgccacttcggcggtgaacgggggcaatgccaatggcgctgaagctgccgacggcggtgaggtcgtcgaggcaaagcccgtggttatcggtgccgacgacagcggggaccctggcgagcagcagcagaatttcacgccagttcaaccacaggttgaactctatcatcgtttaacgattttttcacaatcaattgtgccagttttacgccttgaccttcttttgtttaaattggcatttctaaattatatcgccccatcaaataaaatttcttgaacctgtataataattcttttcaaaaacaaacacaggttttcccttcggactttttagaatttacaaatttatcatgagaatgcaaacaattttcaggtcaacgcgccaatgcccgtttctacgcaacagccgcaaagtccgcagaccgatgcaagttgctttttgcgatgccgcgggttgccatattcggccaacgaaaatgacgtgcgcaaattttttggaggtttgtcactttgtggttttcttcagatgtaggaagtaattcatttgattcagaattcacggtttacgacgtgcatttcaccagcagcgtggacgggaagccgaccggggaatgctatgtgcagtttggagacagagaatcgacggctgtggcacaacaaaaagaccgacagacgatgggcagtcggtacatcgaaggtttgttgagccatactcaaaacatgccaacatttcggggttcttaatgaataaacgaaacaataatcaaaaaacaattcagttttccaagtgggcgacgttgagatggaccagttaatgagacgcatgcaggttggaattgagaactgggggatttag

SEQ ID NO: 51543 - DNA, 1106 bp, Heterodera glycines
  Genomic contig location: Contig_ID=SeqID_20965; Location=104..1209; Strand=+
  SCN-specific regions: Sequence locations=1-326,348-383,405-444,466 -592,614-1106
atgataattctcttgggatccatcgtttgtctcgttccgttcaatctgtctcttctcatttgtcagaattgtctattgatcactctcataattctcgtgaacgccgggctcaccatccttatgctgttcgccaatccttttaccgaggccgaggccgtagggatggaaatgcgctggagactcgccgccgtcattgagcctttaaaccttggaaccccaccgatcggagccgaatttgccaattcttttttatttgtctttcacatctcttttgacgagggaccgtcttttcataaagggtcggggtgtgatatcatttggacttcattaattatttaatttattatgtttgttttggcgttccgtttattcaaattgaccttaaataatttgttttggttttaattagttcttatgattgtgaagtaaaaagttaattgtgtgattgatttattttcttctgtgcctaattctcgccggttttcaagtttgtttgaaattgtgtttgttttggttatttcgttgtctttaatttcgttttgcataaagcataattttattgttttcgatttattttgagacagggcaagtacctttgactgatcaacaaatttaaattgttcgaattgcttcctttgccttcgcttgccaatttggaaaataaagtagaagccaaattggccaatttgttttaactaaatttcccgtactcaaatgatccgattcatattcccaaatgtccaaacttgacaaattgctcaattatctttttttaattgcgataaatttcgaagatttttaatagaataataaaaaatcgaaaagggttgaaaaagcgatgattataatgatgaaaaaaacagttaatcgataaaactgacaatttttagcattcacattatctttgtcgattataaaatgaatagaataatagaaaaagcttaattaaaataccaagtttgaattaagaaatcctatataaaagaaaaaacaatgtattattaatgtttctcgtttttctcgtatctcgtgcctcgtattttattttcccttttgcaatatccctggtgtgtggataagtagtttagtttagaaaaaatcgtcaa

SEQ ID NO: 51544 - DNA, 919 bp, Heterodera glycines
  Genomic contig location: Contig_ID=SeqID_20966; Location=155..1073; Strand=+
  SCN-specific regions: Sequence locations=1-130,152-365,422-430,455 -459,483-692,715-796,820-919
atgaagaggtacaaaagtgatagaagaggtgtaacagtgattagaagaggtacaaatttgatgaagaggtacaaatgtgatttaaagaggtacaacagtgataaaagaagtacaaaagtgattagaagaggtaaaaaagtgattagaagaggtacaatggtgattagaagaggtacaaaagtgattagaagaggtacacatttgatgaagaggtacaaatgtgatttaaagaggtacaaaagtgatttaaagaggtacaaaagtgataaaagaggtacaaaagtgattagaagaggtacaccagtgattagaagaggtacaactatgattagaagaggtacaacagtgattagaagaggtacaacataaattcaaattaaaaattgtatgaattataaatttattaaatttaaaaataaatcctccatttattaattgaaaataacgttgaaaattaacccaaaaaatacaaagaaaaataatgtacaccgcccggcttcgaacttcgccccccccccaaaaaatgatgcctcagaatccccaatcacacagggattctgaggtcttgacgatgtcaaaagtaaaatctgatcacgtattcgtgatcagcgtcccaaataacccctaaagacatgtttttggaagatttttggtgaaaaatttttttcacttaaaaaccatatgctcccccctttggtcccgaatcccaaaatcacttttatttttgtatctttttttaaaaatgtgatagaaatgccaaataaaatttatataatagagcaaaaaattgcggattttttcagtatttaaaatttcaaaaacacctttacagaaccgagttctgaatttttttctgaaaaatcgaaaatttccagaatttctggaataactttttttgtttttgtgatataaatttcaa

SEQ ID NO: 51545 - DNA, 2353 bp, Heterodera glycines
  misc_feature (1665)..(1665): n is a, c, g, or t
  Genomic contig location: Contig_ID=SeqID_20967; Location=1085..3437; Strand=-
  SCN-specific regions: Sequence locations=1-4,25-1125,1154-1322,1348 -1480,1502-1508,1540-1640,1664-1844,1866-2038,2060-2353
  Gene Ontology: Mol. function=cAMP-dependent protein kinase, intrinsic catalyst activity; Cellular component=cytoplasm; Biological process =mesoderm formation
atgccaacaacaacaacaacaacaccatcagaaatagcaccgaattgtggtgacgaagtgcggccaaatgaggacggcggttggggcggcacatcgccgtcttcacaatgcgaaactcttgctgcagcgtcggatttgtctccgtcagaccatcagaaaaacaacgcaccgtcggagcagcaaccgaacataaagccaccgccgctgcatttcggcggtttgcccgtccttccgtgcggttcagaaacaaaatttggcggccttaccgccggcacacccgtgcgacgacatgcccccgcacaggcagaagcggagtttcagcacaacgcgacggaaaaactgctttcggagaatgctatggcgagtggttaccgtgacggaaaaacaccgcccctctcagctgaaattgatcaatcggtgggagagcaacagcccctgctaaaagccacgagggttgatcaacagcagcagagaaagtcctcgtcactgcctcccaacggcggcaccgtttgggcggccccttcggcaaatgctattccacaacactcgtctttctcaaccaatgccgaccatgacgacggtccattgttccggcccgaacttcgtcacgcctattcttggccacctctgaagggcactgtcattttggcaattgagcgcaagagctttgtgcagaaagtatgcgacctgttcaagcaggcgacagccgtcgcattgcccggaggcgcacgcgagttcaatctccgtgccgaattgttttggctgaagtcggccattaggcactccgtgtgtcgccttttgaattggcaggtgaggtgacgcacaaagagcacggcatgcctttctcggagaaatgccattccaaacttcatttattcgtgacaattctcccttactttttatccttctcattaatttccgtgcggatattttcttccaaataacaaaaagacagccaaaaataggaacacattaagtaacaaatgtttgtgttgttggtcacatagtgaaaaaaaggggggagattatttttgtttgttttttatttttgctcacataatttaaaaagggattcattcgcaatgctatttttggactaacggacggtatgtccgctctatccgtctcccctcctctcctctctccttcccctttactttcccaaggtctaagattcaatttccttaaaaaggctcggccagacaaatggtgaaaattttgtatgcacttgttacatggacggatttagaattagaattagcgtaaaaaaggatattgtggtttaggtgcataaaagggcataaaatagaaaaggaagaaacagaaagagagagagagagagagagacggggattactgtagcaattggatttaaatgagaaaaggcaacaattcgaagtgcagcagagacagttagacggcacagcatactgtagcaaaaggacagacagcgcaaaatttgttaaataattttaagcaaaatgactttttggtttttgttctaacattgtgcattttaaaaataaatgtttcattagaatacctcatgtttggacgacttcgaccgcataaaaacgctcgggacgggctcatttggccgagtgatgctggtcaagcacaaacaatccggcatttactttgccatgaaaattttggacaaacaanaagtggtcaaactgaagcaggtcggtttattatgaccagcaaatgaccgattgtttcgtttcaattgcctttaggtcgaacacacactgaacgaaaagcggattttgcaggccatcgactttcccttcctcgtcaatatgcaatattcctttaaagtgtgtctttttcggtgtttttcgttttaaatttaattttaatttcaaatttctatttctccccttctctttaggacaacagcaatttgtacatggttttggagttcatcagcggtggcgaaatgttctcccatttgcgacgcattggtcgtttctctgagccacactcgcgcttttatgcggcacaaattgtgctggcgtttgagtatttgcactcattggacctcatctaccgggacttgaagccggagaatttgctgatcgatagcaacggatatttgaaggcatgcaaaagcccgaggggggaagatggagtttggcactctttttgcaagaatgccatgccattaaaattggactctcaatttgcatatgacattccgaaattggcatcactttttccgcagattaccgacttcggattcgcaaaacgggtcaaaggtcggacatggacactttgcggtacgccagaatatttggcgcccgaaatcattcttagcaaggcgtgttttttggatgagcaaatttactga

SEQ ID NO: 51546 - DNA, 296 bp, Heterodera glycines
  Genomic contig location: Contig_ID=SeqID_20968; Location=296..591; Strand=-
  SCN-specific regions: Sequence locations=1-9,31-114,144-258,283-296
atgtatgttaaaagtatcatgtaaactgcacaagtaccggtttcctatataaatgcttttttgagagttgagtcagaagtccgccgacggttcattaatgggatttttagcgatttgggaaaatttattttcaaaaagaaacccaaaattcacaaaccatcaaacacactgcccggatcatgttcatctccaacaagcatgggaaaaagacgtcgatacttcataaattcaacggccgaatgtgaccaattgcgcctaaacaattcaattttattaaaaaatgggaaaccaataaa

SEQ ID NO: 51547 - DNA, 1313 bp, Heterodera glycines
  Genomic contig location: Contig_ID=SeqID_20972; Location=726..2038; Strand=+
  SCN-specific regions: Sequence locations=1-216,239-737,759-939,969 -1313
atgaacagccaattgctcttggccatccgacggattggcactgtcaccaggaggaaattcgaggaaaatgtcgtcatcgaacgtgacgaagctaaggatggacaccgttacgggcactgtttgttgctccaatttacaattttatgccgcaagagacgaaaagggacgaaaaacggtggagaaagtgaaaacattgtggtcgattatggaaaatagaaaatatgatgatttaaaagcaactcaaatttagttgcttttatatgatagtaaagactcgtaatccgccgaatgactttgttcggcaacggattttgtgggattgcaaagcttatcctccgtttcacctaaaatttgcatttctttgctgttaaaccatcgctttttcattcgaattagaattggtgtccaacgtctgtttacgcattttgaactattcgtacacccaactattaaagcggcgactgatcagtgcaattccgatgccaagctgaaaaggcggaagagaagaaaatcgaacattttgagtcaaaaatcggcagagattaagctgaaaaaaacaatgattaaccattgtgatgtttttccctcttagtataaaaatgctttttccgctgccatttttcattcacgttgcagttttgttttttttttggattcagtgtcggcacatttcaagacccttccattgtttcatttatatgtgcttaaattcgacttttgtttttaaattagtcaaaaaacctttcaattttttgtttcagaaaagcttttgctaaccctgctttttacacctctgaattccaaaaaaaaaaaaaaagtttttcattatgcatttttgcttctgtacatatttcgttttcttaaattgtttcaactgctttccctttcccgttttctctctcgcaataatctctttaacgaattgcccttttcttattgtatttttttgtaatatttaataaatttttgactttcttcagcaagcactctgtcggttttacgaattgttttttgatttttttcttttctaagtttttttattttaggccagtttgccatgccgttggttgtgtttggtggcactcaaaaatgggttgctggtagcgcagggacgtcttcatttttggaaaacggtggataatttttaaagcacattaaaattttgcaaaataacggcatttttttctaaaaatggcatttttatcagaaaaccatgacagaaataccttgaattaaaagtcgaaaaattgacctgaaagttcattaaataactgaaaataacaatgtgttactcaaagaatccaaattgtcga

SEQ ID NO: 51548 - DNA, 67 bp, Heterodera glycines
  Genomic contig location: Contig_ID=SeqID_20973; Location=770..836; Strand=+
  SCN-specific regions: Sequence locations=1-67
tgatggtgagcgtgcttctgcacttcttgctcagtcacttctttggcgacgaatgataatttcttag

SEQ ID NO: 51549 - DNA, 2060 bp, Heterodera glycines
  Genomic contig location: Contig_ID=SeqID_3706; Location=950..3009; Strand=+
  SCN-specific regions: Sequence locations=1-184,220-382,406-1055,1077 -1082,1104-1105,1127-1133,1156-1239,1261-1462,1484-1562,1605 -1657,1691-1780,1802-2060
atgcctgaggaagggtacgagaaagctgagaatcagagcaaaatcgcagtgaggtattttgaatggttggcgcaacgcaaaggggtgaaagttcgacatgcctgcaacggcggggaggttgaatttggcgggctgaaggtggactgtgtgattggggcagagaaaaaaataattgagtttcaggtaaaagaaaaaatattttctttttaaacaatacttaaggggtgtgcatttcacgggtgtccgagatgttttttaccttggacgatagcgccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgatgtcagagcggaattgaagaagaataaggagatgaaaaagttctttgaaagtgtgccggacaagggaccaatcaatccgagggatgcttatgccgggggaagaacgatgccattttgtttgtacgcaaaggctaccgaagaaattgagatatcaatgtttgatatcattagtttgtatccctttgttaattatggtaaaaatctgcttaatttttgttaaagtttcctttcgcttaagacactccataccccgttggagtcccgaaaattgtagtgagcaggaattttaatgtgaattggacagtgcccgacgatattccttatgatggactgctgaaagtgaaggtcgtccccccgaaaaatcttttgtaccccctcctccccgtgcacatcgatgatatgctcctcttccccaattgttgggcttgtgcaaaaagggccaagaatgagtttgtgatgacaaaagatgtaaagaaatgtaaccaccgtccagcgcagagagcatttttgggaacgttcacttcgattgaactacggaaggctttagagctgggatatcgggtcataggcttctatcgggcctatcattttgagcagtttgacagtcaactgttcaaaggatatgtgcggatgtttttgaagataaaggttgaggcgtcggggtggccggcggaggtgaagagtgaggaggaaaagagagcattcatcgcaatgtataaggcaaagtataacatcagtttggattatgataagattggactcaatcccgggttaagaatgattgcgaaattggtgagaaattattttaaaaaatcgaaaaattgtttaatttaagggattaaacagtttatggggcaaattttcgatgcgcaataccctttcaaatacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaaatttagattctctagcttttgctcatcggaaggggcgctgtccgttggtggaggggaaatttttggggtaaaacataatttttgaaaaattttctataaacatttgtttagtgagatgactcgagagtatgctgacagcgaaattttggagtttgtgtccgcgggtccgaagcagtacgccttgaaacttagaagaaagaaggatggtgtgatttggcacaaaaccaaaatcagagggatgacattggatagacgaaacgaatttaaatatgatttgttcaaagagatggtgctggattacaagaaaggggtcaaaaaagtttttcactacccggagaagattgggccgacaaacgacttccgggttctctcaaaagatgtacaaaaagaatatacgccggtgcagaaaaaaggaattattgacgatcactttaatgttttgccctttggatattattaa

SEQ ID NO: 51550 - DNA, 456 bp, Heterodera glycines
  Genomic contig location: Contig_ID=SeqID_3706; Location=5906..6361; Strand=+
  SCN-specific regions: Sequence locations=1-397,419-456
atgaattctgaaaaatcagaaaaagctaattccatattattggaagctgcaaaaaaagagacagaaagagcatggcgggatgtagctgcgctaacggatgaagtaagcgattttgccaaatcttctcgcgaaacacttaatcgtggaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatacaaaacttttgaccaggcaacaaagctcgaggaacaatcgcaaaattcattaacggaagcccgaagattacatttcgagtcccggagggtgcagagccaaatgttaaattatgaaaataggctccaaacaattgtttgggagcatatgggtatataa

SEQ ID NO: 51551 - DNA, 1106 bp, Heterodera glycines
  Genomic contig location: Contig_ID=SeqID_20976; Location=595..1700; Strand=+
  SCN-specific regions: Sequence locations=1-371,413-610,632-759,781 -955,978-1106
  Gene Ontology: Mol. function=protein binding; Biological process =meiosis
atgctcaaaacgggcaccaagaatcgtttcccgccatcaatcattgacgaaatccctggcgttctgtccgaccggcgcacactgttgggcgagttgaattggattttcaccgccatcaccgacgcaattgcgtggtgccgtctgccgcgcagcaccttccaaaagctgttcagacaggtgaaaaggaccaattttttgtcaattttttaatttattcgtctgtccttatccataaaaaacaattttgttataaacttttgtggaacggtcccctaattttgggaggtgcattctgacaaggcacagtttttctacaaggttgactaatttttgaaaaaagccaaaacatttttgagtgcgggatgatcagcaaaaaaaaattttttttttcatttaaataacaatttttaatgctccaatcgtgtcccgacgcggtccagacatttgcggcccgacttttacggccagacattttgcgcttactatgtcaaaaatcgtgctcaaaattaagtttttcaaaccctgaaagcctaaacagcattaaataagtgatagaaagtgattgtgtctgatagtttgatagccaataaatttttttaaaagatcattaattattcaaacaacataattaatgcttctaataaactagaaaactaagatttcttcatttcatgccgtttaggctattatggatggaaaaaattcaatttagaatccgatttttgacatagccgcaaatgtaggggcttcgatgcaataggaaatttaaaaaatgtgaaaatcaacggacttttctaaaaccatttttttaaatgtttcaatattattttggataatttattgagatttaaaaacattcgcgacggaaaagtggccggcttgaagtggaggggtaaagaaaatgaactgcttccgggcaacgttgcttatgacaatcagcagatcatcatcccgcttttgtgcccttccaggacctgttgatcgcctccctgttccgtgcctttttgctgtcggaacgtatcatgcgcgagaacgggtgccatgtggtgtccacgccgcagttgcccagagtgcatgaccatccattgtgggagtactgggacctg

SEQ ID NO: 51552 - DNA, 634 bp, Heterodera glycines
  Genomic contig location: Contig_ID=SeqID_20977; Location=260..893; Strand=+
  SCN-specific regions: Sequence locations=1-29,67-252,301-482,534-634
atgccgagtttgtccatggtttttgtgagttttttttaacatttcaaataaaaaaataaaataaaacttttaaggaaattatcattctggggctgcatttggccatcattttttgtgccattcttggcatttacttggacatgggcattgaggacaatgtgttcatcatcagtagtgccgttttgtgtgttgtgatctgtcagctgaaagcatatttttacaagaaaaagggcgttaaatcatcgtgcgcagtaaaaaaaactaaacaaattaatgtttaattaattatttttaatttaaggacatgctcgtgttgctgttgcatttggtcgtcttttttgtcgcaattcttggcatttatattgacatgcaaactgaggacaatgccatcatcatcggtggtgccgttttgtcgctggtcatctgtcagttgcaaaattattctgccgccaagaaaaaggagaacccgaatgccggaaaagtaaaattatattaaaaaattttaaataaatataatgattttttttattttagatttcgatctttgttcttttcggacgttgatcgatgcgggcattatcattgataaacaaaacatacatttcattataattcaacttgctattattaacaa

SEQ ID NO: 51553 - DNA, 791 bp, Heterodera glycines
  Genomic contig location: Contig_ID=SeqID_20980; Location=1291..2081; Strand=-
  SCN-specific regions: Sequence locations=1-244,267-762,784-791
  Gene Ontology: Cellular component=cytoplasm; Biological process=snRNA- nucleus export
ataaagtgcattagagccgtaaatgcgatggagaggaacaattcattttgacgacccctcctctttagacactttccgttgccgtggacacgtccatttccctttgggagggcgtcgacacgggcgccgccgaactgccgaccgaacaacagaaccacggtagaagaacaggcaaatggaagaagttcaaacgggacagccgtcgacatcagaagcataagcaaagccatccatggaaaaagccctttaaaagggggcagaaaattttcaaaaacgaagccaaagcagtggacgggaaaaacgaacaaacgcagaaacggcagtggaaaatgataccaccggaaaagtttgtgccacgcaaacttatgacgccaaactatgcaaagacaaaacttttggatgtggagattaacgcggatgaaatgagcgaagaacaactcgcaaacgaacttgccgaagcacttggagagaaagtcccggtgagagggggggggggagattcaaaagatttagtaaatacaaaattagtaatattgttttatttaaaaatggagcatatcgccacttttgtaggaattgatgcaaaaagtggtgcattttgctggaaaatcacatgccgtggaactgttcaagcaatgccaagaagttgagcggaacggcggaatgttgacacaaaaccgcttaaggagaagaacgcccgggggcgtgtttatgaaactgttcaacgaaagcaaagaaatcagcgaagagaataaggcacatttaatataattttccattattcaaataaa

SEQ ID NO: 51554 - DNA, 402 bp, Heterodera glycines
  Genomic contig location: Contig_ID=SeqID_20981; Location=1053..1454; Strand=+
  SCN-specific regions: Sequence locations=1-19,200-324
  Gene Ontology: Biological process=N-linked glycosylation
atgcaaaagaaaaggcgaaagaagcagaaaaagaagcatcactcggaaaaggagttggagaaaagagtggcaaatggacaaaaaggagagaacgaaggcagaaaagaagaaaacgaaggcagaaaggaagaaaacgaaggcagaaaagaagaggagtttaaaatggcaaagggaacggaggaggaggaggaggaagagagacgaagtggcacttactcatcctcgggggaggaggtgtatctgaacgaacgggaggaggaggaactgctgatggtcatggagcaggggctggacagaaggctgggcaaagagaggggccaagtcggggaggggaaggacaagcagcagcagcagaacggtgacaaggagcacaaggaggaggaggaggaacagaagcagcag

SEQ ID NO: 51555 - DNA, 786 bp, Heterodera glycines
  Genomic contig location: Contig_ID=SeqID_20981; Location=55..840; Strand=+
  SCN-specific regions: Sequence locations=1-8,33-295,318-535,557 -652,674-759,782-786
atgtcaggcgtggccgaggccgaggccgtggcattggaattggctttctgtcgcctgtgcgcggctccggcaacattttcagcgaggacggggaagaacggaaacgcaaaagccgccgtcgctcttcgcgctccgtttcttcggagacggccaaacggtcgcgcaagtcgatgtcagtgttgtcgcgttcgcgctcagcaagtttagaagaggaaaagaacaggcagcagcagaggggaagaaattcggacagttcagagtgagtgtttgtttcggctgaaaagtgccaatccatggcattggcatttccccctcacttttatggccaattctccccccaggcgttcttctcgctccttctcctccgcttcctctcgcttccgccgttcccattcgcgctccgtcgcagcggaaaaaagtcgcaaaggacaaaagagcagaaaagggacggacggcccccaatcgccagatgacagagagtccgttgagctcagaacgtttgccactgatatggaaatgagagaagccatggggaagagagagaacgagcgagaaggggaaaaggcaaacgaagcgaaggagcagcgggaacggcacgaacagacgaaaagctacgggcaccgtcgacgctattcccatcggcacgggtgccgctcgtgctgccaccgacagagtcggaaaagccggtgccatcgtcgccatcggcagaaacgggcaaagcaaagtttgcgagaggaagaagagagtgccagaaagggtgagaaaatgccaaaaaacaaaagatga

SEQ ID NO: 51556 - DNA, 198 bp, Heterodera glycines
  Genomic contig location: Contig_ID=SeqID_20983; Location=51..248; Strand=-
  SCN-specific regions: Sequence locations=1-157,179-198
atgagtgtaaacgtaaaacaaaagaagacggcgccgaaaagagacgtttcgtcgtcgccgagccaatcgtcgacgagcgactcgagcgaagcttccaacgaatcagtggacgaagcgaaggaagaaacgacgccagccaatgacaaagtactgacgaagtattccatggcagctgaaattgtgaataccgtcctcaaa

SEQ ID NO: 51557 - DNA, 1695 bp, Heterodera glycines
  misc_feature (1514)..(1514): n is a, c, g, or t
  Genomic contig location: Contig_ID=SeqID_20983; Location=653..2347; Strand=-
  SCN-specific regions: Sequence locations=1-303,325-589,621-643,665 -809,831-1434,1456-1695
  Gene Ontology: Mol. function=Hsp70/Hsp90 organizing protein activity; Cellular component=cytoplasm; Biological process=protein folding
agacagaggaaaagtgcggaaaggaagaacagcgacaggaagacgaagaagtgccattgcccgagttggacaacagcggagtgcagactgacaaaaccggggatttgcaactttctatgggcgacctgagcaagcaagtggcggaagaggaaattgaacgtgccaacgagagccgagaatcggccatggcagcgttcagcgaaggtggcaatcatttgaggaatttactgggctcaaggagaaaacaatttttaaggcaattaccaatctgcctttgaccttcttaccaaggccattgagctgaatcctggttccgccattttgcacgccaaaagagccaagtttgttaatttaacgaacactgacacaacattgggttcaaaagcaaggatgaacagaggatttcgtccttggatataccaccctcccacctcatcaaccgaactatctttttttggctctgcggcaagcaattttttctagttttcgaaaggaaaaataacaaaaatatttgaaaataagaaaaaaaacactagaaaataatctcgaagtgtcgaggtgagcgaggacgttgaaggtcgatttaacattctcccccaacttttttcccttaaaaattatattaggatgggagtcatcgacgatcctgaattaggattttcaaggcttaattacccattggaagtctttttttgccaacttcggttttttttttgccttaagaaatttacccccttggggtacccgttccacccaagaatctgctaaatttagcactctcctcaaaatgtcaatgatgaaggcagccatccaagactgtgacaaagcaattgctatcaatcctgactccgctcagccttacaaattccgtggacgcgctaatcagtatcggaaaaatattaacgaatttaaggagtgaattaaacaactcaatttttagactgttgggtaattggacggaggcacaccatgattttgctacttcttgcaaatgtattgaataattcacttttttctcagttttgccttttagtggattatgatgacgtggcctatgggtggatgaaagaagttgagccgaatgtaagcagccacttgcgtgacttcacaaatgttctgttgcgtaggccaaaaagctgcaggagtacgaacgcgctaaacaaaggcgtgccgaagagaaagagcagcgcgaacgactcgaacgcgtgcgtcgagcgcaagaggcgaaccgaaaggcgaaggaaagcgccgctgattcgggggaaggcggggctcattttggaatgggacccttcacggaaatgtttaaggcaagtttccatgtcattcattgttcactattgatttaaggagttgtcggatgaccccgaattgttaagtgccatcaaaagcgacccttcgctgattcaggcagtttaattcgatagtaaatttcaagtaatttctattttatttaagaaacttatggagattatgcagaacccagccaatatgatgaagcatatgaacgaccncaatgttcagaaggtccttgagaaactcggctctaaattaggctcagcgtcgccatttgccaacgaaacgggacgcgactcaacaccctttggaacagcgactgagggaacaccgcaacagaagagtactgctgataaaggacccgaggcaccgaagaaagcgccggagccggaacttgac

SEQ ID NO: 51558 - DNA, 441 bp, Heterodera glycines
  Genomic contig location: Contig_ID=SeqID_20984; Location=187..627; Strand=-
  SCN-specific regions: Sequence locations=1-45,81-164,188-189,232-441
atgtatataaaacttctttttgctcaaaaggtaacatttttaccctatttttaaaaataaacttctaatatttatttttacagatagaaatatacctatttatagcagctgcggtggataagaattttctggaagaaccggacgaaaaatttggaccaaccggtaattacaaaagaaaaaataaatacgatttttttaaaataaaaaattgaatttttttttctttattttgtcttttgttatgtattttgtctagagaccggacaagagggtcggtaggtcggtttcggtataaaaaccgaaaaaaaccgaaaaactcaaaaattagtcggtcggtcggttaaaaaaccgaaccgaaaaaaaccgaagaaaaattttcggtataccgtttcggtttcggtttttttgaatttttttatcttttcccaaaaaaataataaa

SEQ ID NO: 51559 - DNA, 436 bp, Heterodera glycines
  Genomic contig location: Contig_ID=SeqID_20984; Location=1412..1847; Strand=+
  SCN-specific regions: Sequence locations=1-2,24-105,127-133,155-436
atgaaaagtctacttttgaaactttttgttggcctctgcttcattgactttacgtcaaatataaagtcaaaatttgaggactttcttgaaaatcaagaagcaatgaagttgatccaaaattaccaagaaaagcgaatcaaaactattaaagaattacatgctgaactaacaaaaaaagggattaaattggcagaacgtagtttgaggctatatctttgtaaaattaagagtgccaattctgatacatcaaaagaaagtccaaacataccagaaataaaatttgaaaagtgtctttcccgtgatctaacatatactatttatttaatcggaaatggaagcaattggcgaaaataccgaataatgaatgaaaacaatgcagatatatatatcgcgtgttcaaaacattccgtaaaagactaacattaatttttataaa

SEQ ID NO: 51560 - DNA, 448 bp, Heterodera glycines
  Genomic contig location: Contig_ID=SeqID_20984; Location=2206..2653; Strand=+
  SCN-specific regions: Sequence locations=1-373,423-448
atgaagtgccacgccttccatgctcattttgacagattttgcgacgaaaaattcacaaaagagtacgtccggtcggattgtaacgattgttttggctctgattgcaacaaggaccaactgaaattgtcaattggtagcaaaggtaaggaaggaaaaagagcaacaatgttaacgctaattatgccaattaaataatttgataattggtaacgaaatgtttgtccccaaacatgaactgctagggcagccttcatcagctgatagagcattggaaagccagagatgccggctcaaagcggggacgggacaaaatctcgccgccgaaattttaaaaaaaatttcaaacagaaatttctcaagaaaaaaaccttagaaaattttttataagaaaatttcagaaagaaaaatattttaaaaatttacagcgatttttttttgaacttttgta

SEQ ID NO: 51561 - DNA, 1237 bp, Heterodera glycines
  Genomic contig location: Contig_ID=SeqID_20985; Location=1..1237; Strand=-
  SCN-specific regions: Sequence locations=1-1237
caattgggtcaattaaattaccaaaaatattttttaacaattatctaatagcattgaattgctttcagatacgaaaagcgcaacggaggaaagagcgccttctcaggtcgaacaattaaatatttaattaaccaattaattagtggccaattgctttttgtttaagagagaagagagcgagagaagcagagcgtcagacggacagcaattcgacttcgattatgctggtgggagattggaaacaagcaataattttaccatgctgatctgtgatcgcattggttttatgttcactgattggtccgctgagtttggacttttcttagtgatttggccatttaaagccattgattaatcacccattcactgattgtgatcatttttgtttgtcctctttgccaggtcatcatcgtgtccatcttcctcatcgtcaatttgcccaccgctctgttcatggccatgctttgcgtctgtctcccccctccccctaaattcccgtgccacccctttaggtgtacaacactttggggctgagtaaccgctttttggaaggtgttttcccggtcaccttcctcctcgtcaacaacatgctcgtcatggtctgtctcttggctttgttcccccccccctcattaattgccaaatttgtctttgccaggccacttatccgatcaatttcggcatttactgcttcatgtccagttcctttcgtgacaccttttggatgttgttctgtcgtcgaaagagttgcaccgaaggcgaccgaattgacagcaaaagaatgccatcgctggggggaggaggcgtctccgagatgaacaacaactccaccgccacgagtgctctctcaacggtcctccgccgttccaccgacccatcggtggacaaacagcacaaaacgccggtggccaatcacttcggccaatccgctcgtcctcaaagcatcggttcggccttttcccttctgtcggagcctttgcttggcccaccgccgcaactgaacgcaattccgccgaccaatggaccggcgaaaatgaggaaaagcggaccaacaaaaaggacggaggagcagcggaacatttgggagggaggggaaaatggaaaagggggaaaaaagtgcaaagcgatctctcccacagagacaatcattggggagacgatatttctgtgatttaagagaagaaaaagtataaatatatatggaaaacgaaacgaaacaataaatatggtaaaaagt

SEQ ID NO: 51562 - DNA, 627 bp, Heterodera glycines
  Genomic contig location: Contig_ID=SeqID_20986; Location=764..1390; Strand=+
  SCN-specific regions: Sequence locations=1-120,142-201,223-426,459-627
atggatttattggtttttattaccaaatttgccacctttttccatttgattgtttctttgcccatttatttgtcggttttggcatttttgttgcgtcaaaggcatcgtccgcagttcacttcctcattttatatgctttttattgcgcttggctttgtggatttaaggtaagaaagctttaaaataatttaaattggaaagaatttttgattttctcacaaaagtgcccataatttaaaatattttccaaaaaaaattcgccgtctttcatttttgttacatttttcattaaaaaatttccaaaaaattgccaaaaaaggacccctgattctcatttttctcatcatattggatattgggactataaattcgattcagaccgtttttgaaggatttggagttttgaagctaacaaataagatgaacatttatttaattaatttatttttgtttttattccattttagcaaatttttgttgtaccttatcaagaaatgcgcttattggggttatgttccggctatattttacccgttgaaccaagcaaacagcgcagcgaatttaatttacttttcgctatgggcattgtgtttaatccaacttcaggcatttttaattttaaaataa

SEQ ID NO: 51563 - DNA, 632 bp, Heterodera glycines
  Genomic contig location: Contig_ID=SeqID_20986; Location=1459..2090; Strand=+
  SCN-specific regions: Sequence locations=1-247,290-632
atgtcattgaaccgtttttgtgccatttgttgttcccaaatgtatcggcgccattggtcacaaataattagcaaatatttattggccattattcttttgttcgctttggcaatttctgcaccaattctttggcattctgtgtgctttcggttgtctgaagtgagaacaccgcttgggcaaggacagcacaaaatggacggccccgtgttcatggaaattccaacacaagtaaaaaatagaggagcacaaaataaagaaaatttattttaaaaattgaataaattattttgaacaaagattttccgatttttttttaccttattggcatattgggtgcttttgccattcttagtagaggtcggcattttcaaactgcaggcctcgtgctcgggcttaaatgttttttgaatggttgcccgacggacatgtgttttttcaaaattctggaaagatgattataaaaaattatataatcttctatttgcttgtggttataatttgaaatgacgtacgattccatatccataaaagctttaatttttagccttaaaatagcttcggagctaaagttgatcagagtgatcagacacaataacataatcagacagtcagaaaataagaaataatgtaca

SEQ ID NO: 51564 - DNA, 271 bp, Heterodera glycines
  Genomic contig location: Contig_ID=SeqID_3707; Location=1694..1964; Strand=-
  SCN-specific regions: Sequence locations=1-271
ttggccaaattgttgcggatgttgtgcaaaatgttgttcaaactgacgctgctgcaacacctgccgtacaacatggacaacaacaacaaccgcaagcagttgttgaacttgctgctgatgaaccaccgccaaatggacgacctgctcatgacgaggagaagacgcccatgacaaccagcacaagcacaacggtgttggtagtgaacaacgacgagaatgatgctgatgcacaggcgggctttttttttgaaaaattcgaattcaatttgag

SEQ ID NO: 51565 - DNA, 1270 bp, Heterodera glycines
  Genomic contig location: Contig_ID=SeqID_3708; Location=95..1364; Strand=-
  SCN-specific regions: Sequence locations=1-149,171-1097,1119-1270
atgggtcaaaagcactcatataatttgaatcgtgccaaagccacccgacaatcgacgcagattatccaggacgaggtgggttcgaccaaatttgacaggtggaaaatccttcgaaatttaatggaaattagtgccttattttatcaaggaatccttgaaaaacaaaaatttcctcattttgggtcattctcaaggacgtacttgagaaaatagtcattcattctataaggattttgaaaccggcacatccccccataatgtcttatcttcgtatttggctcagaaaaaggcttatttatcaagggtgtccctgaaaacaaactttcctcgttctaaaataaaccttccttatttcatggtactccttctcaaggacgtccttgaaaagtcggtcattttctttaagaattttaaaattggcacatctctataatctcttctctcctaattatttggctttacatatatgttttttttgtgccagattgcttccactgctgagccaacacatccgtctgagcctgtgccactcggtgtgcgcaccagtttggatggaagtgactatgtgcgacgggaagtagaacgacaggaacaacaagaaaaattggcaaaatgccaagaaaatgggacgagtggccaaggaaagggggaggaagtgccgctggaaagcaaagcaaatgccgtagaaggaagtcaaactgtagctgaaccagttgaagaagatgtgccaaaatgcaatgtcgttgtgctaaaatgcgaagaaaatgccatggaaagccaaaccggtgaagacgaagtgccaaaatgccaaaaaaatgccctggaaaatcgaagcgaatcagtaactgaaccatttgctgataccattccgagccctcaagcaaatgtacacgaagttgaagctgtacctgaatttgctaatgatgcattgaaaagcgaagaaagtgccatcgatgttcaagaaacggggaaagcggaagttgaagctgtacaagaagttccaacaattaatcagctggtggaagaatgtgttgctggcacaaaggatgtactgcttgaagttcaagccgttggtttgctgatccatgagaatgaggaacattcggcacaaagccaaactgatggcggagaagtgccaaaaagtggtggggaagaaaatggcaaaacggagcaaacgggaaaagctgccagagaggagagatgggaaagcattgatcaagttttggaagacaaaacgggtgcttcagcagatgttccggaagaggagatg

SEQ ID NO: 51566 - DNA, 193 bp, Heterodera glycines
  Genomic contig location: Contig_ID=SeqID_3709; Location=836..1028; Strand=-
  SCN-specific regions: Sequence locations=1-66,88-193
atggcatttgcttatacgtataaaatatggcacattaggcggtcatactcagtgccaatctatgcacttccttctggcaaacaaaggcagcagcaacaggcgcaggacgacgacgacaatgacaatgagcagcagcgtggtcgaccaccgcttccgccatgtccccttccgggtttctgtcgcgacgggcatg

SEQ ID NO: 51567 - DNA, 95 bp, Heterodera glycines
  Genomic contig location: Contig_ID=SeqID_20987; Location=21..115; Strand=-
  SCN-specific regions: Sequence locations=1-20,50-95
atggcacagtaagccaaaagaaaaataataattatttttaatttattttcagttttatttggcatacaaaaatgccaaagcaagttgggcactga

SEQ ID NO: 51568 - DNA, 172 bp, Heterodera glycines
  Genomic contig location: Contig_ID=SeqID_20989; Location=77..248; Strand=-
  SCN-specific regions: Sequence locations=1-49,109-139,168-172
atggccactttcggtatggcgcttctcaccattttaattggaattggggtattaaaaataattaaattaaaattaattattaactttttaaatatttttttaattttagttgagtgcatcatcagttcgtgctgatgacaacaaaacaaaactgaaaatggaggagacataa

SEQ ID NO: 51569 - DNA, 741 bp, Heterodera glycines
  Genomic contig location: Contig_ID=SeqID_20990; Location=61..801; Strand=-
  SCN-specific regions: Sequence locations=1-72,152-402,424-627,670-741
atgacaaagtggtgcaaagtgagactggcccattgaatatttcctgtcacgtgagttgtaatataaaaaaaattttattttcctattttttcatttatttttggatttttattttctatttttgtaacttttttttgttcatttattctcaacagaaacgggaaggcagcgcggaaagcttctggtattactggaagcaaaaagacgctgagccgatgcgcattgaagaaatgcattgtgtgaaatgtgatccagaaaaggacaaacgctgtaaatatataccccaatgacaagatttaattggttcgcgcaattcgctgaaatgaatgtgttctttataataagccatcccgaaaattcccggctgaaaattttttcttttaatttttcgggtgtttgtaaatttgtgtacatatacatatagcaaaagggcgtagttctaacaacaagttttaaaaacgaattttcaagtttcctgacggtgcctatttcgcgtattccgcaaatttatgttgctacgtcattcttggcacaccccaattccttgggataatcaaaaatgggaaaactttatatcataagttcgttccttaatctattttaataatttgttgtattccgtacatctttttcataaatttgttttttatttataaatgctatttatttccctttgcgatatcacaattttctatttaataaggctgcgattattaagaaagaaaacccttaaataataaa

SEQ ID NO: 51570 - DNA, 304 bp, Heterodera glycines
  Genomic contig location: Contig_ID=SeqID_20991; Location=264..567; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 51571 - DNA, 304 bp, Heterodera glycines; identical to SEQ ID NO: 51570
  Genomic contig location: Contig_ID=SeqID_20991; Location=644..947; Strand=+
  SCN-specific regions: Sequence locations=1-304

SEQ ID NO: 51572 - DNA, 1458 bp, Heterodera glycines
  Genomic contig location: Contig_ID=SeqID_20996; Location=92..1549; Strand=+
  SCN-specific regions: Sequence locations=1-78,109-223,261-339,362 -452,500-671,707-900,922-1231,1253-1458
atgaagtggggctgttcaaccattgccggcaattgtgattttgttaatgccaagaatgatgaaatggtatgtgagagctttataaaattttaaaaaatttctaattttgcgtgaatattttcaaaaattaatgaattttggtgtttggtgttgctaaaagacgcgcagtcggggatttttttttttggcatttttgtcattcgtagagaattttgataaacacaaatttattttaatttttccttttattttttaaatttgactcgggctttttccttaaaaaatcatattttacttgcaattaggggattatgattaccatgatcaattttaaggacaaatgcctgtgtccttttggtgagaaggacgttgacttctccaacgaaaatctcacaattgaaatcccggctgtaatgaccactccgaccctgacaactctgaccacgaaggaaacgacgacaaccactaccactaccaccacaaccacgacagttaccacggaggagccaacgaagcctaagacaactgcaacattggtggaattggctcaatcaaccattaatgagggtgcaattagattacctaattatttgtttaaaagaatatgtaaattacaggaaatggtgttcgcgtcagcaatggtgtgcattgctatttgaaaatcattggtgaattaatattttttattgattaatattttatttttgctaattaggcattctttgtgccgtccaagcgctaattgttgctgctaaacaattcagtgctttgtgaaatatgatgatgaatgatgaaaaggagattaaaataatatgatttcacaaatatttatttttcataatattattgggactatgttaactaaaaattatattcacctattaatcaatcaatctagataaaaacattttcctctttaaacaaacgatcactttaaagaactccaattatttacataaaaaatggggacccaacacttcgagatgctgttatgactagagaccgactaaaaaggcaccaaaaatcgcgaaaaaggcactttaataggcacaaaaaaatcgaaaaaaggcatcaaaaggtacgaaaatcccgaaaaaggcatgaaaaaaggcatttaaaatttttttaaaaggatttttagggagcaaaacacgtaaaacctaatcaaaaaaaattcatttttggtcatttaaatgattattaaaatattttagagctttttcggataaggaaaattttaaaccatgaatttttatcaaaaaaagaaatcttattttggagatgaatttttgagaaatttttcatttcgtaagggtgtatttttgaaaaaaaaaaatcaattcttaggggtgtatttttctgaatttttttcaggtcttcttttttaggggtgtattttaccgattttattgcatttttaatggattttttcggaaaaaacgccaaaaaaggcaccta

SEQ ID NO: 51573 - DNA, 725 bp, Heterodera glycines
  Genomic contig location: Contig_ID=SeqID_20997; Location=93..817; Strand=+
  SCN-specific regions: Sequence locations=1-51,216-725
ttatgcggacaaaaacaggttgccagactataccgacccccaaactataacgaccagactataacggccagactacaccggccagactacaccggccagactataacggccagactataacggccagactacaccggccagactacaccggccagactacaccggccagactacaccggccagactacaccggcgagactacaccggccagactacaacggccagactacaccggccagactacaccggccagactacaccggccagactacaccggccagactataacggccagactacaccggccagactataacggccagactacaccggccagactataacggccagactacaccggccagactacaccggccagaatataacggccagactacaccggccagactataacggccagactacaccggccagactacaccggccagactacaccggccagactacaccggccagactacaccggccagactacaccggccagactataacggccagactacaccggccagactataacggccagactacaccggccagactacaccggccagactacaccggccagactacaccggccagaatataacggccagactacaccggccagactataacggccagactacaccggccagactataacggccagactacaccggccagactacaccggccagactataacggccagactacaccgg

SEQ ID NO: 51574 - DNA, 1847 bp, Heterodera glycines
  Genomic contig location: Contig_ID=SeqID_20999; Location=101..1947; Strand=-
  SCN-specific regions: Sequence locations=1-226,248-1155,1177 -1393,1415-1473,1504-1847
ggcattcccatccgtccgcacttttccatctctctgcaaaatgccaaagaatcgttggagatcagctgtttgccgggcacaagccaaattcgactgcgtgcaactgcggcgacatgcggcggttgcggcaccgtcggaagttccagcgacgacggcggaacgacggcatttgcaagcggcggaccgaccggtgccggggaagtggttctgctggacataaaaaatgagattgaggagttcaagaaggacctgaaattcctgcagttcatccaatccgacgacatttacaacatcgaacagttcatctccactttgaaagtgtaccatcccgtctccgagacaacgtttcgggaggaagtggcggcggtggtcgatgtgagttaattatgagttaataaattgatcaaatcattccaaataccgttcttttttatgattcaattaacagcatgttcatgttttacacttcttattattgcatactttaattttgaagatgttcatcgacgcggatcatttcaattactttttcactgatcgggacggcactttgaagtcgtacagctgctcgtacgtggccagcattcagcccgcctattctggcgtcatccaagcccaattcgctcgtcgttgtgctcaaacttgtgccattgtcaccaccgctccgatgatgcgattgggtgggtggcattttcaaatttttttactgttacttcattgctttaaaattcattttttgaaggcattttggacgtgtgcaccatccccgaggggtattattacattggcgcctctgctggccgtgaatggtttgtggacccggccaacaagttcaaggaccagtcaatcccggacccggacctggagaagctgaactacgtgttcgactccatttcggaacttttggagcatccggaattcaaaatttttgcttggattggctccggactgcagaaacactatggccatgtgacattggcacatcaagtacggaccgaacggagaatgaatgtgctacatttgtgtacccaaaatgttttaggatgtgttcggcacagtgccgcgtgaactcagggagcaaattgaccaaagaatccgtgccattgttgaggacattgactccactcatcagttgttggaagtgaaaacgacggagacagacatcaaagtgttcattaaggtggaaaatgccattcgatacattcacaatttagccaaaatcccaatttttagtcatcattgggacacatcttcgacaagggcaacggcattcagttgcttatccaacatttgaagtgcgacctgcgcgagggcaccattttggtgtgcggcgactccgagacggacattccaatgttgcgcacgtgcctggagcacaacccaaaggtgggccaccaaattttgaccaatttgtactattgttttccagaatgtgtacacagtttgggtggcacccgaaagcaaaaaggaactgagagagaaggtgggcaaagggagggggcattattggagacaaatgatttacacatttttgggtacattttttaggtttcccaactctgtaagagtttcggcaatgagcattttctgttcgtttcctcgccagaagtgttgcttggcgcgatggcacaggtcagtcagtcactgtttactgtacttgcaaactaataccgtaaccataaaaaagtcggagtttagacaaatgctaattgtcacttaatgtaccaagaaaaaatgggacagaatttttataatgagttcacattccctcttccctccaggcaactggttcgggagataagcatcgcccgcggagcaatgggctctccacgccgccgaacggagca

SEQ ID NO: 51575 - DNA, 473 bp, Heterodera glycines
  Genomic contig location: Contig_ID=SeqID_21000; Location=551..1023; Strand=+
  SCN-specific regions: Sequence locations=1-4,26-113,136-291,314-473
atgtgtgatctccatttatttattcttgtattcaccgatctgcagagtaagtggcttatgcccttctgcagatatttttattgactgaataaacaaactaaatacatttttcggaattttttagggtttaaaacacatattttgacagtttttagtccatattttggtccatatttggctatttttgagctttttagtccatatttcgggcttttttagttaaattatttaatttacaacaaaatcaacagatccctttttgtatgcaaattcgacaaaaaatgccttagcaaattaatttaatttttaaattcgcgtaattgtttaaaaagtttacaaagtttacttacaagatagatatttagattcatggaaatccaattcaattgcaaaaaaacggacgcttttatttgcttggactgccaaacggcggcacaaaatccaatggacaattaatgcaaaaattccaggca

SEQ ID NO: 51576 - DNA, 623 bp, Heterodera glycines
  Genomic contig location: Contig_ID=SeqID_21001; Location=615..1237; Strand=+
  SCN-specific regions: Sequence locations=1-452,475-564,587-623
gccatatgccccatttttggagacaattcgttgccttggactgatcgcttattatgccaccccaacaattaaagacatttttcggccaagtcgcatttttataaccgtgccattcatcgcttcagcaattgcgtgggccgtttttgtgctcctcaaaacttttgtctgtttacgttcgcttaaatttaaggtgaacaaaaatagcttcgcgatttaaatttttcgaaaatttttgaaaaacgattatttttcaaaaattcagaggcctcgaaaattccgattcgagaaaatttacagaagctatggaacttcgacaatgtagaggccttagaacttctgattttagaaaactttacacagagaccatggattttttgaaactgtagagagagagaagccttgggatttccaattttagaaaattctagagacgacgaatttacaaaaatttcaaagctttggagagaaaatttgcaggcccttggaaccttttaaattagattaatatttcaagcattttcccggacaaatctaaggtcagaagggttcaaaaatggtgctgaaggatgatgaagaatttgctgaaaatccgtcggcattttgaaaaacggcgaaggaggaaa

SEQ ID NO: 51577 - DNA, 249 bp, Heterodera glycines
  Genomic contig location: Contig_ID=SeqID_21001; Location=1409..1657; Strand=+
  SCN-specific regions: Sequence locations=1-102,126-249
tggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgg

SEQ ID NO: 51578 - DNA, 828 bp, Heterodera glycines
  Genomic contig location: Contig_ID=SeqID_21002; Location=387..1214; Strand=-
  SCN-specific regions: Sequence locations=1-735,758-828
atggcacagcatccaattttattatgggccgatgacgtgccttctgaacaaggaaaaatcggtgagtaaatgacactttgataatatcgcaaaatcttctaataaactgttgtgtccccgggtttaaggctttcagccatttcaaattaccgttttaggagagaggaatttattataaggaaaagcattgacaattaattatgaattgaaaaccgggaatatgtttgggtcaacaacaacctcagagcattttgggtgggtcagtgcaattggttatttgggaaaggattgccaaaggcaagaaatggcacagactgacccaccgcagacatctcgcagcccccgagggggaaattgagtggacttatatactggcacaatgggtatggactttggataggatgaggggtatgacggcataaacacaggaataagagagaaagggatggcatatgcaacagaggtgaatgggatagaaacggcacgataaatgagagggacaggattggcttgagattggatgaacagacggacaagtttatgacgggattgggtcgaggaatagggcaatttacattatgcacaaaatatgaaaatttgaatgctgcggatacagcataaatggggcaaaattcgccaatatcatttgttttttcagtttcgattgattagctgtccatttcgattccattcgatgcttttgttcaagaattgacaatttacgaatttttcaattaaatttttaaaattcattactaaattaaagacattttgtgagcctttttttttacattttttcatatatatgtattttgcatatcaaataaa

SEQ ID NO: 51579 - DNA, 138 bp, Heterodera glycines
  Genomic contig location: Contig_ID=SeqID_21002; Location=2756..2893; Strand=-
  SCN-specific regions: Sequence locations=1-138
gtggctgacttcggctgtgacggcttccatttggtgctcgtcgccatgcgcgacattgacagcgacgaggagttgctgtacgactacggggagcggcggccctccgtgctggcggttaacccgtggattttgggctca

SEQ ID NO: 51580 - DNA, 348 bp, Heterodera glycines
  Genomic contig location: Contig_ID=SeqID_21002; Location=1608..1955; Strand=-
  SCN-specific regions: Sequence locations=1-348
atgcagcaaaagctggaaatgcttctgatggatgcggtgaacagagaggagaaagcgatgccacaacgaactgtccaatggaaggccaatggcatcggagttcaagccgaaaatggggacggaaaggtggagaagcttaaaatgttaggtgggccgattaatcggcttaatcgtttcgcaatatagcatctaattaactaatcacttaattagtggcattgaaaaaccaataattgtttagggcaacagccataccgtaccgtcaaagccaatttcacaattgtcttcgtcaattgcttcttcctccgttcttttggcgtcctccaattattcagtccatggcaataa

SEQ ID NO: 51581 - DNA, 316 bp, Heterodera glycines
  Genomic contig location: Contig_ID=SeqID_21006; Location=592..907; Strand=-
  SCN-specific regions: Sequence locations=1-205,228-238,261-291,313-316
atgcctccaaaaaatgcgcctaaaacaagcaaaaaggcggaggagaagaaaaaacagaaagtccttgaagaccgcacatttggcatgaaaaacaaaaaattgagggcacaaatggagaaaaatgtactcaaaaattatgaaaaattaaaaaaaacacgaaaatttctcagattatgggcgcgccctccaagcagttcacgccgaagaagaagcaagaggatgaagacctgaaggacataaacaaaattttcaaaccagttgtgcaagcaacacagcaaaaagtgagcgcaggtacttgagagcacacacaaataaa

SEQ ID NO: 51582 - DNA, 582 bp, Heterodera glycines
  Genomic contig location: Contig_ID=SeqID_21008; Location=126..707; Strand=+
  SCN-specific regions: Sequence locations=1-366,388-582
atggcatgcggccgcttgcaaactcaacaagcactgccctcgagtgatttttgtgagagcatttaataattggtttgaatgcgtatgtgtatgtttcagctctctaccctgcccggtgtggacgaaaatgggcaagcgtaccgagcgagaactaaagttgccgagcgagttttgtttaacaaggaccaattgctggcccaaatggaatatttccttggtgagatcaattttttttaatttaaaggctcaatacccggtgaactggtttttaacagtgtgaaccgaccgggtatcaagtgcgacatggacgccgcatacattgcagcggaggcgatagtaagttaacaaaaaacaaaaaggagataaatattagcttatcttttataaccaaaatccaattacaaaggtttgtttcatcgaagacgccggccaaacctacgtggaattttccttcgaaagacggtgccccgttcaacagagaagtgcgcccgaattcggaaacgaattccgtaaatacggcgctttctgtccccttaattagtgttaggagtgtaggatttttcgaactggaactaattttta

SEQ ID NO: 51583 - DNA, 1048 bp, Heterodera glycines
  Genomic contig location: Contig_ID=SeqID_21010; Location=227..1274; Strand=+
  SCN-specific regions: Sequence locations=1-406,429-968,990-1048
  Gene Ontology: Mol. function=Notch binding; Cellular component =cytoplasm; Biological process=frizzled signaling pathway
gtgactttcaacttggacagtcgacgaccctttgggatgtccattgtgacgaagaacaaccgttccggatttgcagggatttatgtgcatgaagttaaccctggtaagcttagaatttagagattttagtacgatttgttttatcccatttcaggcggtcttgtggcgttggacggtcgaatcagacccggctttatcattctggaagtcaacgacatttctttggatgaccttagctcaaaggaggcgctcaatctgatcatctcttcggttcgaaatgctaccgaaaccagggggtccgttatttgtttgtttgatggttggttcatttttacgggttttgtcgtttaggcaactcaaattggtctgtgctcccagcagtgagtctgttgaactcgcgcgaaacgttttccaccccattttggccgagcccgtacgaccgattgatcccaccgcgtggattcagcacgcaaacgccgccagagggttggaccaccaattgcagcactttccccctcccccgccaaccgctcattcgcaaggtccgtttgtcatttttaaagtgatagcttcgttgctttcttcgtcctcttcagggcaacagccgccgatttgttgtattatgccgccacaatgtcagccgaacgcggcgaaaccgatggccagcaaatcgtcaaccattccaaaaacaaaccctcagcaacagggaaagggtgggtcaaaaataacattcgaattgtctcattttgcacaatgagttagtgtggttttatattgatttattcgctttcaagtccatgaaaaacaacaccaatttgcgggtgctgcaaattgtgccgttgacggagacattcgaatgatccaaaacccatcgactgacattaccacgacagagtcgggcatttcctccgtggaatgctctattggccaattagagccctccacgaaagcgaaaggcgcatcaactggaaacagaaagaggagcaaaacgacggagacgaagaagcgaaggggaagcggaggcatcgggacggcactccgccgattg

SEQ ID NO: 51584 - DNA, 702 bp, Heterodera glycines
  Genomic contig location: Contig_ID=SeqID_3713; Location=173..874; Strand=+
  SCN-specific regions: Sequence locations=1-293,316-513,535-702
atgacggatcgaaggtatccgatcagagacggcgcccaatggacaattatctcgaccgatacaatccaataccgtttctttgaggcactaaggccagttcagaatgaggtgcattgtcacggttgaatgtgggccaaccaaatgccgttaaggttgctcctgtgccaattgtcagttcgctggacatgcactcgactgacccgacttcgtcttccggcgcttacgttgagcttaatgggcacgacttctaccccaatttgcaggcttggctcggctccactcccatgcccacgacatttgtgtttgttttgaacactaagagtcatcactttgttaaattctcggttccctttgctttgcagcaacaaagagatgctccgtttcactctcctccctctcagtcagctgaatttgcaggagggcgtcgattatgtgttgggtgcccgctgctctcttctgtccgtcccctgcccgctcagttcgccctcccattctccgacaacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacagttcaggacgggaattcaaggaacacaaccgaacagctag

SEQ ID NO: 51585 - DNA, 66 bp, Heterodera glycines
  Genomic contig location: Contig_ID=SeqID_3713; Location=1429..1494; Strand=+
  SCN-specific regions: Sequence locations=1-66
gacgataagaaacgaatgggagggagcaaatggaaagaattgcgccacaacggacgacggacacaa

SEQ ID NO: 51586 - DNA, 456 bp, Heterodera glycines
  Genomic contig location: Contig_ID=SeqID_3714; Location=67..522; Strand=+
  SCN-specific regions: Sequence locations=1-67,89-324,435-456
atgccaaaggaggggccgaaaatggcaacagcacggggagcgaagaatttgaagcaattagcctttgaggttgttattgaaaatgagaaatgagggaaggaaggctgttctgttcaggttgaaagatttgttgcggccaatttgactgatgcgaatgagcggcagtcggcggagcagcgaatggttgttgccttaggcgcgaaacccccacgacggaaggcgatcaattaccggacattaaaggaacagagaacggaagcgaagaggaaaacaatggagggggaagacggacaacagccggaaaaggacttgtggaggatggtcaaagaaggaaaagtgcgaaagagagagggcggaaggaagaggaagaacggaagcggagtgctgaagaaatggaagaaagaaaagcaaaaaatgagtggaagaaaaaaggacaaaaaaatgaatgcgtgttaa

SEQ ID NO: 51587 - DNA, 196 bp, Heterodera glycines
  Genomic contig location: Contig_ID=SeqID_3714; Location=935..1130; Strand=-
  SCN-specific regions: Sequence locations=1-196
gacaaattgcaatggtgtggactggcgatccatcgtcggactttgagtgtatgtttttccctttgatcttttgatgggttacactttcttcagttgaccgtcgactattgtcgttatcgtcagcgtcgtccgtccatttcttttccgtcctccgcccttcgctcatccgaccattttcgcttcatttgcaacacca

SEQ ID NO: 51588 - DNA, 478 bp, Heterodera glycines
  misc_feature (53)..(53): n is a, c, g, or t
  Genomic contig location: Contig_ID=SeqID_3714; Location=1286..1763; Strand=-
  SCN-specific regions: Sequence locations=1-454,476-478
aaacgaagacagaagccgggcttagctatgacgacgcattttcacgcatcatntgtaaaggaagcgaggaattcaattctccattcaaaagcgaaataagcagtgtcgaatttctcaaaatgatcactcaatttgccatgcgtaccctaatcaggtgaatttgaatttattggttttaatttaatttccatttttgcaaactggtttatcttttaattttagagaaccattctgcgcattaacttcctctgcacaaaaccggcccttacgacaacgattatttgtcagtggaagaggaattggccaggggagctcactttcggttgccttgtgcaatttgtatttgggttgggtcgagcgacaaatttgccttcattcgccggaaatggggctgacaaattgcgctattaccctgttttgctgtcgttacatggacgattatctaatcatatccaacaaaagggaacgagttgaaaag

SEQ ID NO: 51589 - DNA, 267 bp, Heterodera glycines
  Genomic contig location: Contig_ID=SeqID_3715; Location=1..267; Strand=-
  SCN-specific regions: Sequence locations=1-267
ctgatcttaacaattgttatacctcatttgaacacaaagtgttggacgaaattttgcacaaaatcacaccctctgacaggtaaaaccccaacaattattattttgattcacattccatttaataaatcaatttttctgataaaccgcaattttcagcaagtttgtagttgtcagtgttcaagtgaacagcaaaatatacaaatatcgaaaaacgaagacactatagaggcttagctatgacgacgcattttcacgcatcatttgtaa

SEQ ID NO: 51590 - DNA, 1761 bp, Heterodera glycines
  Genomic contig location: Contig_ID=SeqID_3717; Location=1231..2991; Strand=+
  SCN-specific regions: Sequence locations=1-824,847-848,888-1290,1312 -1339,1361-1761
  Gene Ontology: Mol. function=oxidoreductase activity, acting on the aldehyde or oxo group of donors, NAD or NADP as acceptor; Cellular component=cytosol; Biological process=carnitine metabolism
atggaaattgtgaaagaagaaatattcggggctgtgatgttgattttgccgttcaaaactgaacaagaagcgattgcacgagcaaatgccacacaattcggattggcgtcgggattatgcaccacgtgagaggggtttaataataaatattgatgagattaggtcgtaaacaattaaaggacatcgtttgatttttagctattatgaatagtaagtttatgtagattttgtttggattggagatgcataattatttaaaatgttttcattgtacccttccttaggcacaaattaaaaatcgtcactctgatgtcctaattaccacttattttttaaatattatccgatttattctcttgttggtcaaatcactaaaaaaatctttggtttacttttagtttaattgggccttattgcaaaacgacaaataagcttttgctaacaaaaaataaaagtttctaaaaatatttatttacaagtaatgaaaatttaaattttggttttattgcattttaattccaattttttaaggaatttagcacgagctcatcgcgttgctgctcaattgaaagttggcactgtttttgtcaacacttacaatgatgctgaggtaacaattttgaataattaattgcgaacgattgggtttactgttttgttgtaagatggtcgtttaaggtgcacatcccattcggcggcttcaaaaattctggtcacggacgcgaaaactgtgttgaatgtttacacgaatattcacaagtgaaatcggtgtacgtgaacatcgacgaaggattgcaacacaatttgggatgaaggaagcggagagagaaaaatgcaatagaaagagctcaaatacaaatagaatatttttaaaattttttcacatgccttattttactaactaataaagagattaactaactttctagaaaaaattaattgaaaagcaaaaaaggttgtttacatggctggaggacctcgtaaatttcggtccccaccacttactattttataacctaatcagtgcttggaaatttcgatgctttatgtaaaatgttttaggtattttgtttgagttgcgtcgcagtgtgtgcttgtgatgactgcctttgaggagttgggcgttttgtccgaattggcaacggcactcaatgatttggaatggacgtccgtctctcccttttctttcctacttaattttcatagctttcagcttgcctactgacattcaatccgaagcgatccccgccattctcgggggtggcgacgcttgcatggtccgtccgtccgtttctttctctcttttgttttgattgaatcggtgtatttaaggcggcggagacgggcagtgggaagacgggcgccttttgcattccggtggctccgtccactaattcctttttcgttaattttgcttttcgttgaatcattttcagattttgcaaattgtcttcgagacaatgcttccgtcaaaccccaaacggagtggtgctgtcgaaggtcaatcgacgggcggtgaccatgtcgataatgatgagcaacgtttgctttaagacaacggttggcgcatgaacatctttgaccgtgaccacaatttgggcatcgacgccagcggatttgtttgtgagagtaaccatcccaaattgtggagcggctcgcgttcagtgcgtggagttaagggatcgggtcagtattcttgttcatttatatgagggataggattttaagtcacgaaaaatccaaaaagtcaactaaaaaata

SEQ ID NO: 51591 - DNA, 384 bp, Heterodera glycines
  Genomic contig location: Contig_ID=SeqID_21013; Location=1128..1511; Strand=-
  SCN-specific regions: Sequence locations=1-384
atggcagagcaatttgtacaacccgaaactgcggaggagcaacaagtgaaagctaagaagccacgcgttgatgagcgatttctttggaaaatcacgcggggccaatttgtactagcgattcggctgtgttcaggttaatcaaatttttgacgaccaaattaattgacagctttcataggactggaacaatttatttcacaacaaagacaagacacgtcggctggaagatgggcgagtggcgattggactcgagatgtgtgaagaatgtgccagaatcaattgctgtgtcagtgatatgatttccgatcaaaagaagaagccaaaaaccaccgaataatacaccaaatttttcacattatttgaataattttgactaccaataaa

SEQ ID NO: 51592 - DNA, 783 bp, Heterodera glycines
  misc_feature (19)..(19): n is a, c, g, or t
  misc_feature (760)..(760): n is a, c, g, or t
  Genomic contig location: Contig_ID=SeqID_21014; Location=26..808; Strand=-
  SCN-specific regions: Sequence locations=1-140,179-272,294-302,335 -339,362-386,409-439,471-475,497-557,581-783
atgcatccatccatatttntaagattgttctgcacaatccagaaccctccgagtcgttgttttgttcgacattacccctgaatatgcaaccaattttcgcaaccagcaacaccgacttttcaaaacattgaggtcttaagaaaaataaaaattatttattttattttaatttaatttagacacattgatcagcaagtgaaagggcatcaacgattttatgcacttgtcgcctttcacagaacgtcggtggtgctgagtggactaaattatgctcaagcaaaaaatgttgaaaaggtaaattcatttttaattaaattaattaattattaattttcttgggaaaaaacatattcttttggggtctaaatatgaactaaatttattgtttaaaacaaaatgattttaattggaattattataatagtgacaaagttttcagaaaaaaataattaataatttcatttaaaattgcaccattttttaattttaaaaatttgcagattatcgcccaaatctctgggcttaatcctcgacgacgacttgaaacggcgccttccaaggtaaatttaaaataaaaattgtcaataaagaatacaaattttaattttctcaattttttaggcatttgcaacagcggcagaattgttggaatatcaccaagaatcaaacaccacttcggagacaacaaatattgttctgttaattcatgatggcttcaacacggatatggggaacgaaacatttgaagcgatgtaacggnccaactggaagggaattaataaa

SEQ ID NO: 51593 - DNA, 419 bp, Heterodera glycines
  Genomic contig location: Contig_ID=SeqID_21014; Location=1073..1491; Strand=+
  SCN-specific regions: Sequence locations=1-53,87-191,260-261,298 -321,391-419
atggctataattcagggaacgtgtggaggccggggtaaatttcacgaaatgggaatataaattttttttaatttgttaattaatttctaccgtctgttgtttgcttgacagttatgttgggtgctgattgtgacaaagttgtcagaatgcaaatcagtaaaaataatagaatatgacaggtgatcattgggaataattaaaactaaattgaaaatcaaacattatttttttgttttaattaatttcaattaaatttattcgttttaaatttcaactttcatttaaatgtgcaaaatatgaagaaataaaagtgaaaaaacgaatattattttttgctttaataaattttatttaaatttattcattttaacattcatttaaataattattcagcttatcaaagtcaatgtgacaattaa

SEQ ID NO: 51594 - DNA, 555 bp, Heterodera glycines
  Genomic contig location: Contig_ID=SeqID_21016; Location=147..701; Strand=+
  SCN-specific regions: Sequence locations=1-213,235-555
atgacgaaaggggtcaatgtcgaaaagtgccaaaaattcaaagaaagaaggggtgactcaatgagaagaattgaggaaaatttatgggcaacggtaaagctagtgaaaacggagtatgcttgggcaggtgaaaaatgtgaaacaacagtaaatgattatatagagaaaggtaaaggtggaattttggatttttatttggtcaccacatttggccataaattaaatccttataaaggttgggacgaaatgcccaaaataactttcatttgggaaattccagagcccagcgacctatattgggcaactcacgctccagtaggagaatttttggcagaaattacagacgacgcaattgttgtcgaaagcgaacagagtgtcttttactttgaaaaagagaacactggccgagaagggattattggtgtgccagaggatgcttacaaaatgtccaatgatgttttcattataattcatcaaattgaccatcgttttaaaagggaagccaaaaaaaaatggagcctaacagaaaagaaaggccaactaaacaggaagtga

SEQ ID NO: 51595 - DNA, 579 bp, Heterodera glycines
  Genomic contig location: Contig_ID=SeqID_21016; Location=761..1339; Strand=+
  SCN-specific regions: Sequence locations=1-579
  Gene Ontology: Cellular component=secretory vesicle
atgcaaagtacaaaagcgcctcttttgtccacaactcaaattacacctaaggttagggaggtcattaccactgaagcaccaccaattacaacaacgcaaacagtaaaaattgagctcactacgaagccgcgtaaaattgagccaaaggttaaagtggaaactccaaagtccttctccaaaggcattcaatttaaaagagtaagaaatgaacaacaaatttacaaaattatgggaattaggaaaggcacaatcctgactactacaattccatttataagtacaactcaagcaccaaaaattacaaagccgaccacagtaagttcagtaacggtaccaaccaaatcaagtcaaaatgtaaaaacgactatgaaacaaaaggttgatacaaaattaccgtttataaaaactacggtaaaaccaacggtaacagtcacgacaaaaaagacttctaaaacaatgccagtaactgttaccttggcaccaaaaactgagaaaactgttacgacaccgaagccgatttttacaaaagttatgaccacagtggccacgaccacgacaatttcaccaataaaactgtga

SEQ ID NO: 51596 - DNA, 1122 bp, Heterodera glycines
  Genomic contig location: Contig_ID=SeqID_21017; Location=691..1812; Strand=+
  SCN-specific regions: Sequence locations=1-636,686-1093,1117-1122
atgagtgacagaagttcatcaccaatttgcacaggaaacccaatgattgacgtggctcgactgctgttgatgaacacttcgccagaagtgaggaaagaattggagaaggacggccgcctcctcaagcagtatttggaagtgcatcggacggaaggaggacagaatcaattcgatttggagaaggtggggggggagggggagacgacggacatgacaattggccaccacagcttaccaaagcgtacaaattggcaatggtcggccaaacggtgggctttgtgatggtgttgcccttcttccaaagagtgtgggctgaagaaacgaattgcgaagtgaaaaacgccaaactcatggaaagagcagtcgctgctttggccgatgcggtcgaagtgttggaggaggaggcgccggaatggttggaagacgcggccgaagagccggggaatttggcggagaatcccggcatttgatggacccttggagttttggcaaattcccatataataagtttatacccatgatttatacccatgatccaagctttcgaaaacaacatatgctgtcatgggttcgagtcgcattaatttttgtgtttccactcattgatgaatgaaaataatatcacctttattttgcttttttaatttatttttttgtttttggcaattaaattaaatttttttatcaaaccactccttctctctcacactcgtacgcgatccatctatattgctgatgctctgcaatacgcgtatgtattctgcatacccctctgtccctgactctgtctgcgtagacagataatcattcagagcattatattcgcacctttcccgtccgtctacttgttttcaaatacattttaactgcacaattacgcccaacgcctgacttattcattcactgaactctcatcagacaccaaactttttatgtaaggattagtatattagttttcttgacaaatattatatttcataattcagaccggcgattgcgttcaacaaatcgacgctatgttaggggaagtgcgcttgaacacaaacccattgccttggtacaacaaccacaagaggattttttttgaatagttaaaaagggaaaatttcttattttgagcca

SEQ ID NO: 51597 - DNA, 518 bp, Heterodera glycines
  Genomic contig location: Contig_ID=SeqID_21018; Location=1325..1842; Strand=+
  SCN-specific regions: Sequence locations=1-202,230-518
atgtggataattagatggagccaacaaacgacgaagcttaaaaatgctatcagcaatgaggaaaatgacgtcagcaatgagaacgatggtatcggcagtgaagacaattcatcaaatgacgtcgtcagcaatggcgaggaaaatttgaccgtgacgattcgtcaaatagagtcagcaatgccgacatccttgctgttcgtcatgattcttttaaattatttgatttattcgtttcagcgcaccgatgagatggatcggaacatgaaagacatcgccgcatcggttcgactgcttttacgtcagcaaagagggcgatgggttgctggacggtggctcattgggctgttgatgggaggacagtgtttcgtcgcagaacgtattcaggagtttctctaagcataattcgaccacattatgggattgttgttattatttgttatgcaataatataggaattttggtaatactgtgctttgtccacccccctttcgaaattttttttatgatttcaaatgtca

SEQ ID NO: 51598 - DNA, 1263 bp, Heterodera glycines
  Genomic contig location: Contig_ID=SeqID_21019; Location=382..1644; Strand=-
  SCN-specific regions: Sequence locations=1-42,90-276,300-990,1013-1263
atgatcactcgttcactgcataggaatgtaaatcaaaggcgtgtagttggagaaaatgaagaacaaaacggaggaaatagccagcaaaataacgggaacaaccaccattcagaaccgatgatggaagacgacgaaattcgccgagcacttttggacgtcaatggtcaacagaacgagcagaaccaacagttgaatgcggacgaagagcgccgccttttggatcagagtaacttgaatgggctgagaaatttgggtgaaaatttcggctggaatttgggaaacaatcggcaaaatgaaaatgctgcacatatggcgcagcgaataaataattttatgacgtccacgcctaacatcagtcccggtcaccaggcgcggcaaaattttaattttgttgacaaccgcgttaacagacgcgttgtagaaaggcctagggatgcgcgcggacgttttattcggattgagaataacgatgagcaagaaatgccaaattttttgcaaaatccaccgcggaacccgcaaattccgccagtaaatcagcaacaagcaaacaatttgggaaatttcggaatcccaaacaaccccaatctcattcaaccattgcaattcggtatgaatggcatgtatgcgccaggcgcgtggcctcaacagccgatgatggcttatccaccacaaaattttcaaatgttttatccaccgaatttcgttccacaaatgccggctcaaaattttgtgccatttatgaataattgggcaccgaatgcgtttcaaccacaaattccccaacccgcaattcaaccaatgagagctcagccaacgaatgttgtgcaacaacagcaaattccgccgccgacaaatcaggcgatggcgcaacaaaacccacagcaggaggtgaaccgacaaacaacagggttaagcggcattgaatatgctatgatcctggacaggctgcccgacattaaaggaaacgagggaagtgattcgatccgcaactttttcaaaaaattttcacaatatacgagtgaatggccaaacaaaaagcgaatcgaatcattagaagccaaattgagtggccgagccgaacgtgcctacaatgctgctttagccacagagccgttcgcgtacgaaaacatcaaacgaaacattttgcagcagttggaagaaacggattgtagggagatgagtgcttttgacgacctcatgaatggtgtctacagaaaatcgggggagaacttagacgatttggcaaatcggatttcaagctta

SEQ ID NO: 51599 - DNA, 531 bp, Heterodera glycines
  Genomic contig location: Contig_ID=SeqID_21021; Location=462..992; Strand=+
  SCN-specific regions: Sequence locations=1-56,83-163,210-210,236 -391,418-531
ggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaagcatcagagagccttatttacttttattaacatttggtgcgtttcagagcactttctgaaaaaatactatgaattaattttgcaaaaaataaa

SEQ ID NO: 51600 - DNA, 566 bp, Heterodera glycines
  Genomic contig location: Contig_ID=SeqID_21021; Location=1163..1728; Strand=+
  SCN-specific regions: Sequence locations=1-566
gggaagctattcccgaaggattcggtctccccataaatctgggcgcatcggttcgggggtactgccccgaaaacaaaaaaatcgattttttcaattgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcgggggtactgccccgaaaacaaaaaaatcgatttattcaagtgtccgtttggggtactcaaacaattatggggatcaaaaattcaacgcagaattaaagaacaggctttagggaagctattcccgaaggattcggtctccccataaatctgggcgcatcggttcggggggactgccccgaaaac

SEQ ID NO: 51601 - DNA, 1088 bp, Heterodera glycines
  Genomic contig location: Contig_ID=SeqID_21022; Location=551..1638; Strand=+
  SCN-specific regions: Sequence locations=1-195,217-307,331-598,621 -663,696-969,997-1027,1050-1088
atggcttcaaaagaatctgatatttggaattttttcacgaaaatttcttcagaggttgctaagtgccggctttgtgaaaaccaattagcgtgtaagaaatcgtgcacaaaaggattgtgggggcattttaaagcgaaacacgctaaagaatttgaaaactatttgcaaaaatccgacccgtcaacggtaatacaagcttccttttgatatgaacaactttggtcaggttgaatcaggaattgaccgtacatttgctgatcaagaattgagatagagaaatgtattgacaattgcatcacataaatactttattttctttttagatgatatctgggcccaaccaaaatcaccatgtggtatttctattccctcaacaatttccggagatcctgactctgattttttatcaaaaattgaggctgaacttgcttgttttaaggcaggccaaaggatggaagtgaacggagacttattttcttggtggaatcaaaacactggccgtcttcccgaattgtcaaaacttgcaagaatggtccacagcattcctgctacatcagtcagttctgaaagactcatttggctgtggttcgacttgattttggtttgaaattcctttaaaaacaaatgagaactccgcttggaatgcctgtcgatattccgtactaaaatataattaaaaaattcaatttaattttcaaaaatgccacctcgtaaaatataaaattggtccgttcgatgcggcgccaatgttcaaaggaattgcggcaattaattgcaggaaccaagcagtgatcggagacgaaattgtcggattgatcagaacggtgtagaacaaatagatacaatagccgccaaaattgacactgacaatgcaaataagtgcccgaaaagcgcgatgattgatctgatcagctgatggcaaacctaatgtgacgaaaatttgatcattagagaatgaatttttgcgggttttaatttttttttttaaatttatttcgtatgcaatatgtaaacgtatctataaaatcgtgaattttaattttattaatgctttttttttgtttttagtcatagatttaattgtttga

SEQ ID NO: 51602 - DNA, 520 bp, Heterodera glycines
  Genomic contig location: Contig_ID=SeqID_21022; Location=2189..2708; Strand=-
  SCN-specific regions: Sequence locations=1-5,361-377,399-520
atgtggaagagaaagtggaagaagaacagaaagtggaagagaaagtggaagaggaacagaaagtggaagatgaatagaaagtggaagagaaacagaaagtggaagagaaagtggaagaggaacagaaagtggaagagaaagtggaagagaaacagaaagtggaagagaaagtggaagagaaacagaaagtggaagagaaagtggaagaagaacagaaaatggaaaaggaacagaaaaagcaacaaagggaaagaggaaggaacaaaaaaagaagagagcaagagaaagcgagagtgatgaagtgaaatgggaaggtagaaaggagggagaaaggggatgagaaagaggaaaagtaagagattttaagcgatcatattaaaatttgagttttaagaaaacgttaattgaattcccggccattaaaaaaatcagttgccttcttacatataaaggttttttggcgcgtagcgccctctagagactgttaaatagcgaagctatttcaatttaaaaaaataaa

SEQ ID NO: 51603 - DNA, 1345 bp, Heterodera glycines
  Genomic contig location: Contig_ID=SeqID_21023; Location=312..1656; Strand=-
  SCN-specific regions: Sequence locations=1-106,153-179,206-416,438 -966,988-1345
  Gene Ontology: Mol. function=profilin binding; Cellular component =actin cytoskeleton; Biological process=chromatin-mediated maintenance of transcription
atgcggcgagagctagcagacaagccggccaaagttgagctcaccaaagggataagcgtgctgttgagaagaggtggtgaagatgaagatggtgaagttgtggacacaccaccgcggcctcccgctccaccaccaccaccacctccgccgcctgggagacgcccttggcgtgggccaaatctaccaccaccaccacctccacctggaagacgccctcggctcccaccaagtcctccgggtcgcgctccgtccccaccagggagtcctccgcctcgcccacaacgtcctcccagaccgagtagaccttctcggagaaatggtcgtttggagcagtgggagaaaaggcgacacgatatacaacgacggcgaccggttgtgcgggaccttcttgcagaagcagctgctgcccccttaccggaaagtgatacagatgatgagtacatgttggagagtgggttagcgctgccaacaccatcccaatactatggcgacttgcctgtgttgccataccaacatcaaattgaccagatggacactgctgctcagcacaggattgccatcagaagaaaattaaaaaaggacgaagcatatgatgatgatgattcggaccgcaaaaaatacagggtttattatcctccttcacctccccggctcccgctcccgcctcgtgcgaaagcaaaaattgaaccaccaccgcgtcctaccgccaagagagagcctcagaagccaacaaagttggaactaaaaccatcaaaatttgagcccgattcacgaccaaaagtcgcgctgcctcggtcgaaaaagaacctgaattcccgcttgaccctcggccatccacatccaggcaggccggatacttgcctccacccaaaattataccaaaacccgagccgacaaagaggcctgtaccataccgtatcccgaaaagagagccaaaaattgttgaacaacagccacagccgctgcaacaaccccttcctgcttctgccgtcgaagaagaaatgcccactattcctccgcctaggcgggggaccaaacgccactaccccgtaaacggtgagaatgatggtgaggtgcgcattagaaaacgcgtgaggcaagcgagaagggtgagagtacagtactctcccgaaccgggcccatcaacttctgcacaaagggatgagcaacaacaacagcgtgaactgtttgccatcccgtcaaatcagctgaccatgactcaacggattgaacgactgcacatcaaatgcaaccattatgcggatcgtatgggcgttcggggaaatacaattaacaccgcaaacggcaaaccgttggcgcatagcaatttgcgaatggccctcaa

SEQ ID NO: 51604 - DNA, 1286 bp, Heterodera glycines
  Genomic contig location: Contig_ID=SeqID_3718; Location=14..1299; Strand=-
  SCN-specific regions: Sequence locations=1-99,121-150,178-439,461 -514,536-580,624-1210,1233-1286
atgatcagcaaacagctcgcgcaatggaaaatgtaattagtcgaatgcaaaattattaattaactaccgccgtatcacaccactgaaatattctcaaacgactaaaagacaattaattgatcagcacattttttgaactttgtaaataaaaaggacattaaaaattaaaaatataagcatttttctaattaaagtttgccagaatattatttttggcaatttattatttaatttgtgcatttgtctttactccatgtttgacaaaatttgaatgtgcggtacgtcctttgatcaacatttatcactaaaaaagtttatcaacggataaatttggcacttttatttatttggtgataaaaatgcccgccttcctcacattaataaataaccaaatattactttttttatttttaaaatgaaactaattaaacgaaaatattttccacccgaattactttttgagttaattcattttttgcctttcaaatgccattgggctaataaaagggtttctgccatttttgatggatttgtcctggaaaaacagggcaaatggctgaaaatgttttgcaatttggtgattaaaatataaaaaataataattatttaatgaaataaatttaggtcgaagcgttggatggcaaattgggcacttttttggcgaaagtggcacatcaccgtaggcttattttgtactgtctcatgacacgtaagtttcacttacatttcgattcacatcataatttgcttaccgtatattctctaattaacgcctcgtatccaattactccccccccccttttgaaaatgaaaaagttgaaaaataatccccccaggtcgataattcgagaacatacggtatatgtggttgggataccgtccgggattggtctcagattcccggctttttcacttcacagcccatgttattcaaaggccaaatgccgtaggacctggggacaaattttcctcatcctaatggcatattatcataccatttagtgctctcactcaatttccgtgttcccaacgagttcttattgcgcatggcgtggcacaacctcactgaagaggcttccgaaaattatggcattggcaaatttcgcacgcatctcgcagaaattcgggcacatattgttaagagcggggacactgaattgatcaccaatgcgcccgagtgtaaatttttattgccaaatttggcaatgcgtaattaatttaaaatgccaaatttcaaacaaacattttcagatttgcagaagcttcttattattttttttgaatga

SEQ ID NO: 51605 - DNA, 231 bp, Heterodera glycines
  Genomic contig location: Contig_ID=SeqID_3719; Location=489..719; Strand=+
  SCN-specific regions: Sequence locations=1-42,64-231
atgaacctgagtaagctgatcaaaaattgatcaatcaaactgatcattttgaaataatactgttgatggccaagtgattagactgtataacacactgattaatgcaaattatcagtcaaagtgatcagcttgaaacattacataaaatggccaagtgatgtgatcaacttgatcatttcaaacaatactagctcactgatcagactcagactcgtttaatgatattaggca

SEQ ID NO: 51606 - DNA, 2424 bp, Heterodera glycines
  Genomic contig location: Contig_ID=SeqID_3720; Location=1156..3579; Strand=+
  SCN-specific regions: Sequence locations=1-162,185-405,428-486,508 -767,794-2127,2149-2424
atgcgtcagtggaaattttattgccataaaactaagttccttaggtttttgaggtaggtcactgaccacgaaacagatatccatttcggcctattccggacccgaattcaaacaaaaagtcaaaagtccaaattctcgaattttggttcaaaaatagcatataggctctctttcttatcaaaggattgatgggtttcagtttatttccgtacactaatttcgaaaattttgactttcgactttttgttcgaattcgggtttggggttataatcagggctgccagattaaaattttctaaagcctcattcggcaagcaaaaaagcctcattttgggtcaaaaagcctcatttttacaaaatttattcaaaacacgcttaaaattttatatttttgactgtccatgatcaatttgagcaattttttgttagaaataagcatttgggaaattttgagcacgaaaaaccgaagttgattttttgcggcacttttttcaaaaaatttcggggaataaggggccggtggtgccgataggggccgccgggggagaaatttagaattttgaccatatctttagcagtttttcattaaaaaaattctttattttgcgatttttctcaaaaaaccacaaaaagcctcaaaatttctcaaaaaaccacaaaaagcctcaaagcctcattttgaaaatttagcctcattgacctaccaaaaaaccacaaaatgaggctaaagcctcacatctggcagccctggttataatgaatgaaagaaaatgggggaggagggagagcttttgtagtcgcgaaaaatttggaaaatgcaaaagcgtacaaatgaaccaataaaaattagtataaaagtggttgctcctcctcctccacctttcattattattttccattcgccatttatttttttttcgactttttctcctgacaattccttcaaaaatgattctgtacttttttgtattttttctctacatcaaaatttttgctaagtaaaaattccaattttaatttgaattttgtttcctttttttcagttttatctccggcgactgttggctttgtgtgttcaatttgctctctccgcgtcagcttggctttggaattgcgatgatcagtcaccgatttgacttttacgtcgatgaacacttcaaaactcgcaaatggacattgggacttattcgaatttggagcaaaattggagagaatggcacgaagaaaatgaaaattgtcaatggctatggaaaacgaatgccaattccgcaaattcaaatgccacggaaagtcatcggattcaattacatttccatctagtaaaattggcgattatacaaatttcagcaaatttcccattcatttttagttacatcgaccaaaatgccatcgcttttctccgccattttcaccaacttttcgccacctgtccaattaatttggccatcgaaactgaaaatgaccgcattttggtgttcattttgcgcaacatttggccaatgatcggaaaaaacattcatttcatggaattgtccgccggaatttttcatcgttttcgacaatttgtcccgtcaattctcaacgattgtccatcacttcgctttgtctgtttcaattttcacaatctcttcgccgaatttccatgcgatgacaatgccatggcatccgatggacaagcggtggcaaaatggctgttcactccgcttcaaaacgatgtgccgaagatgtacaaatgctggttgaaaaatgatgattcgagttggtcgtcgaagattgaagcattcaaagcggtgatttttatttgattgatttaaaatggtcttctcctaagcaacaagtgtcacagctatcatttcttaatctaatttttccatgttttaggcttttgccaatgcttcatctcccgtcaatttcattgtcaccatttggttttcttttgcttcctccgttgtgccctttgatctgaccaacgaattaactcgagaacaattgacgttgaaaagaactgactacagcaatcgttttctgctaatccgttgtccaatttcgcgagacgcgagcaaatgggcaaaatgggaaaaggaagcgattgactggagaatttgcggtcaatgtaacagaattgagattcaaatttatgttgagcgtcaaattggcgacgggtaagcgaatgctttttcaaaaaattcaaatttaattcgtttaaattcttttaggcttctcgacgcaactcctggcacaagtgatcggcagcagaagtgaatgaatgaattgttgagaaatgatcgatcaatttgaattatatagttattgtcgtgatcataaaattgttcttttttgttggaatgttcaattttgtttttcttctttaatccttagagctttaaaaaatgccaaattcgtaacaaaattcgtttttgaaaa

SEQ ID NO: 51607 - DNA, 775 bp, Heterodera glycines
  Genomic contig location: Contig_ID=SeqID_21024; Location=893..1667; Strand=+
  SCN-specific regions: Sequence locations=1-36,66-221,243-553,582-775
  Gene Ontology: Mol. function=protein tyrosine kinase activity; Biological process=protein amino acid phosphorylation
atgaagaacaacgagcgacgcgactcgttcatcggcacaccctattggatggcaccggaggtgatcatctgcgagacgttcaaggaccagccgtacgactgcagaggtcgtcgtcctcgtcgagtcccccccccctttttgggccactattttccctattaaaaaggggacaaaaaactgtgcacacactccaaattattaattaacattgtttgagtagcgacagttttgtgtttgcacaacgcgtgtattgactagtcaatccgtggacaaatctgaccaattcccacgagtcgttggccttaaaccaaacaacatttcttattcttgccattaattaatgatattataaataatgcaacctgtccctctccctaaaatgatatgaaaaggttttcgattaaatgcaaaaaaaaaatccggaaataggccgggaattgtcggtagatcgtcccataaccgaaatcctctgtttgcgccaggagaaccctccctgatttctacagataaagataaccaccactggttgaagcacaactgcttgcacatgccctttaatttgtttaattttaaaatttttagcggacatttggtccctcggcatcacttgcattgaaatggcacagatggagccgcccaaccacaacatgaacccgatgcgtgtggtcatcaaagtgcaaaagtcggagcctccgaccctcgtgcagccgcacaaatggacgcccgagttcagcgactttctgcgcaaatgcctcgtcaaaaatgtggacagccg

SEQ ID NO: 51608 - DNA, 315 bp, Heterodera glycines
  Genomic contig location: Contig_ID=SeqID_21024; Location=145..459; Strand=-
  SCN-specific regions: Sequence locations=1-253,275-288,310-315
cctcatttactttgcggacttgcgcaatgaaatcgacgggttgcatcgcgggcacacgaacttgcagattttcaggtaaagaaaaatattgaaatttttataaatgagaaataaattgacaaatccgttccgttttaaggcggcaaaggctcgtgccagcggtgtgaaggcgatttgtgcaatttgtgaccaatcattttttgggaccgaactctgatgttgatcatgaagctttggtcacagacgatttaaatattttttagcattttgtaaacttttgaatgtattcaacctttaagacaaattttgagaaaa

SEQ ID NO: 51609 - DNA, 1157 bp, Heterodera glycines
  misc_feature (8)..(8): n is a, c, g, or t
  misc_feature (25)..(25): n is a, c, g, or t
  misc_feature (61)..(61): n is a, c, g, or t
  Genomic contig location: Contig_ID=SeqID_21025; Location=7..1163; Strand=+
  SCN-specific regions: Sequence locations=1-75,118-210,232-248,274 -297,319-393,430-540,585-590,612-820,859-1157
atgatttntaaaaaattagccaatntagagaatagtgagaaaatgataaataaatagattnttatagaaaaagtgataaaaaattaaattttgtgaattattgaattaaaaaatttacacatttcgccctaatcaatttgataagctgtgcttaaagaaattgggagcgagcagtgaaattgaaaattgaatgagtgtgaaaaggagtttttgttctccaccactgcccccgacaatcacagagagcattaaaaaatacataaacaaataaatgactcattaatttttactcttagctaataaaattgagaaataatttctatcaattacatgaagaaaatgattttcattaatttcttaaattcaattgaaaaatgatgttaaaacgtattctaataaataaataattttattctaaaagaaatatttcataccaattatcaaataaaaaatggtatccatcaagggctgcttgtaactgaattttcaattaagaaatccaaatccgtaattacgatgaaccaaaaagaccatatccggtaaatataattaaaataattttaaaacaaaaataaaaaaaaattgaataatcttttttgaatgaaacatataaaaaaatgttcttgttgaaagtctaaattaatgcaagattctcgaaaaataatcaaataaggaccgaaattacagaaaaatcgctaaattccagtaatctgtaactgcgtgaagccattccaactaaagcctctgagtttggcaattttaaacatttattcacatgttcatcaaaattaaacatatttgtaatagcagattcaggtccaaatatttaaaaattcacttttaatttaatttaattttcagaatttaatccctccgatgtgtgccgtgccattgatcgctccccccaatttcactcgctttgccttcgttcgtcggtggtcaaacagaaaggctttatccctaagcatttgcgtcccccgtggttggactcatctctttttgaggacaacaaattaaaagcggagatgaaagtgtcggccaatggatgttatgcgtgttacagggggagaaaggcgagcaatgggacaaatgaggacgaggattactgtgcatgtgtggtacggtattcgcagaggaaaggatgggcgtactacact

SEQ ID NO: 51610 - DNA, 975 bp, Heterodera glycines
  Genomic contig location: Contig_ID=SeqID_21026; Location=356..1330; Strand=-
  SCN-specific regions: Sequence locations=1-110,135-575,644-920
atgaattcaaaatcaacagaaagtgggcgaaattcgtccccattgagtgcagaagatgagccaccagtgaaggagataatgtggccaccgcatggacatgtctatcagcaggtggttgttgttgtgttgttccttttgattttacacaaaattgatttatgccccaattaaatcaatattttggcagtgagaaaattgggaattaaatttttaaaaatgataaacaaattccaacccacaattctgcattctgtagttggtacatatgtagcttgcctgaacagcacttgaaagaggtttaaatgaatttttttttttttttgattgcgcttttacaaggcttactgtataagcctaaaattcttatttttccccaacaaatttgcaggaatttatgcttcccgcttattgcaagccaaaattgattccgttgaaatcggtaacgttggaaaagctagaaaagatgcaggccgaaaatgcggagaaactgcgcaaaatggagcaggaggcggaatcagaacaacagcagcaggtgggaattagggttcggaccccgtgggcgggggtggcttttcgcgggggcgggggcgaaggtcgcgggggccgggattgcgggggctgagtcacgggggcggaggtgaggccaaaaaacctgtcccgcccccggcgggggtgacgggggcggggtccgaaccctagtgggatttaaaaaaaattattgcaattttggcataatgtagtatgccgccattttattacggtatctatcacatttaatccgttagccacaggatggaagcaaacacgaaaatgcgcctggctctgttggtggtcaaagcggtccgccggacatttggaaggcagaagaataatttgaaaattaaaggcgacacggaggaaatttttgacaattagagtagaaaatttttattttcctaatttaaatttaaaaatatttttttttattaaaataaa

SEQ ID NO: 51611 - DNA, 679 bp, Heterodera glycines
  Genomic contig location: Contig_ID=SeqID_21027; Location=1147..1825; Strand=+
  SCN-specific regions: Sequence locations=1-55,92-117,154-186,208 -464,486-608,630-633,675-679
atgtcatatgccattatgaaaatgagcattgttctcctgctagtgccaattgcattaatttttgcatttcttttattcaaaataaataattctttgccaacaaataccaattcaaaaagtatgtttctgttttttaataattcagcaattagagcaaaaagtagcagaatttggacaaccaaaaaccttaattagttaattattttttccaataatcaggtgacacattcattgtcaaaaagttcaaagaaagcgaattggcacatcggttgttggatggcaaattcggcatcgaaatcggcgcctcatcgcacaacccgttcggtttggacacattaaatgtggattacaccgacgacccgacagcatttttccagcaagatcagatcaaaaattcaggtctgcagctaatgaccaaaactgtgagagcatccccaattgttttagaaccattccatacaattgtttttatccattttaagatttttgacactgacgccaaaagtgatcaaaaaaactggtcgaatgaacaaaaagattaaatccactcctataatttatatttgatatggctgttaatgggggctggattagaactgattatttagtatttttcaaagtatctttccgctgatatttttaattttattattttaaagaaatattatatttatggcaa

SEQ ID NO: 51612 - DNA, 802 bp, Heterodera glycines
  Genomic contig location: Contig_ID=SeqID_21028; Location=452..1253; Strand=-
  SCN-specific regions: Sequence locations=1-232,276-513,547-706,749-802
ccactaattgtgccatttattcaggacgacgagatcaaacggcaagccgagaagatcaaactgctaaaacaggaactagaggaaaaggtgccgacataagcatcaaaatttaaagaaaatcatcaacatttaaccaaaatttttgtgaaaatattgattttcctcataaaattgtcagttttttggtcaaatatttgagagttttcaattcaattgcttaagaaaatattcaaaaataagctattaaaaatataccaccaaaaaattggaaatgcgggcaaaatctgaagggaaactgttaaatattctttacttaatacactgattgtgtcccactttttcaggacgccgagatcaaacggcaggccgcggagatcaaacggcaggccgcggagatcaaacggctaaaacagcagctagaggaaaaggtgctggaaatatgcaccaaaattttaagaaaatcatcaacatttaaacacaactttagtgaaaacttaaatttgtttgagaatcttattttaatataattattatattttttaaattctgcccttttggtccgttaattttctaatttaaatcaattccaaaagttggtcattttttaggaaaagaaactgttggaacaagaagagaagttggcacaacaaggacaaaaaatattggaactggaaaatgaagtcggcgcactacgaaaaattgtaggttttttaaaatattatttaaaattttaatacaaaaatattttgaggtcaatgccatgtccgaacaattcatgcccaaggataagcaccaaaaaatg

SEQ ID NO: 51613 - DNA, 292 bp, Heterodera glycines
  Genomic contig location: Contig_ID=SeqID_21030; Location=88..379; Strand=-
  SCN-specific regions: Sequence locations=1-105,136-292
atggcaatgctgaatgcgtccttcgataaattcaatatttctaattcggataaaatccgaacccagcggctcatatcaatgagtgaagtaattgggatttgccgatgatataaattatttctaatttttgttttcatattttcagagttgcgaagagtggaaaacatgcaccaagcgagaaacatatgcacttctcgaccaggagctgaacaaactgttgaccacgtcaccccccgagaaaatggaggcgaattttatgggtatctcgacaaaatctaaaatggaaatttaa

SEQ ID NO: 51614 - DNA, 646 bp, Heterodera glycines
  Genomic contig location: Contig_ID=SeqID_21032; Location=45..690; Strand=-
  SCN-specific regions: Sequence locations=1-473,497-518,540-560,582-646
atgcgaagaatggacaaggacccaatgcaaatcaaagcaaaaaaacataaaattgagtttgccgaggacatcacaccacaacaaaagcaaaaagtaaaaaatgattattttatattttctaaattttacttcttaaggcgaaaaaagaaatcaaaaaatttttgaagtcccaaaaatgcttcacggaagcgaaattttttgaaggcctgccgaattattgaaagaaatgacgaaagaatttgaagaaattcttaagcgagaaattttttgtcaaatttcattttgaaataatgttgttaatggataatttaaaaatttcatttttaaatgcttttaaaaattcaattacattttgttttgtttttttttttgttattactagctagagctcagtcaaacattctgagtatcattcgaaaacttgaagtctatatgtttttttattgcaaaattctaggacaatggcaacagacaaaaaaaaaaaatttttttttttgtatacgcgcgaaaaatgattaatttcttgttttcttattgcaattttttcttaatgcaaatattttctcttttcttatatgtatttataaattccctaatctttaagctttcgaatgatacacagaatgtttggattgaacaagtatga

SEQ ID NO: 51615 - DNA, 741 bp, Heterodera glycines
  Genomic contig location: Contig_ID=SeqID_21032; Location=1348..2088; Strand=-
  SCN-specific regions: Sequence locations=1-158,192-214,248-374,419 -471,495-741
atgtgtcaatcaaaaggcagaaaaagaaaaatggtggaggcaaaaaaagaaggcattgatgaaaagaaagctgcgcaatgttttactgtttcaaaaattttggcaatgttcgtcggccgggacaaaagtcaattttactatattgattggggagaaggtaatttaattagtaatttttaatattttaaaaacaaatttgtgtgctgataattggtaataattagaaaaattaaatttaaaaaaatttgtaaattgtgacaaaaaacactcctaaaaacccctaggttttcgaacattttggcattactttttgaaacaaaaatatttttttttagaaattttacaagcaaatagagaaaacttagggctaccccattttttaaaataataaatttgtaaacaaaaaaaacaaatttttgttgcttttacattaaagttcatatgaaaacgcgtttatttttataaaacggttttattgaagtattacaaaacacccctaattcccaggacaattgtacttgaaaaatccttttttttatagaatatgtcggccaggaaagttgggagcctttgagttatattaatgcgcttgaaatggtggcggaatttgtcgaacgttcaacgatcgattgcgtactgaaagcattgttaggtgaacaatcagtgccggaacatatagcaaaaaaactacgcaacagtgacaaattcaaggaatgtacggatgaatttaaatatttttaa

SEQ ID NO: 51616 - DNA, 1238 bp, Heterodera glycines
  Genomic contig location: Contig_ID=SeqID_21033; Location=100..1337; Strand=+
  SCN-specific regions: Sequence locations=1-384,406-543,565-1238
atgacgcacagcggagatatgtggcaacgtatacaagttttggaattggtaaaaaacacccatttaaacgtattaaaatatttatgtttaggcaaaagcatttgaatgtggttacagggtggacagattttaccgggcatggcattacgaagcggcggatgatgatttattcaagggatatgtgcggttattcttgaagttgaaggaggagtcaagcggatttccgaaaggagttgagagcgatgaacagaagaggcaatgggctgaggaatacaaggaaaagtacggaattgcgattgaactgtgcagggtgcagaagaatccggggttgcggtatatcagcaagcttatgctgaatagtttagaggtatgaaatacgaattcttagatctgataaaatgttaatttttaggggaaattttcgatgagaaattcattgagcaagaatgcggtgattgacagagagtctgccttttacgagttggcgtgtgatcataaggtggagttgtgtgacattgtggagtactcgggtgacgcgatgcgggtgatctacagggacaaggaggagtttgttactgagcacaagtcaagcaatattgtggtcagcttatggtaagtttttttttgaaaaaaagcgagaaaatataattttaacaggacgacgagcatggtgcggttgaaattgctggagtttatgatggaggcggaaaggaatggcggggagattttgtacacggacacggatagtatattcgtgtttcatgacagagagtggagccaataacgacggttaaataccttggagagatgagtgaggagtatggaggttacgaaattgaagaattttgttgtggtggggcgaagcagtatggtttaaagatcaggagcaaggagacgggggaggtcgattatgtcatgaagattaggggtgtgacatttgatgtggacaaccggaaggcgttgcattacgatgcgtttaaggagatagtgctgaattatggaaagggggaagtagaccccgcattctttgtttacaaaaatgattttgggaatgttttttgaaaatttttttaaacaatctcatattattttagtccaacgcgtgagtcgaaggtcgtgacgagggagagtcacaagatgtacaagccggtctgtcagaaggggattattgatgaagaattgaatgtgatgtcatttggattttgttaattctgtattttatttttgttttttgttaa

SEQ ID NO: 51617 - DNA, 1562 bp, Heterodera glycines
  Genomic contig location: Contig_ID=SeqID_21034; Location=150..1711; Strand=+
  SCN-specific regions: Sequence locations=1-268,308-408,433-478,542 -654,676-901,940-964,1148-1172,1259-1402,1426-1473,1510-1562
  Gene Ontology: Mol. function=protein binding; Cellular component =lipid raft; Biological process=signal transduction
caatttgggcttctgcggctttttgttgaccattttgtctgtcgttttcctgctgatcactgccccattttcgttgtttttctgcgtcaaaattgttaaggaatatgaacgggcggtgatttttcggcttggccgactgatcccaggcggtgccagggggcctggtaattttttaattttcgcattttttatggattaaaaatttttaggtttattttttgttaacccatgccttgacacctttcgtaaagtggacttacggtaaaagaaaattaaatattttaatttaatttttttttaattttttctttaaagagtgttaacatttgatgtgcagccacaagaagtaatttattgccggggcttgaatggatttttaagtgcaaaataatgacaaaattttcaatcaaaaaaataaaaaaataaaattttgtaattctacaaaatggctaaaaaatttattagatagtcccgctggataaaaatataattattccattatttatataattttatattttaatttttttatcaattaattggggtcaagaaaaatagataaaagcgatttattaaaaaaggaaatccgatttttgtaaaaacgattaaaaaaaaaatttaaagccctttttgaaatatagcgccaataattcattttaatcataatttttggatttaaaaattaaaaaaaaagattctctcccgtgacgcggtcactgtggcggtcgatgtggtcgtatatttccgcatttcaaatgcaacaatttcggtcacaaatgtggaggactgcagccggtccaccaaattgttggcccagacaacactgcgcaatgttcttggcacaaaaacattggccgaaatgttgaggtagaaaattggtcacaaaaaatgttgataatagtaaaataatagtataatttgaaatttttttttttttttggtattttatttacacaaactatcgtaaaataaaaatttaaattatttataataattctatttatacaccattaataatattgtttaacaaagaaacttgtagtataaattaaattaattttaaatgcttttatttctgtattgtgaatattttttaaatatacaattgtataattaatacataaaaaaaataataaattttatttttgaatgatttttttacctagcaactgattaatgaataaataatttataaataataaaataaataaaaatttatggagtttattaaacaaagagaataaaaatatataaataatttagtgaccgtgatcacatcagcctcaaaattcaggttcaaattcttaaaaaatccaaaaacgaaaaatatttttaggaaaccttggacgaggctacatacccatggcatttattcgagaattttaaaaaaatttaagcattttaatttcaggggcgttaaagttgaaagggttgagatcaaggatgtacgcctaccctttcaattacaggtcctaaaaatttttgttttttttacaaataaattttaaagcgcgcaatggccgcggaagcggaagcacgcgtgaagcgcgtgccaaagtgat

SEQ ID NO: 51618 - DNA, 1238 bp, Heterodera glycines
  Genomic contig location: Contig_ID=SeqID_405; Location=1379..2616; Strand=-
  SCN-specific regions: Sequence locations=1-499,526-526,549-603,661 -739,781-786,808-854,897-1085,1109-1238
atgagacagcagacaggcagagaaaattggggaggagtgggtcggagagagatggagagtgtgaaagagaggggaagagatgagaatagcagacaggcagagaaaattggggaggagtgagtcgatatgtcaatccattcccaagcccttcccttgcactgttttcattgcaagggtcaacgggcaccacattccttctgcatttgccgtttaatgcaaactttcctcccccccccccatcaattgcttaacttttttttttttctaaattgttttttttttgacatgccaaactttgcgaggcgtacaggtggcgcgccttgccatcaaaaaagaatggctgcgcgggtggccatccaccttgtaaaaaatgtaacttttttttagttcaaaatttctttcaatttcgcttttttacagttttatacaccgggaggcacagaaacaacagcggcagcaaatgctcgacgaggacaaaaacgaagggtattttttcttcttttttttttaaatttttaataatttcccgctcacatttaaggtgttcaagctgaaaggcaatgttgaaatgaatgaagctgatcgaacagccaacgaagtgggttttttttttgaaattttttttaaattcaaaattaaattttttttttttttttttttgaggaattggacaatgtgatcaacatcagtgccaacgccaatgccaacaatcggaccaatggtgaaggggtaagtaattgtttaaattttcaaatttaaaaaattttcccattttgatttaaggtggcagtggcggtgaacgacgggggtgccagtgccgacactgggacaaataccgaaacggtaagtaattgtgattaatgttttgaatttaaaaaattttcccattttgatttaaggtggcagtggcggtgaacgacggcgatgccaatgccaacaatgaaaccaattgtcaaggggtaagtaattgtgattaatttctaaattttgattaattttcccctttgatttaaggcagcagcggggatgagcgacggcggtgccaatgccaacaatgggacaaatgccgaaacggtaagcaattgtaattaaatttttaaattttaatcattttcccattttgatctaaggcggcgacggcacagaacaacggattggagggcaatgccgacaatgggacaaacggtgcaaatgccaacaatgggacaaataccgaaacggtaagcaattgtaattaa

SEQ ID NO: 51619 - DNA, 1040 bp, Heterodera glycines
  Genomic contig location: Contig_ID=SeqID_406; Location=1407..2446; Strand=+
  SCN-specific regions: Sequence locations=1-295,317-455,477-755,777 -855,879-1040
atgctgaagcttaatttcataattattttcttcaacattttattatttataagcattttggcggttgatgatttagatttccttgatgatttattgaatgacctcaagacaacgacgacacaaaatttgttaaaaaaacaaaaatttgaagaaaataatggagggttcccatcagaacaaggattcaaagtacgtacttcgatttgagcttccgtgcttacaaattctaggtgtatttatttccaagaatgtatttgcaaaatcagtttaccgatgaacagggcagggcccagatttcagagatagtttttcaacacattaatttttttttttaaacctttgactgataaaatatattttgtgttttgcaaatataagggcgattttttaaaaaaaaattcattctttttttgtgaaaaaaattttctgtagagtgcagcggaaccgggaattttgggcataaccgggaccgggaccttttaaaaaaaccgggaatttttggctgggaaaaccgggacttcggtacccagttgtactcagctgtccgtgtttaggtcccggtcccgctgcactctagttttttggcattacaaattcttgtgtggtacttaattgaccttttgacttcttttatgttttgaattataattattattggcgttttgttatcttttttatggaccttaaaatattagtgagtcttttactttgctgttcggttttgtttttggttttttatcttgtcttctctggaattgttttgaatttcttttgatgctgacttcttctcaattgattgttgtggtctcgtctttttaattattattgttgcggtttaaaatttatcgtcgtaaattattttgttttgtttatttattaaagtgtttgcgaattcgttttgaaacaggtgctgacaagccgacagataattgtgtttgatccatttctgaaaagagacaacccatccccatccaaatttgttgattttgtacaacttggcgctcctggcgacaaaggtttggcttagttgcgactattca

SEQ ID NO: 51620 - DNA, 3307 bp, Heterodera glycines
  Genomic contig location: Contig_ID=SeqID_406; Location=2721..6027; Strand=+
  SCN-specific regions: Sequence locations=1-13,35-196,229-512,534 -851,874-876,898-1551,1574-1678,1702-2441,2463-3005,3027-3039,3062 -3170,3192-3283,3306-3307
atgcaacaagccgctccagtccagcatctccaaaatgacagaaatgaacaaccacaaaatatagaaaatcggccgattaacaccgctaacactggggttgccgaaaattctgtaaacgatggcgaaattttagcacacaccatgaactccgaccaaattcttcacgccgttttgaatgttgggtcagcaaaccgacaaagtggacatggacaagatgaagaaaatgtggaaaatcaagatttggcaattcatccgaatttgacacagcaacatggaggtttgagaatgcgtttcagacgcttgccaaatttggaagaaaacagtgaaagggaattgtggcaagctgggaacgaaaacaatagtggtcatcacagtcatcacattctaaatcgaaattttctgcgcacatcaacgcctaataacgagcacattattcatgagttgcatattcagcacccgcgccaaaaccctcccaacattcaagcaaatcctaattttgtgcggcaaaatttgcaaaaaactgtgactgctaaccagcgccaggccaacccaaacgttctcattcctccacctcaagttattcaacaaccaattgcggtatatccgccagttcagccaccaattccggaaacttattggggatatcccgcaccttactatccacatcccccaccacctatgggttacccaaatcagcaaatgtttggaaatgcgaacactaaggtgccgcaaccgacccaaattcgacaaccatacaatcaccaaattccaactcaaataaatgcccagcaaacagctcttaacggcctcgaatgcgttttaattctggacaaattgccggacattaagggcaatgaaggaaatgacagcattaaatcttttttcaaaaaattttcacagtataccagcgattggccgaataaaaagcgcattgattccttggaatcgaaactcagtgggcgcgcagagcgagcatttaattcggctttggccaatgaaccgtttatatttgaaaacataaaaagacacattctccaacaacttgaggcgacggattgtcatgaaatggcagcatttgatgaattaatgcaaggcattcgccgaaagccaagagaagggctggatgatttggccgaccgaattgtgagcctggtgcgaagggcttatccgggactgacgcgaaatttggcggacgagtattcgattaaacacctaatccgcagtttcgataatgccgaacttgccttgagtttggagctaaatcgtcggccaggaatgagttttgatgagtttgtagctctagctgctcgtgccgaaacgacccaaaatgcggcgagaagggccaattcggacagaacgcaacaaaattttggccgtagccagccacacagacaatatgatggaccgatggccaaacaaagcacaaacgcatttgagccgaacaaattccagcgattcaatgaaaatcgaatcacgtgccaaagttgtggaagagagggacatgtggcgagaaattgttttaagcgttttgcagatcaggatcagcgtcgatattttggccaaaatcaaaatgcgaccggtgccaatagagcacaaatgccgacacattcaaatccgaatgtcagccaaaaatccgaacaaaatcagtttggacagcgccagcaacaccagcaatcacgaaattttctaaaacaaaatttcctggtcgaacagaacgaaaagcaagttgagtcttccaatgttcagtgtgccggtgttatcagcaatacacctgaaatgttggatttttttcgaaaattttggacaaaatgcaatgaaacggtggatgacggacaaaaagaagcatttccaatcggcaaaataatggcaataaaggtcaaaatctacgaccaatcagctgattcaatgatggatagcggggcccaaatttcgcttgtacaggcgagttttgtcaaacacctcctagagaactcaacactgcaagtcgaaaatctcaaaattttctccaaaacgcgaaatgtcgtggacatcaatggaaaaatcgttgagtgctatggcataatcatcctcccaatcactaggaaaggatgtgaagcagttgatgtcccatttcacataactgatgcaccgattggcctgccaatactttttggtaccaatgccatgggactgttgggttttaaactttttgactcacaaaatggtgagctgatcgaatttgaatgcgccgataataaatcggattatgtacgcattgtctacagtacactgatcgaacctcactcaacaaaatttgttgaactttctgtttcaccaaaatttagcggcaaagactttatcctttctccaaacgatgaaagaaacgacttaagggtcgaaccgtcgctaaacaaagagaggcgcggaaaaacaattgcagccataacaaatttttctcaaaatgcgttgacattaaaggagaatgaagaggttgcggttgtggaagcaattgaagatgttgctgatgtggaaaactgcttgggggattcatggcttttctcagaacccagtgaggttaaaatggagaaaccaaagcccgaaaatgaggagacaaatgcaaaatttggccttttgagcaaagagaattcggaaattcttgaaaatttgctaaataatttttcgagaatttttgcatttcatgactatgaattgacgcaaacagagatggtaaaacaccagattgacaccggcgaagcaataccggtcaaacaaaggatgaggccagtcccatatgcctatagagaaaaggttgccgcaatgatccaagaatatttgggaagaggaatcattcgacactcaatttcgccatgggctagccccattgtaattgtgcccaaaaaagacggatctttgcgcttttgtgttgattacagagggctaaatgcaatcacaagaaaggattgttttcctctcccaaatatagaacgtactcttctaatgctaggaggacgaaagttcttctcaactttggattttctctctggctattggcaaattaaaatggccaaaaattcaattgaaaaaacggcattttcaaccgaatttggcttacatgaatttactgtaatgccttttggtctatgcaacgcagtcgcaacgtttcaacgcttcatgtcacaattgtttgggagtaaattaaatgattttgtgtttgtgtacatcgatgatgtactagtggcttctgaatcttttgaacagcatttgatacatcttaaatttgtctttgaacaaatccaggaggctggattaaaaatcaaaatttcaaagt

SEQ ID NO: 51621 - DNA, 4373 bp, Heterodera glycines
  Genomic contig location: Contig_ID=SeqID_407; Location=49..4421; Strand=+
  SCN-specific regions: Sequence locations=1-226,250-986,1008-1348,1370- 1550,1572-1584,1607-1828,1851-1968,1994-2143,2165-2706,2728-3625,3652- 3703,3725-4026,4051-4311,4335-4373
cgactcaatgaaaatcgaatcacgtgccaaaactgtggaagagaaggacatgtggcgagaaattgctttaagcgttttggagatcagaatcagcagcgatattttggccaaaaccaaaatgcgaccggtgccaatagagcacaaatgccgacacattcaaatccgaatgtcagccaaaaatccgaacaaaatcagtttggacagcgccagcaacaccagcaatcacgaaattttctaaaacaaaatttcctggtcgaacagaacgaaaagcaagttgagtcttccgatgttcagtgtgccggtgttatcagcaatacacctgaaatgttggattttttccgaaaattttggacaaaatgcaatgaaacggtggatgacggacaaaaagaagcatttccaatcggcaaaataatggcaataaaggtcaaaatctacgaccaatcagctgattcaatgatggatagcggggcccaaatttcgcttgtacaggcgagttttgtcaaacacctcctagagaactcaacactgcaagtcgaaaatctcaaaattttctccaaaacgcgaaatgtcgtggacatcaatggaaaaatcgttgagtgctatggcataatcatcctcccaatcactaggaaaggatgtgaagcagttgatgtcccatttcacataactgatgcaccgattggcctgccaatactttttggtaccaatgccatgggactgttgggttttaaactttttgactgacaaaatggtgagctgatcgaatttgaatgcgccgataataaacggattatgtacgcattgtctacagtacactgatcgaacctcactcaacaatttgttgaactttctgtttcaccaaaatttagcggcaaagactttatcctttctccaaacgatgaaagaaacgacttaagggtcgaaccgtcgctaaacaaagagaggcgcggaaaaacaattgcagccataacaaatttttctcaaaatgcgttgacattaaaggagaatgaagaggttgcggttgtggaagcaattgaagatgttgctgatgtggaaaactgcttgggggaatcatggcttttctcagaacccagtgaggttaaaatggagaaaccaaagcccgaaaatgaggaggcaaatgcaaaatttggccctttgagcaaagagaattcggaaattcttgaaaatttgctaaataatttttcgagaatttttgcatttcatgactatgaattgacgcaaacagagatggtcaaacaccaaattgacaccggtgaagcaataccggtcaaacaaaggatgaggccagtcccatatgcctatagagaaaaggttgccgcaatgatccaagactatttgggaagaggaatcattcgacactcaatttcgccatgggctagccccattgtaattgtgcccaaaaaagacggatctttgcgcttttgtgttgattacagagggctaaatgcaatcacaagaaaggattgttttcctctcccaaatatagaacgtactcttctaatgctaggaggacgaaagttcttctcaactttggattttctctctggctattggcaaattaaaatggccaaaaattcaattgaaaaaacggcattttcaaccgaatttggcttacatgaatttactgtaatgccttttggtctatgcaacgcagtcgcaacgtttcaacgcttcatgtcacaattgtttgggagtaaattgaatgattttgtgtttgtgtacatcgatgatgtacttgtggcttctgaatcttttgaacagcatttgatacatcttaaatttgtctttgaacaaatccaggaggctggattaaaaatcaaaatttcaaagtgtcagttttgcgctgaagaactcaaatttttgggacatattttgacgcgaaatggcataaaaatggacgcggaaaaaacgaagccaattttggaattgccggtgccgaaatcgaagaaagatcttcattctttccttggatttatgacatattatagaaaattcatatattcatttggttctgttgctgccccattgttcaaactcctaaaaaaggatgtgaaattccaaatgggagaggcagaaactcaggcagtttctacattgaaggaaaaaattttgtcagaagtcgtcctttatttccctgatttcaaagccgcaatggaaaatccatcgagaaaatttattataatgacagacgcatgtaaaacggggatttctgccgttctctgtcaatcggacaatgaaaatcggatccgtcccatatattttgcttctcgacagtgcaataattttgaatctcggtactgcccgacagaattagaagcattagctgtgagattcggcgtcaaaaaattttcacaatacataacaatgattcccaccaaagttctaaccgatcataaagcgttggttccgatgtttaaaagcaaaagtgaaaccggaaacgcacgtgtcgataaatggataatggaattgagtgcacgttttattttggaaattgagtataacccaggaaaggcaaacataattgcggatgtgctttcacgttctggcgcactgaagccacgtgaattggcggagaaaatttttagagttgagcaagtcgatggaaatataagtgcttctgtgccaaaaatggaaatgattgagtgggtcaacgcaattaaggaaagtgagctcggaaacctttaccaattcctggaaaaaaggaaattgcctgaagataagcgggaatgtcagcgactttttgacaccattcataaattcacactgattgagggattactgtatttccatgattcgaattacggtaatcttcgacttttcgtgccacaaaaattccgcaataaactgatcgaagaaaggcacgaaggcaaatgtgcgggacatttaagcggcaaaaagattttcgggcaattagcagaaagatatttttggccaaacatgcgggcggattgtgtaaatgcggtgttgaaatgtcggatctgcgcacacacccgaaatccaagggcaaatgcgccagaattaagaccagtgattacggcggaaccttttgagctaatatgcatggacattttatcaattggaatgtcagaacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaacgggccaatcaaactattttaaatatgcttaaaaggtcaactgattcaaattggtcctgggatgaccggctgccttttgtcacatttgcttttaacattactccctctgaaaccaccggattttcgccttacaatttactctttggccggccagtaaattttccgtcgtctgataatgttaattttactgtaaatccttcttacacaatcgatgaagaaagttatctgcagctctttcgtgaaaatttgttaaaaattttggaaaatgcaaaaaataattcggacaaatcaagagaacgaatggagaaatggtttaattcgcagccaaaagtgactttgcagaagtaccaaaaaggcgaacgcgttatggttatttttccgggagctaacaaacgctcaacacataagaaattaaagtggaatatctttggaccctaccaaatcctcgaaatttccaaatcctcggcaaaagtaacgcctgctgataagaaaaatgctgatccaatttgcgtcccattagaacgtctgatcagagcaccggatggacttcctaatatttcaacaactccgcgcggcaaaaatgcttataaaaatgtgttaaatgtgatgactattttgatctttgaagaaaaaagcatggaatttgaacaggaaaattttttgggaaaaacaaaaacttcatcagggacgatgaatttttcagaggaggaggaaaatatggacattgccgaagcggagattaagtggacgatgacatgtgaaggcggcggacatgtgttgtgcaaaaaattgttggccggcgatctcgaccccgtgctcagcaaaacacaaggaatcggtgctatggttgtgcagactccattacaaggactcatcacactattcattttgcggtccaatgtttcaatgtctgcgtcgaaagatttgctgaaggtcgcaaaccaattggaaaaactgggtggaattgctaaattgcaggccattttgacttcggaccctga

SEQ ID NO: 51622 - DNA, 1280 bp, Heterodera glycines
  Genomic contig location: Contig_ID=SeqID_3722; Location=778..2057; Strand=+
  SCN-specific regions: Sequence locations=1-337,359-585,611-938,967 -991,1019-1280
  Gene Ontology: Biological process=regulation of protein activity, epigenetic
atgaaagtcgctttctttctgaacggaacacccgtccaatcgagtgggtgtcgactgatcagtgatttagtacagatcaaccaagaaagatctttttcaggtgaccgtgtgcaagtcttataccaaaacggatttgcattgctttcaatcgccgaagtcactgaacaggatgccggctactacgtttgtcaagccgaaaacgaaattggcagtgccgaaacatccgccactgtggtggtcgtgccacggacgggcgacggcaagtttttggccgaaagcgaagtgtacgagcacgacgtggaagacatgcgcgagttgcaggtaaagaattgcaattgtgaaattaaaacaaatttaaatcgagcaattaaattagcattaaattcctttaaaagagcatcaaagaggccgagggcaaaatgtacgcgccgcaatttgtgcaagcgccacgcgactttaactgcgaggacgagctgggccagtcgtacttcgatgcgcgcataaagccaaccaacgacccgtcgctgcgtgttacttggcttaaggacggacaaccgttgccaaatgccaaccgtattcagctggtaattaataattaaaaatataattagcaattacttgcttctgcccttgcccaggtgaacaacttcggcttcgtctccttgaccatccatccgacttaccccgaggacgcgggcgtgtacagctgcatgctgaccaactcgctgggccaggcacaagcggacgccaatctgtcaaccatttcctccggggacattatgtccgacccattgcatgccggcgcactgccgacaatccaagcgcacgaggaataccaggtaaagtagaggaagcaaaacaaccgagactgggcttgacttggctaggacctttgaagagactcaattgcattacgtcgagattctcgtttgaacgagataaaaaataaatattaaaaaaaaattacgtttgaatataatttagacatctatcgatgataattttatattttaacttttcaggtgcacatgggccccatgtttcagcccgaacgacccgaggaattccaaagcgtagagcaggtagaggaatgtttaattacattaaattgcaaatttgctttttttttattacacttacataagtgcaatttgtcccacttttagcctcggttcgcgcgccctttggatggccaagttgaggtcgaacaggaacagccggtgcacttcgagtgccgagttcagcctgccaacgacgtggtgagaagggaaatgaaataa

SEQ ID NO: 51623 - DNA, 2667 bp, Heterodera glycines
  misc_feature (1421)..(1421): n is a, c, g, or t
  Genomic contig location: Contig_ID=SeqID_3723; Location=197..2863; Strand=+
  SCN-specific regions: Sequence locations=1-62,84-256,278-341,364 -625,649-1039,1069-1171,1196-1437,1470-1534,1556-1657,1681-2075,2188 -2478,2505-2667
  Gene Ontology: Biological process=regulation of protein activity, epigenetic
aaaaaagtcgcattttctctgaccctcagcatccgagcagttacgcgcgcattcaggagatggaggcgccgaagccgctgccggaggaggtgcccgaaccggacaaacagtcaccccaattcaccaaagcattgagtgccagcgccggacatgtggccgaagcggaaagtgtttatttggaggcacagtacggcccattggacgacaacagcattgtggtgggcaaaacgagggggacataaaaaaaacattctcttgcagtgattaaaatcaaaatgagtcattaattgggctaattagagtcgaaatggcgattttataatttacagttgaaattatttgattaaaatgttaacaattccatttcgagcaaatattatgagttacattcagtgtgaatggcttttcaacggacagccgctgatgaaagcacatcgctttgtgctaagccaagactttggatttgcagcactgaccattttgtacatgtacccagaagacaggcaagtgcaaaaaggagaagtgagcccgcattagttctgctgtgaaactctcttgtttcggctcgagaaaatcgtatttttggagtctcggggttttggtctcaagcatcactagccctcatcttaattatgtataatttaaaggggtgataaatttggtcattagtgtccggaaggccgtaattgactgcaattttgttttcggtactactgatcagtgataggatagtctgctgatactgattctctgcaaataattgatatttataaagactgactgggaaggtattcattttcttgccactaattgatccaattaccaattaattactcgtcaaaataattactaaaataaatacccattaatgtgggccacttcagcggcacttacacgctgttgatccgaaacgcggccggcgagtcctcctcgtccgtcgagttgagctgcgagggcaaagcggcgctgctcagcgacccaatccatccacagtctgtggcgcgcatcgccgagttggaagcgccgcgtccgctgccggaagagccggcggagccggagaagcaggcgccgcagattgtcaagcagctgacggtggccacgcaaggcgaaggcggtccggccgagacgcaggcgctgcattttgacgcacaatacacgccgacggatgacaacagtgttaaggtgggggaagggacggagaaaactgtttttacagtgatcactgatcggttcaaaccttttttaataaagatcaagattttgaaaatgccggaacaaaatcaggaacaggaccagaaatcctgccaaaaattttgcgcggtcgctggggcgctctactttttaactcttggtgtcaaaatgaagataattagaacggaacaaataagataatttctgctttcataatactaatatccacncacggggcacattccctaattaaagttaatataaaaaaataaaatattgcattggttgggccattcatttgtcagattgaatggttcctgaacggtcagccgttgttcaatagcaatcgccatcatttgaccaacgatttcggctttgctgctttggacatcaatttcctcttggctgaagatgctggcgattattcgctggtggttacaaacgcagtcggtaggaatgttttggtttaattagttaattaattaattattacttttttactaatcaaaaatatattgccacgaggaattctcacaaaaccatttgcttaaaatgtgaaattaattcccaactatatgttaaggccaagcccaaacatcggcatcagtgcaaattgaaggtggcgctttaatcctggaggacacgcaacatccggaaagcttccgacgaatccaagagttggaagcaattcgtccggcagagccggaggagccggaaattgtgcccgaggcaccccaattcacgcaagagttgaccggacttgtggacgatttggccgacggcatgccgctacatttggacggcacagtgatgccgataacggatccgaagctgcgcatcgaatggtaggcttttgaaacaccaatcaatggtttgggggaccataatgaattagtgaaatgattatccatttggctaccagttattcaatcaatttatatacctattaattatattattttaaatagttattaattaattattgtaattactcaaatcacttctctccctcctactttaaggttcttcaacggacagcctctgcagtttagctcgcgcattcgcaccatccacgactttggctacgttgcgctggaatttgcccatcttttgcccagcgactcgggcacgtacacatgccgtgccaccaacgaagttggccaggccgagtcgtccattaccatcgaatgcgagacgaagcgtaacctgtacttggactcacaacatgaacagtcgtggcaaaagattcaagtctgatcaattactgatctaagaggcttgaaatatattcaaaaattattttttaaggaaatcgaaggccgacaaccgacgaaagagccgagccccgagttgcacttcctgccgccaactttcattgtgccgttgtccaactttgaggacctcgtcgagggcgacgtcgtccgctttgagtgccgacttcagccggtcaacgacccgacgcttaaggcaatttaa

SEQ ID NO: 51624 - DNA, 297 bp, Heterodera glycines
  Genomic contig location: Contig_ID=SeqID_3723; Location=907..1203; Strand=-
  SCN-specific regions: Sequence locations=1-297
atgcgcgccacagactgtggatggattgggtcgctgagcagcgccgctttgccctcgcagctcaactcgacggacgaggaggactcgccggccgcgtttcggatcaacagcgtgtaagtgccgctgaagtggcccacattaatgggtatttattttagtaattattttgacgagtaattaattggtaattggatcaattagtggcaagaaaatgaataccttcccagtcagtctttataaatatcaattatttgcagagaatcagtatcagcagactatcctatcactgatcagtag

SEQ ID NO: 51625 - DNA, 1542 bp, Heterodera glycines; identical to SEQ ID NO: 3724
  Genomic contig location: Contig_ID=SeqID_3724; Location=1..1542; Strand=+
  SCN-specific regions: Sequence locations=1-186,208-211,233-416,438 -948,970-1013,1035-1542
  Gene Ontology: Biological process=regulation of protein activity, epigenetic

SEQ ID NO: 51626 - DNA, 1425 bp, Heterodera glycines
  misc_feature (850)..(850): n is a, c, g, or t
  Genomic contig location: Contig_ID=SeqID_3726; Location=157..1581; Strand=+
  SCN-specific regions: Sequence locations=1-406,429-472,494-918,947 -1425
atgcatcgcgcggaatgccaaaggcgaggcgagcaccgcggcgaccatcgaagtgcagacactggtcgcgcaggaggagccgacggtgcagcaaccgctggtggaaacactggacgccgcggagggcgaatccgtgcacttggagtgccgcgtgacgcccatcaacgacccgcaactgcaggtgcactggctgaagaacggacaaccgctgccggacgccaatcgctatgtgtaagcggaacataaagcaaaaaaaataagaaaaggagaaagggcgaactgattggaagcgaagtgatcggaaatgcaatgggacaaggcgaatgccatcatttttcaggcaaagcttcgagttcggcttcatcactttggacattttgtacgcaattgcggaggacgggggcgactatgaattggtggcagtgaacggaaagggcgaagcgcgcaccaaaacacacataaatgtgatgccgaagccgggccttctgttccaaccgcaagcgccaggcagtcaggtggcgaaattgggctcaaattagtcaattttatttaaaaattccctatcgacggcgccgtagctaaagctttacgaatgatctgacggcgccgtcgtcggatatattttttaataaagttacccaatgtttctcttttcgcaggtggtggacaacttggagcaccatttgcgtcaattcaccaaggcacaattggctttgacagccgaagacgcttggcaaccaggcaaaatgatttaatcataggggggtcttccgacttttttcacttttgcgttttgggacggtgccgccagcggtgccaatattcaatctcattaaattcttaagaaaanagctcaaatttcaaaaaatcagagagagaggaagagaaagagagaaaaaagaccccattctgctgaagtataaatatttcataatttaataatttaggagctcaacaggcgcccgctttcaagtccgaactgaacaacatcggtgtgcaggagggcgacttctgccgcttcgagacccaattagcaccgatcaacgacccgtacatgaaagtggagtggtacaagaatgccaagccggtggacattggtcagaaagaaagagcctattaaaaccgattttggttggaaattcacctgtaattaaggcgcccgtttccgcaacacgctcgactcgggttactgttgcctggacttactgtacgcgttgccggatgacactggcgaatacgcgtgtgtggccaccaaccaattcggacaggtacacacagacaaacagtggacctctccaagatttaatagttccaatttccacattaggcaatgcttacggccaagttggcctgctcgggcatacagcacgtgctgacaacgccgcagattccgcaaggtgaaaagaaaaaattaaaaatgtttca

SEQ ID NO: 51627 - DNA, 1176 bp, Heterodera glycines
  Genomic contig location: Contig_ID=SeqID_21040; Location=271..1446; Strand=-
  SCN-specific regions: Sequence locations=1-177,199-418,440-705,729 -826,850-937,959-1176
  Gene Ontology: Cellular component=extracellular space
tgatcgatgggattggagtgcattggtacactttgggcggacattcggaacaggacaaattccatgcgcaacacccggacaaaatgatcatttccacagaggcaaggaaaatggaacatttagagccctaattaagtgaaaaataatgaccgaatgcctctaataatcggaattgacttctctttggcatctttctttcggcatttatggtcaaacaatgctttgcaacaaattgctggcactttcaaggcatgtacgggctttatctttccggacgactcggggccacggctcggcaattggacccggggctggcaatacgggtgggacattgtgcagaacctgcgccattggagcggcggttgggtggactggaacttgtgtaagtcggcaaagttgaatatatgagatcatcattaaatgtgtgttgaaatatttattagacgcgggtgcagaaccgatcattatcgcattaattagcatacgctaattgggtccaatgtttgaacgcccggagctttcaatttttaaacttgtaaagagccgagacaaaaaaatttgaattgaagtttgcttgaagatatcttttgaaaaatacaaaaatttgaaaaaaaaatctttcttttccgcattcagcctcctcttcggaattccggcatgaaattatgcttttccttagaatcaatttgtaaatgggttagttagcctttttaaaaaataattattgccaggtttggacatgaacggcggtccaaattgggtgcacaattttgttgatgcaccaataattgtaaacgctgaacgagacgagttctacaaacagccaatgttctattttttggctcattttaggttcggaataccatttttgaccaatttaaatttgttatccaaaattgtccataattaagccgctttatgccgcccggctccgttcgaattggctccacactttttgcttcggatagccaactcggcactgatcaatccgcccaccctgttcagcatgtctccgtgacaactccacatggacataaagtgttggtgttgatcaactcggcaacaaatccattcaaaatacgaattgacgaagtcggccgatcagatggagaagagacaccagtgatcgaactgggcccggaagcaattatgaccctaatttggaagtgaaatatt

SEQ ID NO: 51628 - DNA, 1654 bp, Heterodera glycines
  Genomic contig location: Contig_ID=SeqID_21041; Location=92..1745; Strand=-
  SCN-specific regions: Sequence locations=1-502,532-919,958-1370,1396 -1654
  Gene Ontology: Cellular component=extracellular space
aagggatgccaacggcgctattcgcccggccaggacagcttcgtttgcgcgtgcgatgtttcgcattgcgatgcttttgaggatgggtcggtggacgaagtgccgtcggacactttggtcacttattcaagtgatcggaaatggaagcgattggaaagaaaggaaatgccaatgagggcaaaaggggcagcaacggaaggtgcggtgggcgcaaaactcataattagtggtaaaacagccaatttgacattatgccaatgaattccatcgtgttacgcgttaatcgaactgcgaaaaagaaccgttaacaatttccaagttttctgattccccaacgacgttttggttctgaaaacgaaaaacgttaacaatttaaatttgtctaaatattataaatccttagccctcatttaaaaaattttgaagtaaccttcaaatttaaatatgagtagatgcagttaaaataaacccgaaatttcaaaaaatattgggtaaaaattggaaatttttgataaaatattttttaattttctttttactggaaatttactcattttctgaccaaaacggcgaaattcatggtttttaccgtaaccggaggaatatcccatttgttgcagattgttaatcccaaaaacagaaaaaagtttagggtgtatgtaggcaaaataaggtcacctaaatgacaaatgagagaaaatcaaagcaaaaacaaaaagcaaagtgagcccttttgtaagggatgtgcacttgtggcacaaatgccgaaatgaattgactcccccccccgttttgatgatgtaattaaaaggaaaagggaaggaatggcactaaaacaatgctaaaagggcaaacgaagtgcggaaacgaaaagcacttctcatgttttatgcctatcaaaaccaaatccaatttcgctttttgcataaatgccaaaaatgacagcataaaaaacaaagactttgaattatttgcataggctcgttttgacatttttgtatttccattcaaatgctttcccttttaagaaagtgtttttccgtcctccgacaatgtcttgcggcttagcgtggacccatccgacaaataccaaaccattcttggctttggcggggccttttccgactcatccggcatcaatttgaacgcgttgagtgcgcccattagacgccatttgctcgaggcgtacttccattacggaaagggtaaccatttttttggccttctgctaaattttggcattcaatgattgtgacacgttccatttcctgattctcggccgacttttcactctcaattagtcttttgttctgctctcgtttctaatctctcaattaatttgcaatgcctttgccaatgccgccgatttgcccctcccatttcccccatttccccgcaggcattcgttactcattcggccgtgtgccaattgccagcactgacttttccacgcgtcaatattcctatgttgaccaggaagacgacttcgatttgagcactttttcgctggcgccggaggactttgaacagaaagtctgctgcaaatgaaaaattcaaaagaatcgcattttaaaattttcagattcccttcatcaaagaagcagtgagattaagcggtgaaaagttccgactctttgcttgtccgtggtcagtc

SEQ ID NO: 51629 - DNA, 58 bp, Heterodera glycines
  Genomic contig location: Contig_ID=SeqID_21042; Location=599..656; Strand=+
  SCN-specific regions: Sequence locations=49-58
tgccctaccgggaccgggacctgagcttttcaaaacccgggaccgggaaccgggaccg

SEQ ID NO: 51630 - DNA, 520 bp, Heterodera glycines
  Genomic contig location: Contig_ID=SeqID_21043; Location=183..702; Strand=+
  SCN-specific regions: Sequence locations=1-14,50-86,167-415,438-520
atgcttttgtgttcaaaaatttcgcactttcttctgcttttgcttggtgccctgctgttgttgtccttcatttcaatgggcaacggtaattaatttaaaaataatataattctaattttaattatatgaagaaataaaaatacaaatattatttaactttttttttggcatgataatgggtttacttatttcttctttctaccccccccccccccctcttaattagttggaaaattagtacgagtcagggtatactaccagcagtactgagttggcctagtacgagttggggctttcataaaccattcatactccaatttatagttgctaaaaagtgccaaaataattaatttttagtttctaaaaacccccaaaatggttttgctaaaaataccaaatagtttctaaaattcaaattaaggggggtgggtgtaaaatcgaaaattttcttcaaaaaacaaaaatattatgccaacccattaattagatacataattttcaaaatcaaaaattatcgtca

SEQ ID NO: 51631 - DNA, 565 bp, Heterodera glycines
  Genomic contig location: Contig_ID=SeqID_21044; Location=18..582; Strand=-
  SCN-specific regions: Sequence locations=1-159,189-565
atgaaccagcagcaagtaattaaaacaaaacgaaataatgataaattggtgcatgatggtgcactttatgtgtttcacaaattcagtaacgatggacttaagaaattttggcggtgtgagtttcatggcccggcagaccaatgcaagggtatgcaatatattattttgaattttgaaaatcttttaaaatccaggacgcttgcacacggatttaaataacgttgtgcagaagttggtcggagttcattcgtgcgacatgaacgctgcgcatgtggaatgtcagcgtcttgtaactggactcaagcgacgtgctgctgagacgtgcgaagcacctgcgaccattcgtgctcaagtgcttcaaaacacatgcacacctgtgctggcctcttttccgagcaaagatgccacaaaaaaggtgggttaatatcaaaaacaattttgtaaataattttgttttctttttattcaggtcatcaaacgtttgcgccgtgaggaaaatgcaccgcgagtcgaacctctcaatttggagcagttggagataacaggatacctatcgtgtttataa

SEQ ID NO: 51632 - DNA, 600 bp, Heterodera glycines
  Genomic contig location: Contig_ID=SeqID_21044; Location=760..1359; Strand=+
  SCN-specific regions: Sequence locations=1-155,177-600
atggcggtacgaaaacggcggtacgaaaacgtccaaaaggtacatcagaaaccaggggttttcagtcatttttggccataacttttttgtcccttaacgaaattttttgcaattttgcaggctaatagacgacacttagcgctatcaaatgataccatcaatgtttgatttgattgaacatgaaaacagttatagtccagggaccaaacgtgccccgggtcccaactgatcgagtccgggaaaaagcgcatgaaaatggagggggggagggaaagtgatcaccgatcttgaaaaagtcatctcgtcgatgagggacgaagaagaagctgttgacgaattggaattgtgttgtgctaacaacagagagagagagagagcgagggaaaaatgtgtaagcgctaaaatttaatttgacgaattttttatttaggaaatttgaattgaaattttctataaaactttaaggggagggggggggggggaccagtcattttaggtgagagttgcacccaaaaatacgcggaaatttatgcatggaagagtcccaaaatcagcgtttgtttttccccatcggtcgaatccttatcctgctgctgtaca

SEQ ID NO: 51633 - DNA, 2593 bp, Heterodera glycines
  Genomic contig location: Contig_ID=SeqID_21045; Location=5..2597; Strand=+
  SCN-specific regions: Sequence locations=1-11,33-215,237-255,277 -305,327-431,453-460,656-656,681-783,807-868,919-1206,1233-1457,1479 -1544,1606-1793,1815-1828,1850-2108,2130-2347,2380-2477,2499-2593
acaaatttaaaaaataatgggcattttaaaattcccttcctagaatatttattaaactcaaaaatttgtgtagatttgttgcctcgtctgcgtggtgctgggcgtttggctcatttttgaccgttacgcggtggacaatttggccaccgcaattggccacgtggtcaaaggccatgaaaacgacgagggactcagcgaattggtggcactcggaattcttttgtttatttatatttgttcatttcgttaaatacaaatttatttctttgctaattcaaataaaacccatttatattttgcaattgaattttaattttacaatttaaggcatcaaagcccaccgccgtccgtcagattggctatttgcttttgtttggcggcatcgccgtcattgtggtcgcttctttgggctgttgcggcgctgctaaagagtggcgtccgctgctttgctgtgtaagcaaaaacaaaatataatttaaatacaaaatttaataaaataaaataaatatttattacataattaaataaataaattcataaaattttatttttgattttaaaagtttcgttatttgttttactttaaaatattatccaaatgttttaaaatattttttataatgtatatattttaattaaatatattgttttatttgattaatattattattattattattcacttttcttcttcagtatgcaagttgtctgatggttattttggcggtcgaaattgcggcgggaatttacgcagcgatggttggtggcatcttttggttcaacaaattaacaaaaacaaattaattgtcagcactcgcacatgttcgacaaagacttccgccaaattttacgcgcttcattgcgcatgtaaatttattttaatttaattttgtttatttataaattctttttttaaatgcttttccatttttaggtacaatgggacagagaatggcgtggagggcagcgactcaatgctggtcaaaacggcatgggacaagcttatgcaagaggtcgaggagcagggataaagcacattgaaaagtgaatgttttttgaaattcagaagagttgttgcggcgtcgactcgcgggtcggcgaatttcagcagagcgggtggtatcaggtcacacttttggtcccataattcagccgtttgatcgataagcaatgatttttttttgacaaatgccacacacaaaattgaaaaataaatatttttaaaattaattggcttttaatttcgtagcataactagccactagccaagaaaaaaattaaattttttacagcagagtccgtataaaatgacttggcaaaatttgagaattgattgggctaaacctccgtgaatttgaaaaattatgcaaaactcggccaaaattgaggacaaaaggcaatttttgatcacagatgaccaaaggccgtcacgaatttccgcctgcgtgttgtccaccgaaaaagaatggcaaattggcaccaagttgcccaacagtgttcagatttggcgaggtgaaatcagtaaaattattagcaaaatatggaataaatataaaagtaaattcaaaaattatttaataaattttaaattaaaactaaatttttgcttagcttttgtttaattattattatttatgctatttgcttttattttttgccattttgtaaatttatgccaatttgtgaatgcttttgaagggctgttacatcaaaatcagagagtccatccgcgaactgagcatccaattcaaattggtcatgtggacggccattgtcatttcacttattcaggcaaaatgatatgtatttacatgtcaaaatcaccaattattgaactttttgtttaattaattgcttatgtttcgcttgtgaaggtgttcggcataattgtggctttttgtctgtgcaatgccatcggttcggaggaggcggcctattgacaacaacaacaaaaaaatagaaaatgcatctgtgctcattcattttatgctgccctttttcccattcgttcgttctttgccttttgtctaaattttacattttgtgaataaaatttcgatttgttttgatttttttttttgttgtgaattcgggaggaatgcttcgacttttctctccttttttctgccagttttaccaggtttttttttcgaaaaaaagcaacatttggttattgatgtgggccgaaaatgaactcagctacccattggcattacctaaaacccgtccaaacgagggggggggggaaggtcgaaacaaaagaaattaggtccagactttttcaaatgtcgaactttagccctatcatttgtttgttagtggaacagaaaattttacttttacttgcaaaaatataaatatttattaatatttttttttgcgttttaagggttgccatgaccatctgtattatgagcattatgttcgcattgcttttgccatttcttttctgattctggtcggcattgtcgaggtgaaaaagtgaaaattaatttccaattttttttgattttccaccatttttaaactcctcccccatttgccatttgttcagctgttttgcgttctgttcacccacaaattgcacttccgt

SEQ ID NO: 51634 - DNA, 164 bp, Heterodera glycines
  Genomic contig location: Contig_ID=SeqID_21046; Location=194..357; Strand=+
  SCN-specific regions: Sequence locations=1-90,112-164
atggcgccaacacttcacatttccatcactcaatgcaacaacaattccacgatgatgaaaatggcttggaattatttgccactacggtaaaaagctcaattttttgtttaaaaatggtatttcagcggtaacggatcactattttattaattttaatgaaatta

SEQ ID NO: 51635 - DNA, 884 bp, Heterodera glycines
  Genomic contig location: Contig_ID=SeqID_21046; Location=1947..2830; Strand=+
  SCN-specific regions: Sequence locations=1-141,163-617,639-691,713-884
atgggccggaccgtcaaagacgaagaaataccggaagaaaaagagcaaaaaggcgacgagacgttcgggcggattcccgattcatcaattcctaaatcgctgattttgatcacgttcctctccatttaatcgtaccagccattatcatttcacctattttttgtcccattttcacttctttacaaattcatttctcatcggctggctaatctccggcccaagctttgtgcaaaacaattttgcacaaagttctttcttttcaatttctttaacttttcacatctgccaatttacattttatttttatgcgccatttctttgttcacacttttcacatcacaatttcggcccattttttgtcccatttttctcatcgcattatcgggccgtctgtcactccgcccattttgtcgaatgtctatttaagcggccctgcccaaggggtcgctctcttcgcttccttcacccccaaccattctttttattcgttttgctggacttttcgatcaattttttcaccatttacgcatttttaattcgtcgatcgcttctttaataaattttgtgtcggaatcgaagtctcgaattcgttttcgggggacacggtaaggagggaaaaagaccctcctcactccatcacattcgcctacgtcttttccctcaaccctcccggatcccaaattcccctcccatcagccactgggaaaaaattcgggagtgacccgaagtagcgccaaattcgagcagttcagtctcccaccagtaggagcagcggaagagacggggagaactcccgtcgtcgtcaagtccaagcagggcagtgaaggaaggaagagccgagcggtgccaaatcgtccgacgaaaggacagggccgttcgtcagc

SEQ ID NO: 51636 - DNA, 1086 bp, Heterodera glycines
  Genomic contig location: Contig_ID=SeqID_21049; Location=136..1221; Strand=+
  SCN-specific regions: Sequence locations=1-351,373-737,773-1086
atgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtaaacgagatcatgatggcgaatgtgccaggtcaa

SEQ ID NO: 51637 - DNA, 111 bp, Heterodera glycines
  Genomic contig location: Contig_ID=SeqID_21050; Location=139..249; Strand=-
  SCN-specific regions: Sequence locations=1-111
atgtctttacaaccttcaccattcaatgggtcaccagagaagccggatttgcattggcaatcaaagccaccgacaaaatttgtgcacaccgtattcgcttgtgggcatacg

SEQ ID NO: 51638 - DNA, 1331 bp, Heterodera glycines
  Genomic contig location: Contig_ID=SeqID_21050; Location=853..2183; Strand=+
  SCN-specific regions: Sequence locations=1-89,111-231,262-323,377 -467,489-599,621-631,689-818,865-916,940-1050,1079-1145,1167 -1204,1239-1272,1310-1331
atgcaaattgtaaaaatttggatggcacttttcgctgtgaatgccatgatgggtttgagcaagtgccaaactcatcggccggcaccaaatgccaagacatcaatgagtgcgacgacaaaacagtgtgccatcatgcagcaacctgtacaaatgtggagggcagctacctttgccaatgtgtggacggtttcattggcaatggcaaagagtgccatggtaaatattaagttctaaatttatgaaaataaattaatattaaatgcctatgaaatattattgagcaaaaatatcactttgaagccatatatttgtgtacagagttctttttttttattatttattttttgttttttaaaacaaaaacaatatttttttagccaccaaaaataaaatttgaaatttaataaggaggatcaaatttttgtaattctcgactgctcctgtcgttatcgcaaacctacaacatgtttaatatttttttaaatttagttgaaactttgaaaattgaaaattttgtggttaaaattttagaaaaaaattgtgattagggtattcaacaaacacactgttgaaaaaatatttggaaagattgcttttgttcaacaaaagtgtaattctatgcttttgaaagttttaatttttttaaaatatttgtcaaatattttaaatataattttttttaattttagagacaattttgtttccaattgggcagaaacgcaatattcttggaatttcaaacaagcaaatggattccaaagttgtgcaattggacttgccaatgcaaatatttggacaaaattattcccaattttacgtaattttaaaatttattttaatttattattttaattttcattttaaggtctcatctaacggatatatttcatttaatcttcgcttcaatgacacaatgaattttgatgaaatgtttaaaaattttcaattcaatggcggtgggccaatatttttgccgttattagcaaaatttgtgccaaattctaatgaatttatcgacattcaacaaattgatggttagaaattaagatgttttttttaaattttttataaaaattttgtaccagttggcaattttactcttctcaaagcttcgatttttttgaaaattcttaattaatttctgcaacaaatccaaaaattattttcggtactattttataatagaaacgaaacgttttgcagattttattcaaattattttgataaaaataatagagcaccaaattttatagggaattcgaaaaggaagacaattattatttatttattttaatttattagtttaaatctcgtgtaaaaaattattaata

SEQ ID NO: 51639 - DNA, 475 bp, Heterodera glycines
  Genomic contig location: Contig_ID=SeqID_21051; Location=543..1017; Strand=+
  SCN-specific regions: Sequence locations=1-113,140-236,265-475
atgtgccagctcatccggttgagttcttcacagctgctgctgctgctgcccaaaatctgtggttatgttacaccataatgttgcggttgcgaatgccgtacatttgcgacgcgtgctgctgctgttgctgctgctgctggcggtggtgccgttgttccgccgcccaccgtatacggtgcgcagtgcgcgacggtagtccgtgctaaagcgcgtaatactacggtaaatggaaaagccagaaattttttaaaaagacagaaaattcagcgtttttcaaagaaaatctttaaatttccaacaaaactgcccaccttatttaaattttttaccaaaaaaatattcctttgacataaattgtctgttaattgccagccaaatccaaaatctaatttgtttaaaaaaatataattcagttacaaaagtcaataatccgtaattaatttcagccctgatcccgattgtgctgggacgttag

SEQ ID NO: 51640 - DNA, 58 bp, Heterodera glycines
  Genomic contig location: Contig_ID=SeqID_21052; Location=900..957; Strand=-
  SCN-specific regions: Sequence locations=1-58
ggattgctggggtcgtgagttcgagtcccaccgggcgagttaccttttatgttctaca

SEQ ID NO: 51641 - DNA, 392 bp, Heterodera glycines
  Genomic contig location: Contig_ID=SeqID_21054; Location=300..691; Strand=-
  SCN-specific regions: Sequence locations=1-14,36-82,104-250,272-392
atgccgggcaagaaaaatggagtgttgtgcaagaagccggccaacaacggacagaacaacgagctgttcgacaagatctgtcccaacatggccaccaaatggcccgtcgcgcgaaagggtcaggcaaaccacggcacggccaaatcattttaaatgctctccctaactttttatcagatcggcagccgattagtccgccgttggtagcacaatcaatcataaaacggagtggccaactcggacaacctggagagcctggtctgcgagttctagagggacaggccagagaaacagctgcaggccaatctgatggactcggcgaattcgacgggaaaaatcaactcggacaaattgccgcgtccggtgcacttggttatcggcaacacggatga

SEQ ID NO: 51642 - DNA, 6330 bp, Heterodera glycines
  Genomic contig location: Contig_ID=SeqID_3727; Location=2660..8989; Strand=+
  SCN-specific regions: Sequence locations=1-275,297-483,506-525,623 -689,729-779,801-1045,1079-1193,1220-1395,1423-1685,1721-2010,2121 -2182,2204-2486,2509-2550,2572-3139,3161-3348,3370-3392,3414 -3503,3525-3532,3554-3743,...
  SCN-specific regions: Sequence locations=...3766-3768,3813-3954,3976 -4122,4144-4319,4356-4615,4661-4705,4729-5142,5164-5394,5421 -5483,5506-5715,5737-5777,5802-6134,6156-6270,6292-6330
aatagcccaaaaaattaaaaaatttggtcaatttttggacaaactcttaacaaatccgacggtaaaaagttgatcggaaatcaaattattaacggttcataaatttgactatttttttcttttcaaaaccacttttgcggtggaatttttcaaaaaaactaggaacagggggtccggcggtccttatcagggatggcattccgaggcccaaaaaatgtcggaaaccggaagtctttccgtgccatacccatacctggtgcctatcgacatctgcgagaaattttatgaaatttaatgcgatttgttaacagattttgtctaaaattgatcaaatgacgcatttttgactcaatttctacaggattattaagtagggttgcacccccgaacgtcggggttagaaaagtcggggttcggggttgtcggggccagcaagttcggggtcggggtcgaccaaattgttcgggtcggggttcggggtttttaaatttttaccttgtgccatatagtcaaattataatttccataataaagttttatttgtttatatttatttatttttttttatcataaatatttttgtatgctttaatatcttgaaaattttaaaattttttattttgtcggcaacattatgtctttttggcggcgacatttctggtgcatcgaatttctatattaataaatgaaattttgccggtttttacaaatataaacatgtgaaaatttaaatttttcccaatccggaaaacggtttcggatccggcaatttgaaaaaagtgaatcttattcaaaaaatgatcaaaaatttaataagtaacttttcgcatttgcaaatcaatgtttcatattgttaaattttcttctttcatacggcctgccaaatgtgactttcttctccaactttgagctgatcacggctcagaatttccaggaataacttttgatcaattggtaaaaaatcatccgatttgatcaatttttccatgttattgtcaatgtaagccaagcaacgaccagcaaagtcccaaaataaaagtgattgaaattattatttataattcaaaaattaatttttgtacattttcttgcagaagacgagcttcggctaaggcaaggaaaacatttggcaatttcgaaatgggaaagtcggcgaatgcttcgatcagaccgatgatggcatattttttggctaaataataaataaataataattaatccattggtgaaataaattttaatttttgacccgcataaaacacagccattgcattttgtccgtccaaaacactcaaattgtttgtgtaaataaagcgtaacatcgccttaaatggcacggcacaaatgtcagtgaccaccacagggttagaaggagcttaaaatgaaaaacgaaagtttaatttaattaaatttgatttaattgtccaattttcgtacaattccccgccattgtcccattttgagagtcataagcgaacatcgcttcgcacacatccgaggcggccatcagaagggttttatgtgccgcaatttgcttaaaaataaaaaaccattttttatttggccattgcaccctttgtataaaacatgaatatgtatgtatacagtaccaaatacaaatcattttcaattgtacagtagacactgaaaaactttgtaccgtactaaagacaattcctgtcccgattaattattattttaattgatatattttttaaatcgccctcactcgcctccttttcttcgtcttctgcaaccaaaaagtaaacatccgcgccattgcccgtgttcaacaaaagttccaactgatcaaccaacaattttggttttggcattgtgtaaaaacaatttcggccaaatttggaattaaaagctgaaaaactttaaaaaggtaagaaacaaaattattagagatcggtattttgaaaaaagcctggacctggattccatgttggacctggacaaaaatccaggaaaaatccaggcctggacctggattttttgaaactcattttaaaaatcaaaaaatgtttgaaaaaattaattatttgcttagaaaacatttaaaaatatctgatttataataataatgtgtttttaaatttatttaatctttttttgaaaacttgaaaaaacttcggtcacttgaaataataaattctaaaattttgtccaggaaaatccagttttttcctgtttgcctggacctggatttttttcacatttgacctggatttcctggacgaaaatccaggtccaggaaaaatccaggttgccgaaaaatggcctggacctggatccaggtccaggccgatctctaaaaattatcaagtggcgaaaagttgatgagaatctgaattaattgaaggattgggagacaaagtttggcgggaagagagtcccgcgcagaaatttcgcaaattttctaccagaacccgtctgttctggatgaattgttaatacctggacacagcaaattcaatttgtaaatttaaaataattataaatggaaaatgttttttttaatttgcccaatgatttgaggaaaggttttttgagactaaaagtttggtgttttttttaactttcgtatcgacgaaaaaactgcagaaaataaatgtttgagaaaaagtaaaagaaaaactcagtcaatgcaaaggatgagagaaaagaaacggaagagacaaaagggaaaagaaaaaaaggaatatttgtctgactaaggcattttatgggcagaaaagcgggtcaaccaaacaaaccgcgaccgaacgtgggtcagccgcggcggcgttgcgagccaaaatcggccagcaaaaaaccaacgccatttgagtcattaggacgctattaatgagtaaataaaaatacgctaaataaaataggataatatcaaaaactttaataacgaaaagatgggtgaaaagtccgtagaagtgaaaacaataaaaaaaacacttataactttgtcaaagatcttaagaaataatattggaaattctcaatgtcaatgttttcccgtttccgctcttcgtcgcttttcccttaagccttgtatgcttctgaaataccgatttcggcacgaattttcagtgcctttccaatcgcccagccgatcccgaccaaatccttaaattttgatacatttcaaaagcatttcatttcttggcacctccacgggtttttcgataggcgagaagggataaagcatccgatctccaatggactggccaaaaaaggtcctcttttgctcatttcaaccatttaatatacccaattaaattatggaaaaatatgaaccaaatcttgcaattgacaaaaaaggcggtaagccatttactggtaaagctaaaataaaatttgtcagtaagttcattagcaaaatgctcacttaaaaataaacaaaaattaagcattcattgacaaagtaaactcatctcaaatttgccgaaatcagaagagcataaggaaaaagatttataaaaaaagacaaaaaggctgtcaataattaaccacaattaaataatgtcagaattttgtttactctccaaataatcatttgataactttgaccatcgatcagggattgatcaatcagatgaagctgccacattcttccggcttcgtgtcacaacattttcgcgcattgcaatggcatttagtcgtcgctttgtggcagtagcaaatgtcgtccaaatgcattttcttcccgcactttttgcagacgaatttcgactccaacgcctaaaatggaaatattttattgtacaaatttcaatttgaaaattcaaaaaacaaaacatcttattcatcagtgtcagcccaaatatcctttaacaaaaataggcccattaaaaaaagtagcgggtcataaaaagagaaaaatggacaaaaaagaagccaatttgggtttttgaacataatttaaaaaaattagtggaagcttaagtctcttggtaaattttttgctagaaaatgttgaatatttggtgcctttttccattttttcgtgccttttttgccatttttgtatttttttatgccttttttcatatttttggtgccttttttaggtgcctatttgagaaattttcgtgcctaaaagtccggtctctaattatcacccaagtttttgaatgttgttaaaagtagttttttaattttagtgataaatgtttgggtgataatattatacaataatggtggaaaaattactgtcccttggggcccagttggcggggcccagttggttggggcccagttggcggggcccagtcgacccccaccgctgattcccaatccctggtcccggatttttcaaaattccgggctgaatttttaaaacttttttcccactttagttccacaaggtgcccccaccttcacacgcaagccacagattttgcaaaaaacatcagactctggcgacccggccattgtgttcgacatcggatttcaggttaaccatttgtaagagaatacaaaaaataactttgatcctaaaaactcggccaaccaaacgaacaattgtcaatttttatgatgaaatttcatgttgcgctacgttatttttaagaaaattctagaagatatttttggaaaaatcgctagtttcattttttttttaaatttttaaacaaaaaattttaaatttttttttcgagtttaaaagatatgtgggcgagtgaaaacgaacgctttccaaatttcttgattcattcttaaattaatcatctcattttttatgcaggctgaccaaaacccggaagtgatttggctgaacccgaagggcaagaaaatgaaggagtccagcagaatcaagtttgggttgacgccggacggcggcgctaacacttacaccgctcaattggagttgaaggtgaccgaaaataaattttaaaaaaacttgggatataatccgaataatatgcaaatttttattctaaaatttcaatttcttttttttttgcagaattataaggcaaaagacagcgggacgtacacgtgcaacatcaaaaatgacgcgggagaggcgaatgtggagctgacactgaacatcgagggtcagtttaaccacaatttttttaaatgactaatgacacaacatttaattatcggtgtgtttgggagtgaagtgagtgaaaatgctttatctaataccaaaacaacaccccgaagggttaaccccccccagactcaaaaaatttcaacaaaaaaaagttaccacgtttttcttaaaattttcgtttctgacaactcactaatccgtgcgcggtttgaagcttaaaacccgattaaaccgttcttccaacaatctcgcaaagtgttgatcaatcccctactggaaaatcaaaccctgctaattaattgatcatttctcgcaatcgcttccagccccttttttgttttattaaatttttgccaattgcccatttaaaaacagcatttttttttgttcgttatttttactaaaaccggaatatgtatcaaattgactttattttcgataatttttcaaatttaattttggtgaaatttcactgcaattctcttctagcagtactttacttttttgtaattttgggcaaaaaaaaagtcttgcatcctaaaaccaattttttttttaaatttcttcccctgaaataaaaaaacggttttcccgcaattttagacgacgaggtcaagcaataagccagagaacagaagagcgcgcaaactctatgcagtgtttaaaatggtgctgtgtgaatgctgttgttttacaatattattcatcacattattattattttatgtgtatgccgtgtgagtgtgtgttggttgctctctcattcttttatcatcatatctcttctattagatttgaatttcaaaatgataattaatttattttattgtgcaaatttgctgatcgaataattattgcataatacatacatacaataactcaacatattgttttattttaaattataatgaacccgattcaattaaaataatacgattaatgcaattggcacatttctagaatttttagtgggcccaatgaaaaaccataggtgaattcttattagttggtagttttacaatcgaaaattacatttagtataaataacaatctatgatcagcagtgaccctgaaacattaaaaatcaaatggtcgcttttatggtttttcttcgggtccattaaaccagggtgccttaattatgactaatttgatgcaccgaaattctaaccgtttgtgtttaacaatttgacaaaaaaacattatttattttttccttgttaggaccattggacgatgctggcgacgacgaaagtcaagcc

SEQ ID NO: 51643 - DNA, 621 bp, Heterodera glycines
  Genomic contig location: Contig_ID=SeqID_3727; Location=3874..4494; Strand=-
  SCN-specific regions: Sequence locations=1-115,151-413,441-621
atgccaaaaccaaaattgttggttgatcagttggaacttttgttgaacacgggcaatggcgcggatgtttactttttggttgcagaagacgaagaaaaggaggcgagtgagggcgatttaaaaaatatatcaattaaaataataattaatcgggacaggaattgtctttagtacggtacaaagtttttcagtgtctactgtacaattgaaaatgatttgtatttggtactgtatacatacatattcatgttttatacaaagggtgcaatggccaaataaaaaatggttttttatttttaagcaaattgcggcacataaaacccttctgatggccgcctcggatgtgtgcgaagcgatgttcgcttatgactctcaaaatgggacaatggcggggaattgtacgaaaattggacaattaaatcaaatttaattaaattaaactttcgtttttcattttaagctccttctaaccctgtggtggtcactgacatttgtgccgtgccatttaaggcgatgttacgctttatttacacaaacaatttgagtgttttggacggacaaaatgcaatggctgtgttttatgcgggtcaaaaattaaaatttatttcaccaatggattaa

SEQ ID NO: 51644 - DNA, 1174 bp, Heterodera glycines
  Genomic contig location: Contig_ID=SeqID_3727; Location=5923..7096; Strand=-
  SCN-specific regions: Sequence locations=1-82,119-294,316-625,670 -672,695-884,906-913,935-1024,1046-1068,1090-1174
atggccgggtcgccagagtctgatgttttttgcaaaatctgtggcttgcgtgtgaaggtgggggcaccttgtggaactaaagtgggaaaaaagttttaaaaattcagcccggaattttgaaaaatccgggaccagggattgggaatcagcggtgggggtcgactgggccccgccaactgggccccaaccaactgggccccgccaactgggccccaagggacagtaatttttccaccattattgtataatattatcacccaaacatttatcactaaaattaaaaaactacttttaacaacattcaaaaacttgggtgataattagagaccggacttttaggcacgaaaatttctcaaataggcacctaaaaaaggcaccaaaaatatgaaaaaaggcataaaaaaatacaaaaatggcaaaaaaggcacgaaaaaatggaaaaaggcaccaaatattcaacattttctagcaaaaaatttaccaagagacttaagcttccactaatttttttaaattatgttcaaaaacccaaattggcttcttttttgtccatttttctctttttatgacccgctactttttttaatgggcctatttttgttaaaggatatttgggctgacactgatgaataagatgttttgttttttgaattttcaaattgaaatttgtacaataaaatatttccattttaggcgttggagtcgaaattcgtctgcaaaaagtgcgggaagaaaatgcatttggacgacatttgctactgccacaaagcgacgactaaatgccattgcaatgcgcgaaaatgttgtgacacgaagccggaagaatgtggcagcttcatctgattgatcaatccctgatcgatggtcaaagttatcaaatgattatttggagagtaaacaaaattctgacattatttaattgtggttaattattgacagcctttttgtctttttttataaatctttttccttatgctcttctgatttcggcaaatttgagatgagtttactttgtcaatgaatgcttaatttttgtttatttttaagtgagcattttgctaatgaacttactgacaaattttattttagctttaccagtaaatggcttaccgccttttttgtcaattgcaagatttggttcatatttttccataatttaattgggtatattaaa

SEQ ID NO: 51645 - DNA, 1218 bp, Heterodera glycines
  Genomic contig location: Contig_ID=SeqID_3727; Location=8933..10150; Strand=-
  SCN-specific regions: Sequence locations=1-664,686-1036,1058-1218
atgcgccaattggacgcgtccattctcttcaactttccatcccttcgttttgtcggtttcattggcgacattttgcccgaatttccgcccgccgacgacgacgacattgctgccaatgcgtcgtcggatggccaagcggtggccaaatggctgttctcgccacgccacgacaatttgccgaaactgctgcttgtcaccattgtgagtgcgtcggttgaccaatggttgacaacagtggaacaaatcaaagcggtaattatccattattttaattagggtaagtcgggaccgggacttttcgggttgaaaaaccgggactttttggctgggaaaaccgggaatttccgggtataaatagttgttaaacgaatccaaagcttttacccaggaaaaatgtacgtttggaaaaaaatttcgacttttttgttcgaattcgggtccggggttcggaattgggcaattccgagttcagatccgtgatcagcgccctcgaaaaccctcaatactcattttgagcgaaaataaaaaaaagttaaattagggacccccattctttacgattgcccgttttttccctttttttttttttaggcattttccatcgcttcttctcctgttgctttcagcatttgcgttgtatttccgtattcctttccgtttcctgttgttttgccatttgaacacacaaacgaattcactcaagagaaattgagactgtcaaaaaaatttgtgaatgtttttaagctgatccgttgttcaattgcagcagcagacgatgaaaaatggatgatggaaattgatgaagtgattcgagggcaaaagaacagtaaaatttggatttgcatcggagacgacggagtcaacaatgggtgaacaattttaaaaatttgctaattttctcatttttatttttttcagtgttttcgacggattgcccgggccgagtggtgatcagtgatcagcgacagcaaaaaaaaaagtgaattgattgattgatgagattacaccgatggatgagaaagaaaaatttatcttgggcacaaaatattaaatgtatgtgtaaatgccttaggttggattcatgataaaaacagatttttttcaagaaattttttctcggcatcgttcaacaaattctccattttcccaatttactccttaggcttgactttcgtcgtcgccagcatcgtccaatggtcctaacaaggaaaaaataaa

SEQ ID NO: 51646 - DNA, 656 bp, Heterodera glycines
  Genomic contig location: Contig_ID=SeqID_21057; Location=145..800; Strand=-
  SCN-specific regions: Sequence locations=1-656
atggtggaaattgaaacggtcattttcccctttgaaaacattgtgtgccgacagttcgacgttacggtcaaagtgctcaaatggagatttatgtacaacaatgagtcatttgtggtggcactaaataataaaacgggggtttttaaagggcatttaacaggcaaaacaaaaaagcaattaagggaattgtttcttacgatgagttgccagtgatttacggttctgtggagcatcggattgacttgggaaggcatttagtccttagcattttcccattgctaaaggacgaagcgatttatgaggccaaattgtattgcatagaaaagacgaaagcattgatatcgcacttccaaattgatgcgaaaatgtgccaaaaggagtgttcaaaaatgatttttcacaaggaaatccaatgcccaacggaccaatacgatattaccgtatggaaatggaataacgcagcggaggtgtgctattggttattattactcattttgatagacataaaatgattcagaaagcatcaatcacccgtaaagaggtgcgcatgcattttaccaaactgttcattatggaaggccaagagcatcggataaattatgtcttggaacgcgacaaaaactaaaatttgcgaggaccaaattgacaaaattaaa

SEQ ID NO: 51647 - DNA, 548 bp, Heterodera glycines
  Genomic contig location: Contig_ID=SeqID_21057; Location=1320..1867; Strand=-
  SCN-specific regions: Sequence locations=1-30,53-352,376-441,463-548
atgagatgcttaagaaaattccgtcaattattttgggcaaaaaacccatcgaaaaattttgtgaaagaattgtcggatattttcacggaatattcgaattcgtttatggaaaattggatatcttttgagaaatttggaagcaaaaattttgaccgttaccgcgcttttgtgtggaagcaaatcacagaaaaaagcaaaagatctgaggaacgaattgaaatggacaaatttgttggcaaattgttcgagcgaaggcaattctttgagttggaaaaatacgacgcgaactttgaaaaactttttgccattgtgagaagaattaaagcacgcgagagcaaagtcatgcgaattttcatagaaatccccgaaataaaagtgacaaatttcagaaagtttttattccgaaaattattggcggaaatcgaagcaatggaaacgaattttatcaatgaatgaatgaatttgacagcacaactccgaattgaaaaaccccaagtcaaatcgatggcatttcaatattatttcttttttatggtgtccgaaataaa

SEQ ID NO: 51648 - DNA, 324 bp, Heterodera glycines
  Genomic contig location: Contig_ID=SeqID_21057; Location=2261..2584; Strand=-
  SCN-specific regions: Sequence locations=1-118,140-324
atgaatgggagtgggaacattgtcaggcgtttcttcctatttcaaataaaatgtgctaatgctcttacgaaaaatagaagaacggtttttcgctgctatattctttgctcattattacactgtgttttgttaaattttagaactcaaaattgataatttcaatataattagtagggttatcagccttgaaatatggatttatatggactaaaaacctttaccaaatcaaaaattttaacgtagtaatgttatttttaagcccctttcttcatagcatatgagcagaaaaaatttataaccttaataattagtcataaaaataaa

SEQ ID NO: 51649 - DNA, 1948 bp, Heterodera glycines
  Genomic contig location: Contig_ID=SeqID_21058; Location=848..2795; Strand=-
  SCN-specific regions: Sequence locations=1-280,302-479,592-804,849 -1809,1838-1948
  Gene Ontology: Mol. function=G-protein coupled receptor activity; Cellular component=integral to membrane; Biological process =morphogenesis
cgatgaaaaggcatttgaaagccatccttaaagtcggatccaaaaaagaccgttgcgtcgcttatgataatcctgtcaattgtcctctttcacagattgcttcctggacggagtcggcaagccgatctttcatgcccacgccaacactttttacggcgcgtggatgagaggttgggttaacaatgatcacaaagtgatcgctgatacgaaaactgtttgatcaacagaatattctctgatcaattaaatgtccatgagttcttttaaattgccaatacggaattggccataaatttgatcagatttgaccattcccatgcttttaatctccccctccctctcagatgcttatccccgctcggctgctgacttaaacaaacgttggttggccgtccattttgaaggcgattctctcatggaattcgcttccgaggccgaccttcgcaggtgagtagttctcgttgcatcaaggcacacagtcttctgctttccttgcgtttgcttcagttttcgtgcttttcttcattttccatttctgcttttccttttaatttttcgacttttcctctctatttttggcttttcctttttgattttcggcttttcccctttgtccccccaggggtcgtccctccgtcagtcattctctcccccaccctttccgtggctccaattccgtcttcttcaacggctccttcttttatcaccgttctggcactccaatgctggccaaatatgagctgcattcgcatcgctatgacgaagttcaaatagcggaaggaatcgcacataaatacgacgacgttaaaattgaaaaaaacaaatttaaattaataaataaattaaaagcatttaaataggcaattattaaaatttagctcaaaatactgtaaagaaaaaaatacatatgaattaaatttagtatttgttcaatgcttccaaaagttacatggacattgcggtggacgaaaacgcactttgggtactgtatgacaccatgagtaccgtactgcttgataaatttccattcccatttatttatttgttagttgctgttccatttcgaagacgtcccttatctgagcgtggccaaaatggacatcaacaatttgtccatgtacagcatatggaatctgacaatggtatattttaccatttgtcattaattacctaattaccgccaaattgattaaaatgcttttcccacccgcacggatcatgaaaaaacgtcgccggatgcttttttgataaatttttttcctttctcaaccatattaagcattctttttattgttctgaagcacttgaaaattctattaatctgcaaatttaaaattctttttcatatacaaaaaaatcagggcaaaaaaatacgaaaaactaagtttttgagtccttaaagccaaaatttaaagaaatttttgagatttggcagaataataacaaacacattagctgctagctatccaactaaaccaagaagacttaaatttgattgacaacaagcaaagttattgtccaaaaatcttccggcgccttttgcgcggaaccccgccgattgctccccccccctccccgcctcgccttattttctctcttttttcagattaatcacaccgatgtttcgaacggatttgtcctctgtggggttctgtatttggtgcgcagttccaccgaattgacaacggacatttcggtggcgttcgacttttaccgggaaaagtaccgtcagccgaacatccgctgggtgaatttgtacggaaatgccaatcacatcacttacaatccgtttgatcggtcagcgggggcaattaattaatttatttatttattaattgaggacaaatggcggatcgatggccaattgaaaccaaatgacaggcgaatttacatgtacgaccacggctatctgctgacattgccggcacggatcagttggagagcaaaa

SEQ ID NO: 51650 - DNA, 204 bp, Heterodera glycines
  Genomic contig location: Contig_ID=SeqID_21060; Location=102..305; Strand=+
  SCN-specific regions: Sequence locations=1-46,68-204
ctgccctcccactacgaccgcgatggtgccaatgccaatgccaaccatgcgctgttggcacggggcgacttggccaacgacgacggcaacaacgatccgatgggctttggccaggcggaagcggaccaaacggcacgccatcggcgcgggccggcactcatccttctgctggtcgtgttgccgctggttgttggcgcatttaca

SEQ ID NO: 51651 - DNA, 599 bp, Heterodera glycines
  Genomic contig location: Contig_ID=SeqID_21062; Location=603..1201; Strand=-
  SCN-specific regions: Sequence locations=1-176,238-454,476-599
atgccaaactataagttttcgtgttcgctgatcgcgaatccggtatgcatttctgccaattccaaatcccggacccaaattcgaacaaaaagtcgaaaattaaaatttttgcttttcatattattggttagcattgtttaaatacacggaaaggaactgaaagtcatcagtgcttcaattaaaaataatttaaaccatttttagactaaaaatgaaaaataaaaaaatttaatttttcgatttcttgttcgaattcgggtccgggatttggaattggccgaaaaggatgcctgattcgcaatcagcgaccccgaaaactttttgccagttttagagcctaaaaattgcagccttagtcgttaccctgatgattttttttggcgatttttcttttttttaccgtccatgcgataaatcaatgaattgttcataaagcgtacacctagccaaattttacaaaaaattcaaaaagtcgattgataagaacaggattgtaaatattctaacgattcacgatttacaaaatcctctgcaagtattctcaaaagaatttatttagaatttaaataccgaatgaatttaattcatgaaacaataaa

SEQ ID NO: 51652 - DNA, 221 bp, Heterodera glycines
  Genomic contig location: Contig_ID=SeqID_21063; Location=194..414; Strand=-
  SCN-specific regions: Sequence locations=1-221
atgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatggaattgtggtcaacaatattggatag

SEQ ID NO: 51653 - DNA, 177 bp, Heterodera glycines
  Genomic contig location: Contig_ID=SeqID_21063; Location=1505..1681; Strand=+
  SCN-specific regions: Sequence locations=1-177
ccgggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccta

SEQ ID NO: 51654 - DNA, 534 bp, Heterodera glycines
  Genomic contig location: Contig_ID=SeqID_21064; Location=186..719; Strand=+
  SCN-specific regions: Sequence locations=1-68,114-251,407-506
atggaacggctaattgccaccagtgaaatggtcaaaggtgttcaaattgttcaggaaaagccaggaagtaaaataaaaagaaaaagtaacattaattaaaaattatttattaagcgccaataattgctgtcattgtgccaaagtcattcaaccaaataactgttgctgatctgaagcaagaaatgatcgcaatctgccgggaacagaaggcaaattgcatgattaaccagaattttatatttacaaaataaaatatattttaaagtataattaatttttttttaactaattaatttaaatatttaaattaaattaattgaaaatttcattaaaaattaatataatttttttttattaataatacatataaaaaatttttgaattcaattttttcaatttagcttaacccgcccgaacaggtggccattgtgaaggattttccccgtgtgaatacgcgaattcaaaaatataaaattcgtgaagaattgaatgccaggaaattgtccttatattaattttttagaattttaaata

SEQ ID NO: 51655 - DNA, 1256 bp, Heterodera glycines
  Genomic contig location: Contig_ID=SeqID_21065; Location=252..1507; Strand=-
  SCN-specific regions: Sequence locations=1-95,117-125,147-255,277 -360,396-488,558-611,701-715,738-816,866-946,1036-1256
atggccaaggaatatttttcaattgtcatcaaaatgcttggccaaatgccaccgaaaattaaaaatttgttcgaaaatgacattgaaattttgaatttcaaatttaaaaacaaatatcaacaaaacattggtggcggaggtggtggaacaattaatttggacaaaattttggtggaaaatgcgatggattatgatgaggacacacttcgccaaactcatcggagtttaattgaacgtttcgccataaaaattggcagaatgttggagatgacaataaacaacgcttttgtgccgtcgaatgacataatggcaatcattgaactgcacatttatcaaacattttcggaaggactcaaaaagtaattttgttttttaatatttaaattctaaattaagaaagaattttagtattggctggaatttttagcacaagaaatctaggaaattttttttaaatccaaaatttggtaatggaaaaattaattaggaaattaaatttttaaaaaattcattcttaatgacggcaatttgaacaatttttttaaattttaaataatgctagaattttttttaccaagaaaacaatatgaatttttgatataaaaagcttcttaattttttatttaaataaatacatgaaacaattagcaaaaaaaaactaactttttattttaaaatttttttattaatcatttttaaactaagccaaatgtaaatttttggcatttattagttaaatttgaaggtggaataaaatttcattttctttatcggcccaaatgcacgatttgccttctattaaaaaattcattttgctttatttatgaaaataaatatctaaattttatttaaaaattaataaaatctgttacgatttgccattttaagtgttgccaatcccccatttcatcataaaatcgccaaaccaaatcattaacccttttatattaattaaaatttattaattttttagtatttattaatttaattaggtcattatttaaattttaattgaaattttttaattaaaattaaatttaagctggaataaaatttcgaaatctttatcggcccaaatgcacgaatcgccttcaaaattgccaattgatgtgaaactgttgaccaaatattttgtgtcaatgaaaattgcgatttcatttatcagtgcggcaattgaagtgccaatgttcacggattataaaaacactaagagcattcaattgataaaaagtgggtattttttacagaaattttaa

SEQ ID NO: 51656 - DNA, 702 bp, Heterodera glycines
  Genomic contig location: Contig_ID=SeqID_3730; Location=3328..4029; Strand=+
  SCN-specific regions: Sequence locations=1-337,359-662,684-702
cggtgttttcatccgtcctttcccatttgttccatgcgtttattccatgcattcaccggtgattctccggttaacaagcagtttttgctattcgtcatttttctgtgttttgtcgcaacggcagcggtgggaccgacgaggagaagtgcaattcgaaatgcgccaagggaagcgaaggcggacgaagcgacgccaaagtgcgacttgggagacatcgagctgaactcggaggaatttgtgcacacgtgcgacgaggacaaattcgaaaatgctaacatttactgcaaggggaaactgctggaggcaaggaaaagcggattaagtgtcattcaggaatcttgaaacatttttaaaatgcgaattgagaactgaaaatcaaaccattgaggggttgatttatgttataatataaagcgtttttttgaggcagttaattaccaccaattgttggatgacaatgactcgaaggactttgtggacagaccgttaagaaggaacgccagcgaagtgctacgtcaattcgagcagaaattcggaggacaaaacgaatcggcgagcagcatcgacgtggaagaattgagggattttctcgatgaaaactttgatcgcgcaggaggcgaactcaaaaagtgggaaaacggacgaatcattgggaggggggcaagcaaagaaaatgagaaaggggaggaaaagcctaattga

SEQ ID NO: 51657 - DNA, 547 bp, Heterodera glycines
  Genomic contig location: Contig_ID=SeqID_3731; Location=673..1219; Strand=+
  SCN-specific regions: Sequence locations=1-72,94-488,510-547
atgcagaaaaaggcgttttggttggccaccaaatgggtgctcagcaattaccgggtgtaccgttcggaagtgcccaggggcaacatgtgggagaaatacgcggtgaacaaattcaagccgaacaaaggcgttggcggtgaatacgaagttcaggtaatttgagggggaggggagggatttggtcgtcgcaattggacttttcctttgtcagtccgggttcggctggtccaacggagttatcctggacctgctgaccacctttggggatcggatggagttcaagaacgacttggaggaggaccccagcgcagtggccaaggaggtgatcaaggcggagccgcccaatttgcccacgcccaacccgaacattacacccgtactcaacggacccttcgtggcggttgggccgcagggcgaaggcattggaattccgaggccaagcggcgcccttcgaacagcgatggcacctcggcacacattgtgccgatggttgtggtggtggacaagcgtactcatggcactgctcgtcactcgcacaattcattga

SEQ ID NO: 51658 - DNA, 715 bp, Heterodera glycines
  Genomic contig location: Contig_ID=SeqID_3732; Location=2449..3163; Strand=-
  SCN-specific regions: Sequence locations=1-419,442-451,473-540,562-715
  Gene Ontology: Mol. function=ubiquitin-protein ligase activity; Cellular component=proteasome complex (sensu Eukarya); Biological process=ubiquitin-dependent protein catabolism
attgctgcccaaagactgcacgccgaattcaaacaattgagtcaattgccattacaggggtaagttctatacaataaattattctaaaatatcatgaatgaattactatactgttctgtgtaatgttaggtataagttgtcaggcgtccccaaacagtgagaacattttccaatggatcgcagtgatcgaagggccaaaagaaacggtttatgagggagggaccttttttgttgagctgaacttcaacaaaaattatccattcgatgcgccggaagtggtctttttgacgcgggtttaccactgcaatatttcaaagtgagaaaattataattgccaaagaattcaaattttaattagtgcggtttgatgatagagagatggatttttgatagtttgaattgaagggaccgacgctgggaaaatccaatttttaaagtgggaatttctaacctaattccattcagtcaaggaaagatgcgtctgcaggtgatcagtcgacaatcgtggcgaccctcctttggcgtggccaccgttcttcaggttttcccttttataaaataatttgctatcatttttttaatttagtctataatttctctcctatgcaattgcgacccatacaattcgttggttccgttaattggcgaacagtaccagcaacagccggaagaattcaacaaagcggcaaggatttggacagaacgatttgctcat

SEQ ID NO: 51659 - DNA, 483 bp, Heterodera glycines
  Genomic contig location: Contig_ID=SeqID_21066; Location=664..1146; Strand=+
  SCN-specific regions: Sequence locations=1-483
atgtcaaaacatcaaaaaagtgctgttacgccaccaacgacgacgacaacggcggcagagagtggcggcgaaagagacggacgcactgagacgacaagcggacagcggaaacgacacagcgcaaaccaaacggactcggcgaacggcgccgctgggggacaaggtttattcccgggctttggtttctgctgggaggtgttcatgtccacaaaaatcgccacactgttcgtcattggtttgagtttaaaatggccgggagtaaaattatttgttttttcgaaaaaccatatcggagatccttttgataattgacccaggtgcgttttgaaatacccaagtccattgactcgttaagttaccgattgactgccggccaaacaatttgtttgtttagggtcgaataacgccgttgttttgtcctcttctgagtcggctgcaaaggaagcaaaggtcagaaagatgtcgacaacatcgcagaacaag

SEQ ID NO: 51660 - DNA, 408 bp, Heterodera glycines
  Genomic contig location: Contig_ID=SeqID_21067; Location=1426..1833; Strand=-
  SCN-specific regions: Sequence locations=1-173,195-408
atgaagcgaaccaacgcaacaaacatcaccccgcctcgcgccaaacgttcaatggcaccggcaatggacccaatcactgccgcactcgcagaacaagaacgccaacgtagattggtgtttattggcctcccggaaagcaatgccgtttgcccatcggagcgtgttcaggaagacagggaagccaccaccaaaatcttggaccatcttgaagttgaggccgaaccaaccaccgtctttcgactcggccggtacgacccgcagcgaacaactccacgcccgctcaaggtggtcatgccaacacccacacaccaacacgtggcactcggaggatggaagcgcgagcgtgctcgagttcgttctcaacagaaccagacccgtctgttcgtccgcccggcactgtccaaataa

SEQ ID NO: 51661 - DNA, 810 bp, Heterodera glycines
  Genomic contig location: Contig_ID=SeqID_21070; Location=528..1337; Strand=+
  SCN-specific regions: Sequence locations=1-291,313-369,425-546,568-787
atgttgatcaacaatttgccgttttcaagcgtcgaagaggcggaaaaacaagcattggcccaatacccagatgctttggttagtttaactgatttgcaactttattcgggaaataagttcatgaatttcgagaaaaaaatgataattagtggataatgggttaaattttttttaaaaattcaatgaaaattgggtcccacttctgtcgaaaggtgaagccgaggaaaaaagtttgaattttaaattattaagaaaaatgaggtactttatttaaatttcactcattcaattttgactaaaattaaaagaaatgctacaacacaagaattaatcattaattttaataaaatggtatatttcgcacttccgaaaataaatttatttaaaatataaaaaatttcaataaaattaattacttttattacaatagaatgcaatgcaagcaatgtggaacaaagtgaaggagatgaagtcatgcttggcaacctgttttgcagggcgagttcagaatcaaactgcacaacaaattgtgcaacaattttcggttaaatcaattaaataaataattgtcatcaattcattaattagtctcaattttccctaattagagttccgatttcacgtcaatgaccccaagggacatgtgcaaccaaggcgtgaatatgcaccatcagttgtcagcggaggacaacaagaatttgcatgcgtgcagtgcccaacagattggcacaggcatggagccattcggaatgttcaaacatggccaaggtggacctgctgctgatggtatataatttttaaaaatttata

SEQ ID NO: 51662 - DNA, 882 bp, Heterodera glycines
  Genomic contig location: Contig_ID=SeqID_21074; Location=1067..1948; Strand=+
  SCN-specific regions: Sequence locations=1-172,195-420,442-519,541 -722,745-788,811-882
atggctgaattgttattgtctaatggacaagcgattcggcaaagaaaacgcgggggcgtcggggaggttgtgcaggaattcgatgcctttctgaaggtttctgacgatgtcaaagaggagccgaaagcagtgaatggcatttgttagttttggtcttttacaattcagtcagtccttcttcaatttaagtgtttgtgctttgcttccttttggtcgccgttcttctcattggcgaactttacaatttcatgaccaattctgaagttgagtatcgttttgctgttgacaccgactttcaagagtaagcaagctcataggattttgcaaatatataaaaagttttgcacttttttgaagaatccattttagtaatccgatgttggacattgacatggtcatcgccgccccctgcaacaatttggccattatgccaatgggcgtcgattcgttggacggcgagggcacaactcgcttaaagaagagcccaactcggtgcgttctgctgaaaattttcatgtgctccaaatatttagatatgaaatgagtcctgacgaagaagagttgtggacggcgttgcagcgagtccaccgggagcactttaagccgggcacttccctgaaggctttgaacgaagttgtctcggaaaggaatttgaatatcacaccgaatttgcttcttttcagataaaatttgtggacgacgaaattgaggaaggtcttcaagaagtggaggaagagaaggagcggaatgagcgaatcgaaatggaaattaagcgggccgaggcaaaggccaaggggcgaggggagggcacggcggaagagcacgtcatcatgatgatcggcaacggattcggcatcttccagattatcgcctcaggacgtg

SEQ ID NO: 51663 - DNA, 863 bp, Heterodera glycines
  Genomic contig location: Contig_ID=SeqID_21075; Location=134..996; Strand=+
  SCN-specific regions: Sequence locations=1-161,197-197,219-281,303 -461,483-672,695-863
atgcttaaaggatgtctgtacgttatcttagagctgattgctgttagtttgattcggttgggcaaatgttagaggcgatttaagcattttggcccttaatttctccggaaaacttggaaaattcaacacaactccgcctaaaagacagatttctgtctgcaaaagaaatagaaatgtgaaaaaagatttgttctttcttatttagcttattttatcagtttctttttggtagttattgagatttgattcgtttttatcaagtgtctctattttaaattaacacccctttttcgggaaaaaattcataaaatttttttccatcgtcatttcgccttctcctttttagaatcttaatattttcagaattgctacgtacagttaaaaattcagctcgatcggttcatgggaagtggtcaaactcccaaaaaacagggtgtctttattttaaattaacacagtgtattggtggctaaaggttttaaaattggaaaattcgcctctttcaggtcaaatcagcgttgttcaattgttgtcgacgcaaaatggacgcattggtgggacggttggggcgaagtgcggcggcggatgcgtattttgtacgatgcattcggccaaatgagtcgccagcagaggaaaatgtatttaaatagtaccaaaatcggcattggaaagattttaaattttaataattaatccgattttagcatttcgaccgttccgtcgtccttcgccaaatgcgtcagatggatcttttggccgttgtcgagcagtgtcgcgcggttattcacagccagttttggatattcgcactttgttggcgctacattattctcgagccgattttgcgtagtcctaaattaaaa

SEQ ID NO: 51664 - DNA, 896 bp, Heterodera glycines
  Genomic contig location: Contig_ID=SeqID_21077; Location=1131..2026; Strand=-
  SCN-specific regions: Sequence locations=1-317,339-896
ccttcgttttttttctggactgagaagacagaaaatctcctcgacactgttgtggactccttttccgcccaactgttgctcgcattgtgctcgcttctcaccattggcattggcttcttccggatgttacgctctgcggcagaatacgaagtgagttcaatgcgtgaacacagacagcacatcagcccgacaaaaacgcgaacaaattgcttttcagtcaaatcctatgctttttttgatcaaattgaaatcagttttgcttttgtcgggttacgagttgcaaaaatttgcttgttttccattgagtcggttactaattttgtttttcatttttaagtgcttcgactattgcatggccctctattctgtcctttgctggtgttgctctgcttgggcctcatcgtgtttgctgctctattggacaccttattggtcttgcatgaacttccgtgcggatgacacaaatgtgccgttggtcacttttgtgagtttggccgcccatttgattctgcattttccaatttctggatttttcaggtgttcgacatcgtcatggtgtgttcgttcgtcttcgagatgttcttcaacaattcgctggtgaaaaaacggcccgagaatgcttcattcgctgccgctaatcgcaaattgcgcaacgatgtcgccacggaatgtgccaatgtcgccattcatcgccagcagcagcagaagaacggaagtgccatcatcatgcaaacttaagcagaggacggacgagtgggatgaagaatgatgctggtgccaacaaacattcaatgcgatgaaacgatataaagcataatatgtatttctcagctgtattccattgtattgtatattccattatatcgcctatatgcgtatgcatggtctcaaataaa

SEQ ID NO: 51665 - DNA, 482 bp, Heterodera glycines
  Genomic contig location: Contig_ID=SeqID_21078; Location=1094..1575; Strand=-
  SCN-specific regions: Sequence locations=1-12,51-186,309-368,391 -399,451-482
atgccgacacaattcatcaaggtgttattaaaaaaccaactaataacaataaaaatgtgagttttataatataatgaattttattagtcaatcgaacatttataaaattttgtatgataatatacttatactttttaaaataggataaaccaacactgttacaaaaaattgagattataataaacgaattatataaaatttatatttaaatatatcggaaaataatatctaatagataaaaaaatgcatttttaattaacaattcatagttaaaattaaaaacaaaaaattgaaataagaaaaaaaaactcattttcagatagttaaaatccaaaacataagatttcaatataaaactattaattatgatgttttaaatactttaactaattttcaaagaaaaaatgattttttaatgaatttaaacataattcaaaactaaaaacaaaagtgagattcttacgctatcatatcataataaa

SEQ ID NO: 51666 - DNA, 870 bp, Heterodera glycines
  Genomic contig location: Contig_ID=SeqID_3733; Location=785..1654; Strand=-
  SCN-specific regions: Sequence locations=1-128,150-399,422-424,446 -591,613-635,657-687,709-790,816-870
atgtctcaaaaaagctgcatggaagattataagagacaaattgctaacgaagaaacttttaacaataaagagatcagcatgagattccctaatttcgtttcatttgcggtgggtgtcaattcaaaacaattaatttgccttttaaatttaaatgttcataattaaggaattgttggacccaagcaaaggattgtataaccaaaatgaggataaactgaaattggctattgatgtcactgtgaaattggttcatgggaagcggtcaaactcccaaaaaatagggtgtccctattctaatgcaacacagtgtaacacaaaaaaaatgaaaatattatcaactgaaaaaattgcatttaccattctactagaccaaaattatagaaaaaaggctcttttgaaattcgtcattaattttatcaaacctttaaaaatatacaaattttcaaaacaatatatgataaaaagctatttaaacttttactaatggacatttagttcaattcgcacccttttttcacaattataaacaaattgcagttacaaaattttgaatcgattttttacacctttggccactcctttggctgaatctgaaacaatggaaaagaccacaattcatgctgatttttcttctcagaaattttaaattttaaacctcagctaaattccccgtcccaaacttgcataaattttaattgttttattcgtctatgggcgatttttcagcagtatttatctgcgattgttccattttctagatttatagaaaacctagaattaatgaaaagacattttaaaaattataatattaaaatctatagtaggtgagttattttaagcttataattttcactacagatctgaaataaa

SEQ ID NO: 51667 - DNA, 191 bp, Heterodera glycines
  Genomic contig location: Contig_ID=SeqID_3734; Location=1114..1304; Strand=+
  SCN-specific regions: Sequence locations=1-191
atttaatacaccgtttcactttttctttgcttgtttgattttttttcagccgtttttcctgaccattccaaaattggaaattggcccgctaatttttctcgaattttttatggtctcatataacaaaaacgaatgtcttatatataatttagaccgttcgaatacaaacatggctatctttgctacttaaa

SEQ ID NO: 51668 - DNA, 1845 bp, Heterodera glycines
  Genomic contig location: Contig_ID=SeqID_3735; Location=759..2603; Strand=-
  SCN-specific regions: Sequence locations=1-229,252-517,539-768,790 -796,819-853,1134-1326,1350-1353,1375-1748,1771-1845
atgctggccagaagaaaagcaatgcggaaatgctttgccaattacgtggacgacggtccgttggtgatacgggatgcgtttatgggaggacggactgggccaatgaaattgctgcgcagggctgggccgggagagaagatctcttactacgacttcacatctctttacccatacgtaaagtgagtttttaattaaatttacagatataaatgtaatgcatattttatcaattatttgctgctgataaaatttgcttttaattttacaatgttgatagaaatgtatagagactttacaaaaaagcaattaaatgaaaaaaaattataaacatcgctcgatgagtagggttgagaattatatggaaatccatattttttctggactgtgggaggcctgaaacgcatgaaaaacgtttttaacttgggttgaagcttccaggatggatttctatatccatatttttccaaatttcgcgatttatgtccatatttccatatttgtaatattttggcatttaagcccatattttatgtccatattatggcatttttccaaaaaacctctattagaatggcccccatcagataaattggcctttttgacctttaaaaactggaaaattttccgaaaaagtcattttagtaaaattatgtcgaaaatgtttgattaattagattttcgaaaaattggtattttcccattttatgtccatatttcgcgattttttgtccatattttgcgattttatatcacatataattcccaaccccatcgatgtgtatttgttttttcattcattaaataatattattttttatgagtaaataatagttcatgagagtataggttaaagtttatttttatatttattccaaaaaatatatatttttattaatatttcaagactttttcattattttataaattttataattgtaaatttttcatgtaacatataaaagttaattcaatttattctgttttgtctattatattttaaatatttaaatttgttttaattcacgaagattattttcattccacttttttcattattaatagaatagattttaatttaaaatttatagtaattatttatattttacaaagattaattctttaaaatatttattcatatttgaaaaatggaattaataggagattaaaaaacttgctttatttagtattttagaacaattttcttttgttattaaaatattaaaaggattgggtgtgaatattaacgatctgaacaaaacaaaaataatttgttggcaaatttacgcttttcgcttttttatatataatttctgaaatgataattccttattaataaaatacataaattacattagagtcattgcttaggtaaattcaaaacataatgaatataattataacaattatataagaccatttatattaaaaaaacaaatgccctaatgtctttcagtcaactcactgtctctaattattctcttacgcatctgtactctctcacccgcccacagactgctctctcccatcctgcactctctcatctcatctctgactgctctcttgcacatctgtactctctcacccgcccacagactgctctctcccattctgcactctctcatctcatcactgactgcactcttccatcttgcactctctcatttcatctttgactgctctcttacacatctgtactctctcacgcgcccactgactgctctcttcttacatccttcactatctcatttcatctctaactgttctcttctgtccctgaactctcatcctcccactgactatctctaacttctctccctctctcacgtagctgtactcccaaataaa

SEQ ID NO: 51669 - DNA, 305 bp, Heterodera glycines
  Genomic contig location: Contig_ID=SeqID_3735; Location=2923..3227; Strand=+
  SCN-specific regions: Sequence locations=1-205,242-277,300-305
atgcggaccacagatttgacagcctgcagtccctcttctccaattgccgttttcaatacagccggggcaagcaattcgagcagcgatgaagtttggctgatgttcttttttccggctggagcgggtccaatgcctggtgttgcattgtctccaagtcgaacaccacaatacgataagggtcaatttccctgggctcaattagttgaatataaaagatctgcattttttaaattcttcattttctccgagattttcatgtggttttaattcattttgcatttattaatttaaattttaatcggaga

SEQ ID NO: 51670 - DNA, 425 bp, Heterodera glycines
  Genomic contig location: Contig_ID=SeqID_21081; Location=264..688; Strand=-
  SCN-specific regions: Sequence locations=1-89,117-324,346-425
atggccctcaaatcggacactttgcccaagggcagaaaaacatttgcaaagtgcggaaaagagcagccttatgtgaatttggagtcgacaaacacagaaaacaaaaagactgaaggtaataaatgagatggatcacgccgattaagcaacaatcgaaattttatgggccttctctcaccattttcaccatttaagcaaaaagttcgccaccggaaaaaacggacaaaacggcgacaaagcgaagggaatacgaacgaatggcaccaaaaccggacaaattagcgacaaacaacagtggggaatatgaaagattggcaacggcacagaaggagaagaggagagagggtgggcaaatgggaaaaaattgggggaagaaagaaaaatgaaatacgggggaaagggagacgaaattgaaacggaataaa

SEQ ID NO: 51671 - DNA, 348 bp, Heterodera glycines
  Genomic contig location: Contig_ID=SeqID_21082; Location=694..1041; Strand=+
  SCN-specific regions: Sequence locations=1-212,257-348
atgaataatattgatgatatttgcaaagaaatcgaactgcgtctgtccgtccatggtgcgttgcttggttctggatgggctacgatggagaccactgtcacttctctgctcaacagttagtggcgattagttttaagaaagggttggagttggatataagggaaggagggggcggggggaggttgtctttcaactccaacaatctgaaattctttagacaaccaaaatgacatctcaattctgaagagcttgcaattagaacaagaggcgaatgccggattactggtccaaaaagttgacggacttctggctggaaatgcagcggatataactgccatgggttcgtaa

SEQ ID NO: 51672 - DNA, 666 bp, Heterodera glycines
  Genomic contig location: Contig_ID=SeqID_21083; Location=88..753; Strand=+
  SCN-specific regions: Sequence locations=1-16,38-48,336-666
  Gene Ontology: Biological process=N-linked glycosylation
atgaggaaagagcggaagaagtgggaggaggaagagcgtaaaaagagtgaggaggaagagcggaagaagtgggaggaggaagagcggaagaagagggaggaggaagagcgtaaaaagagtgaggaggaagagcggaagaagtgggaggaggaagagcggaagaagagggaggaggaaaagcgtaagaagagggaggaggaagagcggaagaagagggaggaggaaaagcgtaaaaagagggaggaggaaaagcgtaaaaagaaggaggaggaagagcggaagaagtgtgaggagaaagagcggaagaagagggaggagggcaagaagagagaaggtaagcgaaaacactcggacgaattggcggagagttcggcagacgaaggtgagagggattcgagatttataaaaggtagttaaatattgacacattcaaggacgattgaggtcaaagaagaagctgaatgtttattccggatttgatcacaagcgaagttctctcaataaggtacgtcgaactaacccaaataactttgtataaacttcgaaatttagactatggacacggactatgacgattctttttggtctgacagtgattagtaaattaatcacttcgcctaattattttttgttgtaacatttaagcctcatatatcatcattttga

SEQ ID NO: 51673 - DNA, 1580 bp, Heterodera glycines
  Genomic contig location: Contig_ID=SeqID_21086; Location=54..1633; Strand=-
  SCN-specific regions: Sequence locations=1-657,679-1260,1282 -1333,1355-1580
atgaagcatccaagtcacagtactctgttgggatacataagggaaaagcactggatacccaaaggaagaaggttcatcagaaacacgatattgtctgagcgacacggatgcttgaattgccgcaaagagaggcttaaaccatatgcctatccacaaatgccaaacttgcccagtgaacgagttgcgatgataaggccatttgagaagacgggcgttgactattttggcccattaacaataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagccttatgtggtcagataatggcaccaattttattgctggagcagagtgcataaaagaggaatggagaagagaaatactggtagaaaccagccactcaggagtgagttggaaattcaacgtaccacgagcaccctggcaaggtggcgcgtgggagagactggtgggtatcaccagaagtgcgttacgaagaacagtggggaaaagcctcatggaaaggcaagaattcgatactcttgtttgcgaaatcgaagctgtggtgaacacaaggcctcttacattccaatcagaagaagaattcacacaaccgctcagacccgtcgattttttattgccatataaacgtgtggaaacaagccttccattgtcggacgaagatccaatggatcccgactatgcataccaaccccggaaaagaggggaattgcatcaattgatgagagttgcaataaaaagaattgatcgattctggaaacagtggaaaacggagtacttactttcgctcagagaaagagatcgaaccaaccgagcagaaggaagtctcccaagagagggggatattgtcctggttgaagaagaggaagacccacggtccatttggacgatgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcagggacccgcaaactgtcacaacggagtcaagtctgcctccagggacagtgatgcaggattcacaaatcgtcacgacagaatcgagtttgtctcctgtcagaggaaggaatgagcggcaagctgtgaaagagagaattcgaaagagacagccaacggaggaagtcagaggcaaaggcaaattgaagaagaatgggccatatgatccactgcgaccgggcaactacagaattcctcgccgaaacccgttctttccgtcacaagtagcgtacaatgagcaaacacgcacgtatcgacgacgacgggggaggacgattgatctttcgggattgaggaagttgttcgctggattgggcggcggcaagggagggactggaaagtcatttggcgactcggaaaaatgcac

SEQ ID NO: 51674 - DNA, 1569 bp, Heterodera glycines
  Genomic contig location: Contig_ID=SeqID_21087; Location=213..1781; Strand=+
  SCN-specific regions: Sequence locations=1-226,248-490,512-996,1019 -1024,1046-1286,1308-1569
atgcagaaaaggctggttgagcagtgggaattggtcaaggcacgccaatcgccggacgaaggtccttttgctcttacgaaaacccatttacgactcgagaagtcacttttaaattcagagacggagcccaccgaagaggaaatggtcgccgagagcacaatgagtcttttttctcgagaatgcgcttcttttgcttcgacttttattctcggcgaatcgttttcccccaaaaatgtgaagaaagaagcgatagtttcacaaatcgcccaaattctgctgatggacaaggtaaatttgttgagaccgaagcactgaaatgaactgaaaacaacggcaaaggaattgttcctcgacatgctcggactgctcgccaaactgatcacttgctccgactcacaggcggcggtcaaatgcattccgatgctcaacgtgatcaccctaaatgtacgcattgagaagcaaataaacggccagacaaaggatgcacaacatcaacatttgtttatcttcctcacttttacagtacgccacatcatttgacgaacaaaccgcggttcaaattctgatccatgccctccaaagtctgcaaatgtatgtgtccgatgaactcgctgcaggacccattctcacgctgatcttcaacatttattcaacattccgaccaaaataccccgcacttcttgaagtcttgagacaggtttcagttaacattttagttttatactatttatctgtttaattggatcaggttccgaattccatgcccgagaatgtcgagcagttcgaccaacgaataataacaacaatttcaaaacgaagaggaggggaaaatgcacgacaaaatcaagagggatttgatgaggaaggttttgatatcggtgagaatggaggaaggcttttgaaacatggaaattttcaaaatacagagaaaagtcaaaattcaccacggccaaaaaagttcgaacggaacggaggaagacggagaaatggattgaccagagaaatggcggaagggagattgttcttttccttttcactttgttctacttttgtactggagacgggatcattcgttgtttttgttttttgttaaagcgatttataacaaaaatggcagaaaaatatgaaacacaaattgttttgtgtgagattaaattacgcgtcacttttgttttccgtccgttcattttgcccgctttgccttcgattgcgcggtggcccctgagggttcctttctttttgttgcgcccgtcgatgcttcggccttttcttgcgtcgattgcttcttccgtccgccccttcccccctgggcgcccttttgctccaagcccaagtcgcccatttccttctccaccagtgaaattaaaatgttgcaacgtcgttgtaattcctgaaatcaattacataacataaaatagagccccccccccccgcaacaaacaaagtctacaggcccgtaacaagaaaaaaaggccagcaatagtatttctgctttggtagtgccctgatccagtaatgacccctcctcccctaccaattaaggctcataccatggcagttcgagagcga

SEQ ID NO: 51675 - DNA, 720 bp, Heterodera glycines
  Genomic contig location: Contig_ID=SeqID_21087; Location=1423..2142; Strand=-
  SCN-specific regions: Sequence locations=1-112,135-163,187-623,645-720
  Gene Ontology: Mol. function=helicase activity; Cellular component =nucleus; Biological process=chromatin modeling
acgcattcagaaaaggcatgccatcaaacaggcattggaggccaaaatcaacaagtacaaggcacctcagcaccaactccgtcttcagtacgggacgggaaaatgtaaaaattacacggaggaggaggacaggtgaaaagggggggggggaaagggagtcattggcaattaaaattaaataaataagttatgcataagccctatgtaagttatgatttcgggaaaatgagttattttcatctcatttttgcagatttctcctctacaacatttatgaaatcggacttgataatgaaaatttatacgacgaattgcgtcaaaatatccgaaccgctccccaatttcgatttgattggtttattcgctctcgaactgccatggtatgagccttaattggtaggggaggaggggtcattactggatcagggcactaccaaagcagaaatactattgctggcctttttttcttgttacgggcctgtagactttgtttgttgcggggggggggggctctattttatgttatgtaattgatttcaggaattacaacgacgttgcaacattttaatttcactggtggagaaggaaatgggcgacttgggcttggagcaaaagggcgcccaggggggaaggggcggacggaagaagcaatcgacgcaagaaaaggccgaagcatcgacgggcgcaacaaaaagaaaggaaccctcaggggccaccgcg

SEQ ID NO: 51676 - DNA, 274 bp, Heterodera glycines
  Genomic contig location: Contig_ID=SeqID_21088; Location=146..419; Strand=-
  SCN-specific regions: Sequence locations=1-227,259-274
atggccaaaacacagtattatggtcagtcgctgatggacaccggcacagcggcgttcatttttgtgaatgctatcgccgaccatgatggaatggcacgcggacaaagcccacggcagagggcggccaaggcgacaatgtcagtggacgggcggatggtttggaatgccgtggcacaatgccacactgggaaaattattgtgggcatttgtttcatttccttcgacagaaaaattaaaaaaaaaatttttttttattttcagtgcttttttgtaa

SEQ ID NO: 51677 - DNA, 126 bp, Heterodera glycines
  Genomic contig location: Contig_ID=SeqID_21091; Location=1192..1317; Strand=+
  SCN-specific regions: Sequence locations=1-126
atggcacggaaattgcatttttgtgccctcatttggctggtgttatggttggcgttgagcactgttcgccaagtgtttgacatcattggcaaactgtgggctttggtactgatcgacatggttcag

SEQ ID NO: 51678 - DNA, 329 bp, Heterodera glycines
  Genomic contig location: Contig_ID=SeqID_21092; Location=529..857; Strand=-
  SCN-specific regions: Sequence locations=1-113,139-198,250-329
atgacccacaccacaattggagggccgagagggttaaaggttattctcatcaccgaaccgatttccatggcaaagtaattgctttgaatgtaaacaaattgttagaaagactgatattttaataatatttatgtgtttaaaatactatgttaaattgacacaaaactaacaatttttagaatttttcaaatacataactttattttaaaaaaaatagttttcactaataaataattctttattttatttcagtgacgaaaggttcagtgacgaaaagtttagtgtcgaaaggttcagtgacgaaacgttcggccaccgataaaaataaa

SEQ ID NO: 51679 - DNA, 210 bp, Heterodera glycines
  Genomic contig location: Contig_ID=SeqID_21092; Location=953..1162; Strand=+
  SCN-specific regions: Sequence locations=1-210
atgcaagaaaataactcatcatccgacgaagagggtcaattgctttcatcttcatctgggaatgaagaagcggctaaccaagaattaattcaattcatcgaatttaagtcaaagcgaggtgcctcacttcttgcacgtgatgggtttgagtaccaattcgagcgcaattcagccttagttgataatgttgaatattggaagtgtgttaaa

SEQ ID NO: 51680 - DNA, 426 bp, Heterodera glycines
  Genomic contig location: Contig_ID=SeqID_3736; Location=5..430; Strand=-
  SCN-specific regions: Sequence locations=1-281,305-426
atgaagccgaaaagacggaagaaacgcgaccttggcaaatgctttaacggttttatcctttgcttctttgttttcgtgataatgcccattaccaatttgtcaaatgcaattgttacgacactcaaattggacgaggattcgaaaagtaagtcaaaagagatgagaaattcgtgaagaaggttacgaaattccatatttctgatcaaatataatttgggttagaatgttccaatgcaatacatagatggcgaaattatgtcaaatgccatgatacaaattagaaattaaagtgccaaaattaaaatttaagtatcaagagccctcgataaattatcggttcaaaataacaataaggaagctgaagaatgtccaatctgtcttgaatcctttgaactgggcaagaagaaccctgtcttaaaatgttca

SEQ ID NO: 51681 - DNA, 338 bp, Heterodera glycines
  Genomic contig location: Contig_ID=SeqID_3736; Location=1289..1626; Strand=+
  SCN-specific regions: Sequence locations=1-74,121-145,174-276,318-338
atgaatgaacaattggctaagaaaaaccgcagaagagatggtgcgaaaaataattccataaatcagacagaatttctaagagaaaattaaaagctaaataaaatttagctcttaagaaaagcgaaaaattactttattaacttggataattatatataaaagaattttttaaagaaaaatcatgcaataaatctatatccattcaatttataatgagaaatgtagcgttgtcctatgggcattttgcaacgtacgcttggatgctatattggattctaaaaatataatttatattaaatatttaaatttaattattagtattcactcatatttgtaga

SEQ ID NO: 51682 - DNA, 1203 bp, Heterodera glycines
  Genomic contig location: Contig_ID=SeqID_3736; Location=3445..4647; Strand=-
  SCN-specific regions: Sequence locations=1-101,133-529,605-704,743 -1157,1180-1203
atggcggcgatcgaactcttttggccgacatcgaagcatctcttgccagtcattctgctggtaataagtggggaatggatcaaattaatggatcatttaccaataattattatttattttaaatatttttatgtttttcccctttttgatgagtgtgcccacagcctcggcttcgtccgtgccatgttcgccattgccgcctccgcttcttcccatgccagcaacaacagcgaatggcaggcattgagtacacagtttggtcagaaagtcactgaaattgactcgaaatgtgcagagtttggcattagcattggaaaagtgcccatcgatggccccaagggtaaaaacaattagagaagatctcattaattaattatcccgtacaattcaaggagaccactcccaacgaaatgtgcctagtacggacagtgtgatttccatgcccggattgaccggctcacacaaacattgaactgaatgatgagtgacggaatggaataacctaattgtggagttcgttctttgattgttataaatatttcactaatttaaaaaaaataactttttttattatagataaaattttccattaaattttttaattcacattaaacatttcagaaaaatttgattttgaaaattaatacgtaatttttcgaaaatttgaattttcaaatgactagaaaagctagagaatcagaaaataggttaagaaaaattaattttaattgtcaatttttaagacaagtatcctccgttcttagtggtttaagtcactcttttttaaggtgccattttttttattccgataaaaaaccaaaaaaaaaaacaatttcggcacaaaatgcacatataggcaaaattgggacgaaaaattcatcctaatagttcagaaccaaactaaaaatgttttttcaagcttatgacgataaaaaacataaagcgaatgacatttaaaaatgatgggcctaaattggaaaatttaatgaatttaaaaaaagttaaattcaaatgtttagcctgactttttatagctgttctttcgaatttaaaaagattcttttggcccttagggtaaaagaaaattcttttaaaatttgttcacttttcatttcacattttttgttcagcaaattctatttttctttctcaaagcgatttaaatttttattaaattttcgacttccataggcaacaaataaa

SEQ ID NO: 51683 - DNA, 190 bp, Heterodera glycines
  Genomic contig location: Contig_ID=SeqID_3737; Location=2329..2518; Strand=+
  SCN-specific regions: Sequence locations=1-190
atggagaaaaatttaaatttcattcggcaggcgaaatgtaaaaaccctccgagagcagtccagaaaaaacaacaacaacaacaacagttgcaattgatgcagaacggtgggccggatgcttatgagctgaaagaagtttttggctattataacaatggatgccatgaagcgtactatgtgtcgtggctca

SEQ ID NO: 51684 - DNA, 289 bp, Heterodera glycines
  Genomic contig location: Contig_ID=SeqID_3737; Location=111..399; Strand=+
  SCN-specific regions: Sequence locations=1-289
atgttcgccattgccgcttccgcttcttcccatgccagcaacaacagcgaatggcaggcattgagtacacagtttggtcagaaagtcactgagattgactcgaaatgtgcagagtttggcattagcattggaaaagtgcccatcgatggccccaagggtaaaaacaattagagaagatctcattaattaattatcccgtacaattcaaggagaccactcccaacgaaatgtgcctagtacggacagtgtgatttccatgcccggattgaccggctcacacaaacattga

SEQ ID NO: 51685 - DNA, 493 bp, Heterodera glycines
  Genomic contig location: Contig_ID=SeqID_3737; Location=945..1437; Strand=+
  SCN-specific regions: Sequence locations=1-86,108-286,308-493
ataattcgagccttactttactattatattatccaccatcacatagcaaatgctacaatttgcacttctgctgctctttatggtgctaattattttttaaaaatatagtagggtaatttaatcaaataattgtccgatttaataggtgtcatcatttgatccctccgctgaatttatggccaatgaccaaattagtgcggtgcaacagcagcaagtgaattcaaaagattcaacttttgagtttaattatgctttttttcccattttaaggctgtaaaaccaattgttggctggcatttttggtgggacggacgaaatcgaaattggatagcaaaaaatgcggaaaatgttgaaaaataaaagaaagcaaaggaacaatcgaaaatggacagaaaataaatggcgaaacattttataaaaatggcagagataagtgaatttttgtggctttcttggaaaacgacgaaagattggataaatacatatatttgtt

SEQ ID NO: 51686 - DNA, 142 bp, Heterodera glycines
  Genomic contig location: Contig_ID=SeqID_3737; Location=1804..1945; Strand=-
  SCN-specific regions: Sequence locations=1-142
attttatggaaaattttatgaactttttatcatccaacaaaattaaatcagtatttgtagtccaacattgggatggccttgttcaaaaatatcaacatttctgcggttttcggctttaatctcgaacgtcgataatcattaa

SEQ ID NO: 51687 - DNA, 323 bp, Heterodera glycines
  Genomic contig location: Contig_ID=SeqID_21093; Location=1109..1431; Strand=+
  SCN-specific regions: Sequence locations=1-100,122-154,176-298,320-323
atgcccgagggcgtcaactgtttgcgcgttgggcacgcggacgcgcaccgcgactcatacgtgattgtgtgcggttgtggcacaacaatatggggtagcgcattaatttgtttaaaacatttcgccaaagtttttgttggcatttttaaataaatttggcatctttcagaattttaattatatttgtttataggcttccgattggatggcactgatgtgttctggaccgcattgggctacgaagtgaatgtgattgaactgtgcgacatggacggggacggccaaaatgaggcaaaaaataatggggaaaaattaatttaaaa

SEQ ID NO: 51688 - DNA, 912 bp, Heterodera glycines
  Genomic contig location: Contig_ID=SeqID_21095; Location=1..912; Strand=-
  SCN-specific regions: Sequence locations=1-155,177-912
  Gene Ontology: Mol. function=protein binding; Cellular component =nucleosome remodeling complex; Biological process=chromatin modeling
aaatgggtgggagcgaaaatttacccctaacagtgccgtcggcatcggccagcagttcttcctcttcttgcagcctcacatttagtgagtttttgaggttaggtcagagtgaaatttatttaacaattcagctgaggctaagaaaagcattgccgagcaggaggagcagcggggagtcatctcaatgcacgtctgctggaatgacttttcacctgaccaaaacaagcgaaaagtgcgctggctgttcgaaattcaacaactttgtacgttagcggagaaatactctataaaagcccacaactaaaaacaaaacgggaatttttggatttgtatccgaaaatcataaaatccgaattttgtgtatttagtcagtgtccaacttcccaaaatgccgcgtgaatacattgctcggttggtgttcgaccgctcccatcgcaatttgatggtttacaagaaaaacaaaggtgccattgcctccatttgctaccgtccttttgccgaacagggatttgccgagattgtgttttgtgcagtagcagccgatgaacaggcaaatggacaaaacaaacaaaattggatcataatatacacaatactgaaacaaaatttgcttattatgcccatgcattgcgttattttaggtcaagggttatggcacgcacctgatgaatcatctgaaggattttatggtctctcagttgggcattttccatttgctcacttacgccgacgaatttgccattggatattttgctaaagttgttaaaaatcctatatcaaaattagttaatttagccgttttaagcaagattttgtcatgcaaatcccactgccgcaagggcgttacaaaggctttattaaggactatcaggtggctacactgatgtactgccaattgcatccaaagtcagt

SEQ ID NO: 51689 - DNA, 165 bp, Heterodera glycines
  Genomic contig location: Contig_ID=SeqID_21096; Location=772..936; Strand=-
  SCN-specific regions: Sequence locations=1-31,53-165
aacatccggaagaatttggaaccaccaaagtacgtggagcaggtgaaggcggagggcgatgcggcaaaaccgccggtgccggtcattccgcttcaattgcccgcggacgacggacaggcggcagcggcaccggccgaagcggcggcaccaccgccgccggaaaag

SEQ ID NO: 51690 - DNA, 2214 bp, Heterodera glycines
  Genomic contig location: Contig_ID=SeqID_21098; Location=117..2330; Strand=-
  SCN-specific regions: Sequence locations=1-141,188-210,245-403,466 -481,505-554,637-695,717-772,816-819,842-939,961-1001,1023-1148,1170 -1196,1219-1231,1253-1294,1391-1442,1466-1682,1710-1868,1890-2214
atgccgaaattgaacgacttcggatggcacttcgacgcggccgtgagacagtcgagcgtgagcgggaacggcacgcagatgaggagaatgcggcacgtgaacaaatcagccgtatgaagagaagatatggcatttttttcgtttttataatttaattgatttaaaaaaataatttaaattattatttgcgaattctaaacatttgctaggatatttatttttatttatctttaaaaatttatttgatttttggcatcggaaaatttaattgcttttttaagttgcgtacatatgaaacggagttggaatatgctaaacgactaaatcggcagcagataacagcaaccacaacaaataacaacgaagcaatggcagtggcaaaattggaaaatttggttttgtgaattattattgaaaatttattttttttttcacttttagattttttattatttctttttaattgaaaatgacaaaaaaaatatatatatatatatatatataaatgccaaaatttaaacagaaagagtcaaggataaattaaagaatattcgttaaaaattattttctttctttttgttttttatagaataatagttaaaaattaatcttataattttgaaattatttatattacatatagaaaacgacctgaatctggtccaggtgttgtttttttcctggatacgggtccaggccatttttgggcaacctgggttttcctggattttttttacaggaaatccaggtccaggcttttttcaaaatgtcgatatttattataatattttatttttaatttaaatttttaaaaactctaaaaaggcaaaatattttaaaattatcaaatttttccggcacaaatttccagatagttgaccatggtaagctgaaaacggagttggcacaacaacagcgagcagttgctgaacgtgaagcggcatgggacagagagcgtgccgaactcaaccaaacagtgcgctcgttgaacaacacgctggaggagttggagcaggagttgcgccaacgggaagtgcatgggcgtgaaatgcaattgcaatttgaacggacggtggtcgagcgggacatggcacaaatggaactgttggacaatgccaaacaaagcaatcataatcagcaacaccatcaccaacaggaacacataaatggtaataggaattcaggatttatctttgtaagaaaaatgggaaattttttagacgaattttggaattttgtaaaaaattttaaatgctgtcccaaataattattgataggggggggggtgaattggaatttatgataaaaataattatataaatggaaaattttcgatttttattaaattttcttcaaaaataataaatataatttaatttaatttttttttgttttttcttctaaaagatttttcataccatactagctgtattcgaaatttctttgctgaaattttcatgattttgaagaattgagaaattttgcccttaatttaatttgtaaaaattttctgtgtatatttcactttttatgcgcatattgcgattttatgtgcttataatttccccacccttataatgatagaacaattcgagaacatttgcatataataaatggaataatttatctaagaaattaagtttttatgctaattgcattttaaataaaatttgaatttacgctttcatttttgaaataaatttcaaaatcaaaaaacggtaaacatttccagcagccgcacatcgttcttcaatgctgcatttggcatcatcaaattcagctgagagcggaacagctgaagagcacaacagctcaactgcagcagcccatgtcgatggaggaggcccgtcattggcgagcagttcaggcattgacagcagcaccaccagtttttcagtgacagcggatgccaaagaaattgacacaaaacatttgcggttggcacgacgcaaactgattgaatgccgtcagaaagtggcacggctgctccgatcagcggagaaagcaatgctcggggaacggctcggacgggacgatttgttcggcagttatttgggtaaaacaaaaaagaaaagatttaaattttagacttaaatttttagtgaaaatttaatcccaaataattatttgaagaagtgatcagtagcgcccatattttttttgggcataaatcaaatttttttatctaacttattactttctataattaataaa

SEQ ID NO: 51691 - DNA, 514 bp, Heterodera glycines
  Genomic contig location: Contig_ID=SeqID_21100; Location=253..766; Strand=+
  SCN-specific regions: Sequence locations=1-514
gaacttggcggacgtaaatttttcagtaccttagactttatgtcaggttactggcagatcaaaatggaagaaaattccatcgaaaaaactgccttcacaacagaatatggcctttatgaattcatggttatgccttttggcttaactaacgcagtggctaccttccaaaggttcatgtctcgtctttttgacggaatgattaaccaatttttgttcgtgtatatcgatgacattctaatcgcctcagaatcattcgaagagtatttgatacacatcgaattagtcttttctcggattaaaactgccggtttaaaattaaaattggaaaaatgccatttttgtgcgaccgaactaccatttttgggtcacatccttacgagagaaggaataaaaatggacgcagataaactgaaaccagtgatcgaattgccaacgcccacaacaaaaaaagagcttcattctttgctaggatttaagacatactataggaaatttatacattcctttggtacaa

SEQ ID NO: 51692 - DNA, 2196 bp, Heterodera glycines
  Genomic contig location: Contig_ID=SeqID_21104; Location=41..2236; Strand=-
  SCN-specific regions: Sequence locations=1-118,140-207,284-331,353 -652,675-787,823-909,948-969,991-1026,1053-1239,1261-1415,1437 -1612,1676-1759,1810-1982,2007-2137,2160-2196
atggtttggctcggccttttcttcgcgccgcttctccccgcgataaacaacgttaagctggtgatctttcccttttattgtccggtttgtctctgttcatttgtgttgattcccttgccagatcatcatcatgtatatccgtggctgggcttgtgtcacttgcaatgtgccggcccgggaaatttttcgggcgtcgaggtgaaaagcaaaaaattaattaataatattattcatttgaagttttgtttttaaatcattcaaaattatttttataaatttatatgaagaataaaaacagatctttgtaaatttagttccaaatccttttgctttttatcattggaatatatatatttttttctttttttttgaacttttgtttttccatttcttttattttaaaaattttttgcattgaattttcaattttgaggcatcgttttgcccgtgaacagctgtactttctctgctggacattaaaccgatgctttgctaggccattttcagtgaaaattctcattaaattccacggattgggacgagttaatccgcatttaatccccaagtcaattggcggatgatcaaatgttttaaatcgggggcatttgctgtgatttcagtcaatcgacagaaaataacggcaaattctgttggaatatttttaatttcactgaccaaatattaaatattgaaaattcacagaaaaaaagcaaaataagaaatatttggttctcatttaaatgttaatattcctccaaattcaactgcattttctcaggtattttgcattatttaaaaataataatactatataaaatttatggactcatgaagagttttattaagatattcaactaactgcttttttatgtcaacaatttcgggcaaaatattttatccacagaactgttaaattttaaaaaattatttattgaattattaaaattggtaatcgcatctaatttgttgtattaataaaattttttccactgattaaatgaatccgatctgatttctcaaaaaatgtttcatttcaaaattacactaccccaattttaaattcatttccaaaaattgaaataaatcgagttggccaaattcgcccaattaaggtcctccaacttctttttggccattctcctctccgctctgctcttatgcactgtccccgttggttatgtgcttacatccaaacaaccttcggtgctttgtggaccattcgcgtgagaatttatagtgtattttatttaattaaattttcaaatctacaatgataagttctgttgaagagaacggcaccgtttctacgacgtgctcacggaactgatcattggaaatgtgccgaaaagggcgctcagatggctcagatacggcgcatcgccgggcgtaattatcccaaccattctcgtgctgccaattttatttattattttattcaaatcatctgtgtttttcagctcctcattctgttcattgtctttctgatctcattggttcggggacttcgcaaggcgaacacggaccttcaaaaacagctgatccatgtgagtaaatgaaaacaaaacaaaaaacattaatttaatgccaaaatataatgcaaataaaataatgctaatttatcatttaaaattattaaatttattaaatttattggttttttattatttaaatttttggtatttctaaaccactcgtgataatatttcttttttcattattattttctaaatttctttttaattccaatcatttttctcactaattaaaacatttttttaaactaattattttttattagtaattaattaactaattgcctgattaattgtcccatttttaaggaacgcaccgaagagaagcgaaaaatttttgaattggcgggcggagcaaatcgaaacaaaacgaaagcgtcgacaaaagcggaggagcagcggaagaaaatgggaggaggtgcaggacgcaaattggagcagggccaacatttgccggaggtggagaggaagaggcgcgagccgtggcgactctttgccaatttggcaaaaaatgtgagaaaagggacaaaaaagggaggtgggaagcgaaaaacttagcgaagggttaaaacatgaaatttatgggattttcgccagacgatttgagaaaaatttacattcaaaattttcctttctccaaacttcgttgattttggtgattaaa

SEQ ID NO: 51693 - DNA, 968 bp, Heterodera glycines
  Genomic contig location: Contig_ID=SeqID_21105; Location=634..1601; Strand=-
  SCN-specific regions: Sequence locations=1-263,297-774,804-968
atgcacaccgacccaaagtggggaaaagcggcggaggaagcgatgcgctacttcacttctcttgttgaaacgctcaacacaacaccggtgacaaattgaaaaaagcgacaataaatgaattttgtgaattttcggaactttacgaagcgctgagactgtcgttggagcgcgagcaattggacgcggtcagcgaacggacgtgccgacttttgctggccgagttcgagcagtccggcatccaattggcttctgtcgaggcaaaaactttgcttttctttttattttgcacattttatggctagtgactcgtttcattttattccttttagcgaaaacaattcgtcaaactttccgatgaaatcttcgaggctggtacaaattttgtggacggttgtgagcggcccgtgaaactcagcagcgacgagcagaaccaattcggagtgcgcacttcacatttgaacggcccatggacccaacaggtcgaccgacggctccgatggttcagctacagaaaatattttgaacacaacgaacagcaggtgaagaaaggcagtggaaaacattgttttatttaattgagtttttggatatttaaaaccatttaaatttctttaaggaaacctttttacgccgtttggtctccgcccgacacaatttggcactgctcaccaatttccagtcgtttgcccatcgggcccaaagcaactctttgctgggcacttacgaaaacgttcactcatttcttggcactgtcatcgaagtgaaattagcttcattttttaatatatatttttctttattttcagaaatttgtgccaaaatgtgccgccgaactcgccgaagctcaacaaattgtgcaaaagtgctcactcaatttcgacgcaattggtccccagttgaacgaatgcgacgtcgaattcgcaactgcggtgcctttttgtccatttaacactctaattactatttaa

SEQ ID NO: 51694 - DNA, 351 bp, Heterodera glycines
  Genomic contig location: Contig_ID=SeqID_21105; Location=2310..2660; Strand=-
  SCN-specific regions: Sequence locations=1-282,306-351
caatcgacggaccaaaaactgttggttctgctgaccgcacttaccagtgtccagggccaaaccgtgcggttggttgatcggctgaatgtgctcgcccgtgatcggcttcagcatgtccccatcactttctaattgctttgcattcaaatttcactctcttctttttaggagcgttcctcgtttattcagcatcgccattgctccaatttgttcccgggcttatttggacgcttctaaattaaagcacagcaaattacctatttcctttgtctattgcttctgtttttgttgctttaatgtgtgtattttacgatttctgtctgaaattttacgataaattgaattttaaaa

SEQ ID NO: 51695 - DNA, 1264 bp, Heterodera glycines
  Genomic contig location: Contig_ID=SeqID_3739; Location=67..1330; Strand=-
  SCN-specific regions: Sequence locations=1-40,79-185,220-239,261 -556,587-751,782-806,828-877,916-1022,1057-1076,1098-1264
atgccaaaagaatcacatgaatacaaacaaatacgagaagttttaatgaaaattaaaaagaaaaaatttattttatatggcgaggacaaagttgctgtaagagatgttgccacagcaataagaaacataaagggggtaattattgaaaatgttttttttaataaatcgaagttaattagttatccaaataaattaattagtattttataatttattaaagtagagcggggtcgggaattcttggaaaaaccgggaccgggacatgtcgggaccgcgatctggatttacgatcgggaccggaccaaccgggacttttacttgaaaaaagaattttttttttgtaaggtcaggcggtgccattaggcgctgtcaggaaaattttgaaaatttatagtcattttgccaagaatttaaagtgccaaataaaaatttttcactcagaccccccattcttaccagtgcttatttggtcccggttagtcgcggcccttcccaaaaaattgtcatttttggcgcaaaaccgcaaaaaatcctcctgtttttcgggccggtgctgaaatttttatatataaagaaaaaaaaatttggtctgaaaatcaaaaaacaaaatagcgcttcggattcccacatccgacgaaatctttttctggctatgggctgccttcccctatattgtcatgaatttttttttaatatcccatagaaattggaaaacatttttgaaattttagatattatctatcactcagccaaaaaaaaatgaaaaaataataataaatttgtttgaaaatttaggcggatcattattttaaacaatttgaaaaatttgttgaagcaatgccaaaagaatcacatgaatacaaacaaatacgagaagttttaatgaaaattaaaaagaaaaaatttattttatatggcgaggacaaagttgctgtaagagatgttgccacagcaataagaaacataaagggggtaattattgaaaatgttttttttaataaatcgatgttaattagttatccaaataaattaattagtattttataatttattaaagtagagcggggtcgggaattcttggaaaaaccgggaccgggacatgtcgggaccgcgatctggatttacgatcgggaccggaccaaccgggacttttacttgaaaaaagaattttttttttgtaaggtcaggcggtgccattaggcgctgtcaggaaaattttgaaaatttatagtcattttgccaagaatttaaagtgccaaataaa

SEQ ID NO: 51696 - DNA, 165 bp, Heterodera glycines
  Genomic contig location: Contig_ID=SeqID_3740; Location=145..309; Strand=-
  SCN-specific regions: Sequence locations=1-165
atgatgagtccacgaacattcaactcaaaagagtacagtcattacagagaaatggaggacaagatgacatttatggcattttgggcctatgttttgctaagcgccaaaagcaaaattttgattgacctttgggtaactggcgatgccacatttgatcacgattgg

SEQ ID NO: 51697 - DNA, 995 bp, Heterodera glycines
  Genomic contig location: Contig_ID=SeqID_3740; Location=2187..3181; Strand=+
  SCN-specific regions: Sequence locations=1-79,102-248,270-277,309 -541,563-649,678-679,724-744,777-791,820-865,887-995
atgagcaaagaacggcggaaaaacaaattaatccaattctacgagaattggaaatctctgtgaattctgttggacccaaaaaataataatttgccaaatttattgtccgtttcatcatcgtctccctcccctcactcccgtctcatcaattctgcaaatttggcaataaaattctgtgtcctttgatcatcaccgcttctacccccttttttcatgcgttcactattttcacatcaccattttttttacaatttcacaaatatataattggttttgttctctcttacattttaatctttattgttgtcattcatgttcatcggggatggaattctgacgctccaaaaaatttaggaaatcggaattccgagcccttctccacaaaaaaaatataatcgagaattcattattccatcccagatttctctatcgtcaacagtaaataaactcgacaaaagtttaaacgtaaatgtcgtgcaaaatgattaatgtacagttattaggtgtcagtcaaaaatttgggttctcatctccaggcacatttttatttctgctctgttttttgctaaaatgaaaaggtaatgaaatgatttggtttttttgagagttaataaaacggcggcgcgcgtgtgcgtcataatgtcaagacaaattaaaacaaaataaaataaaaatttgaaaacgaacaaataaacaaacaaatggatggatggatggacatagaaatggagagagaggatgatgattaattaattatagcaattaattaattaattgctttttgcatcatcggctcttccttctcttcctcctccttcagcagcggcggcgggcggtggtgttttgatggtggtggcactgctaatgccgctgccgttgttgctgttgttcctggtcaacaatgcccaatgcaaactgtacacaaccagctcatacgtgccgatggtaaacgccgtgttgggcaccgatcggatcaacttgggggaacaaattga

SEQ ID NO: 51698 - DNA, 61 bp, Heterodera glycines
  Genomic contig location: Contig_ID=SeqID_3742; Location=2333..2393; Strand=+
  SCN-specific regions: Sequence locations=1-61
atgaaccacaaaaaacttgaacatgaaggtcatctttatgttttcttatcaaattttggag

SEQ ID NO: 51699 - DNA, 183 bp, Heterodera glycines
  Genomic contig location: Contig_ID=SeqID_21108; Location=1570..1752; Strand=+
  SCN-specific regions: Sequence locations=1-10,32-183
atgactccgccccacccgcaccatcgacgccagcagcagcaaatgccatcggcacagtctgtcggcagtgccgcccaatttggacgacaaccattcggagccggcggtgggccgataatggcgaacaatgcaatcgcaaatcgaaaaaagcgcagatttgccgacaaaatggtggcaccggag

SEQ ID NO: 51700 - DNA, 741 bp, Heterodera glycines
  Genomic contig location: Contig_ID=SeqID_21110; Location=3016..3756; Strand=+
  SCN-specific regions: Sequence locations=1-63,85-308,334-617,639-741
atgttcgggccagatttggggcgaagccaagagaaggaggtgagagtcgggttggcacttgtttgccgtggagtggggtggagacacttctttggaagggaggcagatgaggccacgtggcggtggaaaggaaacctttaagcatttgaggagggtgttggtggggggtttgtacccttttcggaggggtaggccgtgcatgaaattcctgtttttcccatgtcgatgtcattggggcgtaaggcggcaatagtttcggcagtagtccagcaatccgagcattgacttaacaaatgggaagcacaactttttaaaaatattcagaaaataaaacacattgtcagatggactgaccgaaccgggcaaaaacaatcgcaacttttgcgacttcagtctttgcgggtcactgtaatccacagtacgcacccatgttacgatggaacccttgggggatttcctctaccgaaaagactatacttgaatttaaacaattttgaatagcagacgttcacagggcaattgccacgtactaagcacatcttcttcggtcttctcaatcctgagggatcggcacgtgtcagggaatgggtttgccacttatggaaggttaggaatgtgcctcccggcttcagggactcagtccggtcaaactcaatggacgcagtacaatccttctcagttctggcacatattcgggcggttgatcgtccaacaatcactattcagaagtcaactttctga

SEQ ID NO: 51701 - DNA, 641 bp, Heterodera glycines
  Genomic contig location: Contig_ID=SeqID_21111; Location=516..1156; Strand=-
  SCN-specific regions: Sequence locations=1-59,81-175,197-279,305 -526,548-641
atggcacatttggggaaaatccaaattttcaccaaagtaattggttttcatttttgtggaaataattttttttaatttaaggcccagccattgtctccaggtgatttggatggactggagacggcagtttaccagttcaaggcatttctcgacgaacaaccaatggtgcgaacgcttctttcaaaaaagacaaaagcccatttgctgcttcaccactttgttccgtttgcgcgccaacacggatttttagcccttttggatgagcagggtgggaccatatcatttttgggggttcaattttaaaagttgtgatttttcaggagatgaggcactgcattccgtgtggcggcgacttgagcaactttggaagacgatgccggactctgaacaaatgcgacaacagctggagcatcatttcgtctcgaattggctgctggacaccggcagactcgacgaattgaagctggtgagttgatggaaggggatttaaaattttaatccaactaattaagcgggaggaggaacaacgggagcaagcggaggaagacaaaacgaatgaagaaagtgatcaagatgccgacgtcgatatcgttgactgatcgaggattgatggttatttttcattacacatgacaaataaa

SEQ ID NO: 51702 - DNA, 107 bp, Heterodera glycines
  Genomic contig location: Contig_ID=SeqID_21111; Location=369..475; Strand=+
  SCN-specific regions: Sequence locations=1-9,31-31,56-107
agtggtctgtgagaaggtcaccaaaggggtgggtcccaggttcgattcccagtgcatgctattgatgtatttctatgattttaatgaataaataaaaggaaaagtga

SEQ ID NO: 51703 - DNA, 859 bp, Heterodera glycines
  Genomic contig location: Contig_ID=SeqID_21113; Location=252..1110; Strand=-
  SCN-specific regions: Sequence locations=1-246,270-287,309-442,478 -825,847-859
ctgaagaagaaagaattggccaattccccgggaattttccaaatgatcactgatcatttggccaaagaccatcaaatgaatgattgccggtcactaattgctctttctgatgttcagacaattcgggacgtcgtccgctctctcaggaacaggtggtccgctcgaacattgccaatgcgtgtgtgccgcgactggacgaagcggaatgtgaacggtgggggacaataaatattgtaattatccaactaattagaataattaattaattgtctttgtgtcatcctctaatcaccccttccctctcctcatttctcagttccctctgctataacctccatttccgcacaatggacggaacgtgcaacaatttccgtttgcctctccgtggcgccgctttccgtccctacagtcggtaatgcttttagtatttggacttagggccttaataacaatttaattttcatttatttattaaatgactctgtttaattgccctaatcatttaattagcaattgtttaggctgctcccgcccgaatatgacaacggattatcggagccaatttgtaaataacacaaaaaaaaactatttcgaattaaacatccacaatttagcctctattcgcagcacactgaggccaaatccgcgtgagattaacctgaacattctgtccaccacaaaggcattttgctcttttcggatattccaattttttctgtcaaatcgcttttagcaagtgaccgtctccgagttcaacgcccttctgatgcaatttggccaatttatgtcccacgacttggccaaaacgacgttggtcccttcggccaaatgcaatgtttgccagaatatcacttcccga

SEQ ID NO: 51704 - DNA, 700 bp, Heterodera glycines
  Genomic contig location: Contig_ID=SeqID_21115; Location=909..1608; Strand=+
  SCN-specific regions: Sequence locations=1-319,341-700
atggacgaggaaatgttggaatttggcgattcgctgccgtcgacatcagcgacgccaatcggcgatttggtgccgttcccgtcgacacccactgcaccaatggacactggagagatgacaccgccaccagtggccatcgacgagcgatcaccgcgcatcgaacagctggaaaagcaactgaaggaccgggatgacaccattcaatttctgcgcgagcaggtccgaaaccgagaagcgctgatcagtgatctacgtcgtgtgcggcaccatcaacggcgacaccaacaccagcaaaagtgagtgaaatttcgatgccttctcttttcccaattaattttctcaaaaattgatcattcattttttgtcaattttagcaacgccaaacagaggaagaccaaggaaggccatcgacgagctccaacgcagctcgcgaaaacggttgacggagcagattttggatgccattgatcgggaccgatcgagatcggcaagtcggtgttcactggagcgcatccaccgagaagtccggcacaaatacggccattatacaccaaaaaaggcaccagcgaagaagggcaaagatgaaatggaggccaatgacggcttgcttttgatgacccaacttggcacacagaaagcttatcagcggatgaaagcaacccttcgtctgatccacaaaaaattcgacattttaccgcca

SEQ ID NO: 51705 - DNA, 76 bp, Heterodera glycines
  Genomic contig location: Contig_ID=SeqID_21115; Location=364..439; Strand=-
  SCN-specific regions: Sequence locations=1-76
tagagaaaaaaagataatgtttttctctggcactctctatttattggtacacatctcgttttttgaaacggtgtgt

SEQ ID NO: 51706 - DNA, 966 bp, Heterodera glycines
  Genomic contig location: Contig_ID=SeqID_21116; Location=260..1225; Strand=-
  SCN-specific regions: Sequence locations=1-60,85-536,558-966
atggccaacggaagggtttggggacggccaatcaacaaaatttgcccgttggaagaagcgccgccaaaaatggccgaaatggatgatcaagccgatcaagcagtacatgtacgacatgaagtacaaacagtcgagactcagagcgaagcgagggagcagaacacaccctcggcagcaagaaaggacggagaaaatgaaggaagtaaaggcgaagaaagtgccgaaaagcgaggacgagaagttgaagctgtacatcccgacggaagagtaaatcgagaaatcagggaagacagttctcgagaaaaggcccccaacgattcggacggagaaaatggcggcgacacggcgccgctgaagtcggcagtttccgaaaaagcagcagaagtgccgtcggcagcacaaggaaaagcgggaactttggcacacccgcattcggctcagagacatgagaaaaaatatttgggagatagttcgatggccccaagtctcctcaaggttcctaccaagtttcagccgaattcgacgagatctgaaggaggagataggtttggcgcagacggacctcaagcagttcaggcgggcgaaatcgggggcgaatttcccgaagcaccagcggtcgaacagcaccaaaatgaactcgaacaaactcccaacaagcccgtggaggaagtacacgacggaaaagacgtccgagaagttcaagcagtacctggagctgaacaaaggaagtcggccaggactcggagaaaccgggagatttggtccccggagcgtcatgtttcacgaaagcgaggcttaattaagcccaaaacgggaatggcgctgctgatcatgctcatcagcattgtcggaacgttcggctgccagccgtcaatgcgatcatcgggaatggacccgaacctgccatttcaagaaggcccaaaaatgccatgtaccatggaatgtgcaaaacgtggggtcacaatc

SEQ ID NO: 51707 - DNA, 1526 bp, Heterodera glycines
  Genomic contig location: Contig_ID=SeqID_21117; Location=582..2107; Strand=+
  SCN-specific regions: Sequence locations=1-254,276-279,302-306,332 -1140,1162-1252,1274-1431,1459-1526
gtgcaagaagttatattttacatccgagttggacatgctgaaaagcgtgcgaatgggtgagctcagaaatgaatgaatgggtggtgggaaatgtttaaatatgtttataccgttcaattgaaccatttatcgcttttcaaaatttatagccctcttcaacgacctccaaatcgtcgaaggctctcatctcagcggttccaatcttagcgcccttttcaattttgtggatttattggccaaagtcaaacaaatgaccaattagcaaatgctaattaatgttttcttttctttagcattttccgtacagcacagaagaaggagaagaagcggacggaaatcgcactgaggtgaaagaaacgaatttggaggcgaatgccaacaatcgcttcagcgttttctgaacgcaagtggacgcgcccgcgttgtgttcagtcatttgagggattttgttgagagtgtcggattagacggatcggtcgctttggacgattggaaaagggaatttctgcgagcagaagtgagcaaagggaagagggattaatcgcaatcagcttaattaccaccgatcattccaatgagtgaaggccgatcaaggaagcccttttcccgtgacggaggaatgggaacactgcaaagggtgagaacgaaatggcaaggcaatggggggaggggcactatttgaacagtgatcagtttggtcggaaggtgatccttctgatcatcgcgatcggggagtggtccctctgatcactctgctccgagcgtttttctttcccatcaattttgagtttctgtccaatttttctgggccctccccccccctctcccctttgaaatgtgcgaccgttttgcagaagttcgcccattctccgcggcttcacctgcggcctttggatggttttccattcgctgacagtcaatgcttttcggcagaacagtaaatgatgaatgtgtgaagtgattgtgcattctctgtgctttcgcaggtgatcagcagaagcagttccatccggtcgccgttcttctcaccatcaaagattgggtgacgcatttcttcgcttgtgaacactgccgcgcccatttccatcggatgaccacaaaaacggccaaaattgaggcggcggtcagtcgttttcccaaaattcctctaacttttctttgctaaggttcgccaaaaggaggacgtctttctgtatttgtggaaggcgcacaatttggtcaatggtcggctgaggggccgcgagacggaggaccccaaattccccaaataccaattcccgccaaagttcctttgccccgagtgccgcaggggcgacaaattcgacgagggaaaagtgcgcgaatttctgctgaaatattacggccgagtgagaccaattgatggagagcagcgaacgacggagaacggtcgcggaaacggggaacacggcggaggaggggaggaaaaggaagaagaagcggataagcagcagcgaaacgaacggatgccaaaagtgatcgggggaacggcggaggaagaaaagtga

SEQ ID NO: 51708 - DNA, 535 bp, Heterodera glycines
  Genomic contig location: Contig_ID=SeqID_3743; Location=3029..3563; Strand=-
  SCN-specific regions: Sequence locations=1-535
aaggtgttcgatgccctgttcactgatccatgcgaaccacccccagcgctttgcaaagtctggaccatgggcgagaagccaatgcaatttgggggtgaatccagcggcattgtttgtgtcaaatgcagttggataggtctcccaattcttaaaaggggaatgtgagaaaaatgcaaaaaaattttttgccttgaaatagccatgaatgccgagatatttgtttgagaaatctgtgatttgttctgttgtcaataggtccgcacgtccaaaaacgtggagctcccgaatttcgtcaaggagggcggcaatatccatcgaaaagggtgttccaatcgatcggatttcggttgaggcgagaagtaggcgcttaatgtggtcgcctaaaatcgattcgaaaaaaagaaagaggggaatgtcaggaccagtatactcttgcgtcttggcatgccgaattgctcccgattttgccataatttcttctaattggcgtttttctgcggggcacccatttttttgaaaaaagtcaatgcatttc

SEQ ID NO: 51709 - DNA, 3308 bp, Heterodera glycines
  Genomic contig location: Contig_ID=SeqID_3743; Location=1..3308; Strand=+
  SCN-specific regions: Sequence locations=1-1766,1788-2164,2223 -2490,2514-3308
aggaaatgcgcgatttgcgtgcacctttggatctgctctttaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcggagccacgatcagccatgtgtttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaatatgttaaatccgctaattttggacaggccgacgttttgtctcgactgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtctttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgattttgcaggcccatgtgccgatggaaacatttatctcatcctcgtggatgcactttccaaatggcctgaagtgatgcagatgcgcacgacaacagccaagggcacaatcgaagctttaaatttggtatttcaccggtatggtgctccaaaagaaatagtgtctgacaacggaccaccatttacttcccatgaatttaaagacttttgcaggcttaaaggcattaagcacaagttctccccgccgtatcagccgcactgtaatggtcaagccgagcggatggtggacacattcaaacggcaggcaaagaaaaacgcaaaatccaaaaatcaacaatggatttcggaatttttgtttgcgtaccggtcctcgccgagtccaattttgaatggtttttcccccgcagaattatttttgggaagaacactccgcacgcccttgtcaatgcttgaaccgagacagcacacgccgaacgagaacaacaaccaacgtggacagtaccaatcgaggatgtcacagcagtacaaccgacatcatggcacaaaaagccgttcattcaattcaggagactcagtcttagtcttgaattatggtaggagtggtaagccatcatggttggaaggtaaaattgtgagaggtagtggtttgatttggaaaatcgaaattccaatccttggaattacagtaacgcgtcacgtcaatcaaatgcgttcattttccccttacatttcaagtaagattgtgtccgatcagattcaagccgctccgcaacaaccaattcctccaatggcgccaattcaaattgatcagacacctgtccgtgatcaaactcctgtccgtgaccgcacacccgaaccagtcaaatctcctcgtccgcagcgacagcgcaagaagccaattcgctattcgcccggctaattgccacggacggtctttccaaaagagggagatgttggatgtgttgatatttaatattattaagtttcgacacgaatacttttattgattagttatttgttgatgggtcctctcccatcgactcattcttcgcatttgtgttattttacatttcggtgtttatttttcggactttctaatttgactccgtcgttattttattattattttgtgattctaattttattgtttattcatttaataaatttatcttgtttgtgtgttagcaaaacacaacaacactgatgttgggattcagttggcgacaaaggcagcagctgaagaacattctcgtgaacatgctcgacgccgaaacagctgaaggaatggattttttgtcttcaacacatgaagtcaatgccctgcgccgacgtctgacaagtcacgctcgttttgaagtgcggcacagcgaaggaggaacaacactgatatgtacgaacatccgtcaggtgttggtgcaaagagtggaggcgttgcttggccaaggtgggagaactgattggaaccgtgcagagtaaagatttaaggacgaatgaaagaatttgagcaaaaattgtttgtgtcaattgttggagatcgaggatgtggaacaggcgacacgactagggcctgtactggaacagctctagcaaatcgctgatttgccatttggccgaaatttgacgattgaatggtcttataattttttgcattttttgcacattttttcttaaggtttttgcccggcgacatggctttcatctgcgcttggatgggacacatgggaccagcctccgttttcccttgtgcactgtgccgaattccatacaaagctttgggcaacaccatcatcgggcgaaggacagcaaagtcgatcgtcggtggcgccgcaatttttagtcaccgaacagcagacacgggcaagcacacaactcgggactcaatttcgtgtggaagtcagaaagacttgcctctctttttcgtgccgccaacaaatgtgatcccttcaccatttcacacgcttcacagtgccggacggaaatgcattgacttttttcaaaaaaatgggtgccccgcagaaaaacgccaattagaagaaattatggcaaaatcgggagcaattcggcatgccaagacgcaagagtatactggtcctgacattcccctctttctttttttcgaatcgattttaggcgaccacattaagcgcctacttctcgcctcaaccgaaatccgatcgattggaacacccttttcgatggatattgccgccctccttgacgaaattcgggagctccacgtttttggacgtgcggac

SEQ ID NO: 51710 - DNA, 2515 bp, Heterodera glycines
  Genomic contig location: Contig_ID=SeqID_3745; Location=105..2619; Strand=-
  SCN-specific regions: Sequence locations=1-165,199-246,278-498,548 -784,806-822,849-947,983-1011,1033-1040,1080-1300,1322-1363,1387 -1659,1685-1781,1803-1947,1974-2515
atgaggtcggtggaattgagactcgaagtggcaagagattgagtgcggccgcctgcgaatgttcaccgattcaggcaagtcaaaaagcaatgccaaatacaggcaggaggagtttttttttttttttaattcaaaccccctagagttttcaaatattcaattacttttactggcatttttaaaaaattcagattttttgaggggggggggggggggggaaatctaaaaatttctttcccactgtccaattattttttaaaatttgtttctaaattcttcgtatcgtcatggaatgagaaaggagtttttagcagatttcttacttaaagtttggccaaaaaattagccactttttgaatgaatttgcgtcaatttataaaaatttaccgcaatttttttttttgggaatttccattcagaaaaagcaattcatgtaattttaaattcggagttcatttgggtgggtttattcccctctcccatgtcgtttcccccccgaaaaaattttaaaaaaattcaaacatagaaataaaaaaaaaatttttttccagtgagatttcgaaaattttttggaaaaaaaattcaaaatcacatgcgtgtttattcagtccacttcaaatgccacaatgttgcacacgttggacgccttggccaagtggaaacagtccacgttgtgcttcaacgcctgtctcaaatatcggtgcgatccgttgcgcaaattcttaatgtacagccggcaacacacgtgcagacggtgcaaaatagtcagaaagttgttacaaaatgaggtaacaacaacaacaaattggtatttgatgggacaaaattttaaaaaaaaattttaaattgcgtattttttggtcaaaattgcaaaactttaggccgatgctgtctgtccatccggggaaaagttcgcccttctccaaacattttttggtcctttatggaaaaaaataatataaaaaaaaaaaaattttattttgggtaattttttcttcattttcaaagaaaatttttaatttaagtttttaccatcgaaaaattgtgagttttcaaaaaatttttatgaaaatttgggctataacacgtcaccctggcacaccaattcctttaaaattctcaaattttgtcagaactccggcgggttcgggaattttttttttttttttgtccagctcatcttggtatatgacaaggaggagctggaaaccacgctgctcaattacctctatttccatgcgcttaaagtgtttgacgcgaacgccgaccaacactatgccaagaatcgacgtaaaattcacggatttatttttatttattcgtataacggagacgaatagacaaattttgagagcggttttcgaaaacaaaaaatcaaacaaacaagggaattagtgacgccgtcgaggaaaattcggtttttatcctttttgtcaccccccccccctgaaaatgttttaaaaatatttttttctagggtaattttggcgctgaacacgaatctaacattagctttggccaattccgcatcccggacccgaactcgaacaaaaagtcgaaattcgaatttttttagaattacatttatgttagaacctgtatagaatgaccagatttgtgactaatttatctagttttaatcagttttagggcaatgtgaaaaattttttaaattttaatttttgttcgaattcgggttcaggattcggaattaatataaatgaatgtcagattcgtgatcagcgacctcacaaagccccagggaaggcgttttatacgacttttttaaatttttattttttcgaaaaatggggtggaggggacaaagtacattattaccacgatatactgtagttgactggtaaaaaattccacgtaacacacctaaaaaacataagagctaaaaataaatgtcatatacgtgttcaacgcataaatttaccctagaaaaattattttaaaaaaaaatttaagggggggggtgaaaaaaaggataagaaccgaaaattcaaaaaaaaaattatgcttttccctaaaaatttctcagatttttgtgtcatttttttggagtcatattttcaaaaaaaaaaaaagacaaaatcggggcaacgatttggtgggtttcagttaagaaaattgattaaatatgtccaaaaaatttggttattttttcacgaaaatttctcgatgcgatgataccattaaaaaaaacgacgaaatttgtcaattaaatgcaatctaatgtgtttaaaaaaatgattgaattttcctaaaaatttttccacacaacacattttttgcagcacaacatccctacttcagcgcgtacacccagttccgggacttgaaacgcgtgctgaccacgaacattgtcgcctgtttcaacgtgccaattccgctgcaaacggcggcacttcgcccgttcattttccgcacaaagctgcgcaccaaatgggaaatgcaacaaattgttggccgctcatgcgaagttggtggtcgtcatttgtctgtctaa

SEQ ID NO: 51711 - DNA, 1171 bp, Heterodera glycines
  Genomic contig location: Contig_ID=SeqID_21119; Location=246..1416; Strand=-
  SCN-specific regions: Sequence locations=1-388,410-595,617-1027,1049 -1171
atggaacatcaccagggacaagaaacttgggtacgttgacgctggctttatgtgattagtacagtatgccctgtgccgatgaaggaagtgattgatatgatcaggattaaatatcggaaacagtttttgaaaaaaatagtgattagaatagcgtttacggtaacaaatgtgtaaatgacatttcctaaatttgggttccgatcagcagatcttccgtctgatgttgagtgatcggaatagcttctgatcagacaattaactgatcagaaaaggaatagttcgataactaatcagaatttaaagcatgagaaaatgatttcaaaatgtataaatatgatcgtaaaggaattctattccacgcgttataagcatagcccataattataccttcaaattttcagatttattgaaccggaccgaaagggcgaggtcggaattttcagaaatttcgtttaaaaaaacttttttgtttccctgaaaatttaggaagttctccggcctcaatgcggcacaaatctttacgcatcacaagccgggcaaaccgcgattggagcaaaccgaaaccaagtcgaggagaaaattttaaaaaaatcgcaaaaaaatttaaatttaattaggtgcccctggtggaatacaaaaaggaatgggagaccattttggacaaggagggcgaaggcattttgccaaaacaatcgggcgactacggcttcgcctcccaggctggagaggtaaggtcaaaaatggcaatcaaagattgatcggatttggaagtgatcagttgagtaaaatgataggagtgacaaaaaaagtgatcaaacgaattagtaaggggtaaatgaaaaaagcatttaaattattggaaaaaagcaatcaaatttaaaaaggatattgataaaaaagatggatttaaaaaattgaatcaagtagtgatcactgatcaggcaaaaataatcgaataaatttggaagtgatcagaaaagatggattagaaaagcttcgtagttggttactgatcactaattaggacaaaaaaaataatttttttaaacttgaggttaacatcggcgcccgtcgaaaccaagtggcactgatcagaggacgtctgccaaacgatcgacgtaaggaggactaagttaaaagcccctaattgggctgcttctaagtgattaaa

SEQ ID NO: 51712 - DNA, 2358 bp, Heterodera glycines
  Genomic contig location: Contig_ID=SeqID_21120; Location=104..2461; Strand=-
  SCN-specific regions: Sequence locations=1-105,127-408,440-446,468 -498,520-648,747-1065,1194-1301,1323-1464,1495-1504,1550-1602,1627 -1813,1873-1875,1994-1996,2026-2087,2163-2358
atgtccaaatgtactaattaccatatccatcttaatatacagtactgtacacgcgagtatcgcgttactgtgattggattgagaagaacactgacggtgaggtgaaatgtttgtgaattggagaacacgaagactttgcaaaatgtgataaaaaaaagacgaacatttcaaggtttttgcaattattatccagattaattagttttatgcttaagtaaatatgctaatggataattgtcaaataatattgttggaaattgtcatttaaaatttgagacgtgaaaattttaaatttgagaagtgaaatttttaatttaatttatgcctttaaagctttccttactgttgtttctacggccaactagttgtaagtttgtttgtctttactaagttacaaaatttaagaataaaaaagtctttttattaaaatattttccataaaattgatcaaagttttttaaataaaacttagtcaatttacaataaattagggtgggtcgggaccggggcgggaattcccagtcctccgatgtcccggtcccggattttgaaaaaaaatcccggtcccggtttgccaataatttaaataaattttgtttgaaacactgattaaatatattatagtttaattttacgttaacttttgggttttataaaaaaaaaaacaaaaaattaattatttaattttttcatttgaaataaactaaaaatttgaattttttgaatttttttgaatttttaaaattccccggttggtcccggtcccggacaaaaaccgaggtcccggtcccggcttctcaggtcccggcaggtcccggttttggccaaaattcctggtcccgtactgctcaccccaaaatgcttgactcatgcttatgcgaattcctttggcgcgaagactgcaaacggcgcggtgctgatacattcgatgacattttacttcaaattgcggcttttatgcctccttctaaataatcccgccggcgccaaaactggcgcatttcttccctttttctacattttggggtgcggcagcctaatggaaaagtacccatagaaccaatgtataaatattatttgctatatttgttaaaaaaaacaataaatcaatttaaaaatttgaaaaaaaaagtctaaaaaatttttaaaaaattataattattaaaaaaggaaaattttttatttaaaatattgctaaaatctatttttcctagcaaaaactgacgggtgagacttttgtttttactcgttgacaatttgttattgctacaaaaatgacttaaaatgatgttttacacgcagtttaacacccgaaaaaagcaaagtattttgttagccctaaagcaaaactgtgcacgcaaataaacaattaatgaattttgaaatgctatttcgaatttaatttcattaatggtccatttgtttacacatatttcccaaaaagtattctttcgcccacattccaattatagttttataaaaaattttaattttctcatcgttaaataaatatacaaattcaaattcaaaaattaatttggcccaaaaatagtaatcaaattttagttcctaaataataagaatcattcatcaatccttgtgtaaataaaaaaaattattatttaagcccttatttgaataatgcttatccataacaaaaaaataattttcctttcgtttaacaaatgcaaaatcaattaatttaaatcgattatacttgcaattagtaagagaaaagtttttctgttgtttggatagaattaaatttaatatgtcctattatatataccaaagttagtaagacgtattgttgttataaatgaaaatttttcaatagttaaaaataaaaaaagcaattaaaattaaaattaagatttttattttttttatattcagttaattttctggctaaattttgaaagttttttttatcttattatgacatttttatgtttattttttttcattttacaatttttgcgttatttcatttagcaaataaaaattaatttaattttataaaatgttcaaaattctttgcctgttttcccttctgattgtgccaattcttacagcatcatataagccaaagtgcaaagtgaatttacaaataattaattattatgttattttaaaaatgaaaaataataaaacatttttaactttaagcttccatgctcaataattgagcactatggccaaaagaaatgcaacggatgtgagccgagttgcgacaatccgaacccaaagatatgtacgaaaaagaaatgcaattgctcttgcgaatgtttgccgggattatttcgcaacaaaaagtcgggaaaatgcgtgaagaaatgcccatacaaagcggattaa

SEQ ID NO: 51713 - DNA, 187 bp, Heterodera glycines
  Genomic contig location: Contig_ID=SeqID_21120; Location=2235..2421; Strand=+
  SCN-specific regions: Sequence locations=1-101,123-187
ttagcatatttacttaagcataaaactaattaatctggataataattgcaaaaaccttgaaatgttcgtcttttttttatcacattttgcaaagtcttcgtgttctccaattcacaaacatttcacctcaccgtcagtgttcttctcaatccaatcacagtaacgcgatactcgcgtgtacagtact

SEQ ID NO: 51714 - DNA, 329 bp, Heterodera glycines
  Genomic contig location: Contig_ID=SeqID_21124; Location=1..329; Strand=-
  SCN-specific regions: Sequence locations=1-329
atcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaagttcgaattactgggtttttgagttccttctggccataacttttttgaaacttaacgaaaatttttgagattttgcaaattaataataaacacatagagctatcgaacaacaccaacaattcttaatttgattgacagtgaacaaag

SEQ ID NO: 51715 - DNA, 1092 bp, Heterodera glycines
  misc_feature (21)..(21): n is a, c, g, or t
  misc_feature (263)..(263): n is a, c, g, or t
  Genomic contig location: Contig_ID=SeqID_21125; Location=4..1095; Strand=+
  SCN-specific regions: Sequence locations=1-42,82-83,105-286,321 -432,455-574,657-708,1038-1092
  Gene Ontology: Biological process=N-linked glycosylation
atggaggccgaagcattgccnagggcggcggagaggcgaaaaggagcggagacggaggaggagcaggaggagcagcagctgatcagctggctgcaccatgcccagtgggacaccatagccgaacttctggagaacgagtgggtccgcgaacagctcaaaatcggtgagtcagtcacaaaatcatgaaaagaaaaattcagtcccgactcgatgattcataccaaacagacagtatttcggggaggggggggggggggtaaggngcatgtgccctttccggaattcgaaaattttttaattgaaaaaaaatttaaaattttgcgggcttaatgggcatacgccgaagtttattcgggcaatttttcaactcattcttttgaaagctccaaaccttgtttaaaaaaatctgaatagcaatttctttaatcgaattattagaataattagtgaatataaataattaattttgtcggcataggtttcatttcgaatgacgaagcgaaagagcgactgacatatttggttagttttgaaatggccaacgaaatagtggcatttttaaatttggcaacagaaaaagaaaaaaaagaaaaaataaaagagatgaaaaagaaatatgaaaaaactaaagaggaaaaagagaaaaaagaagaaaaggagcaaagtgagcaaaaaaaattggcagataaaaacatgagagaaatgatcagagaagaagagaaaatgaaagagttaaaggtgagaagggaacaaatgcagagagaaaagcagaaaaagaaggcagaggaaagagagagagaaagggaaaggagagaaaaagaaacgagcgcaaaaatgaaaagagaggaaagtgaagagaaaagtagtcgggatagagaagaaaaagaaatgaaagagaccaaagaagaaaaagagggaaaagaaaagggagcagcaaagagaaaagaaaagggaaagaaaaaggggaaaacgcagacagaagagagagaagagagcgaaagaggaaaaatggagagagaaaaagaagcggaggaaaagagtttggagagtgaaatggcacaagtccaattagacggtaaaagaaatgtttaa

SEQ ID NO: 51716 - DNA, 2315 bp, Heterodera glycines
  Genomic contig location: Contig_ID=SeqID_21128; Location=73..2387; Strand=-
  SCN-specific regions: Sequence locations=1-489,512-540,562-604,626 -2032,2068-2315
atggttgccaaaacatgcaattggccccgatggaagttttcccgttacttgaacaaccaatacgggcaacaggaacaactcaagcatgatgcagttcagcttatgctacaggtcaatgcaccaatggatttggacggctacgacgcggacactttcgtgcctcacgtcgttgactactggaacaacgcgcagcgacaacaccgctttgctgtgttcatctttggctcgttgggacagtacaagccgctctacaaatacattgacaacacctacgacactccgctgctgttgtacttcaatgaggaccattttgatggtgtgcagaagcagggcggtctgcaaccatactgcttggagtgtgagcggccataccgaagaatgtcgacacacagtaaatcatgtaaggcgcgctgtgtgctgtgctcacgtgttggaccagcttttccatgtccatcatccgccggcttcttcaaaaaatgtaaagagtgcaacaaaaaattcacaaacaacggctgctaccagcaccatctacagtcaggcttctgcaaaaggtcaaaaaagtgcaaggactgcggtgctgtttgggatgttgtcaacaacactcaaaatggcagaaaagggcatgtttgtggtgaacgcttctgtaagatgtgcaacaactaccacaacatcgagcggggatgctacatccaacccattgagcccaaggaaagcgacgcctaccgcattgtggcatttgacttggagactatgcagcatactccatctgaaaagcccgaaaagcgtgagcatttgccgaatttcatcgcagcacgggtcgcctgccccgactgcattgaaaatgagagctggcgagaggcatcgggagggtgtgaagtgtgtggacccaatcgtacggttgcgttctgccagcgccacttcactgagacaacagtcgacaagcaagtggtggcggaaagcccattggaagcgtttgtcagctggctgataaacgacttgcctttggcctacgacacctatgccttctctcactttggcggccgcttcgatatggtgttggtgttccgcgaactgttcaaacgcggatataatccggatatgttgcgcaaggtaataattgactatttttcaaatttgaataatttttcaattttaagggaaataaaatgtatgaaatgcggattcggaggcttttacttccctctacccgtatgtcaagtgagttttgttatacaattattcacaatttctaattgtttgtttcagtttctccaccacttacccaattgaacacccaaaagtgctcatcttgaatgaaaatgtggaatggacaagcgtacgcgacaacccatacaaattgtctctgctcaaggtgtgggtgatcccgccacgcaagtgcgatgtgccagtgttgccggttaaagtcaacgagcggctatgcttcccgctttgtatgcagtgtgctcttgactacccaaagggaggcgtgaattttgactaccaatgtgaacacgacgaccaacaacgcggatgggtcacaacatgtacatccattgaattggatgctgcgcttgaggagggttaccgtgtgaccaaagtgttccgactgttgaagtacaagcatggcgacgacaaactgtttaggccctacatcgccgagttcatgtcgcagaaaattgaagcgagcggatttgacgccagcattaagggaaatacagagttggagcagcagttcatcacagagtgtgcagagaaattcggcatttcaatcgataagaacaacatgaaagtcaacaagggcaagcggtcgttggaaaagctgtgtctcaacaacctgtgggggcgcttctcgttgcgcaactttggccttgcccagacgctgataaccgacgacccttcggtgctggcggaatacttggacaaccgctcagttgacgtcacttccatcgacgagttggatgcggaccatattctgatcagctatgtgcaaaaggagtgggtggaggagcacgagtgctccaatattggtgagattttaaagaattttttaaaaatatttgtaattttcagtaatctcgctgtggacaacatcaaaggcccgccttttgctgttgaaagcgatgcagaaggtgatgagaacgccaggatgtcggctactctacacagacaccgactcgctgatctttgtccatccgatcggcatgaatccgctacagactggaccacacttgggacagttccccgatgagtaccccaatcatgaaattgtggagtattgtagcggcggagcgaagcaggttaatttatcattttaa

SEQ ID NO: 51717 - DNA, 1073 bp, Heterodera glycines
  Genomic contig location: Contig_ID=SeqID_21132; Location=82..1154; Strand=+
  SCN-specific regions: Sequence locations=1-126,148-176,198-431,453 -471,500-662,688-708,730-843,865-899,921-996,1023-1073
atggacaaaattgatggcacaaaaactgttgtcaacaaatgcattttaatccgaattttgaaattgaagaatttatttgatggtaacattttccaaaatgtgagcgatttaataatggttttgtgttgctgatgatgatgatgttagaagaagcatgaattgtaattggcttaaactttaaaaaaaattaaaaatttgcaccgaaaaattaaatttgcaccgattgtcgcaaattgtcagaatagcgcaaaataccgcgcgaatctcaaaatggaaattttatgctcctgactgactgtatgttgacaatttattttgatgttttaaggaaattttttaatgtttttatggatgccttctcttgtttcatatgatggattgaaattggaaattttaatgtgattatttgcttagcttaacgagtatatgtatgcttttgaacaaataaatgcgcccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaa

SEQ ID NO: 51718 - DNA, 1178 bp, Heterodera glycines
  Genomic contig location: Contig_ID=SeqID_3747; Location=1792..2969; Strand=-
  SCN-specific regions: Sequence locations=1-44,66-186,208-229,262 -779,801-804,827-1107,1135-1150,1172-1178
atgctaattgacgcggcggcgccaccattcatggaagaaccagtagcagcaacagcagaagaggatcaatttaaatcagaatcatctgatgaaagtgcttcttctttgtttgaagaagaagaatcggaaagtgattctgatcaggaattttccaacaaaaaatcactgacaaataaaaaaagacgaagcattgatgggggaaagcatcatccattaaagaattggagacaattaattaatgaatattatttaattaaaaatgcacaaaatattaccgacaaaaaaattgctgaacagtttggcatcaccagaaaaacactgtgcacgtggaagaagaagcatgaagcagaatgtggtatggtgctttatttttttggaacctttttttatatttttggcatttttcttcgacttttattaggatttagacatttgtggcatttcttttcagactgccttaagcagttcccgaatattttgtgaaatgttgaaaaatatgccaaaaaaacctctcaaatttgtcgaaaaataagccaaaaaatcttctgtactgctaaccacctaattgcagttgcgcaaaagcaacttgccccatttcaaaatgaacacaatgtgagcaaaatggaaaaattgagcaccaccataactggcaaagcgccaatgatggataaaagaagagccaataaagtgaaaattggcggcggcacttccatggcaaaaaaattgaaaattggcacttctgctgggtcttcaaaagcacaaaagattgaaccacaacaacatgataaagaaaagaaaagtatttccattttatttcgacaattttaaaaatctatataaatgcgtaagagttggcggtttcttgaaatttttgaaaacctagcccaatcggttttaactctgaattaattggacctcaatttctctgcatgtttagttcagagaccgttacgatatcgatttatcgtacgaaattttcgatataaattttgcgatattccagaaaaaattgatcgagaaatttcttgttttccattatttttcgattgcgatttttttgaatgttttattgaaaaatatcggtcgaatcagttgtctagtctcaagtttcgttttgttttggtttgtttcaatccgccagctttttggcataaaaattttttgaaaattctaataaa

SEQ ID NO: 51719 - DNA, 2218 bp, Heterodera glycines
  Genomic contig location: Contig_ID=SeqID_3748; Location=67..2284; Strand=-
  SCN-specific regions: Sequence locations=1-209,231-356,378-834,856 -1077,1099-1320,1342-1429,1451-1720,1749-1781,1814-1941,1989 -2028,2075-2218
atgttatggccaatcattttcggcttattatttttgacaattgaattggaaagtgttgatagggacaagaaccgccgagatcgtgttgagccggggtcaagtgtgagtcaaatcccgacaaacaatggaaaacatttaaaaatgttgaaaattgtaaaaaaaatttaaaaaaatgttgaaaaataccgaaactctggggaaatggctttaatattttttaataccaataatttatgggcattaaggaacaaacattgccacaaaatgatatcgaaaatatgccatttgatgattttgtggatgatttatttacattgccacaaaagcatgtcgaaaatatgccatttgatgattttgtggaggatttatttcaaacaaattatgcgcatgcaaaaccacaaatcccgattaaaccctcggctggaaagcaacgcaatgatcagccaacaaccagcagatttaatacagtacctaatcgcgccaaacagacgcagactcgaaggattgatcagccaacgactcaccaaactgatcactcaatgattaaagggaagggcattgaaataggaagacaaatttctgatcagtcaacaaccagcagatttaatacagtacctaatcgcgccaaacagacgcagactcgaaggattgatcagccaacgactcaccaaactgatcagtcaatgattaaagggaagggcattgaaataggaagacaaatttctgatcagtcaacaaccagcagaattaatacagtacccaatcgcgccaaacagacgcagactcgaaggattgatcagccaacgactcaccaaactgatcagtcaatgatcagagggaagggcattgaaataggaagacaaatttctgatcagccaacaaccagcagaattaatacagaaccgaagcaaaccaaactgacgcaaattacgcaaaatcgaccgactgatcagctaacgacccaccgaactgatcagtcaatgatcagagggaagggcattgtaatgggagggcaagtttctgatctatcaacaatcgccatgaaggataataaacaaacggaaaggcaaatctttgaaaagccaaccagcagcagaaataatacagaaccaaagcgcaataaacaaacgcaaactcgacggattgatcagccaacgagaactgatcagccattgttcagggcgaagggcattgtaatggaaagacaagtttctgatcggtcaatggcctctgatcagtcaactatcacgacgaagggcattgtaatgggaaaacaaacgtctgatcagtcaatgatcagcgcaaatgaacgtaaacaaatggaaagacaaatctctgatcagtcaacgatcagcacgaaaggctctgatcagtcaaaaattagcgaaattgaaccccagccgatgatggacaatcgtaaattgaaggaaaagcaaactgatcccattcagtcgtcgaacctaagcagatcaaaaacggaaccgatgggccaaaaacaaacgaaaaggcaactgaatgatcagccaaaattcaaccgaactaaatcagatttgctaggaaacgataagcaaaccgaaaaacagatgtccagatcaaattcggagccagcgaaaagtaaaaaaaaattgaattaacttcgaataaaatgaattgttcggattttacaaatttaaaattcattaaattcgaaaattatttgttggcccggtgatgccgaaacggccaaggaaatttgaattgaattttaaggatttaagatttatattaaaggcaccttgctgtattaaattaaagaaaaattaaaataataattgcatattattcactattaggagcatatccgaaaattaaaataatttttacaaaatcaaaatacaaagaattgtcaaaagtaatcaaaaatgagcaaccacaaagcgcagaagaagagccaagttggacaaaataataaataaattattatttaattaaattttaaaatatttttagaaactgacgaagaaaaacgacaaattgtccaccaattcattgaattaaaaaagaaatatttacatttaactgatgaaaattatgacctcccattcattgaaatggaggagagaattgctggagaaatgggcttaaaacggagcacaattctttcctggaagaaggaattcgagaaaaacaaaaaacgtaactttttaaagcctcatttttggaaaaaataggaaataaa

SEQ ID NO: 51720 - DNA, 753 bp, Heterodera glycines
  misc_feature (198)..(198): n is a, c, g, or t
  Genomic contig location: Contig_ID=SeqID_21133; Location=422..1174; Strand=-
  SCN-specific regions: Sequence locations=1-169,191-708,730-753
atgtcgaaagaactctatcctctttatccatccaattcacgggttattgacctgagaagtaaaataactcctgcgcctatgtcaaaaaccaagcagttttttaatgagttgcaaagaattgctggatcatcgccaacaaaggttaatttcttttccattacaaacctaaccataaacaacaacaaaataacatactanattagccaaaattagatcactaattagatataagcactagttgcaaggcgatatactgatagaaatcatttttcttttaagtcatcatcgtcgctacacatgaaaagggcttacgaaagtgagcgttggtttagcccacgggtcgattctgaccaggcagacacttcgggaccgcctcgtcgttcaattttaacacaatcaagacttcaattattgtcggcacagcgaggacgtgaaacgagaaaaccatattggttagttttactatttaaattcggtattgttatagttgttaactgggaataacttgtgacgaaggttttgaccttaaacttataattgacacactttcacaatttcaggcgttgtccgatgccatcagcaagatccatcgatacggaaattacgcagccttcacttgttgacattattgctacgccgttagcgcgacagggaccgattaagccatttcgacaccgagagccggagacaggcagaaaaacgaattcgtttgctgtggatgaagatatcctaactgttgaggaaaaagaaaag

SEQ ID NO: 51721 - DNA, 736 bp, Heterodera glycines
  Genomic contig location: Contig_ID=SeqID_21133; Location=1788..2523; Strand=+
  SCN-specific regions: Sequence locations=1-58,87-435,458-736
atgacgacttcctttgcaattttggcacaaataaaacgcgatattgtgagtaacagtcataaaatacttaattaaaaatatattttggctccttttttttagctcatttgtcatggcagcgcatttttcacatattttatttatgtttttgccattttcaatgcgtcattgcaacagataatcaggtacagtgattttcgacaggataattaggttaacaaattgaacccccaattaaagttgtttttctcatcatgatattacattattcgcacgttttattgctgatttttgccgtttacactgcgtcaaatggagctgttaaccatgtctagaaattttctataaaaaatttgtcatgattcaaattacaatcattttaaatttccagaacgaaactgattcgtcgagcgaatgggatgaaaatgaagcgctggaggatgaggaaaaagaggagtctcaaattattggtgcgccatcggagctgttggtcatggcgacccacgactcggttcaagtgtcatggttaccaccgcgggatgacaatgtgctgatcagaggatatttggttggtcggcgatttaacaatcatacagccatattttttttccaaagatcggttggggtattaacataccggacgtggaaaaggcgacggttgacccggaggctcggcattttactattcgagggctcaaaccgaaccgtgaatatgtgatttcgttgcgggcgttca

SEQ ID NO: 51722 - DNA, 1631 bp, Heterodera glycines
  Genomic contig location: Contig_ID=SeqID_21134; Location=918..2548; Strand=+
  SCN-specific regions: Sequence locations=1-126,151-217,261-417,472 -544,619-703,725-781,855-979,1004-1076,1161-1278,1325-1631
ccactgacaactttgcgcttttgggtggtttccgtttttggtaataaaggacagaaaatggtatttaaagtttaaaattggcaatcattaaggaacaagcatcgcgttgtgcagcattgtggagaatttgtttttcttttatcttttctcgacaaggcaattaattattaatttcattttgcaatttacttaatttaacaaggaatatcaattgttgaatttattattatttatttatattataaaaatcaaattaaaaacagaaagcaccaccggaccacgttcaacatgtacatgatgttcatctcgttgttcgacattttcatcagcatttcctacatccttatccaatcaatgaacgttttgatggactttctccgatcactgacacttttcagaatatggtgggacaatttcaaatatataaaaataaaaataaattttatttttataaaataaatgaataatttaggcacatttacatggttccctttttgaccatctctcactgtgccatcacttctgcgtcttttctcatgtgagcttttttaattaattaaataatcaaccgccttaattgtcaaaataattaatttaatttttttttctatttttttagtctcgccgccaccattgagcgctatttgctcactgccaattcgaaacacattcgattggtgcagagaaatcgccgatacataatagcatttgccattctgatgggaatcatctccaaagtgaccatctgtttggagtttaaggtcaaatatttaattgcctctaaattttaacattaaaaaaaaatttgcaatttaatttttaaaatgtattaaaaatccaaattaaaatttattcagatttcgtatttggaagattgtgccaatactatgaatgaaattgaaataaactttgccgactttgtcttcgacacggattatcacttggtattcaaattaatagttacattatccatttaatctaacttaaatcagttatttttagtattggcgcttttattaccgcaattttgtaacaatatttttcccattcttcgcacttttaatgttcgtttaatcataatttattatttaattatttgctttataaataatttatacataaataataatgttttgattcaaaaaaatataaaataaattcgcagattgaatgccaaaatcatcagtgtgttggccaaggtcgaaaaagagaattacaaattccaaatgcttcattcgtccaccgcaacggccaaacaaatgaaacggaaggtaaaagaaaaattaaatataaaaatgaaaattttaatttaaaattaatttttcctcaaaagaaagtcactcgggcagcgaccatcaccaccattctgttggtgtgctcctatttggtgtccaacatcatcagtgtggcactgaccacttgggaacacattgacaaaccgtccctcgtcggcgagtacatacagtaagcctcagtaccgtcttcgttattcgtgccatcgtcctcccccctccctccaaatcagactctatctgatctccattgatatgtcctcgctgctcaccgtttgctcctgcgcttttcggcccctcatttatttgatctgccagccggcactgcgcaaggaagtg

SEQ ID NO: 51723 - DNA, 112 bp, Heterodera glycines
  misc_feature (81)..(81): n is a, c, g, or t
  Genomic contig location: Contig_ID=SeqID_21135; Location=813..924; Strand=+
  SCN-specific regions: Sequence locations=1-112
gctatagggaagctattccggaaggattcggtctccccatatatctgcgcgcatcggttcggagagactgccccgaaacanaaaaatcgattgattcaagtgtccgtctgcg

SEQ ID NO: 51724 - DNA, 396 bp, Heterodera glycines
  Genomic contig location: Contig_ID=SeqID_21136; Location=931..1326; Strand=-
  SCN-specific regions: Sequence locations=27-156,185-396
aattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataa

SEQ ID NO: 51725 - DNA, 375 bp, Heterodera glycines
  Genomic contig location: Contig_ID=SeqID_21143; Location=74..448; Strand=+
  SCN-specific regions: Sequence locations=1-294,339-375
atgcagcagcacgtgcagaaacgggatgacaaacccgggactgagctgcccggacttgctcgcccaatgacggacccaaaatccgccaaaaagggccaaattcggatttgggttaaaggattcgttgttccgccattggaggcctggccattggaggaccggccattgaaggacccgcctttggaggacccgccattggaggattggccattggaggacccgccatttgcggatattcccgacattgagggaccgactttttgaggacccgacatttgaggatatacacaattcaaaaaaaaatgaatgaaaattttatttatatcattataaaaaaagagaaaaagctattcccgagggccggggaagcaaaaa

SEQ ID NO: 51726 - DNA, 658 bp, Heterodera glycines
  Genomic contig location: Contig_ID=SeqID_21143; Location=1568..2225; Strand=+
  SCN-specific regions: Sequence locations=1-658
  Gene Ontology: Mol. function=calcium-dependent phospholipid binding; Cellular component=actin filament; Biological process=synaptic vesicle targeting
atgtcaagtcctcaaaagtcaagtcctcaaaagtcgggtcctcaaaagtcgggtcctcaaatgtcgggtcctcaaaagtcgggtcctcaaatgtcgggtcctcaaaagtcaaatcctcaaaagtcgggtcctcaaaagtcgggtcctcaaaagtcgggtcctcaaatgtcgggtcctcaaaagtcaaatcctcaaaagtcgggtcctcaaaagtcgggtcctcaaatgtcgggtcctcaaaagtcaaatcctcaaaagtcgggtcctcaaaagtcgggtcctcaaatgtcgggtcctcaaaagtcaggtcctcagatgtcgggtagccgaaatttttagtttacgtagcaattcagaaaatattaagaaaagggaaccgatattttatgaatttttttcaaaattggggtattcatttaatataaggacactttggaaaactgagcaaaatcggtgttggttggttcagtttgattcagttggtcacaggtttgagctgattaaaaccttatggcccttaatttctcacggaaaacttggaaaagccaacacaactctgcctaaaagacagcttaaaaattgataacccataatttcgaaatttcccactgagacgcctaccgataaaattccttatcagaaaaatttctgaaaatta

SEQ ID NO: 51727 - DNA, 2117 bp, Heterodera glycines; identical to SEQ ID NO: 21145
  misc_feature (13)..(14): n is a, c, g, or t
  misc_feature (51)..(51): n is a, c, g, or t
  misc_feature (90)..(90): n is a, c, g, or t
  misc_feature (101)..(101): n is a, c, g, or t
  misc_feature (145)..(145): n is a, c, g, or t
  Genomic contig location: Contig_ID=SeqID_21145; Location=1..2117; Strand=+
  SCN-specific regions: Sequence locations=1-227,278-312,335-373,395 -433,455-725,752-991,1014-1185,1209-1366,1405-1564,1586-1633,1662 -1768,1791-1842,1866-1964,1991-2063,2085-2117
  Gene Ontology: Mol. function=general RNA polymerase II transcription factor activity; Cellular component=SWI/SNF complex; Biological process=chromatin modeling

SEQ ID NO: 51728 - DNA, 868 bp, Heterodera glycines
  Genomic contig location: Contig_ID=SeqID_3750; Location=676..1543; Strand=+
  SCN-specific regions: Sequence locations=1-4,26-218,241-241,263 -383,405-662,684-868
atggcctgtacctgtacctggatccaggaaaaatacaggcctggatccaggtacaggccgatctctaattttcattagtagaatgtttatttttttgaactccccccccccccctttatacaacacaccgaatcagtttccttataaccagaagccattcctccaaaaatttgtgcttcaaaattttacggcaaagatgatgctccgattttgaaggctttttaatttagaaaaattttcctaaaagcatgtcatgcctgaaatttcggctctaattttatacatttcatttctattgccttctttaaacaatactaatcttttaattaagaatggatctgacacctgaacaagaacgcgagttgtataacgcctacaatcgtcccaatgtcccggaggacctcaccgaagcagaactgtcgcatgaagttcatttgggggcgtttaatcaagcgatgcaaatgcgtcatgcattgtctacaacagatttgaatgccgcgccaaaggacatcagcattactctaccattcacaccggaagtaatcagaaataaaaccattttttggtttcgggctgtgattttttaagcattttaagccataatttgacaatttgtgccatttaattgggtacttttacacttacgccacataaatttttttaattttgttgttttctggggtattcgggtgcgctgatcacgaatatgacattcatgtccatctatttagaaccccggaccagaattcgaacaaaagccgaaaattaatttttcacatgtattgtccaaaaacgattcaagtgcactaaatggccgtgaatctctattttttattatatgcctgtctatttgaatcggttttggaca

SEQ ID NO: 51729 - DNA, 402 bp, Heterodera glycines
  Genomic contig location: Contig_ID=SeqID_3750; Location=4326..4727; Strand=-
  SCN-specific regions: Sequence locations=1-157,179-402
attcggcatgcctttgtgatttccattcgtcagctccgtttggccatcgaaattggtgacccggtgctgatttcgcgctgcttcctgtacattgcgctcgcatttgcccaaaaagggcaattccttccggcactcaaaattgtgcggtacgttaagccatagaaatgagacaaaatgccaaataatttttcaaaaattttccctttttcagccaggaatggaacagagacactgagcttaggtccgcttttttgctgaattgcacccgcggcatttggtccagcatcaaatggctgaagatgaacagaaaagtgatgatgcttaaataatttcgcacacatattttttccttttaatttattgttttgtgttttggctaattaatcaaattaattgacaatt

SEQ ID NO: 51730 - DNA, 1653 bp, Heterodera glycines
  Genomic contig location: Contig_ID=SeqID_21146; Location=36..1688; Strand=-
  SCN-specific regions: Sequence locations=1-1068,1094-1488,1510-1653
atggaacggaacagcgaaccgctcgatgaggaagcggcaaacgggaatggaaatcagggggatctcccctccgaccgacaggacggggaacgagcgaatgcggcgcagcagaccaaaacaaagaaagggatggacgcgcaaggcctggggacaagccaaacgggtgttacacccgcggcatcgaagaatttgcgcagcggagcaattacggtgaggtcggcccgagatcggattgagagagcggctgaaacactctcgtcgcgaatcgcagaagcgcgggagctgatggactcggatttcacgaggggcgaagcgcccgagcacgccgcgcggctgatggcaatggaacggggacttggacaggtcactcggattttcgaaggacatttcgataagggaatcgcagaagcgggtgcagcacccgaggagcggcaggatttcttgtatgatttcgtggccgcccccttgccagcctcgacgaagtatctgcaactgcgggagcatccaactcctgccgaactgctccaaattgcggctgagcatctcggtgatatgcaggcgatgaggcaaacatttgaggacgaagaaagggagcagagcatctcccgatcgagcagatcagtcgacaccgaggacagtcacccatcgaaggagctcccacgcaccatggcaagacgaagcatgccagagtgggagacatcgttcagggatgccttggcgcggttccaggctggacaagttggccaagcgccacaaagattcgaacaagccaaccgggtggccccacccgtcatgccaaacatggctgcgctcatccaacgccgctcaaatgccccatcagtggccagtgttcgggtgaacaacccggtcagggaatggatggcaaggaaccgagggggagagaacgaacccccggcgcaacagcagccacaagctcagcaaccgctgcaagccgaacagcaacgatttgagcgacttacgctcaatgaccagggacaagcattccctcgggcatcccatcatgcccgtattcggaaggaggagcatcccagtcgggaacgcctccgaactcagggagcagctccctcacatcaccatcattcggaaactcgagcagacacattgacgactttcgaaacggttcgattgcagccaccgacgttttccgggaaaccggaggattggaccaccttttgggcctacttccaacgggcggtggacgacaaaccaatcccgggattcgaaaagcagcttcatctgctgcggtgcctaaaagaaggatcgccggcgcgaagagcggtggaggtgtacccaccgtcggatggaaattacccagttgtggtacaactgctgaaggagcgattcggcgacaccaacgatttgcaacgagcaattcgtgctcagctgctacatttgccaccagctaaagacaacgtggccagtctgacggcaatgatcgacgagttcgagaggggagtgtgccaactcgagcagctgggagccaacgtggacgacgagtcattcggtccgctgttggaagccaaactcccagtgagcatcctgactgagctgaggattcgggagagcatgatgggagcgaaatggacggtgagggagtcccaaaagcagtcgcggcaccagtcaaatgcatga

SEQ ID NO: 51731 - DNA, 648 bp, Heterodera glycines
  Genomic contig location: Contig_ID=SeqID_21146; Location=970..1617; Strand=+
  SCN-specific regions: Sequence locations=1-648
gccaaggcatccctgaacgatgtctcccactctggcatgcttcgtcttgccatggtgcgtgggagctccttcgatgggtgactgtcctcggtgtcgactgatctgctcgatcgggagatgctctgctccctttcttcgtcctcaaatgtttgcctcatcgcctgcatatcaccgagatgctcagccgcaatttggagcagttcggcaggagttggatgctcccgcagttgcagatacttcgtcgaggctggcaagggggcggccacgaaatcatacaagaaatcctgccgctcctcgggtgctgcacccgcttctgcgattcccttatcgaaatgtccttcgaaaatccgagtgacctgtccaagtccccgttccattgccatcagccgcgcggcgtgctcgggcgcttcgcccctcgtgaaatccgagtccatcagctcccgcgcttctgcgattcgcgacgagagtgtttcagccgctctctcaatccgatctcgggccgacctcaccgtaattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcg

SEQ ID NO: 51732 - DNA, 56 bp, Heterodera glycines
  Genomic contig location: Contig_ID=SeqID_21149; Location=343..398; Strand=-
  SCN-specific regions: Sequence locations=1-8
gtcccagttcccggtcccgggttttgaaaagctcaggtcccggtcccggtagggca

SEQ ID NO: 51733 - DNA, 388 bp, Heterodera glycines
  Genomic contig location: Contig_ID=SeqID_21150; Location=780..1167; Strand=-
  SCN-specific regions: Sequence locations=1-47,85-177,199-228,279 -331,385-388
atgacaattaattgtgaaaaggaggaaaaagttaatagaaaatagactataaaatattattaaatgatttttttcatttaatttgctttattgagaatgaagtaaaattcatctttaatcagagatttaccagcccaaaattgctcactgacatagaacattacaagaaattaatttaaaaggttaaattaataaaacaattagctttaataaacacttggtaaaatgatattatatatagattaattaataaactataaaataaaaaatctaaaaaagaaaacgtttatcttattagtgcaattaaatgtaaataaattttagcagagaatatttatgttgaaatattacaaaatgtgatttaattttatattcaagtgaaaataaa

SEQ ID NO: 51734 - DNA, 826 bp, Heterodera glycines
  Genomic contig location: Contig_ID=SeqID_21153; Location=228..1053; Strand=-
  SCN-specific regions: Sequence locations=1-215,257-467,504-731,753-826
atgaacaagcgcttgccgaatgagcttatttgggaaattgttgctgcaattccgataatgtaccttttcggaggagttgcaaagaagccaggtaatttttcaaaagtattattaaacaatttaaaaataaaggaggtacgcgtccaccatccggcatcaccgttgtcagccggacgttcgaaatttttcgtgccaagcggcatttttacttcttaaaaatagttggtaatatttaaaataacaataaatctgaatttttagatcgatcttgctcgaaatttcgagaggctctgtgcactgaggaagttaccgtgcggagaattgttcatacagttcggcttcattcaatttggattcgaaaatgaactggaggacgccaagtgtttcgccgactttttggtgtacctatattatggacgatctggccctaccgttacgacgagagtcgtgacttactcggcggtaagaaaaaaaaaatataataataatattaatattatttagccgattaaaattggagagctattcggcgccattctgacgcatgtgttgggaagcgcaaatccgctgaccatgaagaagcggactgcaggcggttatttgctgcgtcaacactttccgcggcttctccaactctcggcaacagaaatggcatcaggtggcattggtcaactggtccgctccgatgggatggaaatgtaccggctgatgaatccgcaccacaaaggagatgttggtcaattgattattattgaaacgtctcaacaccctggttcgtactattttaatttttcaatcgaataagtgttttttgtaattgaataaa

SEQ ID NO: 51735 - DNA, 1259 bp, Heterodera glycines
  Genomic contig location: Contig_ID=SeqID_21154; Location=15..1273; Strand=-
  SCN-specific regions: Sequence locations=1-3,25-502,524-719,749 -818,841-1259
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaaccacaggagaccgatgaaccccggaaaataattattcctaggaaaagacttgaagagcaaactcctgatcctgaatcagataatgatacaataaatgagttaactccggagccccaaacaacatccacattaaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaagaaaaaaggcaataaaatctataaaaacacccggcatagtgcgagagaagaaaccctttaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacgtgatcgaggcttttgatcgggtgttcgaaaagtctaaaattatcccgatgaaaatatatagtgacgagtgggcagtgaattcccaagccaaggaaaagatgaaaaaa

SEQ ID NO: 51736 - DNA, 825 bp, Heterodera glycines
  Genomic contig location: Contig_ID=SeqID_21155; Location=166..990; Strand=+
  SCN-specific regions: Sequence locations=1-116,138-583,605-669,691-825
atgaatgctcatgtgcaggcgcaaattggctttaatgttggaatatttaacgcggtaagtgttttaggagttacgtaattcttgaaatattcgattgaatatttgtaaagagatgcttttcccaatgtttcattttttagaacctgggaggttccctccgttggaaccaagctgaagcacagagtttggcaagggacgcgcgggctgatcggtgccatcgacaacgcgatgaacgaaacgcggcagttcaaaatgctcgtgggaggactgatcagaatgcagcagcacgacgaattgacttgcgttttgcacgcgaagaagtacagcgttatgtggttgaagctgaaaccatcgcagaacaagcgagggacagacggcggcacgcggagaggcgtggaaagcagagaaacgaattgatgatttccgtcgtcggatcaacgatttgcgacgggttgaaaagcgagcaattgcacaagcagcggaagcgcggcgtcgctttgaccgaatcgctcgtgttcgtgagctctaaccttgttcatttaaagtacataatttcagcagagacagcattgagttggaagaaagatgggagccatttactccgcctccgttcacttcgtttcccaccgcttcgcccactcgaattgcgccttttgtggtgccaacaacggactttggcacggacaccgtacgacctccgccacacgtcactccgccgtcggatttgacatcgctgttcacttccacagtcatttcgccacggactcggcccaagccgtacactcggcacagcgcaactgttccatgggagaccggcattccgaa

SEQ ID NO: 51737 - DNA, 557 bp, Heterodera glycines
  Genomic contig location: Contig_ID=SeqID_21156; Location=403..959; Strand=-
  SCN-specific regions: Sequence locations=1-557
gtagaattcgacgtcatcgatggtgagaagggcagggaagcggccgctgtgtcggggcccggtggaattcgcgtgggcaccgccatccaacacaacaacactgcgcgcagtcagccgttgccggccaatgccaacaattccgccggacggatgttcatcgccggcagatttcggcgccccgttggcgcggttttgttcagtgttaaaatgggtccccactcttacaaatcattttgctggctattaaaattgacttctgatggacttgttatgtctgtccaaaagtgtcctgccttcggctgattccccgtcaaatttgttttttcccatcagccgaacaacaaagccaagtcggccgtcgcttcggtgcccgcggtggtcagtgccggcgacgacagtgcaaatggtccgccgctctctctgtccggcgtcactcgcaaaggccgtcgcatgttcaaagcgaatgatggcgaaaagggcaaaaacagcgacaaaaaggaaagtgccagtgacggcgttggcaaagaggacgacggaggacgggagggcgacaacga

SEQ ID NO: 51738 - DNA, 1581 bp, Heterodera glycines
  Genomic contig location: Contig_ID=SeqID_3753; Location=1500..3080; Strand=+
  SCN-specific regions: Sequence locations=1-324,366-969,993-1581
  Gene Ontology: Mol. function=electron transporter activity; Cellular component=mitochondrion; Biological process=energy pathways
atgattggagtcagtggtgccttactgaccacgctgggcacattgaacccggacccgcagacattgagccaaatgtgtgctgccatcgcttccggttccctcatcggctcaatcgtcgccactcgcataaaagtcaccgatttgccccaattggtggcactttttcacagttttgtcggaattgctgccacggcgacgtgtgtcagcaattacctagccgagttttcgcactttttggccgaccccgcaggcacggttgcggtgaagacttgtctctttttgggtgcttacatcggtggagtcactttcaccgggtctttgatggcctatggaaaattgcagggttattatttttagtttaatcaataacatgtcaaattggtcaattccaggtcttcttggcagcgcgccgactcttcttcccgccagaaatatgcttaattttgcacttctcagtgccaatgttgccgccctcggcttttatctgacaacggacagcatggccatgggcttgtccatgctcggcactacgtctttgctctcctctctgatgggcgtcaccctaacaatggcaatcggaggtgcagtcgattttttttttttttgctaaatttcccaatgcttttgcatttaggtgctgacatgcccgtagtgatcacggtgttaaactcgtacagtggttgggctctctgtgctgagggattaatgctcagcaacaatttgctgaccattgtcggtgcgctcattggcagttctggtgccattttgtcccacattatgtgcaaagttggtgattttttgcgttctgttcattatttcatcgttttaggcaatgaatcggtcgttgttcaatgttattttgggcggcgttggcacaaaatcgcaaaagggtggcaaagcacaggaaatcactggcactgctcaatttgcggaggtggaccaggtttgatgatggatacagtgaatttccatttcaaaaattctccataaatcaggtcgttgacatgatcaaggatgccaaaaacatcattattgtgcccggttatgggctttgcgctgcccaggcccgatacccaatcgccgaacttgtcaaataccttcgcgagaggggtgccaatgttcgctttgccatccatccggtggccggtcgaatgcccggccaattgaatgtgttgctcgccgaagctggtgtaccttacgacatcgtggaggagatggacgaaatcaacgacaacttccccgacactgacctcactttggttatcggagcaaatgacacggtctgtccaattgcgttcactgattgtgtgaaaagttttctcgtgcggtccaatgcttttcacacttcccttaattaaggttaatcgcgcggctgaggaagaccccaactcgtcaatcgcgggaatgcccgttttgaaagtctggcacagcaagcaggtggtggtgatgaagcggactatgggtgttggctatgcggcggtggacaatccgatcttcttcgaccacaacacgcagatgctgctgggggacgcgaagaaagtgtgcgacaaactgttggccggtgtcaaaagcggcacttaa

SEQ ID NO: 51739 - DNA, 483 bp, Heterodera glycines
  Genomic contig location: Contig_ID=SeqID_3754; Location=1255..1737; Strand=+
  SCN-specific regions: Sequence locations=1-98,123-197,219-483
atgaagggccttccgaatttagcgatgatgggcgaacttttttgcggtcttttgggaggcgcaagttttggcaaaaacgtgcgatcgtggcgagaagtgcaaaaggcagccaacctggtaaatgccgactttgcttgaccagtcgcttgtcggacgaattgccaaatccaatggcattattttcaatattttgtcccccagggccaatgcttcgtggccattgaccccgaatgctttgctccaacatttgtggactatttgcagttgttcctggaccaaacacgtgggcttaagccggttatcactgctcttcctccatggcattcgatcgcctcccttccctccttttagcgcgacccctccaaatcggtgttagtgcccggtgaccccgaaagaatgaacagcgaacggagcgcaaaggctggcggagttatttactcagcaggacaaattcgggatttgctcagtcggaggagcacttaa

SEQ ID NO: 51740 - DNA, 993 bp, Heterodera glycines
  Genomic contig location: Contig_ID=SeqID_3755; Location=570..1562; Strand=+
  SCN-specific regions: Sequence locations=1-331,354-494,516-683,724 -868,891-993
  Gene Ontology: Mol. function=electron transporter activity; Cellular component=mitochondrion; Biological process=energy pathways
atggatgaagacttcgctaaagttggtgctaaaattgtgaaccgggaagaggcacttcgtgctgatgttttacttaaggtgaactgacaaagatttaagtctctcacaatttttaaatttccattcgctcagatgcgttgcccagaaacattcgaaatcgactcgtttcgaccaaattcaactttaatttcgttcattgggcctgcccaaaacggaagtgttgtcgagctgcttggcaagaagcaaatgaatgtctttgcgatggattgtatccctcgaatatcaagagctcaggtgacagacaatctcattagcaagtaattatatgaaattatatttcatttggattataggtttttgatgcgctttcttcaatggctaacattgccggctataaagcggtgattgaggcagcaaataattacggtcgttttttgtccggccaaatcacagcggcaggaaaaatcccacccactaaagtgttggtggtcggaggtggagtagccgggctgagcgcaattgcaaccgcaaaaaatttggtttcaaagtttcactgtattactcaacaaactcgtttttaagggtgcgattgtcagaggtttcgacactcgcccggcggtcaaagaccaggtcaaatcattgggagctgagtttttagaagtgagttttaaaactgttatttctcattaaatttttgttaatttgattcaaatacaggtcaaaattcaagaatctggcgagggcgttggaggttatgcaaaagaaatgagcccggctttcattgaggcggagatggaactttttcgtcaacaatgtcgcgaagtggacattatcatcagtacggcagcaatccctggaaaaaaagcgcctgttttgtttacaaaagtgattttgtttaaaatggcagttctttttatgccgatttcaggacatgatcgccctgatgaagcccggctccgttttggtggacttagcggcagaagcaggcggtaa

SEQ ID NO: 51741 - DNA, 985 bp, Heterodera glycines
  Genomic contig location: Contig_ID=SeqID_21158; Location=1026..2010; Strand=-
  SCN-specific regions: Sequence locations=1-82,104-104,180-265,300 -307,329-440,465-927,954-985
atgacgaaatttctggtttacgagcacagagccccgggacaccaacaaatgcttttaagtttataaaatcgaaataagaatttaaatttcttcttaaaataaggataaaattatatattttttaactccatgtatcttttaaataaatatattatgtaaaattattaaaataaaataatctaaagaatcaatactgaataaaaaaaaccggtcttatgcaccaagattagtcaaaaaagaatatggatgatatgcttaattctttcaataaaacaattttaaaaaagtttaatcaaaattcttcatgacaataaataattttgaattatatacatgaaattaatataattcaaaagaaaaaaactcttcattcaataatgtttaagtcaagtttgggactgattctgataaatatttatttaactggaagaatatgagtgaaaatataataaatatttaaataagagaagagcattaaaaagccaaaattttttttttaatgtttaaaattcgattaatttaaactggcaaagtgaattgatatagggtaacacaatgatgggttgataagttatcaattaaaaaagatataaaactatataatttagaaatatcctcgcaaggacccacacagcgaaagcccagtgatgggtgcattgcccaactgaattcgtggcattatgcagaacaggaaaacgataaaaaaagtgaatatagtcaacaatggtgtgcaaaaaaagaaggaatgcggaaaaatagaaagttaaatggacctataaggatggttgaaaaagggcgaagcactgcgaattcaaaaaaaaattctctaaaaatttaattgttataactaataacctagaaacaaaactttttcctccagtgaatttaaatgctctgaaaataatattataatggcgaaataattagttttaaaggcatacataattaaaaagcgtttttttaaatattttcataaacaaataaa

SEQ ID NO: 51742 - DNA, 1899 bp, Heterodera glycines
  Genomic contig location: Contig_ID=SeqID_21159; Location=167..2065; Strand=+
  SCN-specific regions: Sequence locations=1-146,168-474,508-592,631 -807,834-913,935-1006,1034-1551,1577-1604,1647-1724,1754-1899
agaatacgtcggcgaagtgccaacagtggagccaaaatttgtgttacaaaagaacaaattggaaattgaaggcccaataatttatgcggtgaattgcctgaccaaaatttcgcaattgtattttgataaatacagtgcgtggaattataaaagaaaattaaacaagctcttcacttatcattttgaaccaaaattgttaaatgagcatagattgaattataatgtaaaattggtcaacgaaaaaccaaaagtgccaattaacgaaatgattttacaattggcaattgacacagcttatgggtgccaaacaaatgaaagtgtcgacggaatattccggcagaattttaacgaaattttaggggaaatgtttaaaaaagcggaacaacgggcaaaaagggaagataattatggaattttcgttacgtatgacataattgtccgatcgatttttgatgattattgtttatgggtgagtcttttaaaaacaaattgttttaattaatgccaaaattaagactgatgatgcaatttttactgaatttgtgaaaggtcaagagacaaattttgagaaattttataggatgcttaaagaatattattcaaactctgtgaaatcaaaggaattttatttacaaaaatatggggcctattttggtcttgtgtatttaatgagaaaaaattggcaatgtgccaaagttggagaggatttaaaagaaaagtgccaaaaatacaaaaaatatttgcatattttgtatgaatatttcttcagaatatctgccgaaggtttttgctttccatttaatgatcatttaattaattaataaaataattaagcaaaaaacccaaatatgacaaatcaattgccagcggtaaagcctgtttttgaatgcagtaataaatattggtattcaataatttttattattcaaattctgaatgatttttcgatatgtttttggaaaaatggcgaaaaagaatgtgagaacgcctatggaaattatgagatggaattgcaaaatgagaaagaaacaaatcatgcaattgaagaggaagaaaaaaatgggcaaaatttggagagaaaaagcaaaaaacaatcgacggaaattggcaaacttcggacagaatttgaccaaaaaatggaagaaatatatgaaaatacaaaagaaaaagaagcagaagaaaaggccaaattggaaaaagcattggccaaagtaccaaatgatttggaaattaaaaagatggaaaagaaatatgaacaaatattagccgcaagagaaattgctgcggaagaaaagtcgaaattggtaaaaaaaatggccaaattagcaattaatcgtgaaagaaaaatgatggaagatgaatttgaagaaaaatttggcgctttcaattcgtcaccatttgcataagcaaattctcgtcttattctaatccaaaaggaatttgaaacttgaaagtgattatttgagctatataattaatttacacaactccttattctaacagaacacaaacactaagtcgatatttaatttttctcttcaattaaggtctaaattttacggaggtttgttatgggctgctttctgagaataattctagcatgcttaaattatttaaaaattatttatttaatttgatttaattttgttgctttttggataattttacgattttacactccactaaatttggactttatgacacctattttcccatttttagcacctattttgggggttttttataaccaaaaactaactaagcaaaaatttaattacaccaaaattgatttttgcaaaaattactacgcagttggtggccctttaataagttattttaagagtttcttataactttttaactcccttaattacccccccccccccagttcactacgca

SEQ ID NO: 51743 - DNA, 1215 bp, Heterodera glycines
  Genomic contig location: Contig_ID=SeqID_21166; Location=156..1370; Strand=+
  SCN-specific regions: Sequence locations=1-140,162-366,388-1215
attgaacgcaaaaggggccaccccgccgctttgcactcggacatcggattcaacgagcccggccaactcaacgatggtccgttgtgcaagtgctcctgggcttcaaaacagtcgggcataagacacgacaaattcgtgggggagcaatttgtggccaaatgtcagcagaattcgaggtccttttttcttaatttcaattttcttcatctgattgtgagacgattgtttcagttccatcgaaacgctttaccattacgttttggtcgtcgacccgtcgccctgcgctttttcgagacggccgaccgccattcaatacgacggacattcctacgaattcgaagggttctccattttctttcaccggcctttgccccgaacactttccccagacaccaattaatcagtggacgaatgactttcagttgaggctggtcaaagagaatatgcctgaagtgaacttctacccattaataatattaaactaattccttttttcttttaatttattgcttttcaaaggcgaaagcaaaaaaaaaaacttaaatttcagagtttcacagtcgatgatctcgagcttttctacgagtttttatttgaagaagtattggaactgtacgatctcaaccgtttttcaactgacaaacattctgtcgatgacccaaagaaagaagagaatgaaaacttgggctgtcctttttatcactgtatgcccagatttgcccgaaaattgccaggtttgaatttactcttaccattagaaaatgtcacaattcctttggtcagatgatggcaaagaattgcttccgatgtccgccgttctcacccattttactcgcgaattttcacctttggtcgatgacaatatggccaattacttttgcagagacaaaacggcattcatcgaatttgcattgcaaaagaagggccaaatttgtctaaacccatctaaggttgaagtgtttgttggtggaactttacgtgggaatttgctctcttcagcgtccaatggcgctcagagtggacatgatcgacgggtacaattcggacccgacaaaccgcgacttttacccaattttggtccatttcggcgtcaaaccgactgcttatgcctttatgaagcggccacagtggggcaaaaagaaaatgaaacttttttaagctcaaattgtacattttcgcagataccaagaggcactgaaaaaacacatcaaattt

SEQ ID NO: 51744 - DNA, 1605 bp, Heterodera glycines; identical to SEQ ID NO: 21167
  misc_feature (16)..(16): n is a, c, g, or t
  misc_feature (34)..(34): n is a, c, g, or t
  Genomic contig location: Contig_ID=SeqID_21167; Location=1..1605; Strand=+
  SCN-specific regions: Sequence locations=1-370,392-434,473-1441,1478 -1605

SEQ ID NO: 51745 - DNA, 1075 bp, Heterodera glycines
  Genomic contig location: Contig_ID=SeqID_21168; Location=45..1119; Strand=+
  SCN-specific regions: Sequence locations=1-12,51-379,413-667,689 -883,905-938,961-1075
atgacgcccgatggtaaacccacctttaaatttttagaaatttttaaaaagatgtggaaattttttttaaggggtttaagggatcgctgaacacgaatgcagtacctatttcatccgccaattcaatcccaggtccgaatttgaacaaagggggtagaatctttaatttttcaaataacacatttgtggttcaagcgcgcttaggtaaatacagggaatcagactgaaagtcagcgacggagttcgaataggtcgaaatggaagccggattgtggtcagagaccctggaagcatgttttcatgactttggaagcaaatacaatttttcagaaaaagggggcaactatcggcagtattaccattacccctcatccccatcttttttttcaaaaaataaattatataaaattaaggaccacttgtgcacaaaattaagttggctcagttggagactttggtggactcactttgtgccaatatggtgagccaaaatgagcaattgcgcgacgtcagctccatcgctctgaagacggtgctcaatgaacttccaagtggatccataaccactcaaatgtttctttgtgtgagacgggtcattccgaagctcatcgaaacactcagtaagtaattacaaatgtcatttaaaagaatctatgttaagacgtgtctttttgaataattaaaatgttttttatgccaagtttattaacaattacgagaaaagcgctacttgtaaattcgtgtcttaaattttattaaacccaaggggagtgattttacgtgaaaacttattccctggcttatcgtggtcgcagatctcgaacctaacatcatttttgtaccaaatcctaatcactataagccgaactcgaacaaaaagtcgaaattcaaatttttagaacttgaatttttgctcaaatttaggttagggatttggaattgtgaacttgatgctgggtttgtgatcattgatcccgaaaaactccaggatcaagttttcatgacaaaattttccaaccaccctttgattttaataaaattcaaaaagtaccaatttgcaatcagcgcccaataa

SEQ ID NO: 51746 - DNA, 129 bp, Heterodera glycines
  Genomic contig location: Contig_ID=SeqID_21169; Location=337..465; Strand=+
  SCN-specific regions: Sequence locations=1-129
atgaacgattacttgggcaccattactacaaacatcacaaaaactttgactgacagtgcggcggacggaactatgaaaattgaaattttgcgtttcatttcgctgttgttgaacacccacgaacctgag

SEQ ID NO: 51747 - DNA, 902 bp, Heterodera glycines
  Genomic contig location: Contig_ID=SeqID_21170; Location=89..990; Strand=-
  SCN-specific regions: Sequence locations=1-251,274-682,704-902
atgtcgtcaagccgacagaatgcccatcatgcaagaagtgggagtggcgcagatgccgtcagaggcaattcgcgcgagagaggtcatagatcggcgcttgaacttccaagaggccgactatgttggtgagatgacgccagctaacaaaggcgacgacaacagaggtagccgaaagtgaaaaattttgtaagatttgtcttcataaggacccggttcacatccgcacttcacctctgtgaacatgcgtattttgggaagaagggaggaaggaagacaccagagaacggacagcgtgtgcctcatttgccacctgcagcttctgcgtggacagctgatcagcgttctgccttgtgaaaggtccgtcagccacaccttccacacgatatgcatcaggaggtggctggcgacaaatcgcacgtgcccagtctgcaggcgggatgttcgaatccgtcctttgatgtatgagacgactcataaactgttacaaatcaagaacttaagggaccaaacggatgatcacctgcgggcattcaacgagtacgctgagggcttgaacaaccagccgatctcgacacaacggcaggacgacgattttgtggccagggcttggtatgaattcgtcagaatcgataaaaatttatcggttttctaggcggcactacgagcagcttcttcaacctgaacacgacagaaacggagcagtcatccgtcgaccgatgcggccacggctcgcctacagacaggtcatgcaacacatcaacagaggaaacttcgacagattttgtggccaacatctcacctgggacatcaccgacccgaggaacgacgaagaagtcgcataccagatgtgccagacacttcttcaggaacgagccaaagaagatgataaaaattggggataa

SEQ ID NO: 51748 - DNA, 468 bp, Heterodera glycines
  Genomic contig location: Contig_ID=SeqID_21171; Location=54..521; Strand=-
  SCN-specific regions: Sequence locations=1-157,179-468
atgcaacgcccgattctgatgacggctgaacaagcaaaggcgttggaggcggagagaatcgaggcccagaagcgcatggcagcagatcgccgagtacaagatcgattgcgccaagccgaccaattcctcaagcagcaccttgaccagcagaagaggcttaagcagcggaatctggtctggggcaggcacgccgcatacgagcgatacatcaatgagcggttggagaagctcaaggctgacgtcaacgctctacggaaatctgcacgcgagtcgataaacttcacagaaattaacctatgtttgtaaaaaaaacattaaggtcaaatagtgcaaaaaatttagttctgccaactcgccaagctgttgaagcatattgcgctgacatcattcgctatgctaatcatcacgctgaacttgatgtgcaaaaagcaataaaggaacatcagcagattctcgagcggcgaaagc

SEQ ID NO: 51749 - DNA, 1236 bp, Heterodera glycines
  Genomic contig location: Contig_ID=SeqID_408; Location=50..1285; Strand=+
  SCN-specific regions: Sequence locations=1-422,444-618,656-674,703 -830,888-1028,1050-1236
atgggtgatggaattgttggacaagttcaggctggacaaccgagtgaggttgacaaacgatttgggaaaactcgaaaaaagaaaattcactttaaaaaacggcgaaaattttggaaaaaacggaggcctacccggtcacaatgtttgtgcttatgtccaaataggcaccgatttcttcaggcacttcgacaatttctggggaaaaaaggattgggataaattagagagaaaaattgggataaattagtggatggatttttgaaaaaattgaattttaggaaaataaaagcctcctagaggaggggtcagagttttacgtttgaccaattttctgtttttttggtgaaaataagcacaaacttagaaataagtgttcacattttggggaaactggaatatgccaagttcgtgacgatttgaaaaaagatttggcccaaaattattcaatttttaacggatattttatttgattttacgatataagaaaattcactaatttaccattatacataaacctaaaaaaacatgttggctatgacattttagaatgtgataaaaatagttgaaaaatgaaaaatgctaaaaaatgaaaattaattccaaattatttaccgtatcaaatatttaaaaaaatgcttaaaaattaaaattttttccaatttttttaccgtgtcaaatatttaaaaaaattgaaattattttccgtaataaatagtctaaaaaaattcttaaaaatgaaatattatttccgcatttggcactaattagccaattaattaattgcccacattcaatttgccaatttccattggcaactcgctgagaatttcttaaaaaataaatattattttataaatgtaaagcaaaaaattttaaatattattataggtatatggggaaaaaaagaaaaagaaatatttggaaaaataaaataaaaaatggcgtgcgttcgagcggactcgaacttaatgtatttaattgagagcagcaacgctaacgactgcgttatgcacgacaacagcaaacgatttaatttccttttcaatattccaaaaaaacttttgtatatggaatttgagagaaaacaaaggactaaaatcgactaattggattggcgccgaaaagtctcgatattgcgccgagaaaggtttacggggtgtgatcttcgagctctgagggccaaaaaaatgtaaaatttgaagtcatgaaaccgacattggaatttttgaaagaaaa

SEQ ID NO: 51750 - DNA, 778 bp, Heterodera glycines
  Genomic contig location: Contig_ID=SeqID_411; Location=1228..2005; Strand=+
  SCN-specific regions: Sequence locations=1-34,56-103,160-193,216 -333,383-493,522-523,552-603,625-778
atgaagcaccagaaaatcatggtcaaactgaacacactgcaggcgaagatgctcaaaatggagcaggacaaacagcaaacggaaatggagaaaaatggtagggaaattttaaaaaaaaaattaaattaattatgcattcaaaaatttttaataatttttggtgggtttagaattattttttttcaataattcggaaaaatttgaatttttattttctcaacttttacatttctccggggatccatccttaaaaagttgaaaaatgttttaatttttttcctgtgcttttggtcaatgtaattttcgattttttgacaccttcgttatatatggaaaaaattttaatttaaataaaaataattaaattaaattttgttttaatgtttaagcttcggtcgaccaaatcaaaaagttgaacactgagcagcaaaggcttttccagaggatcagcacattggagaagattaatcagcaacaaaatgtgaataaatttatggggaggggggaggagaaaaatttttcgtaaattttttaaaattttataaaaattacgcacacattttcaaaccaggttaaaaaaaaattgtgtcataacaattattgggttcaattacagaaatccttagcccataattacgcatttccataaatgacatttatttacggcagagttcccaagtttttttttttcaaaataagacaaaatggcctaaaaactaagattctgaccccaaaaataagatttttctaaaactaatatttgcgtgaaggaaacgca

SEQ ID NO: 51751 - DNA, 1220 bp, Heterodera glycines
  misc_feature (103)..(103): n is a, c, g, or t
  misc_feature (135)..(135): n is a, c, g, or t
  Genomic contig location: Contig_ID=SeqID_412; Location=113..1332; Strand=+
  SCN-specific regions: Sequence locations=1-44,66-74,160-212,234 -473,523-633,662-663,692-743,765-1082,1121-1220
atggagatggagctgaaggagacaaagaatctgcacatgatcaccaagctggagcttgagaatgtgagttgggcttaattactaaaaaaataaattacaaaanataaagatttaaaataaaaatatatattttanatttaattattttttcaatttttaggtggcacttcgagaaaggatgaagcaccagaaaatcatggtcaaactgaacacactgcaggcgaagatgctcaaaatggagcaggacaaacagcaaacggaaatggagaaaaacggtagggaaaaattttcgaaaaaaattaatgatgcatttttctatttttttcaaaaattcggaaattcgaatttttatttgctcaacttttacatttctccgggggtccatccttaaaaagttgaaaaatgttttaatttttttcctgtgcttttggtcaatgtaattttcgattttttgacaccttcgttatatatggaaaaaattttaatttaaataaaaataattaaattaaattttgttttaatgtttaagcttcggtcgaccaaatcaaaaagttgaacactgagcagcaaaggcttttccagaggatcagcacattggagaagattaatcagcaacaaaatgtgaataaatttatggggaggggggaggagaaaaatttttcgtaaattttttaaaattttataaaaattacgcacacattttcaaaccaggttaaaaaaaaattgtgtcataacaattattgggttcaattacagaaatccttagcccataattacgcatttccataaatgacatttatttacggaaatgcgtaattacgggagtcaaaaaggcagtcattaacccgtaattagtaattgcttcctgccttaaccacaacaacgcacacagaagtgtattatattttttttaacttgaatttcaccataaaaattccaattttttttttttgtattttcgaaacttttttaaaaactaaaaaaatttccacccattaactcttagaaattgtcataaaatttaatggaaatttttggaatttttcattttaatgaaaatttcaatcttttttcaacttctcattaaaaaattataatttatcaatattattaaaaatttcagttgttttacaatttccaacaaaattattgggatgccaattcgtgtaacggtggtcagctcgcaattacggatgacaattgtttgacagtgcattaca

SEQ ID NO: 51752 - DNA, 565 bp, Heterodera glycines
  Genomic contig location: Contig_ID=SeqID_412; Location=1698..2262; Strand=-
  SCN-specific regions: Sequence locations=1-77,99-565
atgcgtaagtgcccttgcgcattcgaattgcgccatccgattggttgacggcaaagccgaaatcggcatagctaaatatttttaaaaattagtaaaattgagatactcgagaatcgagtttttctggatcaggaagaggagacggagaattaattaatcgagactcggaagcgttaattgaccagctgagccaagaatcggtgccagagattcgagaccgagaatttgaccccggacaagggcgtataatttctaaggaaaatggtatactttttcaaaaatttccaacttttcaatttcgggtcccctccctgctggctaagccattgacccggaaatcgagatgtagaactgatcagactcgggagcttataattgagccagggaattcgagaatcttctgccaagccggggattgagccttcaataccctagtaaaaatgcgacagactcgagaccgacactcatgaagaaactttaattgagcccgagagtcgaaaatggaaacagggagccgaagccgagaattaaaaaaacatccaaaaaaagagtttctcgaaataaa

SEQ ID NO: 51753 - DNA, 1725 bp, Heterodera glycines
  Genomic contig location: Contig_ID=SeqID_412; Location=2983..4707; Strand=-
  SCN-specific regions: Sequence locations=1-116,139-151,173-506,530 -853,875-1488,1510-1725
atggacgagcacgagaaagacccggacacctacggaaattggcaatatgaggagaagccatgtgcctgccattgttcgtatctgcgtgccaagaaattctaccgagtaatttcgctaaaacaaacaaacaaattgaacacaaataaattgagtttttcacaattttgttaaaggttgattgtgacttcatggaccgcactaccaaaattgttttggatgctttcttatcggatactgcgctcagcggactaggtaattaattaatgataaagaacatatgaggtgtttcattttagcattttttggggataaattccccgtcagggctggacgaaatttcgttttcgtttcgtcctacattttcggcacctttttgagtttcgttttcgtccgccaaagttttttcggtttcggttttcaaaattttgtttttcgtttcgttttcggtttttaaatttttggattttcgtttcgttttgttttcgtattcgaaaattttttttttatgattttcacacacccctgttcccagtccccgagtggtgccgtgccatccccgaatccctccattccttcatcccatcaattttttttctgcacttgggttttaagtacgtgctttgattccattccatgcgtgaactagtgttagccctacttaataacgaaaagaattaagccaattttcgcatttttcaaattttcgatttcgcacttttcttctaaaattgattaaaactaattgaaaaaaatcacaggcaattttaacagcaaaaataagtcattctatgcaaccttgaaaatgaatgccattttgtaaaatttttgctattgtaaaaaaatttttcctattgtttaattttcttgaaattttgcataggcccatattttgatcaccttgatcgaatcacagtttattttttagctgtctagtttttaactcgagatcggctcttcctttttataagggaaagtctcggcaatttttttaaattagcggacttttttgtccttaggcaataattgtcaaattgatcaatgatcatatatggtgagatcaaagtactgtataaataaatggttcgatttcataaagggaacaattttactccaagattttaagtcgaaattttgataaaaaaaaattggcattttgaaaatggatttgctttatccattgctgttcgttcatccactgttccttccttcatcacagacattacccacaccgctttggaggtgcactacgaatgcatactttgtctcgaaattgcctacaaaacttacgaaattgtgtgtgaagacgaaacgagtgacagatggggccgttacatgacaacgtacggagatgagcccatcgttggcattcgcaccacggattttgatggcattcagcgcgtgtttgatggcatgtggaaggactacaatttaattgtcagcaattgcaagcattggaccgataatatgatcagacgtctcatgtcagttaaagcagaaattcccataaataaataattagatttgatggatttcacaacggaattcgaagttttaattatatccattggaatttgttaattgaagcggaaatttgttgttttttccaattttttagtgcctatttgaaaatttttcgtgcctaaatgtttggacccaaaaaacaaaaaaacataactgagaacattttaacgacattttaaatcaatgaaaaagtcaaaaattaaa

SEQ ID NO: 51754 - DNA, 1607 bp, Heterodera glycines
  Genomic contig location: Contig_ID=SeqID_413; Location=1423..3029; Strand=+
  SCN-specific regions: Sequence locations=1-126,148-536,571-702,732 -807,853-1052,1074-1267,1289-1607
atgcaagttaaacttattttttatgtattttacgcgaccgttttggattattcggacaaatggtttaatctctttgacgatgttagcgaagccaatcaaattctcaattcaatcccaaaggacgaattgcagaagctcaactcagaacagaaatggatgaagttatttgaagccgatttaccgcacttgtacaagttggtcagcattgtactttccgtgccggtctcaaatgcatttgtcgagtgttttcgctttgcggctcacaatggactgatgttcggaatctgttgaaagttgaaaccgtgaaggagctggttcagacgaaaataaattttgatctcacttgcccagaaatgtatcagatgctcatttccaatcacaaactgttggatcagatcggtggatgggaaaaatactttgaatgacacttttttgaaaaaaatattattttcaataataaaaccgttgtaattgtgccaattggttgtattttgcttttataaaagccaataatgcttttaactgtttttacaaggtaaaaatccattttttcaaaaaatctttattttggggtcaaaatcttagttttagcctcgtttatcctttttttgaaaaaaaaacttgcgaaccctgtgtaaaattcaccaattctttaataaaaatgcaatgaaaaattttttgacgcgatcactttttggcgacttgttcaaaaactttcaaaaaactttccacgaaatttattattttttttttggtggtcgaacatttcttcgtcaatgaacctttcgtcactaaacttttcgtcactaaaataaaataaagtattttaaaaaggaaaaaattaaaataaaaaattaataatatatgtaatatgcatttgaaaaaatataaatctaatacagggctcccattcgtccttggatgccaaggacgtccttggaaatgagcatttggaaaagtttaaaaatgaaagaaatttgataagtttttgtaattttcaacaatatttggattaaattatgcattatgtaattaaaatgcaaatttaattgcccaaaatctcaaaatttggtcatttttagacaaaatctgctaacaaacactgccggaccgcccccccctgttccccgaaattttttggaacaaagcgcgccacagcatatgcggtgaaatgaggaaaaatcagtgaaatcaaaaaaatgtagaaaaaaatccattccggtgaaaaatgcaagcctttgagtaaattattaaccatttttctttcatacatataataaaaatttaaatgtccttggttttcatgaattttccccactatgttcttgcaaatcggcatacccgtccttggaaacggagcatggacgatggtaaccctgatctaaaaaatatccattctttaaacaactagcggtagtacggttgtgccaaccctcggcatttcatcactggatctccggcatacacatacactcatcggaactctatttcagcaattcctctacatcccaatcgccgggactcaattctccggcattccaatggccgggactcaacccaccagcattccaaagcactggaactcaactctccggaaatccaatcat

SEQ ID NO: 51755 - DNA, 77 bp, Heterodera glycines
  Genomic contig location: Contig_ID=SeqID_413; Location=1326..1402; Strand=-
  SCN-specific regions: Sequence locations=1-77
ccaaggtcagcaccaaaaaagcgctccctctttctgaagcgtctgacaataggttgtgtacacaaaaaaaacaaaaa

SEQ ID NO: 51756 - DNA, 427 bp, Heterodera glycines
  Genomic contig location: Contig_ID=SeqID_414; Location=256..682; Strand=-
  SCN-specific regions: Sequence locations=1-24,46-70,97-324,346-427
atgtctgacaatccaaaagaagcggaaaagatggaaaaagcaatgtaaaataattaaaaatgccaatttcaatttttgttttcctttttcttcagtacagcgcgtccgccgttgcttatcacttgtcaggggattcctttggctctactccagtttatgcgtccaatcgttttttatgcgtccaatcgacttttatgcgtccaatcgctttttatgcgtccaatcaaagttttatgcgtccaataacatttaccatgtgaaaattattatcccttgccactgtttgcaaaaaaaaatctcttacactacacatgataattgcgtttcatttcttccaaaatatgcatgatatcattctgtaattttccaattaattacatgaacatattctaggacgagaattttcggaagatatcacacaattaaa

SEQ ID NO: 51757 - DNA, 456 bp, Heterodera glycines
  Genomic contig location: Contig_ID=SeqID_3756; Location=731..1186; Strand=-
  SCN-specific regions: Sequence locations=1-456
atgctcgtcaagcggctctcccaacagaagcgccgttcgtccgcttgtgattcactcgttgccaaagcgaacatggccaaacgcgacgcttttcggcattttggctcccatgtgcagctttgtgtgatgatcaaaatcacaacgttttccttgacattcaacgcagattattgtggagctttgacggaaaaggtgctgaagaatttgcagacgaacaaatgcgaagagagggaaaaacggacggaagtgttggaggagttcaaccgcgagcactttggcaacatgctcacttcccttcttatagatttcagcgaaatgaacgccctgaagcaacttctgaagcatcccggagcaaaaactcgccttttgcgactggtcggcttggcagaactgtttgaaaagttttgggaaaagctcggactgacgggagaagaatttacggatagtggtaaatag

SEQ ID NO: 51758 - DNA, 1201 bp, Heterodera glycines
  Genomic contig location: Contig_ID=SeqID_3758; Location=1386..2586; Strand=-
  SCN-specific regions: Sequence locations=1-378,400-1201
atgcatgtcgccacgcatacggtcgagcgtcgttatgaagaagaaatagccgaaattgatggccgatatgatgaagaatttgcccaacttgatcgccgttatgacgaccaaagtgccgaaatcgaccgtcgctatgatgaagcaattgccgaaatcgaccgtctctatgatgaagaagttgccgaaattgatcgccgttatgaagaaaaaagtgccccaatcgagcgtcgttatggcgacgaaaccgccgtaatcgaacgccgttatcgcgaagaatcagccgaaatcagtcgccgttataacgaagaaaaagccgtcattgatcgccgttacaacgaacaaatggccaaagttgagcgccaaggtccaaataattacagtaaatggcatttaaatgaatttacagacattcgttttgccgcaggtcccccggcttccgctgcttctgctccagcgcagcctttggctccgaatcacggcacaaattttggcctatcaggccattctgctggtccttttatcactaatttaaccattgataaattaacacaactttcagccattcctttttccactcgtcaaccgaatcccgtcgcgtctgttccggtacaatctttggcacccaattacgccactaattatggccagcaacccttgggccatcctcctggtccgtttatcactaatttaaccattgataaattaacacaactttcagccattcctttttccactcgtcaaccgaatcccgtcgcgtctgttccgctacagtctttggcacccaattacgccactaattattgccagcaacccttgggccttcattttgccgctcgtccaccaacttccgcctcttctgcgctgtcacctaattacggcactaattattgccagcaacccttgggccttcattttgccgctcgtccaccaacttccgcctcttctgcgctgtcacctaattacggcactaattatggccaacacctcatgggccatcttcctggtcattatcatttgatctcatctgtgataatcccaaaataagtttcaggcgctcattttgtcacacgtcctcaaacttccgcagcttcagctttggcacagcctttggcagccaattacggcattaattacggcctacgccctttcggccacgcttcaggtccttttatcactaattttatcagtaaacctaattaaa

SEQ ID NO: 51759 - DNA, 815 bp, Heterodera glycines
  Genomic contig location: Contig_ID=SeqID_3759; Location=1214..2028; Strand=-
  SCN-specific regions: Sequence locations=1-98,130-155,177-382,404 -408,513-815
atgacccttggaagtgcgtatgctgtgcaggtgtgtgaaatgcgattttttggaaaaaaattttgaggaccggcggaagggtgccgataggcgccactggaaattttaaaatttttccccacttttgtagcccgtgctgatgctcaacgccagcaaatggcaatggccacacagtgtgcgacgaatgcagcgactgttaacgaaagcgaccactgccaccaatgacgacaaaacagcaacggagacgacaacaacgacggcaccgcagcaacagtcgcaggacggcgccgcaacgacagcagcaactgcacagccaagtgtcaccaacacggacagccgaatgatgttcacgataaagtgagtggtgggagaagcggtgggaaaagcaaaaatatacatattttcgtgtttataaacaaaaaattttctgttatttttaattttaaatacttttaaaacacaaaaattttctgaaaaaaatagtatttttttaaaattcataaaatattttagaaagactaaatgtacaaacgggacccacgcgtttcggcgctcgcgtttcggcgccagctctttttctacgatagcttttttctttgacatccaaatacaacattgttggtatcactcgaaagctcttaacatgctctattagccttaccaaaagcgaaaagattttcaagcctggaaaaaattttattacgaaaaaacttcaaaaatttcgaattttcgaattttcgcaattttcatgtataacttttttggaaattgtctaatagcgaagcaatagcttagaaaaaatttctgttaataaa

SEQ ID NO: 51760 - DNA, 1291 bp, Heterodera glycines
  Genomic contig location: Contig_ID=SeqID_3760; Location=617..1907; Strand=-
  SCN-specific regions: Sequence locations=1-392,414-641,663-691,713 -849,871-917,956-958,982-1011,1097-1105,1127-1291
atgactgactgccttcaaattttcaacaaatctgcaaagtccaaggatccaccaaagaacagaaaattagttatcaaacagctggtgaatttggcgcaaagtgagatagaatgggccaaaaacaacaaattctgcaaagcagtggagcagggcattccagcggaggacaataagaccaatgaatgatcagcgaagtaccaagcgattcaaaatccataattttccatcatgcctcaccctcataaaaagtcatatctcaaaaacctaaacttttctagtgtagtctggcgtcaaaacaaaatttcgatttatggggaaggatataacggaaataactataaatctttgcgcctaattttcataaaaatttgttagtaattagtgcggatgggatttttatgtttttacattactagaaaagcccaagacaagcattttttgcattttctctaaacaattttcgatttaaagccacttataaaaacataaaagcacattttaacgttttggcacataaaaacatatcgcacatagttcgatgtttggcacatattttacaattgaaaaatttgtaaggaaaatgtaataatttgaaaaataccactcctaaaaattaactttctcgtcatttcttacagcattttcaaaaattatttatttattccgaatgctgaatcttgtgtgcttgattcaaaattatttgaaattgaataattcctaaaggcgacgtatcaaattattattctttttagcacgagctttcgtacgaacattgcgatcaatctctttgttaatttttctaaattttcgggtctcttttcaattttcatttttttggctcgttaagaaagattttatcatattttcatatatcccgtaatctgacaatttttttctttttttctcaatatttcgacataattattttcatttatattatttctttaatatttttgtgcatttctttcatttcttttttcaacgggaacagtcagcaattttttcagtgacatttttttatttttaaatgaactataatattttttgtatataaaaccaatattttgattagtaattttcaatttaatttaattttgctaaatatttttcaagaagttttattttttctcgattaaagtgatggaatgttgttcatttgcctttttagcggttaatgaagtatcagacatagactggccaccttccaatatgcaaattaagaggcacagtattagtaaaaacctaagaaccgcagccctaattatttattaagttcttatttttcaataaa

SEQ ID NO: 51761 - DNA, 420 bp, Heterodera glycines
  Genomic contig location: Contig_ID=SeqID_3760; Location=2080..2499; Strand=-
  SCN-specific regions: Sequence locations=1-189,211-420
atgttccccacttttcttcttcttcttcttccactctttgcgctgcttttgagtgaatgccgtggcattgaattggtcttacgcaataactcatccctcaatcaattgaacatctctttgccccatgctccgtctacgaaaattagcaaaaagattttggtcaaattctccgaagagtctttccgacccatttttgcttttgctggcacttcgcttgatcggccctatttgtatgtggacgagtcggacaacattaaatcagttaaccataaagccatggagaatgccataaaaaatgatttggcggtgcagaagaaaaatgccaatattaaacatgcaattgaggacacaacttacgacattcagcaaatcaatttaaagcagcatcaaattaagaggcaagtggattgtaaattttaa

SEQ ID NO: 51762 - DNA, 1037 bp, Heterodera glycines
  Genomic contig location: Contig_ID=SeqID_21172; Location=496..1532; Strand=-
  SCN-specific regions: Sequence locations=1-9,31-198,220-258,280 -399,423-423,445-801,823-877,899-917,959-1012,1034-1037
atgaatacgtcttttgaaaaatgcaagtatattgtaattggtgagtaattttcaaaattattagctaatcaagaaaggacaaaaattgtcctcaattagtgaaaagaaaaaattcctatttttactccgcagtattcaaagtcaaacagctgcagacagaaaaagtataactacttttaaatgaaaataattaagagatgaaaattttaaaataatttagtagtatccgctagtcaaatctattttacattaaactcattattttgagcaggagggagtccgagatagaattacacaaaatatgtgaatatgttcttgtgtttaattaaggcctttatgcgcatcttttaaccctttaataatagaagcgagttgaaaacagtctcactataaatatgtgcttattttaaaattatgaatacctcttttgaaaaatgcaagtatattttaattggtgagtaattttcaaaattattagctaatcaagaaaggccaaaaattgtcctctattagtgaaaagagaaaattcctatttttccgcagtattcaaagccaaaaggcagacagaaaaagtataactacgtttaaattaaaaaaattatagttcaaaaactggctggcgcgaaaacgacctggcctgcattttttgttcgaaaattttgcgttttatcgcccttattcgccctttgaaatccttattttagatgttcgcccttaaaataagtgtttgcccatattttggcatttcgtccttattttcgcccttatttctagatttttaaattttttcatgtaaaattcacaaattctttaacaaaaatgcaatgaaaaaaactttttttacgcgatcacatttggcgacttattcaaaaattttcaaaaatttttccactaaatttgttttttttcttgaccaaaattttgatttgaaatttatttattttggaaaaatgtattcaaaaatttcgaatatatacaattatttgcaactgtaatcaatgcgcttcattttttaggcacaaaaataggcaaataaa

SEQ ID NO: 51763 - DNA, 435 bp, Heterodera glycines
  Genomic contig location: Contig_ID=SeqID_21173; Location=14..448; Strand=-
  SCN-specific regions: Sequence locations=1-435
atgcgtgccaccaatgttttgttggccgtcgtccctttcgtttacgtccttttcaatttcatgtacaacctcaaaaactttctcaaattcttccaaacgaacaaaagtcagaatatttttctcgagcatcactattggttcgttgtcggcagttactttttattctgtgccaattttgcgctcaatttcatcctttactcaatgataaggtaattgtacaaccatttaatcattttggtttgattatactaattagttaattaattaagcccggtgtttcggaaagaattttgtcgcaaatggcttcgaaaacgggcaactataaggccaaggtccaccacaatgacgacaaaagatgtgcagacggaaagtgccaaaaagagtctccaaatgaaaccaatcgaaacgaaaacagcggcagagacaataatttaa

SEQ ID NO: 51764 - DNA, 572 bp, Heterodera glycines
  Genomic contig location: Contig_ID=SeqID_21177; Location=56..627; Strand=+
  SCN-specific regions: Sequence locations=1-95,131-201,223-302,324 -366,388-484,506-572
atggacggaaaagaattcatgtcacaattcaatttaatatggaggaatccatggtcagaatcaaacaaagttcatttgattagaaagaaaataggtaataaaaaataataattaataaatttaaattattgaagggaataaatcattcatttcaattttttttcaccaaagttgtaattttttttgttttctaaccattccaaatgtgctagaaaattttaaactgcaaaattgaaattttagatgtaacttccatctttaatcattaaattttgatttaattataccaatgctataaaagaattattatactttttattaaaggaaaaaatgccagctcatattgtgtcaataaccttggcataatttttgatgaacaaatgaaaaaactcaaaaacggcacacctatctctttggaaccaaaatgtaaccgacgattacatctacaagttttttggcaattgcgttggacattggaaaaaatgccagagtttacttcgatttcagcccaaaaaaagaatgcgatcgcttttctggacggatgtataaaagttcttcgttacacagaatga

SEQ ID NO: 51765 - DNA, 141 bp, Heterodera glycines
  Genomic contig location: Contig_ID=SeqID_21178; Location=914..1054; Strand=+
  SCN-specific regions: Sequence locations=1-24,46-141
atgacattgacaaaggttggttatattacaaaaatttattgtaataagctgcataatttaattgcagaatgtggaaatcgtcacccgaactgttggcaatgggcaaacgaaggccaatgccaacggaaccttttttggatg

SEQ ID NO: 51766 - DNA, 337 bp, Heterodera glycines
  Genomic contig location: Contig_ID=SeqID_21179; Location=1417..1753; Strand=+
  SCN-specific regions: Sequence locations=1-37,59-111,177-337
atgtgccgtcggggaggccgtggtaagcgtcagattagcatgctgttggaaggagctgctggttctccgcccggaggacattcagaagaccagaaaggtgatattttcatcaattaattttcaaaattttatttttaatataaatttaataatttatttttgacattttttaaaatgaattccatcaaagattcacttggaccgcccaaaactgctgcttcgggagcgaaagaatttatttcaggacaaaaatcaatgccggaaagcaacggaatgccaacataaaaaccacttaaatttgaattctgtttcccttctgacccaataccaaaatcaa

SEQ ID NO: 51767 - DNA, 1488 bp, Heterodera glycines
  Genomic contig location: Contig_ID=SeqID_21181; Location=19..1506; Strand=+
  SCN-specific regions: Sequence locations=1-36,59-252,287-317,552 -570,651-697,744-906,929-1033,1055-1132,1168-1275,1297-1430,1468-1488
atgcctattcaatgccaccatcgctggaatacattgatggagcagcagcagcaacgcctccacccaaatgatgagaatgccaacaaacagttgaacgcaactccgctgtgccaatcgcggcgtgccaagtcgccattggtaactttttaaaatatatttacggtttttgtaaattttaattcctctaaaattttttaagaaaatttactgccatttttttagattagaaaccaaaaatgcatctcatcaacattttaatttaacaaaaataaagaattaaaaagtgccgaaattgttcgtaaacaaaaattaattccttatttaattaattatttttatttttatgttttttttttgggataactttattatattaaaaatttatgaaatttttacagaatttaacaaattataaataaaactaaaaataaataaaatattttatttctttgaaggttcaattcctttaaattaaaacaatctgagatttatattaacttaaaaattaaatttaaaaaataattaaattatttagattaatgaaattatttggatttttctgctttaatcaaaaaaattttttttatgaattttgtgaattttaacaaattttattctaaacataaaatcataaaatgaatatttattttctatttgaaacttcaattcttcaaatgtgaacggctttagatccttgattaaattaacttaaaaatgaaaaaataaaaataaatttatttattcaatttgtcaggtgaccggtctcggcacaattggaaaacgccatcatcagtttggaaatggaatgccaaacaattcaaatagctctcaggaaaacaatgccaattcgccttgccaacttagcaccgattcggaagtgtaagaagaacaaattcgatacacaaatttttgaattttcaaaattgcccattataattgatcatttaccataattaattgattcttaactaacacgaattgatgactaattaatgcacgcggacaaaatttttcacctacgaaattatggtggtttttttatttttttatttttcgaaatatttctttcaggctaaatataaaacttaaaaacgaagttatgaattaaatttcttttaaattatatccgaagaatttaaaatttataaaatattttcattattaaatggtgaaaataatttggagttttgtccgaaaaaatttaatcattaatttaattaacgcaagattttaattatacattcgctacttaatgctgctttgatcattaattgaaaagttttgctttttgaaaaataacttggccattattacaattatttattcaatattccaaattaacttttggtactttcgtttgaattatttttcactttcaattaactcttcccatctcagggatttggtttcgttataattgtattttcttcttatttattttttaatttaaacttttttcatatttaacttccatttttcatggcttga

SEQ ID NO: 51768 - DNA, 233 bp, Heterodera glycines
  Genomic contig location: Contig_ID=SeqID_21182; Location=2503..2735; Strand=-
  SCN-specific regions: Sequence locations=1-76,100-233
acattgcgaaaatggagatcaattatgaggacgagtgtccctacaatttgggctttgctcgtgccatgttcgacttggccgctgctgctgctggccatgcgggcaacggcacagaatggcaaaacatgaaaagcaaatttgtacaggaaagccaagcaatcaaagcaattggccaagatttgaacattaaagttacggatgtgcattttggagccacaagcaaaggcaaataa

SEQ ID NO: 51769 - DNA, 1888 bp, Heterodera glycines
  Genomic contig location: Contig_ID=SeqID_21182; Location=1214..3101; Strand=+
  SCN-specific regions: Sequence locations=1-617,639-750,773-950,987 -1027,1061-1181,1203-1258,1296-1423,1447-1533,1570-1669,1691-1888
aaaaaatagttcggaaaatgattcttcgccctctaaattttcaaaagcttcatcttctaaatctgggtcctcagttagccgtggtcaattgaaagaggaaacgcgcactttggacgagatttacatggccgcgctgaaggaaggcgacaaatttattctttatgccggcggcgattttccaggcgatattgatggcattaaaggagcattcgaagcgcgcttaccgatggaagttattgtggactactccaaattccatggccctcgaattgacattcaggttgcgcttgttttcaaatagcccattttattggtcaattaaccgtgatcggtttaaaagctggtctcaaaatatcgtatatccgccaatatgcaaaaaatctcattcggcgtgtgacccgatccaacctagtcttcaatccagaccaacactacatatttttcagcttgagaacaactcactggtgccagatgttgttcagctccagactctccatgattttcctcgctggaaaaaacggggcatgctgatgcagtacaagcccaagggatggaatgccatttacgagggctaccgcgaccgggacggttatttcacaggaattatgattgccgtgttcagcaacaatgtcaacacccatatggtatccaatgagagtgattggctacgcaatgccaccgactgtctaaaaccgatatttgccaatggaagaattattcagacctacccaaacgatgatgatgcagtacttttttggtttaaacaagtaaattataatactaaagtaataatatcggtaaaatactttaaggtagtagacaaatatggatgggattatatgacaaattggctgctcgaaagccagtgatggtccgcggcaccggtgttgtatgagcacgtcttacgctacgctaactagcatgggtccagcagttctcagcaattcttcatattattttaaataaatatttattgattaattttactcttttgtatcatacgatagtccttgaattgcgttattagtttaataaatttcaaaaaaaaaatttttattaagagcaccggggaaatacgaatgaaatgggtcagacacagtcaataaagaaggggtagagaaatgtaataaaacaaagaatggaatgagaatggactttggtcatatccaacaatggtcaacaaagtgtttttctgtattatgaattttcttgctaatatattccgctttttggcggaaaatccttgaaaattatttggaaatataaataaatatttatttaaaattaatttatttgcctttgcttgtggctccaaaatgcacatccgtaactttaatgttcaaatcttggccaattgctttgattgcttggctttcctgtacaaatttgcttttcatgttttgccattctgtgccgttgcccgcatggccagcagcagcagcggccaagtcgaacatggcacgagcaaagcccaaattgtagggacactcgtcctcataattgatctccattttcgcaatgtcttaatgaggtaatttgaaacaataatttcattttaattatttatatcttccaatgatctgctgttagtattgtaattactcttcagctgtcggtcgatttcgttcacaatttgtgcttctcctccgcttgggcatcccccgcgataggacagttcattttttattccatccacagtaattttcgcggttgagcatactgtagatttgtccacaccagtgaaagtgttgatgtatttggacatcacagcaggtaactcttcgatatttcgcgcaaaaaattctcgaataatccctttttatcaaaaatttattactttaaataagtgtaggacatgtcacaaaatggttttcggtgctatgaattt

SEQ ID NO: 51770 - DNA, 395 bp, Heterodera glycines
  Genomic contig location: Contig_ID=SeqID_3761; Location=227..621; Strand=-
  SCN-specific regions: Sequence locations=1-136,158-250,285-395
atgcgtggatcagtacaaacatttgtttgtcttctcgacggagaatttacgctctgcaaggctggcggaggtaaaaataaaaaataaaaatgcaattttttgtcaaaattagggaaggggcggcataaatgtcacaatggggagagggaggggggacaaatgggtgacaatccgtggtttttttcgatatacctccttttattcaagcccttaaagtgtttgtgcaattatcattttcttgggaaacccgaaaaattgaaaaaaaaattttttttttaatttttgcttttgaaggtccgccaacatttcaagcagaattcgcggattttcttcgccaaaaacaatttggtggccatggcattggacaaatcggcacaggacgaacaggtagatag

SEQ ID NO: 51771 - DNA, 2575 bp, Heterodera glycines
  Genomic contig location: Contig_ID=SeqID_3761; Location=1973..4547; Strand=+
  SCN-specific regions: Sequence locations=1-110,132-146,168-549,571 -923,945-962,1013-1079,1115-1201,1237-1273,1296-1382,1420-1460,1515 -1602,1648-1727,1805-1847,1898-2022,2046-2061,2139-2193,2216 -2317,2339-2474,2505-2575
  Gene Ontology: Mol. function=protein binding; Cellular component =endocytic vesicle; Biological process=synaptic vesicle endocytosis
atgggaattgttcttacggtatcctcccaagaagaagctgatgaccgacagattttggaagccaatttacgtgcggatgagtggcaatatgctggcgatgttcaccaacagagaggagacgaggccggcgcaggaaatactcattcaggcaaatggcaattaaagaagcaattagtgctaattggttaacgaccaatgaatctatttgttgtgtttgttcactgatcacttccgttgtgcccaaattcaggccaattattcgctgtcggacattgtgctgcaaccgtacgacgctttcaccaaaattcacaccgtaaaattgcaacacattctatacaatgagcgcaatggtattcgctccggtcaaatctcgcacctcgtcgaaggctatttgaccaaatatggccttcctcttgagcacgcggctcacaatcagtgcacagtgctggctaagtttgggtcattgaacgaacggaccatcgccagtttcaccgacgcattagaaaatgtgctgttccattacccgaaaaagcgcgagacggcgccgacctacaaatatgacgaagtgcaggtgaaaaaaagagagaggagaacgatgcgagagtgaaagagcaatagtcgagaatgggtatgctggtcaagagtttacgacggaaaaaattggcactttgaaatgggagggacagagaataattagtcggcaatggacatttagtactttgaatattgacacatttgcattcagattaattgttacgatgagtgcgaggcttcggttttgataattttcggaatcataagttgctcgttgctcaaaatatcttttactcacccggatccgaacctaaccatcccctcccccctcagaatgtttctttggggcagtacgatggcatagtatgagttgggtttcgtccgtgcacttctccttttctggtatttcatttttaagtaagaaaaccaaataaaatataaaattatcccaattttcctttattttttaagctttgttacactaagattgtccaaccctgaactgagtatgaatttacaaaaattaccacaaatttcccgggcccaaaaaataaaaattttcaaaatttaaaaaaaaattccaactttctaaaacgtaaaataaggttcatattccgatttcaatattttggggagttttaactggaatttttcgaatttttcatatataattcagaaatttaaaaaatgcaataaaaatgatttttttttgcgcgattacatttttggagacatattcaaaataaattttcaaaaattttccatcgaaataaatcagttgaaattggctttattttgtaattgggcgccattgaatatttaaaaaattaaaagtaatcttgctgatgatttatttaatattaggtaaattttaattattttattcgagatccaaaaaactttaagaataatgtgtatttaagcacaatttaattaaattatgttttaatttaaaaaaataataaaaatcataaaaaaatcaggtttttgatttttcactttttttgtgaggcgcccaaatttgcacttttgtgaagtggccaaccacgattaataaagtattggtgctaatttttattttttcaattaaatattgttttaaaatatttttttggattaaaatgatggcattaatctccaaaagttaacaaaataattgttttcaccaaatattcatgcactttttacattacaaatattttaaaatttaataagtatatatttaaatggaaagttttaaatgaattttttttttttgtattaaaatattgctttttctattcactcattaagttatttttttttgattgttcataatttttacaaaaatattatgaataatttcaaaaattctattaaaaatggttatctgttctgattatatcaaactttgtgaaccagtcataattaagctggttagcgtagtaataaatttaaaataaatcattcttcattaacttaatttttgtttaattgtatttctttcgcataattaataattaaaaataattctttgcacggtttttgatttttaattttcatttacattttttataatgtatttttaaaatattgttattaattattgtttttaagtattttttccgttactttatgaaactttgtgataataatattatatcaaaatactatagaattttatgaaaatgttatttatttcctttgtttaccttttgacgtttacagaagctgatgaccgacagattttggaagccaatttacgtgcggatgagtggcaatatgctggcgatgttcaccaacagagaggagacgaggccggcgcaggaaatactcattcaggcaaagcggaaattaaagaagcaattagtgctaattggtttacgaccattgaatttatatgcttgtttgttcattgatcacttccgttgtcccaaattcaggccaattattcgctgtcggaacaacggacggaagaaaaggcggaggaagcgaagcgcggagcagcggaggaattcgaggcggacttcagcaaaatggacgctgagaacccggcccaacg

SEQ ID NO: 51772 - DNA, 82 bp, Heterodera glycines
  Genomic contig location: Contig_ID=SeqID_3762; Location=1526..1607; Strand=+
  SCN-specific regions: Sequence locations=1-82
atgccaccgcatttctgttcacaccaaaatggacgaaccgtttgggctcggaatgatcgaagcaatggccacggggacgccg

SEQ ID NO: 51773 - DNA, 1311 bp, Heterodera glycines
  Genomic contig location: Contig_ID=SeqID_3763; Location=393..1703; Strand=+
  SCN-specific regions: Sequence locations=1-18,49-670,692-869,891 -1026,1057-1311
gccaattattcgctgtcggaacaacggacggaagaaaaggcggaggaagcgaagcgcggagcagcggaggaattcgaggcggacttcagcaaattggacgctgagaacccggccaaacggtgggcggccgcgtttgagcaggccacgcttatgccgccgtccgactcggaagtgaatttggcacataaaatgaactcggacggatcggaggacccattcgacattagcgccgcgttggagggcacaaagcgcgccacagggggcgagccattcgcaccaatgccaacggtggacgaaaatgattaaatgcctttttaaattggaaattcggcccctttcagctcgaatcgtccccctccttcgacccttttgaggttattcccgtggaggaactgatagcgaaagcgcgagaaaaagccgagttggaaagggccaaacgcgaggccgagcacgagggcgaatttgtggccgagaatcgaatagcgcggcctaacgaccacctgtccgcctcgcacctttcgtccccaacgccggaagggggcagtcccgtgtcatccgtggcacggccggtcggcttctacgacgacttcaaaggggcacaggtgagcattctgctgatgattaataattgaaattgtttttataagaatttaatgcgttttccctcttttaaaagaccgctgatgacgaaagtccgttgttcgacgcggacgattctcttccacttcccgaatttccgcttccgttcatcggcgatggatgggaattgttcttacggtatcctcccaagaagaagctgatgaccgacagattttggaagccaatttacgtgcggatgagtggcaatatgctggcgatgttcacgaacagagaggagacgaggccggcgcaggaaatactcattcaggcaaagcggaaattaaagaagcaattagtgctaattggtttacgaccattgaatttatatgcttgtttgttcattgatcacttccgttgtcccaaattcaggccaattattcgctgtcggaacaacggacggaagaaaaggcggaggaagcgaagcgcggagcagcggaggaattcgaggcggacttcagcaaattggacgctgagaacccggccaaacggtgggcggcagcgtttgagcaggccacgcttatgccgccgtccgactcggaagtgaatttggcacataaaatgaactcggacggatcggaggacccattcgacattagcgccgcgttggagggcacaaagcgcacagggggcgagccattcgcaccaatgccaacggtggacgaaaatgattaa

SEQ ID NO: 51774 - DNA, 577 bp, Heterodera glycines
  Genomic contig location: Contig_ID=SeqID_3764; Location=1..577; Strand=+
  SCN-specific regions: Sequence locations=1-348,370-577
  Gene Ontology: Mol. function=protein binding; Cellular component =endocytic vesicle; Biological process=synaptic vesicle endocytosis
ctatttgttgtgtttgttcactgatcacttccgttgtccccaaattcaggccaattattcgctgtcggacattgtgctgcaaccgtacgacgctttcaccaaaattcacaccgtaaaattgcaacacattctgtacaatgagcgcaatggtattcgctccggtcaaatctcgcacctcgtcgaaggctatttgaccaaatatggccttcctcttgagcacgcggctcacaatcagtgcacagtgctggctaagtttgggtcattgaacgaacggaccatcgccagtttcaccgacgcattagaaaatgtgctgttccattacccgaaaaagcgctagacggcgccgacctacaaatatgacgaagtgcaggtgaaaaaaagagagaggagaacgatgcgagagtgaaagagcaatagtcgagaatgggtatgctggtcaagagtttacgacggaaaaaattggcactttgaaatgggagggacagagaataattagtcggcaatggacatttagtactttgaatattggcacatttgcattcagattaattgttacgacgagtgcgaggcttcggtt

SEQ ID NO: 51775 - DNA, 474 bp, Heterodera glycines
  Genomic contig location: Contig_ID=SeqID_21185; Location=1897..2370; Strand=-
  SCN-specific regions: Sequence locations=1-341,380-474
gggaaaaagaatacaaatcatccgatcaagggctaacttcccccagatcgcagtgtaaaagctgctctactgctaacaactccctgaccagtagtcaagtcgtataaaagtgattttgcgccccgacgttccaccatggcacacgagtgctacggctttggcaatgtgcgagcaattaagcacgcacatcgggccagatgctggggcatttgggctgcaccgcaagcggcgcataagtagtgcctcccgacaccggggagcaagaatattgcaatctcgcttgagcgggatttcaatagcttcacatcattggtctatcgaccaaacacatgaaccaaatacctgaacctgcggttcctctcgtacttagcaggattactatcatagcatcaggtctttggtagggtaaaattaaccagtctcgcgacggtttaagcctagctcacgttccctattcattggcttaacattcag

SEQ ID NO: 51776 - DNA, 873 bp, Heterodera glycines
  Genomic contig location: Contig_ID=SeqID_21186; Location=1120..1992; Strand=-
  SCN-specific regions: Sequence locations=1-54,82-416,438-554,582 -601,635-689,711-873
atggaaacaaaagatgaagcgatagcattcactgagaaagtaataaaacaaatgttttaaatatatttattattttttattgtttgagtacgaacattttattgtcatcgaatgcaaaggctcaagtcacaacgtggacaaattctgcgattttgtcggaaaaaggctgcgctacgaactgcttgaatttgtggagaaccccttggccatttgggtggacttttgccacgtccgcccaaaaatgatcggcccaacggaatgcccttctgccgacttggagaaaaatgggtaaaaaaatactaatttaaattcgaaattcaaatttggacagaaactcaattggcctgaggcattggctggtgggcattcaaatggcggcagaacaaaaggcaaacagcgcatttaagcgcaaattgagggacaatctgaggaagaagttggacgtgaagatcaaggaggactttgagaagggcagctttcacaatgtgcagctgaaatcggaatttgcagagaaagaaaatctgcgaaaatggtaaaaattaaaacgaaaattgaaaaataattaaaaaataattttaaatgtttaggcattttcattctcaaaaattaaaatgaaaattaaaataatttaaatgtttaggcacttccacacgcaaatttaaacgcagaagcgaaagacaaaagttaacgacaaatgtttacatttattctttctttattttatctcattttatgaacttcgatcacattattaaatttatggcagacaattaagtcaactctgacttttgactttacagttgttcgaattgaaatgttttttgttgcgaaaacggatttaattctttaaattgggccctctcggccaataaa

SEQ ID NO: 51777 - DNA, 1061 bp, Heterodera glycines
  misc_feature (946)..(946): n is a, c, g, or t
  Genomic contig location: Contig_ID=SeqID_21187; Location=47..1107; Strand=-
  SCN-specific regions: Sequence locations=1-128,153-236,258-381,418 -531,569-797,819-1061
  Gene Ontology: Mol. function=microtubule binding; Cellular component =spectrosome; Biological process=body morphogenesis (sensu Nematoda)
gactcgactgatgtgcgtcgcgaaaaactgaacaaagccatcactgttcaccaatttctgcgcgacattgacgaggaggaatcgtggataaagaagaaaaaagagttccaaaatttcatcggccgtgttgaggaggaggaagcctggctgaacgagaagcaacagatactcagctcgcccaacgtcggtgagaacatggctgcagtgcagggactgttgaagaagcacgacacgttcgaggtggacctgcagatgcaccagcagcgcattgacgaactgcagcgccaaggcgaacaggtgggagacagaatggcatggcacacgcgggggagggcgaaattgacgcataataaagccaaaatttgtcttaaaaagggacagattaaaatatttttattcaaaattaataattttaaagaagctaacatatttgtttccttgggtgactttataaacactgtcgaaaaaatttctcaaaacgaaaatctcagaaaaaagatcagctactgtattttactaacattaaattcctttaattttgttaattataattattaattgataattacagctcatcaattctggcaatcaccacgcaaagaacatcggcacgcgcacggaacaattactcaagcatttgatcctgatcaaagaattggccgtccaacgattgcaaaagttgcgcgacaacaacgcgtacatgcaggtagataattgactcgttgttgactggtttctcaagaagactgaaagtctgtctaataatattgactttttcaatactctcgaaatggtggaaatttttctgattattttaaatttttgcatgaagactgatcagtcattaatataatccggcattattggattcagagacatggcatctaattgtttgaatgacaacttctatttattcgagacttcttaattttgagactccccttanatgaagcgggattcgaataatttctgtccaccttcaataattcgcatttcttatattgtttattaccaattgttgcttctttcaggactcgactgatgtgcgtcgcgaaaactga

SEQ ID NO: 51778 - DNA, 297 bp, Heterodera glycines
  Genomic contig location: Contig_ID=SeqID_21189; Location=170..466; Strand=+
  SCN-specific regions: Sequence locations=1-297
gaccttagaaagacggaggaagagctgaacttgctgaggaagcagtacaacgaaagagggacgcttttgaaggaggaaagggaggcaaaggcgaaggcacggagggagacggacagactgagggagttgttgctgttcaacggtggagacgaggaggccaaagacccattggacaaattggaagaatttgaggggggaaacgtcggagaaattactgatcagacaaaagccgaagaaagtgatcaggcggaggagggaaaagccgagcaaagaggccaagtcgaccctttcactgaa

SEQ ID NO: 51779 - DNA, 1701 bp, Heterodera glycines
  Genomic contig location: Contig_ID=SeqID_21190; Location=287..1987; Strand=+
  SCN-specific regions: Sequence locations=1-852,878-905,927-928,950 -954,976-1057,1079-1084,1146-1220,1242-1289,1312-1430,1612-1701
atgaacgacgtattaagaggacaaaacgacgcactgaacagggagagggagaagctgaaggcggaactggacgagctgaacgcatttctggacgacatcgaagcagaaacggaacttaagtcgatgtgtgagtggacaatttggggggggggtcccgagagttggcccagtggtcgagaccgacactatcgagtagcggagttaagaaatttttcattggtgctagtcttgcgagaacgaatacatttagtggccaacatcgaacgacgttttctccaagctttgagagaacagtctgagtgcgcggaagagagagaggcgttggggtgcgaattgcgaaggagcgaacgcaatttcaggtgattagtcagaagcagtaattggcagcttcaagatggcactaattgatgttaattgggctgaattagtgccgtcgtccctttcagtgagacgcgtgatcgttggctgagtgaacggcgtcgactcgtggacacaattggccacctcaactcggctctgcaacggcttcaccgtgaccaattgctggccatccccggctcggtccatgtgactacttcacaattagaagcattggccacccatttgagaagggcatatcagaaggagagagaagcgagtgggagagagaatgagttggaggagagggcggaagagatgcagagggcggagagtgcactcatggcgaagagagcggcgctggagacgattttggacagagacggagagttgagggcagtgcatgccgtgctgcaggggtacgcactgaacgaagtgacacttagcgcggaattgcaacggacacgcaaaaaggtggatagatttgggaaaactagagagagaaagggagagagagagaagacaatgccaaagtttgaaaacaaatgaaaaaaaaatttaaattttaagctggaaaaagtggaaaaggaaatgaacgaacggactgaagaattggaagaaatgagagaaatgctgacgcactttcaacatgtaaaggaagttgatttaaaacaattggaacaacaaattgagcaaagacaaaagagaggggaagaaagaatggacaaaaaggaagaaaaacaaagggaggaaaaggaaaagcaaagggaggaaaaggaaacgaaaggcgacagagaggagaaacaagcgcaaaagagaggggacagcagcagaagaacagtgctaatggtggacaattcgagcgaatgggccgaacagctgcagaaagtgcgggaacgggccaaactctgtgtggacacttacaaggtaaaaggagaaaagagagggagagaataaaaaggaaatgcgaaggaacaattggaaagtcgggacaaaacattggacgaatatcgccaattggtggaacaactccgaaccgaactcaccgaagtacggaacggaagaagagaagcggaggaacagaggaagagagacggagcggaaacggaagaggagacgagcaaaagcggagaaaggaagcggacggacgaatgggaagcggaagaagcggaggagcggtgggagaggcggacgagggcattggagaggcagctgaagaggatggtggaggagcaggcggagatggagagggagcggacgaagctcagagagaccatcagagccaaggaagagagcgagagacggcacagagagggagagggcacgagggatgtgaaagtgcag

SEQ ID NO: 51780 - DNA, 1309 bp, Heterodera glycines
  Genomic contig location: Contig_ID=SeqID_21191; Location=91..1399; Strand=-
  SCN-specific regions: Sequence locations=1-95,117-244,266-342,364 -458,480-569,592-859,882-887,909-976,1007-1099,1122-1309
cttggttgaacgactggatcagcagagtcgacggaaaagcgatctacacaactgatgggaaggtcatttattgtcaggcatgtcaacagcaggttaaagcatcacttttcatctacaaacaacacgactacaacaacataaacaacgaaaagcattttcaggtcccttctaaaatgttttatcaactgaaacaacacaacgaaactgctaaacacaaagcaaatgttgaactttttatgcggccatgtggaagcaaaaaacaacaatttttgaccactcaaacgacgaaaaaactggatgaattctcaatggatttgtgtaccgctctcacctcggcgaacattccattttttaaattggaaaatcagggttttagaggttagtattttctgggaatacctagcggaaattttcttacagattttctggaaaaatattgcaagcgagtggttccgcataatgatgccttgcataaaaattatttgcctgcatgttatgagcaggttatccccctttccattcaaagagatggtaaaatttagaaaatgactgagattaaaaatgaattcaaacaccaaaaaatttgggcatcggttgatgagacgactgattctcgtggcagatatgtcgcaaatttgatcattggcattttggatgggaaattgcacaaaccgcatttggttgcggccaaatttctggacaaaaccaaccatgaaacaatcgctcgctttatcaacgacaatttgagggagctaatttcagctgacgaccttttgttacttgtcactgacgcggcacgttacatggttaaggcagcacaggttaacaatgaaaaatttataaaaagtgctatctatgtaaaccaattttaagggcctcaaaattttctatccaaatctcattcatctcacatgtttgtgccatgggctccatcgtgtgtgcgaggaaattcgtggcctctttccaaatgttgacaaattgattgcaagtaccaaaaagacttcttcaaaagcgccatcccgcttggccaaattccgcgaacgttgtgatctccctctcccaccgcgcccaatcatcacacgttgggggacttggctcaatgcagcggattattactgtcaaaatcttaaccaaattggtgcgattattcgggacttcaacccatccgattctgatgctattcgccaatcacaaattgcctttgactgttcaggcattcgtggagatttggcctttataaaatcacattttgacattttacctggagcaattgaaaaattagaatcacgcaatctcacactcattgaaa

SEQ ID NO: 51781 - DNA, 392 bp, Heterodera glycines
  Genomic contig location: Contig_ID=SeqID_21192; Location=532..923; Strand=+
  SCN-specific regions: Sequence locations=1-392
atggccatccctccactgaaagccttttttgggcaaaaagtcaatttgactgggcaattggcgaggactgtgccgcgccatctgaaattcagtaaagatttacagatcctaagtaagtaacctacataaaaacgtttgtagcgtttgtcccatcggaaacggtagactgtacggtagtccaacagtacggtaacgccacttttacggtttgtgaatgcggcgttcacacgccggggaccgttcgggaaaagctcggaaagagcaaaggcacgtctaaaaaggaaggcattgacggcgaaggcatttgggggccgacttttgctgaaggccctgagaatcgcgccacacttcgtaaaccatcccagcggagaacagatagagatgcctgttga

SEQ ID NO: 51782 - DNA, 656 bp, Heterodera glycines
  Genomic contig location: Contig_ID=SeqID_21193; Location=1543..2198; Strand=-
  SCN-specific regions: Sequence locations=1-150,172-426,448-604,636-656
atgcccggaggaaggggtggacaaggaatgtgcgaccttcttacaccgctttgtgcaaatgtacgaaaggcctgttccggtgggttttacggctaagtccgtccacggatatttaaaatatttctctaacaattttagtacaatttattcaaaaatcccaaatttccccttaaattcggttgtttaggagggtatttatcgtctcgcctacatctttcgtcaaaacggtggctcattcagcagaatcgacttgctcgagaggaaatatttggacacgtacggcacccgattgagcacaagtgaggtaagctaatcaaaattggcaaaaaaaattgtaaagcatttcccctattctttcagccgagtaaatcgaacaaaaagtaaaagattaataagctgaaaagattttcctattgttttttttgaaaaagtttaattaattttgtaaaatcgggggggggggggagggaatacgaatttggagccccgacatttgcggccccagccaataaccgacatttgcggcccgacttttgcggcccgacatttgcggcccatttcttaagtgttatttcccgacatttgtggcccgacatttgcggccccaaattactcatttaaaaatttaacaaaaattaaccactttattcaataaa

SEQ ID NO: 51783 - DNA, 86 bp, Heterodera glycines
  Genomic contig location: Contig_ID=SeqID_21194; Location=2348..2433; Strand=+
  SCN-specific regions: Sequence locations=1-86
atggccaatgttctcggcgtctccattttcattttggtcattttctaccattacatcgtcgccaaccaaaagaaacagtcgccgca

SEQ ID NO: 51784 - DNA, 721 bp, Heterodera glycines
  Genomic contig location: Contig_ID=SeqID_3765; Location=2338..3058; Strand=+
  SCN-specific regions: Sequence locations=1-35,58-144,178-696,718-721
attggccataaaatccgggccctattcataattaggtaattaatttttaatttaatcgaataaaaatgcaaaacttccgactgcagaacagagagcccccaacagaaattgaatacataatgtgataaggggaagaaaggaatctaatcgaacttttcaaataaacaattgaaaaaagagatgagagaaaaaaagggaggaaatgtgcggtgaaatgaattgaatgacaacagcggaagagaagagagggacgcgcgacacaaagggaagaggcgaacggaagacatttctaatacatagcgcagcagaagagattcatcggattgttcgaattgcactccgacagttcgaacacggtgattttgcttcccaagaaaattgaaatggagtgaaaactcgaaacgaaaaaccaacttttaccatcttatttttaatcctcggcttaactttgcacaagttacgcccctctctaacaaagcatttgcttacattaaactcttcgttcaaataagttcgtctttctttgttaaatgataagcatgaagaaaaggataatgataatttcgttctacgaatttttttcggaaacatttccggtttctaaaatttttattttcttttcattttcaaacttatttttatgtatgttttcgcgcaactctactggggatggacggccaaaaatcgctgcttttatacacttttttacattgcatttgcc

SEQ ID NO: 51785 - DNA, 227 bp, Heterodera glycines
  Genomic contig location: Contig_ID=SeqID_3768; Location=1020..1246; Strand=+
  SCN-specific regions: Sequence locations=1-94,123-227
atgggcattgtggcgcggcgtctgctcaaaaaccgggccattcaaaagcagttggaccgtcgacaaaaaagtcggttgaattatgtggaaaaactttaaaagataaaaattttttttttaaagatctgaaaacgcttcgccgtcaacacgcggcagctggccggccgcccattgttgtgcattcggcggtccttggtttgccaggaccgcggccgtacatcaagtaa

SEQ ID NO: 51786 - DNA, 868 bp, Heterodera glycines
  Genomic contig location: Contig_ID=SeqID_21196; Location=178..1045; Strand=-
  SCN-specific regions: Sequence locations=1-159,181-226,248-363,386 -526,549-623,645-868
  Gene Ontology: Mol. function=tRNA guanylyltransferase activity; Cellular component=proteasome regulatory particle (sensu Eukarya); Biological process=protein modification
atggttaaaataaaaataaagtggggtaccaaagaacttaatgttgacgccaatcccgaagaacctcccctattgctcaaggcgcaactattcgggttgacaaatgttccacctgaacgacaaaagttgatagttaaggtaaatgggccttcatttttatatgcataatacataaaaaacaatgatatttagggcaagacgatatctgacgaagcatggaacggaatcaaaataaaagatggaactgttataatgcttattggaagcactgaatcgatgttgataaaggcagaaaatgctgagtcgtccggccatgcaaattcgacagagacggaaccgcgccaacagttccccattggtctacgaaatttgggcaacacttgttacatgaactcgagtttgcagtgtttgaaggttagtcccctgctgctctgttcctattgggttcttcccttcggtgttttttgcttactcccccctgtgatagtcgtgtgaattaatgcgacggaacgaaccaaaaagttagaaacatgcattaaaagcatttctcttaagattgtgccggaatttgaaaccgccttgaagcaatacaatcccaaccaatctgttgacgggtcgaaccaacgcataaaactcttcaccaattctatgaagaagctttacaacgagatgaatgttttggcgaaggaccaaacggcggactctcccgaagtcattccgttgtttcttgtgcatgtcctccgccaaacctttccacaattcgacactcaagatgaacggggcaaccaccagcaacaggacgccaacgaatgtttttgtgagatgctgcggatgatttctgatgaaacggttttcacgcccgaaactg

SEQ ID NO: 51787 - DNA, 1206 bp, Heterodera glycines
  Genomic contig location: Contig_ID=SeqID_21197; Location=264..1469; Strand=+
  SCN-specific regions: Sequence locations=1-16,38-202,229-442,464 -1090,1112-1206
atgcattccgttgccttttcttctttatcaacagaagaagctcgcttgaacttcgaacaaattttccatgagaatggcttcgtccgaatcgatggtgtattttcaaccgaagaattagctgaactccgtgatgctgtaaaattaattgttgaaggctttgacccgaaagaccacccacggacaacatttaacacaagtgacgaggaaaaggttaacaaaatgaaacaaagaaatgccccccccccttgtgggttttgacgatttgattgccagcagcgtgtttcgtcgccgcgggtcttccaatactcaaaattgacgaaaacccgtccatagttaattagggttcttgagaaggagaataggcattttcttaaccaaaattagcggcagaattctcctgttttcgtgcctatctcaattcgaatattctttgttctgtctctatcaaatatttcttttaaagcatgtgtccgacagctacttccttgaaagcgtagacaaaatcaggtttttctatgaagaaaaagcggtggacgagcaaagtggcaaattgaaagtacccaaagaaatggcattgaataaaatcggtcacggtaatttagccgatgattcggtccttcctaataaattacccttaattaagccttacattggctggacccatcttttcggaaaataacttttcatgaacgaattaaagtataagagaagcacagttcaaatgaatcgttttttaagaaaattgtcagtctgaccggcgctgttcagcctcgcgtgatgcaaagcatgttcatcttcaaagtccgttggaattccgtcctttccaacgaatggctttgattcaaaagtttaagcaacccaaaatcggaggctcgactaatgagcacgtcgattcaacgtttttgcacacagaaaacggagacaatcttttgggtgtttggatcgcagtggacccggccaatttggacaatggctgcctatggtttcttcccgggtcgcacaaaggcaaaatttacaatattaaattattcaaaataatgtttttagacgccaattatctttctgctactaagcaatacaaattcacaagaacagaaacaaagcacaatgggaaaaaggcatcctccgatgggccattgttaaaatttgttgggaatcggccttctttcgaaggatgcaatttcattgcattggaatgtcaaccag

SEQ ID NO: 51788 - DNA, 326 bp, Heterodera glycines
  Genomic contig location: Contig_ID=SeqID_21198; Location=1014..1339; Strand=-
  SCN-specific regions: Sequence locations=1-159,183-271,296-326
atgaacgaagtgacgaatgaaaagctgacactgaaacttagcaaagaattaggctataattgcctgtataattggctgttgcaacggtgcccaattggggagacggcgccagcaattaaatgggaagacagcgtaaatccgagtgccaatttgaacaatgtcacttttgatctgtgtagtttcgataaatccattgggtgagcagcagcaatagcatttgattttgccgaataataaaatatttaattcattttaggccattgtcgccaccaacgaaagaagaaaaagaagaagcggatcaaagcaacggaaatgtcgtctgctga

SEQ ID NO: 51789 - DNA, 572 bp, Heterodera glycines
  Genomic contig location: Contig_ID=SeqID_21199; Location=2119..2690; Strand=-
  SCN-specific regions: Sequence locations=1-145,187-382,419-572
tccacctacgacaaagtgttagctttattggaatccaaagaaggcggaaatgaggagcggaaacagcgggcggaagagttgcgcaagcgcacaaccgaattgttggcaaagattaagcggagtcgggaagagaaaatttgtgagctatttttttattaatttatttttttgtttttttaattttttttagccctgattgaacgtgctgattcattagatgtggaactgaacagttttcatacctcaactgaggaactcagtgatcagattgatcaggtgaccagcgaaattgatcgacgcgttgagttccatgccacatgcgatgcctaacaactaaaaagcccatcattttgccacatttttgccttttagtttataattgaaaaaacgaaaatgaatgtttaattgtttgattcttcattgttcttaaaattgttgcttgaaaagcaaaaatctatgtattgccagacattgtatgccttttttaaatgctttcgtatgtacttgtggtccttaaaatgcaatgtattccaatcccttacttcaaactaatttttgattggctgaataaa

SEQ ID NO: 51790 - DNA, 694 bp, Heterodera glycines
  Genomic contig location: Contig_ID=SeqID_21202; Location=151..844; Strand=+
  SCN-specific regions: Sequence locations=1-11,33-546,573-694
acactgactcaatttattatgttgcaaaaaatgggagacgattggttcccgaaggagaagggctcggacaaatgaaacgtgagcacactgaccgacgaatttttgaattcatcagtggtggcccaaaaaactatggctttcggcactgtgatcgtgttacgcgggcagatgaaaaggcggagctaaaagttcgaagctttcgactctcttatgccaccaatcagctactaaatttcgaatcgatgaaacaacttgttctggaacattacaactttgatggagaaatgttctttttaaaaaatttttacgtaaaaaatacatttaaaaattcagtgatcccgctctctatatgaacgacgaatgttatgtctgccccggatcatcccgttctatccgtgttacttttccacaaattgggcgctccccttgctcagatttatatacctatcaagcgcataaggattatcgcccccattacgtgaaaggccgcgtaaggccaggaatggagacactgccttttggctatcgcaacgggtttacacgtgccaacacacaacaacaacaacaacaaccgcaaatcaacgaaatgcatggaagaaatgtcaatgatggtgatgatgctgcattccgtgatttgccgggctgttcacattggcaacccactcattatcgcaatcgatataattatcaatag

SEQ ID NO: 51791 - DNA, 555 bp, Heterodera glycines
  Genomic contig location: Contig_ID=SeqID_21202; Location=929..1483; Strand=-
  SCN-specific regions: Sequence locations=1-2,25-60,82-293,330-345,367- 555
atggaggaggaggaggacagccatattgtaagagcggaagcgttgagtgaacgtgaaggcggtgttgcagttgctgcagccaacaaagggcaaacccaaaagacgagtgatgataataatgatgatcatgatggcgcgcaccagcaagtcgtcgtaatggcacgtggaggtgaagacgcccgtgcaaaagctgaagcaagcggaggtccaagaagtgtcgttgaaacacgaattagtgataaccaacgagggggagaaagattagctttgggttcggccattattcatagacaaggaagaagaagaggaggaggaggaggaggaggaggtcgaaacagaaaccgtcagagaggcaaagaagaacaagggcgaggacgaagacctattgccaacgataaatttcacccccgccccccgcaatatatggagctaaacaatcgtcagaaaggaaatgagcaagtcacagtcaacaacaatgtgcacacaatgagccctgtcagttacccatatttgttgaggaaacaagttggaagagaatgtttttgtacctgctga

SEQ ID NO: 51792 - DNA, 1334 bp, Heterodera glycines
  misc_feature (96)..(96): n is a, c, g, or t
  Genomic contig location: Contig_ID=SeqID_21203; Location=1..1334; Strand=-
  SCN-specific regions: Sequence locations=1-444,476-725,747-1334
  Gene Ontology: Mol. function=microtubule binding; Cellular component =spectrosome; Biological process=neuromuscular synaptic transmission
caaaaaaggtggcagggaaacacaaatgacaaaattatcagcaatccgttttatcatcccatttatcatcgagtccgttaattatccaaattatcnccacaattacccaatttgtaacttttgttaggtcgtcttgcgaatgggcggctttcgagagcgaattgaaaaggttaagcggctgctggacgagggagtcgagttggagcaatttgaagccaaattgtcagaaatgtgcgaatgggttgaggagaaggaaaagcgcgtcaaagcacaaacggcggaagcgggcggggcgtcgttagagcaaaagttggacagactgaagcgacagcaggcactgcagcgggagatggacgccaatggcacacgcattgacaaaatgagagagcgattggaacggctgagggggcgccatggcacggagacggcggtgagtcaaacggtggcgagagggacggggaggggaagggggaggacatgacacggagacacggaaaacgttggcatcatgcccaaaatggccccattggaactcattaatttattctttttgcttgaaaggtctctcgggcggatgagtttcttttgcgttggtcaaaactcagtgaggcgatgcgcaaattgcacgcggcgttagacgaagcacgcgacttgttggagttggagcaattagcagaccgattgtgcacatttgtgcgggccaaagaagggatggtcggtgcggaagatttgggaaaagatttggagcattgccaatcactgtcagtgattgggggagcacaaacggacaacggatgaccacccaccccttcaaatccaggctggaccggctggacgaaagtcaaggaatcgacgagggcactctggcggaggcgaatcgcctcgggggacgattgatcgggcgaaagtctgccgaatcggactatgtgcgcaaaaggctggcggaagtgaacgaaggctggcaacggctggcgggccgactgagcatctaccgaacacttctcaacgcggcactcgcaggtcagcggagtgaccgtgccaacggaagtgacggacgcggcactatttaagtgcaccgattcaatcacaacgtggaagagaccaacgaacgcattggggaaaaagcagcgcaattgggcggcaccgaaatgggcaaagacatggaaacggtggaacgactgatcagagcacaggacgcggtggagcgcgacatgagcgcgatccatcggaagctgaacgaacacgacgagtgggcacaacagttgctgggcaacggcgagttgcccttgcgcgattcggtgccattcgatgtgcttttcccccttttcattttg

SEQ ID NO: 51793 - DNA, 675 bp, Heterodera glycines
  Genomic contig location: Contig_ID=SeqID_21204; Location=179..853; Strand=-
  SCN-specific regions: Sequence locations=1-155,177-248,271-675
  Gene Ontology: Mol. function=structural constituent of cytoskeleton; Cellular component=membrane fraction; Biological process=actin cytoskeleton organization and biogenesis
atggccaaggaagcggcacggggtgccgggtcggtattggcagtgcgttcatttttggcggacggagcggaattggaggaatggatggagcaacagaagcaaacgacgaacagcgaagaatgtggcaacgacttggagcagtgcgaacaactaaggacgaagttcgaagagttcagacaatcccttcggatgggcgacgaaagaatggccaaagtggaagaagcagaaggcgaactgataagccacgtggacgatgaaaagcttgcccaaaaagtggcgataatgagcgacagactgaggacgacttgggcacaaattggccaattaaccgaacggagaggacgcaaattgaaagaagcggagcggacgcaccgcctaaggagagaagcggaagtattggcggaacgaatcagagaaaaaacggccgaaattccgacggaagtgggcaaagacgcgaagcaggcgtacgcactgatgttggccaacgaagtgttggagaacgaagtggcacaactgcacgaacagcttcaggtcggcggaacagccgtccccgacggatttggattaattggttcccattttaagcttttattggagcgcttcgaatcggttgaatcaccgaaccctttggtcgactttctgccgggtactaatggctttgtccgccttccttag

SEQ ID NO: 51794 - DNA, 416 bp, Heterodera glycines
  Genomic contig location: Contig_ID=SeqID_21204; Location=576..991; Strand=+
  SCN-specific regions: Sequence locations=1-8,31-102,124-416
gccactttttgggcaagcttttcatcgtccacgtggcttatcagttcgccttctgcttcttccactttggccattctttcgtcgcccatccgaagggattgtctgaactcttcgaacttcgtccttagttgttcgcactgctccaagtcgttgccacattcttcgctgttcgtcgtttgcttctgttgctccatccattcctccaattccgctccgtccgccaaaaatgaacgcactgccaataccgacccggcaccccgtgccgcttccttggccatgccctccaatgcttttgcttggttctccacccgttccattcgctcggctacgctttcatgcccccttttggccagctgttcgccccgctgtctcagttcgccgaatgcctttctccacggcactatctcattttgcaa

SEQ ID NO: 51795 - DNA, 1756 bp, Heterodera glycines
  Genomic contig location: Contig_ID=SeqID_21205; Location=80..1835; Strand=+
  SCN-specific regions: Sequence locations=1-306,329-434,517-555,580 -668,700-937,1001-1036,1074-1227,1320-1486,1509-1756
  Gene Ontology: Mol. function=uridine kinase activity; Cellular component=mitochondrion; Biological process=cell cycle arrest
caaatctctctttttcgtaaatcacggcatcctttcgccgatcgtaaacggcgctttttcctcccgtcgttttcgttcgtgggcggcccgggccgcggaaaaggcacacaacgcgagcggatcgtggaaaaattcggcttttacacatctcgagttctcggagatttcgttcgcgcgctcgaagttgcatctcggctcagtgttgggcaaacagctcgaaggcaacgatcggacgcgggtgggctcgtcccattcggtaagaacatttgaccaggggtccggacaatcggtcagtggacaattcgtcagaaaattttatttatttttcgatcaatcgataatcaaacgattcgagattcgctcaatttaaattaaatcgggttgggtttagaacctttctagttatttaatagaacaattttcgtttatcattctttaaaaattatttttaaaaatgttcattcattacttttaaaaataaaacaaattattatttaaattttttcaatttaaattcagtccttgtataattacaaaacatttgcatttaggatacagtgttggccattgtgaagggggctatgctcaaaaagcgagaatcatcgaatggttttctcattgatggtaaaaaatgatatgcggaagaaattagaaaattgcagttttactatttaaaactttaaaaaaataaataaaatacaaaaaacgaaaaacgaaaaaatgtggaaatatgagtttttattcggcgattctaaaaatagattagtgtaacagctttaccaattctaaaaatttaacgcaaaaatcttttaaccaaaagtaaaaatgtgggcgaagtgacaaaagtatgggtgtgggatgtggccgaagatgagtcattgcagtccaaagattaaaattatcattttaattgataatttgctttttcaccgggcccataaattatttattttcattatttatcaaaaaaattattaaagagaaataaaacccaaaaccacattcgccaattcattcaattgcacttttacttttctaaattttattttaaatatatttaataatcatttaatgatttagaatgaacttttcaaacttctaaaatttcttactattttagaaattattcttcaactcgatatttgtctccaacgaaaccgacgactaattaacatttaaaatttaccgaaatttgttaaaacaagtaaaaaaaattgctgtactttgatttatagttatttaatttttaaacatatattttaagacatataaataataatagggtaattatttttattttaaataattttcatttattagaatcatttttgggactgaaatgatccatcctcgtgcctgtccccacacccattctttcttttgtcactcaaatgattattaaccttttagggtatccccgtgaagtgacacaaggagaacgctttgagcaagaggtgtgttggcccattaaattcaaatttcaccaaaatgccattttcagatccaatcgcccgttttggtcatttatttcgaggccggcgatgaaacgctggtcaaacggctgatggggcggggacgaagtgatgacaacgtggagacaatcaaaaacagactgcacacatttgtggagtcgacaaaacccgtggtggaccattacggaaagcagggcaagctggtcaaggtcagtcagtcagctacgacaaacaaatgttggatatgttggatatggaaccgttccgttagaaaatgcagggct

SEQ ID NO: 51796 - DNA, 3193 bp, Heterodera glycines
  misc_feature (1864)..(1864): n is a, c, g, or t
  misc_feature (1948)..(1948): n is a, c, g, or t
  misc_feature (1966)..(1966): n is a, c, g, or t
  Genomic contig location: Contig_ID=SeqID_21206; Location=14..3206; Strand=-
  SCN-specific regions: Sequence locations=1-139,169-200,223-514,538 -624,647-885,910-986,1018-1027,1050-1122,1144-1186,1216-1245,1294 -1314,1355-1362,1427-1430,1482-1675,1713-1824,1857-2117,2139 -2303,2330-2477,2500-2560,...
  SCN-specific regions: Sequence locations=...2593-2640,2676-2707,2731 -2747,2769-2938,2960-3193
atgggcaaaattgggggaaaatgggaaaaatttggggaggaaaaattggccaaatcggacgcaattaatttattgttggaaaaattgcatttgctggacgatgagctgaatgagctgacatttggagggtgaaaaggtcaaattttaatttaattttaaaaaatttaagagcgaatgaaagagaaagtgccgccgtaaaagcaatggaaatgattttgaaattggaaacggaaaaagagggacaattcgaatttgggaggggaaaaatgggcaaaaaaacggacaaaacgacacaacaattgcaccttcagacaattggcacattaaaagccaaagaattgctaaaagcggaattaaacggaaatgaaaagcaatggaaaggccaaaacggaaaaacaatgagcacacaaaagaagatgaagcagcttttgttgtcgaaggaaaaggcggagaagaaatttctaacaaaatttattaacggaatgaaagcgatgataacacagcaaaaattgggtaattaaattaaaatttaaaaaaccaattaaaaccaccaaattgaattgtcaagttaataatccgtcatggacttcggtcttcgaaagaagtcaatacaatttgatcagaacgaacgcaaaaggacagaaaagagacgcggaaatatcgaaaaaggcaaaataaatgaacaaaactcaaaaaaataagctaattgttgcactttaagctgatcgaattcactcaattatattgcattgaacaaaacaaacgaagggaaaatgtggcataaaaaggccaaatcgaacggatcttttggccatgggtggagaaaaaatggaccaaaaaaacagaaaaagtgcaatttgaatgtcattaaattaattggttcaattttaaaaaggcttttggtggccaagggtcctttttggttaaatccggaaatggacgggttgaacttggatttaattttgggttggcccggaaaaaaaaatttttcccattttttggggccccccgggaaaatttttttttaggttttaaaaggggaattttttcaaattcccccggaaaaaaaaaaaaaaagggagaggggggggcccaataaggggggggtttttgcggggggccttttaaaaaaaaaaaaaaaaagggaaaaaaggggggggcattttttttttttcccccaccccccaaaaaaaaatttttagaaaaaaaaaaaaaggttggttgttatagttttgttggggggggaaaaaaaaataaaaaaaaaaaaaaaaaaaaaaaaaaaaaaaaaaaaaatattttttttttttttttgttggggggggggggggggggggggggggggggggggggggggaccaccaattttttcttcttcttttttttttttttttttttttttaaaaaaaaaaaaaaaaaaaaaaaaaaacgcctttttttttttttttttataataaataaaaaaaaaaaaaaaaaaataaattgggggggcccccccccctttttctttttttttttctttattttttccaagaaaaaaaaagggaggggttttttttttagtttttttttccccctttttttggggaataaaaatttccaaaatttaaaaaaaaggggaaaaatatttttttttcccccctttggacacaaaaatttttaaaaaggaaaaaaattttttggcccaggcttttggaaacggtttgggttgggcccttgtttttttggccaaaccccccctccccccttccttccatttaaagaaggggtagcaagccaaaattggcggtattttaactggcaaatggcaagcaaaaaataccattgttaattcatttttaaataaaaatttcctgggaccgacaanaatggcaaaattcgttggcattgctcttctctcgctgaccatgtttttcgatggcacttgcaaaaactggcaaaagtcaacggncaggtgggtaaattttanaagactgaattttttttttcttatttattgtattagggagagtttgaataaatttgtacgcaattataaattcaattctaaatgtgcccaatgaaattgtaaaatgaaaatgtcattgttaaattttaaattcatgaaaatcattttttcatctaatatttttagtttttgaaaaactcaaacttttcccaaattaaaatttaagtatttagacattttcgctgttttttttggaacaagcgtaatgcattggtgtaaatcccactttgaaaaaattgctcatcaaaaattgaacatttttccatgtacatgagatggactgaaaatttggaaaaacaaataataaattatatattatatttagacgaagttgagggatttcgcaatatgaacatcggcgacaacaataagggtatgtataataataaaagttcgtatttggatggtaagcatacctatctggaattggcactcaattaaactttttcggattttataattagaaaagatgtaaaaatattaataaattatatgtttggcatttccatgacataatttatcatgcatacattacaaattttgcaatttttaaagaatgtacatattttttatattttgtaaaatttagaaaaatgagcccactaattgaacatttgattacgcacaatacattcataaaaattaatttttttgtaatctaataatatatgtctttaggaatttcaaggacttattcttcggaaatatattttttttaattttatcaaatgagccggattaaatttcaaagaaataattttcactcaacaaaccaatgagttggaatctaaggactggccaagggcttaagggtgtccttggcatctgttgctcattcgacaagaacacccttggacacgaatccatgtcgctctgttgtttttacaaattgccattttaacagttgacgccggaaaggagcccgcggctgataaagcaaccaaaaagggaaaagctcagaaagccggaacgaaaccggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagaccgaacacttttatggaaaatgctttga

SEQ ID NO: 51797 - DNA, 771 bp, Heterodera glycines
  Genomic contig location: Contig_ID=SeqID_21208; Location=1553..2323; Strand=+
  SCN-specific regions: Sequence locations=1-771
cttttcgaaccgcttcgttgagtacgtctcggaactttgtcgtgttccagcgtgccgggtcttctccctttttggttaggattgtgcgcaggaatccgggagtaagcttcttttcaagcatgaggaaggtcggtgggccttcgatgtcttctcctgtattgttgagttcgcgtgtgagtcgttcgagttgcaggaggaattctttggtgtcgcacaggtttttgcagggcttgaggtttgccaattcgaagtgaagtgccctgatgtgttcgtccggtgcgccatatgtgtccttcagcaattggagggccgtgtcgtaattgttgtcctccagtcgaaagccggccacgacttctcgggcctctcctccgagcaggttgcgcaggagattgaacttttccgctttgctgagtgcgtgtgtgccgattgctgatttgaacgattcgtagaactccggccatttgcgtttgttgccgaagaacttgtccagctggattggctggaattggtagaacggaggagtgaaggacggcgtcttatttggttgttgctgcgaggtgtgttgcattgcgtttgcatgagctgcttgagcgtcccgctcttctttgtccgccttgctgcggtagagtcgggattgaactgtgagtgtgcttatgaggtcgcgcaagtcgcgcagcttcagtgctgcttcgtcgactttgtctgttgttcgctcctttttctcgaacttgttgaaatctgcttctgctggatcgcgttccgttgcaggca

SEQ ID NO: 51798 - DNA, 1725 bp, Heterodera glycines
  Genomic contig location: Contig_ID=SeqID_21208; Location=828..2552; Strand=-
  SCN-specific regions: Sequence locations=1-996,1018-1725
atggccgcaccaattcaacagaaactcagcgctgctctcaaagttctctcccgaacccgaactgcggcggagctaaacatccaagccgatcaagcggcatcaaacctcgaaaacgcattcaatttcgaggctcaactggagaaggtccaaaaggaagcaaaaacaatggacatcttcctcgacgacgtacgagaatcgctcacagcatgggcggatttactgcgcaaactgcctgcaacggaacgcgatccagcagaagcagatttcaacaagttcgagaaaaaggagcgaacaacagacaaagtcgacgaagcagcactgaagctgcgcgacttgcgcgacctcataagcacactcacagttcaatcccgactctaccgcagcaaggcggacaaagaagagcgggacgctcaagcagctcatgcaaacgcaatgcaacacacctcgcagcaacaaccaaataagacgccgtccttcactcctccgttctaccaattccagccaatccagctggacaagttcttcggcaacaaacgcaaatggccggagttctacgaatcgttcaaatcagcaatcggcacacacgcactcagcaaagcggaaaagttcaatctcctgcgcaacctgctcggaggagaggcccgagaagtcgtggccggctttcgactggaggacaacaattacgacacggccctccaattgctgaaggacacatatggcgcaccggacgaacacatcagggcacttcacttcgaattggcaaacctcaagccctgcaaaaacctgtgcgacaccaaagaattcctcctgcaactcgaacgactcacacgcgaactcaacaatacaggagaagacatcgaaggcccaccgaccttcctcatgcttgaaaagaagcttactcccggattcctgcgcacaatcctaaccaaaaagggagaagacccggcacgctggaacacgacaaagttccgagacgtactcaacgaagcggttcgaaaagaaagccaaatccaagaagtcatgggcgagtacggacactcgccacaacaacggccgcaaccacaaaggcccaatttctcggcatcaaaattccgagaccgcgcaccaatcccacagcaacgggaacgcacattcatcacctcagcggtggatgacaatcacaaaaggctgatcaatcgacagcctcaacacaggccacagcaacaaaggcctcgcgcaccacaaccgcaacaaagaaattgcgcactttcaacaatcaaaggcaattttcaactcaacgtgccaatgcgaccaacaatcaacgacaatttccaactcaacgtgccaatgcgatcaacaatcaaaggcaatttccaactcaacatgccaatgcgacattcaatcaacgcaagcctccaagtccatgcatcttctgtgacaacgatcactggaatgaagaatgccggaaatacagcacaattcaacagcgaagagaagtgttgcgcacaaaggcattatgcttcaaatgcctcaaaagcaatcatcaagcaagcaattgcccacaaccgaaaagatgcttcaaatgcaaacaacctcatccaacggcattatgttatgcagacgaaaaaccaccgaaccaaatcacagcagcaatgttggggcaaacacaacaaaatgtgtcaatcacaactcaagacggaagcaacgaaccaacggcatcgacatcgcaaatgtgcaatgccgtaa

SEQ ID NO: 51799 - DNA, 979 bp, Heterodera glycines
  Genomic contig location: Contig_ID=SeqID_3769; Location=1825..2803; Strand=+
  SCN-specific regions: Sequence locations=1-139,161-436,461-979
atgccaccaatggaagcacctacattcacggcaccgctctatcaattcagccaatccagctggacaaaattcttcggtcaaaatctaaaatggccagaattctacgagtccttcaaatcggccatcggcagccaattaatcagcaaagcacagaagctgaacttgctccgcaatcttctgggcggagaagcacgggaactcatcgctgggttccgcctggaggaccaaaactacgagacggtccttcagttgctgaaggacacttacggcgcacccgaagagcacatcagggcgctacactttgagctggccaatctcaagacgtgccgaagtctccgagacacaaaagacttcctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgtgcttaacgaagcagtccgcaaggaagtccaaattcaagaggtgatgggtgagtacggacaccaccatcagcaactcaatcgaccagcaaggccgcaaacacaagcacatcaaactcagcgagcacgcatgccgacagcaaatttccggaacagaaatgcatctcccgccaatcaggaacgcactttcatgtcctcaacaattgaggaggttcagcaacgaatgaaccacaggccgcaactgcggaagtcccaacagaggggaccaaggccaactcaagcgccttacaacgtgccaatccggaatggcacagcacaagcagggtcaaggaatccgccttcaccctgcatcttctgctatggcactcactggaatgagaaatgccagaaactcagtaccgttcagcaacggtcagcctttgttcgagaaaaaggcttgtgcttcaagtgcatga

SEQ ID NO: 51800 - DNA, 2295 bp, Heterodera glycines
  Genomic contig location: Contig_ID=SeqID_3770; Location=5..2299; Strand=+
  SCN-specific regions: Sequence locations=1-160,182-230,252-1299,1322 -1914,1937-2158,2181-2224,2246-2261,2283-2295
atggaagacactaaggtgttgggcatcaagtggacgccaagatacgaccaactcgttttctccatgccacacttcgacagcccaatcaccaagcgaaacattctttcgcacattgccaaagtatatgacccactggggctcatttcaccggcacttctgccagcaaaacacttccttcaaatcgtccaaaacgcaaactacaaatgggacgacccgttggaagaggatttgaaattgatgtggataaaactgatgcatgcgtgggacggatttggattcaactcactcgtcgaattcccacgccacatcatcgctgggataagcgaagagttccattgctattgtgatgcgagcaaatctggtctgggtaacgcgttgtaccaggtcgcagaaacgcattacaacaaaagggaaagcaatttgatcttcggcaaaagccacgtcaagccactcaaggtcgcgtaccacaattcgaccatacccaaattgaaactccaggcactcactttgggagtcatggctaccaagttcgtccaaacacagctcaactttgccgacagccaagtcactttgtggacggacagccaatgctcgattgagcggttgaaggaaaaccgcacccacgacagattcgtagtcaatcggctaaagaagataagagaagcaaacttcaaagtccgacacatccgaacagctgagaatccagcagacatcgcctcacgccgcacagacccgcaaagcctccaagcctcattgctttggcgatatgggccagcctggctcaccaaaacacacaaatggccagaaacgaacgtcacttacactcccggagaagagacacgggaagagctgagccaccgatcgtcgagtggagtgcagcactccaagaagagcagaaattcagcccgtcaatccaatttgaaaggttttcgaattggaaccggctcaaggcggcagccgcctatgccattcgtttcgctttggcacttcttcaaaaaagaaatgtcgttccggcgatcgattcacttctgtatcagcaagaaagacaagcggggctgcttacggcaaaggaattggaaaatgccgaaacatggattttgttggaaacccaacggcttcactcgcccacagaaacagccacaaacaatttaaaattgtccagctcgagctccatcgagccactgagatgccaggggcgattggaaaacgccgatctgcccaacgaaagcaagcacccgacctttttaccggcagaagcctggaccaccaagctcatcgttatccactacgatcgggcgctgaagcactgcggcccacggacgcttctctcaaaacttcgagaaaattattggataacaaaagggcgacagacagtccagcacatcctcaactccaacaaattcggatgtttgaagtgcagactggtgagactcaagccatacgcttatccggacgctcctgacctgcctgaggactactcagctgaagcatttctgagagccttccggcgatttgctgcacggcgcggcattcctagtttgatgatgtccgaccaagggacaaatttcaccgccggcgccaaaacgatccaagaaaattggacagtgcaattgttcccaaacgaaatcagtggacaattggcccaccaaggagtcacatggctcttcaacacggcacacgcaccttggcgaggtggtgcctgggaacgacttgttggcataacaaaaaatgccttacgacgaagcatcggtcgaaatctcctcacgtgggaggaattctgcacactcaccgttgagattgaaacgatcgtcaattatcggccattgatattcgagtcggaccgtgaaccgagccccgtcattcgaccaatcgattttctgattccgtactggcctgcggaaacgaatttccaagtgatcgccgtggatccagaggatcctgagtacacggagcacacatgtcgccgctggcgactgaacgcgtggaaattgggggacagccctgaggatcgctcggaggacagcccggaggaccgctcggaggaccgtttggaggaccgcccggaggaaagaaatgaggaagtcctgtggaggacggaagaagattctcgaatgttcccttgtgatctttgtgattaatattcccgaagtttccccatttttcatttcctttcaggtgtgttttagaattttccctccctgtccaaatcccatatataaacccgaatatttttccctttagaatatctctcgaaaaatcattattccatcctttgattgtgcgctattccgacaa

SEQ ID NO: 51801 - DNA, 762 bp, Heterodera glycines
  Genomic contig location: Contig_ID=SeqID_3770; Location=2680..3441; Strand=+
  SCN-specific regions: Sequence locations=1-85,107-762
atgagcaacctaatccggatggtactgggcccacaagtggcaattcttcgtcaacgagtaaacacggcacggacacatgtcgaccgtgaggaagatgaagaagtcaacaacgctgcgctgatggaagcaaaagtattgctgttaaaagtattgcagcgtgtggaagctgaactagcgaaatgggaaaacgtgatttctggacttcaaggacaagaaaaacagacagagcaagaacgactcgagacattcatcaacgaaagagaagtagcgaatttgctagccgacgcacatgctacgatggatgaaatactagtggcacttgcaggagagtcagaatacgatggttccgaaaacggggacaatgccgtgcgagaaaatgcccaaaggcaacggcaatcacctgctcgagaggaaaggcaactcccttctcgagtacaaaggcaatcacccgtcagagaagtcctgcatcaaccaaggatcagacttcctgaattacggatgccgatattctccggcgatccgttagagtggccgacattttggcaatccttcgagaatgcggtccacaatcaggctcacctgcagccaatcgacaaaatgaattatttgatgggatgccttaaagggaaagcctctcgtgcagtgataggctacagaggtggccaaaattacgaaaatatggtggaaacactccgccgattgtttggcaatccgcaagttatcgtcgaagccttgcaagccgaacttttcaatcttccaaat

SEQ ID NO: 51802 - DNA, 228 bp, Heterodera glycines
  Genomic contig location: Contig_ID=SeqID_21210; Location=793..1020; Strand=+
  SCN-specific regions: Sequence locations=1-228
ctgcgccaaatttttgcatgcggtacggcttgcgtggtgacgccggttggccgaattctgtacatccgccagggcaatgggcgtgccggccgaatggaggacatgcaaattccgatgccaaattcggatgaagaaccattgaacatcatgcagagactgtacaaagcaatcaccgacatttattatgggcgacagaaacgcgaagaatggactcggattgttgtctaa

SEQ ID NO: 51803 - DNA, 683 bp, Heterodera glycines
  Genomic contig location: Contig_ID=SeqID_21211; Location=110..792; Strand=-
  SCN-specific regions: Sequence locations=1-66,94-266,295-683
atgaaaatatggtgtttgtttcgacatttgatgacaccatgttcgtgatcagtgactttgaaccccaaaatatgaatttttaaaatttttcgaggggggagggggtagcaaaatacggaagtacctactaaactatattttcgtaaaatttaaaagtttcaattttcttcaaaattaataaattttagcttgattttttgttttaaaataatttttcattttccatattgagctatttccgagattgttagcttaaatttattgaatttaaagaattttggaaaattttgcaaattttaagatgattttcagacaccattgtacgtgatccgtcaacgctattccccgccgaaaagcaaattaattattctgcgggacagaaaaggacagtgttcaatttgacttttgtaaaatgtgtggccgaaattgcgtattttcgagtgatcaatgaaaatgatcagtcaaaagatgcgtttctggaattcaaagtggtccccgggatcaacgcgctaaacgaatttttgggctttttgcattttgaccaatcgattggccagcaaatttctcacaaatttaaaagtgaatttttctccaccgaaagtccactcgccgaatccgtggtgaaccaagtgatgcaattggccttctcatttgctgcccgtgtcattctgtgcataatgtaa

SEQ ID NO: 51804 - DNA, 696 bp, Heterodera glycines
  Genomic contig location: Contig_ID=SeqID_21212; Location=306..1001; Strand=-
  SCN-specific regions: Sequence locations=1-112,134-232,254-398,442 -534,562-696
atgtgcatggcattgccgaccaaagtgttgaacacaaaattcggcacgctttcacctctgtcggcttcccagccttgcaagcatccatttgtaaggagattgttggatgatcggaaaatttcccttgggctttgtgtggcataatgttgcgcattgcgacgaccaaatgcccggcattttggaccaataaaacaacaacttaaccctccgaaaaatttgccaattttgaggcaaaaattatttttaaaaatttcccaaaattttggaaaattaaaaatttgaaatttttcttaatttcttaacaaatctcaaaaaacgtgcaattcttccattgacgcctgtcaaaatttcatttttcatagattttcccaaaattttgcgcttaggccatgggaaggtataatatttttcattttatttgttaaataaaattaaaattttcaaacttttttcctctttccaggcacttgcatttgcgtgttgagccttgcgtttgtccaaatttacactgctcaggcccgtttttacgggaaaatttcaaaaatttacaaaaaatttttccaggtatttgtccgggttctctgcgtgtgcattgttttgtgtgctgtccattccctgtttttgttgcccgcacttttcacatttttggacgcaatttgcaaattgttccggcaatttatgtgccaacgacgatga

SEQ ID NO: 51805 - DNA, 769 bp, Heterodera glycines
  Genomic contig location: Contig_ID=SeqID_21215; Location=130..898; Strand=-
  SCN-specific regions: Sequence locations=1-521,543-578,629-769
atgatcaaaatcaccaaagcaggcaccaatgaatcggttggtgttacaaatggatgcttatttgtaattgatagaggccggattaactatctcatcaatttgggttgttcttttagactaattatcgaactgtgttgtatacaataattttagcatgaatacttcttcacagaaaagcagcttcttctttataattatcgtacttcttatggccataacgtaccaattgtgctcggtttcggcattgaaccatcagtttataaaacattccaagtacgctatgagaatgcgcggatcgccagagaaaattatcgttatgtagtagaatatataataactgtcaaattaaaaatggacaattatcctcagcacttggtgtcagagaattttataagaccgttgaaatccacattcatattaatcagcagcataatcattagtaagattgaatagattaagttcatattttttgcgctatgtcgtttcttaaatgcgccagctcgtatgggttttcaacagattttaattatatgttattcaaagtaaccgaattaacatagtttgaaacattcaatagcattaattttctatatcataaatatttaattaatttatgaaaaatattatagcggcccattttgtatggccaaaaatgttttcatcgcgaacaatgcattcgaaattgatttggacaccacatattacggaagttcatatggtcgaattagaccagtgtcaagaccaattaccaatgtcgaaggtggcataa

SEQ ID NO: 51806 - DNA, 134 bp, Heterodera glycines
  Genomic contig location: Contig_ID=SeqID_21217; Location=1428..1561; Strand=-
  SCN-specific regions: Sequence locations=1-67,89-134
aaaggaaggtccccaggtgtccgtgggatttccaaatgaaatttggtgggtggatagagcacccatgggttcttaagaaaaatgtttttattttctgcgaaatgagtctgagtgccgaattatgacgtgccaaa

SEQ ID NO: 51807 - DNA, 656 bp, Heterodera glycines
  Genomic contig location: Contig_ID=SeqID_21218; Location=425..1080; Strand=-
  SCN-specific regions: Sequence locations=1-539,573-656
  Gene Ontology: Mol. function=protein C-terminus binding; Cellular component=cytoplasm; Biological process=regulation of cell cycle
atgatgcgcgaacgcacattcacgccgaagagtgacacgtgggcctacggagtgctctgctgggagatcttcagtaacgcgcaacagccctaccagttcatgtccaacaacgacgtagccccgatggtgagtgcagtgggggggggggggggttgaaaacgaaaattcccattttcagaatcagctccccttcccttttcaggttttgcgcggcacacgactccgcttccccaatgtgacgccacctccatttgcggaattcatcagcgcgaacgtttggactgccgacgacggtaatgttttttgtttttgttttaacattttcaattataatgttttcccttccctttcagtgcgccgctattcaatgagggatgtactcgcctggattgagcaacacatcgatgagctgatcgacgataccacagcatcgcggcacgacacaacgacgactcgaaaccgcggatcccgtcaaggctctcgatctggcccataaaagatggtgatcaatgtgtcgctgatgtgtgtttaatgtactttatgtgtgttgtatatatgtatatgagtgtatattacgtcgctgttgtatcaatatttactgcattgtctcgtatttcgatcaaatgactgtcatatttgtatttgtcatgaataaa

SEQ ID NO: 51808 - DNA, 657 bp, Heterodera glycines
  Genomic contig location: Contig_ID=SeqID_21220; Location=943..1599; Strand=-
  SCN-specific regions: Sequence locations=1-431,453-557,579-657
atggtcaccaaagtgttccttctgttccccggcgaaacttcggtgacatttctattggaaaagtttttcctcatttactcgttttggtaagtgtttgggttgtgccgaattgatgaaattgcgaaattatgaaattcaagagtgaattaatcgcaaaatccatttaagggtttggccaatgccattgcaattaaaagaaattaattatgccaaagaaggggcatttctgaattggtcccctgaacgagaatggtttgagagaaagcaaagcgaagttggccatgcccaaattgggatggaaatgccaatcatttcgccaataattcctcacaaaaatatggccaacaaaattcagccttctgtcgctaaaaacattctaaatgaatttttgaatggtaaattaaataaattaatcgaaaggaaaaaaatccaataaattaagtgattaattaattaatttacagaatttaaacaatttatggccgaagaaaatttgagtaaaaactcctagaagaagctgattgacaaacgtatttaaatcattttttttagaagtgatactttttatttgttatcacaaaattctaaacatttatggacttttctttcaaacgtttattattcgtcataaatttttattgcaaatttggaattaaa

SEQ ID NO: 51809 - DNA, 534 bp, Heterodera glycines
  misc_feature (7)..(7): n is a, c, g, or t
  Genomic contig location: Contig_ID=SeqID_3771; Location=628..1161; Strand=-
  SCN-specific regions: Sequence locations=1-8,30-534
atggttnttctcagtgtgttctgtgctgagcttctcaattgccgagtttcacagctttgcgaccgactgaaccatcctgaagaccgcacttacatattaaattcactaaagggtcgcaaggtcacgacaacatacaaggacagaaacggaatgaccaagactttcttcattggaggtttatcggaaaagggtgctgcacttacaatggcctacggttgtctctctcgccctttcaacatcaacatcgcagctcatttctatgctcgacatcgcattaagcttcatcatccttatatagtctgcataattgaacgattctcaaaaggaaaagaggatcgactctatcccatggaattgcttgagcttactgaggacaaccctatttggcagcaatggtcaggacccttattcgcagagagggacccgaccccaccacgcacttcgggccggtttgaaaatgatgtggatgatgatgaaacgttaaaagatgttggccgcaatcagtgcacacaatcgccagatttattttggtga

SEQ ID NO: 51810 - DNA, 1332 bp, Heterodera glycines
  Genomic contig location: Contig_ID=SeqID_3773; Location=372..1703; Strand=-
  SCN-specific regions: Sequence locations=1-95,117-312,342-575,597 -723,746-773,798-904,936-1016,1043-1218,1269-1332
  Gene Ontology: Mol. function=zinc ion binding; Cellular component =nucleus; Biological process=mRNA splicing
atggctaataaatttttgctcgttccacaagaaatttaccgagggctaacctcagcgtcggatacgggagtcattaatttggatgcggtaaggcatgacctggaccgtgccaggggtgaacggactaatccgacaacaaaaaatgtccgatacaatcaacagcttaggcgctatctgcaaatgagacgggagcttgccgataggcctaccaaagttgagttaaccaagggcttgagtgttttgctaaagcaagatggaggtgttgatgatgacgacggcgaagtcgtcaacactcagccacggcctcccgctccaccaccaccaccaccacctcctccacctcctcatcaataccaccgtcgccatcccagccctcccgatcagcaatcttcctcgtctgacgatagtcatccgcctcaccctcctcgtccaccacgtcctcagcgaacaaagaaaaaccatcattcttctataaaatatggtcgactgaaccaatggaagcaaaggcgacgtgacttacaacaacaaccggtagtacgtgatctactcgctgaggcagcagctgctcctttacctgaaagtgacgatgacgatgaacaaatgctcgaaggtgggtatctgctgccaacaccatcacaaaattatggagacatgccaatattgcctgattatgcagatgaaattgaggaaatggacaccgcccaacaaagacttgcaagcagaagaaagataaaaggagagggaatagataaaaacaaaaaatacaaaatttactattctcctccaccatctcccacactaccacccgtgtacaaacgaccagaccatccccctcctccgcctcgttctatacccaaagttgaactgaaaaggggtccacaaccaacaaagttgaaaaaatctgcttcacccccacctccaccacttcctccacatcgcgcaaagagagaaccaaaaatagagctcgcccctcctccacctcctcgcaatgtctccacaagggaactgaaaattgaactagctcctcctcctcctcgtcacttcaccaaaagggaaccaaaaattgaagttgacccacgaccatccacatcgaagcaagccgggtacttcccgcccccgaaaatcaaaaccgagccaaaacatgagttgcaacctacaaagaggccagtgccataccgtatcccgaaaaaagagccaaaaattgaagaaaagccattacagcagcagcagcagcagcagcaacaacctcctcctcctccagctgttgtcgtcgaaagaaaatgccctatgttcctccacctaggagggggaccaaacgcacataccccgtaa

SEQ ID NO: 51811 - DNA, 2564 bp, Heterodera glycines
  Genomic contig location: Contig_ID=SeqID_21221; Location=1..2564; Strand=+
  SCN-specific regions: Sequence locations=1-8,30-97,119-262,493 -649,672-721,773-862,936-1014,1071-1173,1208-1237,1259-1442,1553 -1569,1602-1877,1923-2072,2102-2564
  Gene Ontology: Mol. function=zinc ion binding; Cellular component =integral to plasma membrane; Biological process=proteolysis and peptidolysis
tccgacgaaaaaatcattttcattttggtaaaaaattcgtcctcttccgatcagccattgttgtcgccgatcagcagcggtgcagaagaaaccgcagcagaaacagcagcagctcggggaaacaacagcaggtgtgaaggtaaagaacctcggggatggtcaccgaatcgtttcgttcgaaactttaattcgaatttaattaggatgaaaaaatattcgaaaatttaattcgatttcggcattcgactatttcgtgtaggggatttatagttttttttaatattataattatcttaaacatatataattattaaaagtttatcaaattaaaaaataatacattatttttaaaatacatcgaatatatcggatataacaaattgttttatttttaatttatataaaaaaattttttaattacatcgaatcttgaaaatacattaaattattaaatttataaagaatttaaatttaattattcattaattatttcagatttaaattcagtaacgacaattttatttattttctgtaatttattcatttagctcaattttttggtcacgtcgttcgatgttcaccgcaatttttattacgcttacattgcttattggcacagtttctttagtcaactctttttctagtgaaaatagtggtgaagatggtgacatattgggagatgacggcatttcacaaatattttcggatgacgatgccaaagtaattaatatattttaattaataaaaaatctatttcaaaataaaaaataaacagtgcaataataacgggaaaatctaatacgtaacgaagttacaaattctcagaaacctaacatactttctattaaccttagatatataaaaatataaacataaaaatattttaaaaataaaattgtcaaaaatatagaaaaaagttagatttaaaataaaaaaatatttttctagaaagtaagttaaacttttttcaaatatatttaaatttaactaaaacgaagataatttcgtgtattcaaaatattttatttattcccatataatattttttagcattaataaattatttttttgccatggattttcaatttttttaaatccattaattccagggatatcttaatcgttatggttacattgacaatattctgtcgtcccaaggtcatcatcatcatcattaaataaataaattaaaattttttaaaataaagaacaaaatgctgatgccacgccacgagctcatgcccaacaacagcaaagcaaatccggcgaattagttggtgaattgacattggattcaatccgatcggctgtcaggaaattccaagagtttgccggtttgccgacaaccggcgatttggacaatcagacaaaacaaaagatggcaaagccacgttgtggcattcaggatgtgcaaatgctgaccagtgggagtcagatttttgatttattttttttaatataatttttataaaaattaatttattaatttttttttcatatttcaatattaattaaaatattttaaatgtttaatttgtttacataataaattggattggttatacagacaataataattaattttttttaataaaaaatttctatttgaaaatttctttcccattaaatcattagggattttaaaaatttatttatgtttgtaaactgaaaatattgttttaatttttaaaacctaaacttatgatcaaaaatatttactattaaattattttgggcttttacaaaatgaatgattatttacaaaattttaattagctttttttcaaaagattatgtaatgaaatggcgcaagagacgcgtaacctttcaacttatgcagtcaaccaatgacattccagaacgcatgcaaaagttagtaaaaaaaattttgaaaattcaaaaaaaaaaatttttttttttttcattagacaggccatccaaatggcatttgacacttggtcaaagattgtgccattggattttagcgaagcaagcagatatgatacgccggatgtgaaggtgttgttcgcccggagaaaccatggcgatccttggccattcgatggccgaggtaaaattaaaaaaaaattaaatttaattaccctaaaacgggtgcttacaaataaggacaaatgccaaaaaaagtcccaaatttcgacaatttatgcccttctttttaaggtggcgttcttgcgcatgcaacctttcctcaagatggcaaactccattttgatgatgacgagaactgggttttcatggacggaagaaaaattggaaagtaaaaaattttaaaaaacacccattttgccaatatttttaaatttttagccatcgctttacggatttgtattgggtagcgctgcatgaaattggccatgtgttgggcttgtcccattcgaacattgaaactgctattatggccccattttatcaagtaaaaacactaaatgaatttttaattaatctttttttaaggacccacgtgatttggtcgattggcgtggcaattacaaaaggccagagctgactcaggatgatgtccgcgcagcgcaacaaatatacgg

SEQ ID NO: 51812 - DNA, 325 bp, Heterodera glycines
  Genomic contig location: Contig_ID=SeqID_21222; Location=674..998; Strand=-
  SCN-specific regions: Sequence locations=1-70,124-136,186-325
atggctgatgttttgctgttgacatacataacaaaactttgctcggcaatatttatttctgcacacaatctaaaaattatttatgtaattataaacttttttaatcaaaaaatcttttattttcagaagccgtttctttaattatagttttttattatattttggaaaatgttatttatattattgtcttgacaaaaaaaaacattcacaaaattacagccgccagaccaaacaaatttaatatggcattttgggcatttgtcaatggaaactttatccaaatgtctttgcctaaatataaaaatcatcattattatatattaaa

SEQ ID NO: 51813 - DNA, 1022 bp, Heterodera glycines
  Genomic contig location: Contig_ID=SeqID_21222; Location=1989..3010; Strand=-
  SCN-specific regions: Sequence locations=1-34,56-525,549-624,647 -727,749-935,959-1001
atgaacgccgtccgactgcgcgtttgggtaagacaagagatgaaaaaacaggaaggataataaatggtatgatgagtccaatgttaaaggatatatgaattaaggcaaagcacagccaccttttttaaggacattaaggacagaaaaaacataatcagtgaattaaatctattctgaaaaaagagtgatgggtgcaggcagatccaaagctcaggcagggttgggtagaaaatcaacattaaaagctctgttttttttaaatttcgacatagggaaactgattgtaaccacggcctgtcaatagaggatgtcgagacttgagattgagagttgaacccaagactcgagacggagaattggatgaacttaagaatcgaaaccttgaattgaatctgaaattctagaccgataaatgaaccagagactgacaaatagaaagtaaaaatatcgagaaatggtcttaaggtgaatccgaccggcggatgtgcagcacccctggtttatggtaaggtcggaaacacacagttaaaaaattaaaaattatttatctcaagaaccgtactgatatggtcgctctcttttgttaaatttacacttttcgcaaaacgtttttttccgtaaaagtaaaaaccaaaaatttttggttaattattaacaaaaaaatctcgtatcgtctcgtctcgtgtctcatattttatttttctttcgcaacatctctgctagcacccattttttgtttggtcatattgcagcaaagactaatgctcagtttttgacttttttgtcgattttttggtgtttttcgtgattttatttacccctcccgagtgatgataggaaatttgtaatttttttcattataattattcggttaaccaaattttggtagtaaaataagaaatctttaaaagtgtcttgattttttatagtttcagaaaatccttgaaattttgttgtccaacatttgtgcaattactttgaatgtttatgcataaattttttatcgaaaacccaaaaataaa

SEQ ID NO: 51814 - DNA, 404 bp, Heterodera glycines
  Genomic contig location: Contig_ID=SeqID_21224; Location=487..890; Strand=-
  SCN-specific regions: Sequence locations=1-42,64-118,140-251,300-404
atggcaaacaattcacatacactcattcagcctccggtgcaatggtattttatgaatttttgatacttaaactttttttaggtttactcgatgtctatcgtcacgttcggtcagtaagataataaataaaataatcctttcaacacttttttttgttgaagttgaagctgacaactacggacttggatgaattcttgttccattatctttttccatttcaattttcaggtccttttataggttaaatcacctaataaaagaaatttgtttttttttatttctaaattaaaaaaaaaattgctcgataattaaaattgccaaaattttagttggctttattggcgatgcgcttaatctgtggattcttcgctctcatgaaatgcggaatcgtgccaatgatttag

SEQ ID NO: 51815 - DNA, 95 bp, Heterodera glycines
  Genomic contig location: Contig_ID=SeqID_21224; Location=1233..1327; Strand=+
  SCN-specific regions: Sequence locations=1-95
atggccacagcaggaaaagcttatgatttgacgatgaaaatttgtttcatgcatcgaccgacaattcaaaaaataatgcaaatctcttctgctgt

SEQ ID NO: 51816 - DNA, 174 bp, Heterodera glycines
  Genomic contig location: Contig_ID=SeqID_21225; Location=1128..1301; Strand=-
  SCN-specific regions: Sequence locations=1-152
gagagacgagcagccgatgagtgagagaaaaatagtggtgaaatggtcaactgctgcattggcagagtcagagaggggtcacaaagagttcgcacagcatcgaatattccctcattttgggcgtcattcttccccactgcacttctttcttcggtttaattacccaagtttgag

SEQ ID NO: 51817 - DNA, 80 bp, Heterodera glycines
  Genomic contig location: Contig_ID=SeqID_21225; Location=425..504; Strand=-
  SCN-specific regions: Sequence locations=69-80
gtcctgcccataatatctgtggcatggaataaattttggaactgcgctgcctaacggcggtgcttaaagtgcgctaaaaa

SEQ ID NO: 51818 - DNA, 845 bp, Heterodera glycines
  Genomic contig location: Contig_ID=SeqID_21227; Location=139..983; Strand=-
  SCN-specific regions: Sequence locations=1-139,162-174,196-324,346-845
atgaagaagaaaggacaacaacaggagaacaccgttttggagaacaccgttttgggaaagagtaaaattccatccgacggcaagaaaggtttgtttgcactccacggggtgggtcgactctaggaggaacttgctccggccaccccacggggtggggtgggtcgccttggagacaattctttttaataaatttaatactgaattcaactttttcagctgcaaaagcatcaggcaaggaggtcaaggtcatgaaggagaaaggacaacaacaggagaacaccgttttgggaaagcagaacggttttttacatttctattaacaacaaaatataaaaaattatttatggcaattaaactttcagctacagctaagctccagtgcaaaagagattgcgtggtttcaatgataaaacacggctggctgaacaaagacaatcagaacgatatcaagacacagctagtgagactgcaactcttcaagtcaaaagcagcaataccttccatgcatgactatgaatcagaattcggagacaaaagagcacagagcactgcactagctaatgtttccgttggtaaggccatttcggacgatgctgattttgctgggtatgtacttttgtactgtatatatatttatgttactccatttcagcatgttgctgatccgcgctggccgttggtatcgtacaaaaatgactgaaactgcattgaccaaattggcttcattcgactctgcacaacttcatcaattgcttgtgaggaaaattaaccaaagcgtttggaatgaaatattttctgatgctgcacctaaaacaattccatccggcgcagagataggtaataaa

SEQ ID NO: 51819 - DNA, 367 bp, Heterodera glycines
  Genomic contig location: Contig_ID=SeqID_21227; Location=1129..1495; Strand=-
  SCN-specific regions: Sequence locations=1-105,128-367
atgtacactgagcctacgaaagacatgactcttgcacggacgcctctttttaaaactccatccgatggaacagacggtaacacagttaatgggaaattgaacgtgtaattataaaaattttatttttgaagatcaagaagatgacaagagagacgacaatagtttgagtggctgtgaaaacagcactgattcagacgcagagaacactgacgaagagaacgcttcgctcgaatacaatgcagcaccctcacccgaaagatcgaacaagaaggaagtggtggcagcggcggtgacaaaagccgttaccttctcagatgttgtctatgaaaatgtaaaacctgttgccaaaccccgtggcaagaaatga

SEQ ID NO: 51820 - DNA, 422 bp, Heterodera glycines
  Genomic contig location: Contig_ID=SeqID_21229; Location=279..700; Strand=+
  SCN-specific regions: Sequence locations=1-152,174-422
atgtcgggccgcaaatgtccgattttggcttgggccgcaaaatccaacaaaaaagtgttaggtatgcatttttaattgattatttcagttttcaaaaaaaatttattcatttaattgattatcagattttgaacatttttttctccatacagaaacaacaaaaaacaaccagctgtacgtggaacgcatccgaaaagtgcgccaacaattgcaggagcgtcgcccgctgttccaatggaccctcaaggacttcaaccggtgcgcatttgcggaactgctcagctaaattgtcctgcttccactcttggagcagtcggttccccgccccctgcgtcgttcccatccaaaattatgtccgattttgacttgggccgcaaaatccaacaaaaaatttggccgcaaatgtccgaaaatggccctta

SEQ ID NO: 51821 - DNA, 77 bp, Heterodera glycines
  Genomic contig location: Contig_ID=SeqID_21231; Location=243..319; Strand=-
  SCN-specific regions: Sequence locations=1-77
gcgtctccgctcgcaatgctttggccgatgcgtttcgcggccttttgcccgcctctgtagccgctgccgtcgctccg

SEQ ID NO: 51822 - DNA, 1005 bp, Heterodera glycines
  Genomic contig location: Contig_ID=SeqID_21232; Location=321..1325; Strand=+
  SCN-specific regions: Sequence locations=1-200,223-241,275-421,453 -549,589-750,772-779,801-1005
atgaagaccctttgcaaaattcaaatggcgaatgtttggcgcaaaaatgggccaaattccacgggcaaaagcattccaaaatggctggacattcttggctttataggagaaatgcggcacgtgcaaatccaaattgatgcctttgtcaaaaatttgctaattggcacggagaaatgtgatgacggaatggtcaatgtaactgaaaggcaatcctttatcacatcccaggttaaaataagtcaaaaattctttaaaaaataataattttaaaaatcatctttttcatatattttccccgtcttttttctgcttttccgtcaaaagtgtatgccttgctctaccgtttagtaaactatttttctcgatcttcaatgttttaatgagcaaaaaaagatgaaggaccaacggacaaaggacacacaaaataataatttaactaaaatatattttttggcgaaatcaaatcttaatctgttaagattagtttttttgatcatataagtcatatagcatttttctcacagtccaaattgagtaaattagtcacagtttattttttaatctttttaaaattcaaattattattttgttggttctttgtctgttggtcggtcctttgtctttgtgggtcctttgtctgtgggtaaaagaacggcgattgtcaggggaaaacttttgcttttttttcttacgggcgatgccattaaaaaataaatttgcctaaatggaaatttttgtatgaaaagaaactaatgaaatttaatatatattggattgtgaaaatataaaataggaaggtctgaagcttaataatgccatcaacattaatgagcaaaaatgagcacaaaaatatcagatccatcacaatttgtccgttcaatacttcacaattatatttcactgcttaaagttaaataagcaaccagcaggacaaatgggaatcgttatgtctccggatttagggctttaagccattttaaactaccgattaaaagcattgacaaa

SEQ ID NO: 51823 - DNA, 216 bp, Heterodera glycines
  Genomic contig location: Contig_ID=SeqID_21233; Location=383..598; Strand=+
  SCN-specific regions: Sequence locations=1-216
atgcaagcgccgcaaccgttgccaaatttgcaccaaattttccaagcggtggaccgcgaccggtccggtcagatcagtgcggacgagttgcagcgcgcgctgtccaacggcacgtggcagccgttcaacccggagacgtgccggatgatgatttcgatgttctactacaacaacgatggcggcatcagttttgcccgagtccaatcactgtggaat

SEQ ID NO: 51824 - DNA, 105 bp, Heterodera glycines
  Genomic contig location: Contig_ID=SeqID_21234; Location=62..166; Strand=+
  SCN-specific regions: Sequence locations=1-105
gacacatcaacttcgacgacttcatccaactttgtgttgtgctccaaacgctgaccgctgcttttcgtgaaaaggacaccgacttggacggatggattcgcattc

SEQ ID NO: 51825 - DNA, 299 bp, Heterodera glycines
  Genomic contig location: Contig_ID=SeqID_21235; Location=336..634; Strand=+
  SCN-specific regions: Sequence locations=1-299
ggccgatccagcattatactgggaagttaattcacaaaaatggccaatgattggtgccgttgtacggaaatttctttctccgcctgcaacaagttcagaaagtgagaggcttttctcaacggccggcctgatttcagatgacttgagaaagagtttacaggcggaaaatctggcaaagcttttgtttcttcaccataacttgcttctaaccggattttcaattgaatgattttgcttttataaatttgctttttaatatgtttttaaattgctttaaaagatttataggattttttaaa

SEQ ID NO: 51826 - DNA, 567 bp, Heterodera glycines
  Genomic contig location: Contig_ID=SeqID_3774; Location=1196..1762; Strand=-
  SCN-specific regions: Sequence locations=1-158,180-368,390-567
atggcaacaaaaaaagagaggagacaattcacaaatgtgatgattagagctaggcctacaggtccagggcatttttggcaacctgggttttgtccaggaaatacaggttacagtcccaggctaagcacgaaaaaacttggatttctacacaaaatgttagaatttattatgtatttcaagtgaccgatgttttttcaatttccaaaaaatgaaaaaataaatttaacacgcttatcattgtaattagatatattttgagatatttttcctggatttttgtcaaggaaatccaggcccaggcttttttcaaaatgtcgagctctagagaagataatgtagaaattcgttcgcccaaaatataaaattagccacttttaaaatatttaattgaaaagatttttcatttttttggatgggattaattgattttttcttttttctgttggctcatttttcgccgcttctgagccgtggagagagattgtaatcacttgttgcggtcagattgaatctgccggactgagaaagtaacggcacgcgaaaatgggaaatatttttataaataaa

SEQ ID NO: 51827 - DNA, 438 bp, Heterodera glycines
  Genomic contig location: Contig_ID=SeqID_3774; Location=2431..2868; Strand=+
  SCN-specific regions: Sequence locations=1-282,304-438
atgtttttaatttggatttggttgcttctgagaaaggcatttttcgaagcgttttgtcaaattgccgataaaagtgccgttgtccccgcccgatttgtcactttttctctcagttttcattcgttccatgccggctcaaagcgtgcctaccgatggatgacggaacaccgtgaaaatggtggtgccaccgccgaaactgaggcgacaacagaggcaaacggaacggcagcaaaaaacaaagtgattaggccagaggcggaggaaaatggcaaacaagtgccaaaaatgtaaagaaaatggttctacaaaatggatattttgaaaacagaaaagcaatggcacgggcgccgccctttggccggacaaaatcgacgccataaatatgggcaaatttgggaagagtgccgaggcaaatgaaaaggtgggaaatgttgaaaa

SEQ ID NO: 51828 - DNA, 1269 bp, Heterodera glycines
  Genomic contig location: Contig_ID=SeqID_3775; Location=2104..3372; Strand=-
  SCN-specific regions: Sequence locations=1-91,113-325,357-991,1013 -1269
atgaacgaaaaacgaaatcggtattttcttcctggcaatgtaaaaggatttaaagacttttttgccttaagcttaagtgaacgacaattggcaacaaatgaaatgtaaatgtgtgaaataattaaatgcgggcacggccaaaaattgttttaccctaaataattaatcgattcataaatgaaaaagggcggagggtcgaaaaaatttttttcagtagggtcatacgataggagataggttggcggtcaaattttttaatgggagcagaggggtagatgggcaaaattttcataaattttgcatgaaatttgcgatggaaaatggttttaatttgatttttaaaatttactcaaaatatttggcattctgtctttttaattaaaaaattcagtcggataccgcggatcccgcacaaaaaaatcaaatttgcggataaagcgagtgttgtaatgtacgaagctgcaccctatggcccgtgcttatgcctttagagattcatttacagtttttcgcaacaaaattggcatttttcaattcaatatactccaaggaaactttatgtgcaaatttttcttttttttatatgcttatacatatgttatggcccttataaataataattcaaaaagtgtgaatataacagtctcagaagaagagaaaccgtatcatttgttgtattaaatgacagcgcaaaaataacaaaacgatggaatgtgtcagaggaaaaatgctttcagctctttaaaatagtaattaacagcagtgagtgagtgatcggattgatcatatgaaaagctctcccattccacacgatcactttctgctgctgtgtccgttcatggcaatttttggctgtgatggctgaccagcgtttctgtggccgcttccgccactcggcgcaaatgttcgatgaccaggcgaaagcccgtgaaataatcgtccaccgaaaaattaataaaaaaatgttttttttccgaaaatttctagattttcagtgtgtttttgggtgtcccgatcacaatcaaggggtgatctgaccaagttggataaaaggcaaatgtgacgagacccgctaattgggtgcacttttgcaccctaaaagatttagaaatctttttctcaagaaaaaaacaatttaacgatttaaattatttttggcacggtgccgtgccatgtcgtacatacgtaccatgtaagggatgtcattttcggcacagaattccttcaccaacggcatcacctgacaagggggatgggctaaacattaaa

SEQ ID NO: 51829 - DNA, 2740 bp, Heterodera glycines
  Genomic contig location: Contig_ID=SeqID_3776; Location=1..2740; Strand=-
  SCN-specific regions: Sequence locations=1-74,96-272,311-567,598 -784,807-959,981-1356,1394-1902,1924-2008,2031-2656
gacgtttaactttttttcctaacgttaaatccgcttcaaattttgcatatcgatagagaaaaaaaatctgcatttttctatactgattttatttttgtttatacgttagttcaaaacttgcaagtttagaacacccatatattttttctaactcatcaaaatgctcagaatttgcttagaaaaagcttctccttatcaggagctttcgaatgataccaagtttgtacaatttggttggtaaaaacctccaaaaataattcccaaaaatggtcattttttaattttttgcaaaaaaataaataaaaatattcatgttgcacaacggactcgaaccaacaccctttgtccctttactatcttacaaaaaccactgagccacatatgcaaatctttttggaactgggaggccaaaactgaaacggtgtgtgcacgaatgtgaattttgatgaaaaatgaattttcgactttttgttcgaattcgggtccgggttcggaattggtcgaaatggatgtcagattcgtgctcagcgtacctataaacccctagaaacatgtttttaagacttatgaaaattttgaaaaatttttcaaaaaaggtgtcatacccctgtcccttaggcagggaacagcgccgcagtgggggtgggttccacccaattcagcgcccaaatgggctatatatagtgatttaggttaggcaaagtaatatgggttgaatagtaggtcgggaatgcaaaaatggatgccggattcgtgatcagcccttggtaacatattttcacgatttttaatacaaaaatcttttcgaaaacgggggggggggttgtgaagtttctaacagcagcctccatttttgagaaaataggtgttttttcagcacccgccttttatctctgcacctgataggtcgtgccgcctcccctcttttttttcttgttttttagttatgaacacatagatatgtatttccgagcattttcgggtgttgatcgcgaaatgatacccatttcgactaaatcggaatccttaacactttcattttatataacaaaaatataatgtaggaaacttggatgtcagatccgcgatcagtgccccgaaaagcctctgatttcccgttcactcactggctgggcttctggcaccacttgctgtccattcccattcacaccattgttaagattaagctggttatgttattgttctgatggttttgttgttattttgttgattgttttccattgttaaattagataagtaagctaaatcaagatttttcattttgagcaccaaacatcgcatttgcattgccaaccgcagagttaatctgtaataaaaaatttttccattctctcacccctccccctttttgaattaaaaagcccctaagaaattgtcataatatttttcattcttttttttttaaatattcttttgatttttggcatattcatttctgctcattccatgccgatggacgacgtaacaacgcaaaaagtggtggcgaaaccgaggcgattgaaaaggtaaattatacggtgacccaatgcaacctctgccttgcaccctcccccttgcccatcccaatgtttccatttttattgtcaccatttctctttaattacccccattaacactttgccatgatgcccccccctctgctgtttagatttgccgttcctttgatgttctccgctcccgcgtccgttcgcttggccttcttcgcgcggacgacgcctttttcgtgctcaaatttgtccaatgcgttgctctgattgcgttcgccgtgttcctccagtcgcgcgactttttccttgcctccgccttttgcatgggcatcgcctggcaacagctcgggtggatgatccacgaagtgggcccatgggatggcacggcacggggcgcgggcggggggagaggagggcatcccccgggggaaggatctgatgacttaatttaccacggagacggacagtcccgagttttctatcccggctggcaccctcacgagggccatccccagggagaagttcgtggctttaccacggggacagtccctacatttgaggcccctcctccaggccccaaatatccattttaaacagttttgtttgcatttggccaactcttagcaatatttaaacccaagtgccatactaatcatagcaaaactgagggggttgggtggttttgtcctgccatttgcatttgtgacggtgtccgccggtcccttttcagtacggtcatcagcagcactttggctcctggtggtggaacgacgtttgtggctatgtgtgcggcaatttgatgcagggcttttcgctcggcggatggaaagtgagtcggaaggagaaacatttttctgacttttagatttattgcgactccgaaaatacaatttcctgaaaaaagctacaagacccaccctctccttcccaagaagaccacatgtgatccccaatcggcgtctcgcgtaatatagtattttacaacgatactatatgattaagcaaggcgcaacgaggtcaaaatgttgatggtttgtgtcacactgttctttctctgctacacgccgatggtcgtttactttttgtgggcgtaagcaaacgcaaaattcacaaatacgccaattaagcatctgcatcggatatcgctactccacccctccctctctttttctcttactcatcctatccttcctttcctcccttcactctctctctcttgccccctctctctc

SEQ ID NO: 51830 - DNA, 598 bp, Heterodera glycines
  Genomic contig location: Contig_ID=SeqID_21237; Location=965..1562; Strand=-
  SCN-specific regions: Sequence locations=1-315,358-598
atgattggactgacaattgtgagttttttggtgttttatttaatttattgggaaatcttgccaatcatgagcatggtttttgatgaaaattctttaaagcatttttttggcattgtgcaaaggtttcttattttcaacctcgagacctttggtaatactgacccaaactctctcgggttaaattcccggttttgtgaactttctaaagctcctgaaaacaatttttcctatatatattccaatctgacggattaatgctaggagaaaatgccattttcattaaattcatttgaatttaaccataaatcttttggcattaaaaaataaatttacaaattaattttagtttaaatatttcttcattgtttcagcaggaccccgtggtgattgcaggtgtgatcatttccattggcttcagtgtggacattccggcacacatctcagcattctatgggcatattatttaaatgtttaaaatgaatagcatattaattggttgttaccaatattgttcaatggatctctcttatttaaaatgaataatatcttattattgttgttatcaattttgtccgaatctcatttttgtttaaataaa

SEQ ID NO: 51831 - DNA, 164 bp, Heterodera glycines
  Genomic contig location: Contig_ID=SeqID_21238; Location=59..222; Strand=+
  SCN-specific regions: Sequence locations=1-68,147-164
atgactcaaatgcttcgaaagcacgcgggaagtaaatgctgctttctctcgggtaagcatatggtctgtaaaaataatttattgcttttaaattaaaaagaaaaatttattttttaaataaaaattttttaattcaaaatttaaatgaattttcagaaatttaa

SEQ ID NO: 51832 - DNA, 1215 bp, Heterodera glycines
  Genomic contig location: Contig_ID=SeqID_21238; Location=322..1536; Strand=-
  SCN-specific regions: Sequence locations=1-35,86-217,307-345,377 -434,514-799,828-933,955-956,1035-1146
atgaactccttactgaactcgctttccgaggttggaaatttaaaaaataaattttttttgtaaatttttgtaaaattcaaattttcaaggttttggaagacactggtcctgcaattctgatctcagcacttaccaacatcacgtccgacttggtcggcatgtggacaggatcgcccgaaatcactttactctgcattggaaacatcgcatcggtgcgtttaaatattgaaaaattaatatgcattttatttaaaaatagcgaaaatattatatttaaatatggaatttaaaaattgaaaaaataatcggtcattcattatttttaattgtttcaaaattcctttcatattttttttattatcaatttaatttttttcacccccatttaagatttcgtttgatttcttctaccaaattaccctgttcactgccggtaattaattaattaaatttaaaaattttattgcctataattcattattaaatttaaaaagcaattaattaattaattaaaaatcctaattgtttttaagtgctgatcatttgcgcacgattggaattcaaggcagaattgaaaagcatcgagcagaaccacaacagcaattcgaccagcgcaaccggcacaatttcatcgaccgattcaaattcggatgagcacaatgacacgagttcacgcgcgaaattcacttccaattttgaacggatcgccaacgcatacatcaaatttgtttcgaacatttttgcctccattggcattgtcatcgtttcggcagtgtttttcgtcatttgctttagggtacattttaattaattttaatttggcacaattaagatttttttgaatttaggcggtgctcggattcgaaatcaatctgacaatggtcaaattgttcccgccagactcgcctctgctggaagtggacaactatcgtgaagacaaagtgaaaataccaatgatttttattttaattaatattttaattagaaatttataaaaaattaagtaattagttatttaatttctttttatttaagttgatgcccttctacacaatggcacaaatttttgtgaacaacccaggcgatttgtcaaatgcgaccagaagacacaagcttcaccagttcatcgacgaaatggagcatctgtaaaaaaattatacaataatattaaattataaattaaattcattaattgataaatttttaaataataaa

SEQ ID NO: 51833 - DNA, 387 bp, Heterodera glycines
  Genomic contig location: Contig_ID=SeqID_21240; Location=315..701; Strand=+
  SCN-specific regions: Sequence locations=1-152,174-205,242-280,319-387
atgtttttaacacaaaataaatattccaatgagcaaaaatcacaaaagctgaagcaatattttgaaatcaaggaactaaaaccaacaattagtgatggaataatagccgagaaattgggaatcggattttcaactataaaaaatgggttttggaacattgatttttgtgaagaagtttatgctattcgaaatgtgttcgttaatgttaaaattaatttttgttttattttgttttttttttgtgaccaaatggcaaatatttaagtggggttacaaagcctaaaattattataaatatgatttaattaatttatttatcaaatttcatgctgctcgaggtgttgatgcattaattaaatatcacagaaggtacgaaaaatggaaaaa

SEQ ID NO: 51834 - DNA, 1307 bp, Heterodera glycines
  Genomic contig location: Contig_ID=SeqID_21241; Location=219..1525; Strand=+
  SCN-specific regions: Sequence locations=1-1047,1069-1307
  Gene Ontology: Mol. function=sodium:dicarboxylate/tricarboxylate symporter activity; Cellular component=integral to plasma membrane; Biological process=synaptic transmission
atggccatccatcccggcgacccgtccatcaagcaggacttggcctatttggaggtgcagcacacgcccatttcgccgctggacacttttctcgacgtcgttcggtgggccaatgccatctctcccatgcctttttggcacttttccgacactcttttcttacaattagcaatatgttccccgaaaatgtcgtccaagcgaccctccaaagagcacagacaaaatattttgccccgagaagaaacgcacagcaaaaaacacaccaaaagcatgaaaaaggtgattaaaggagaggaacggaacagagcaatttccattttggcattgactttatcgttttttaaagtgttcgataataatttggactccaatcggtcgataattacttaccgaaaaaagatcgagagtgtgaatggcattaatatcctcggtgagtgtcccccccccctttccgttcggcacccccccccccccctcttttggcatcatcgttttctgcaccggctttggcattgtcatttctcaattgggccaacgagcgcacatcatcatcgagtttttcatcattctcgaggcggtcatcatgcaattggtcggtgccttcatgtggtcagttagcactcaaatcacagtgaaaatgccaattcgatgcattttgcattagtcggtttctctccagccccaatcgcttttcaggctgacccctctgggcattgtgtcgctaattgcgggcaatttgctcgagttggacgacctcagtgacaccgcagcagtccttctcctttacgtagtcactgtgctgacggcatttacagcccacaccatggtcacaatgccactgctttatttcgtgttcactcgtcgcaatccgtttaaagtgggccaatgaacggcgggggggggggaggagggggtactcacgcggcatttggcttgggcactttttggacacttttacggcataaattttgtttaatttaatcaactctcatttttcaagtgaaactaaggtcgtgcattgtgctgcttttgcaactcccttacaggtcgtccacggcatgctccaagctttggtgaccgccttcggcactgcctccggcggtgccgctttgcccgtgtccatgcgctgtatggaggagcatttgggcgtggaccggcgcatcactcgctttgtgcttccgctcggctccaccataaatatggacggaaatgcgttgtacgaagcagtggccgtgattttcatagctcagctgaacaacgtgacactgacactgaccgaagtgatcacagtgaggcgagtaaagtga

SEQ ID NO: 51835 - DNA, 156 bp, Heterodera glycines
  Genomic contig location: Contig_ID=SeqID_21243; Location=447..602; Strand=-
  SCN-specific regions: Sequence locations=1-156
atgcacacctgtgctagcagcttttccgagcaaaagcgccacaaaaaaagtgggtttatatccaaaaacaattttgttatttttttggtttttaggtgatcaaacgataaaagaagtatcgcgaagccgacgcacggattctctgactcgtccacc

SEQ ID NO: 51836 - DNA, 104 bp, Heterodera glycines
  Genomic contig location: Contig_ID=SeqID_21243; Location=167..270; Strand=+
  SCN-specific regions: Sequence locations=1-83
ttcttaactttttaattttttttatttcttgcggctagtatcttctacaataatttgtcagcttggtcggatgtgcgtcaaacggaaaaaataattaaaatttt

SEQ ID NO: 51837 - DNA, 551 bp, Heterodera glycines
  Genomic contig location: Contig_ID=SeqID_21244; Location=459..1009; Strand=+
  SCN-specific regions: Sequence locations=1-400,445-508,530-551
atgatgagcgcttcatttgctgaaattggcgaaaatgccggcaaactttggtccatcccacagagatttgagaaaaaagtgagaaaaagtaattgaattgggggtggattatcatcagaaaggcgtggggataaacaaacatcaaacggcgcgggagaggctttggccgttttgtatgcagtgactgccgacactgaggggaaaccttttggacttttggcatttcccttccgtgccattcccttccccacccgaccgacaccatttttcgatctttcatcattgggaggatggaaaaacaccatcccaaaatggcaaaataacaattaaaaatttgtaaggacgtactaatcagagttacttttgacatgatatatcaaggacattaataaaactgagcatttaaaaatttattatttcattaatatccatttttaaattattctatccctattttttcagtttttagggaatcatttggaaattaacttatttatgctaattacagaaccaattggcatttctgttcgctttttgtcttgcgcatagca

SEQ ID NO: 51838 - DNA, 820 bp, Heterodera glycines
  Genomic contig location: Contig_ID=SeqID_21245; Location=480..1299; Strand=+
  SCN-specific regions: Sequence locations=1-508,530-660,687-769,812-820
aaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtggcggtcaaagtttggtgcgcttctgatcagtttctgcttaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 51839 - DNA, 370 bp, Heterodera glycines
  Genomic contig location: Contig_ID=SeqID_21245; Location=1690..2059; Strand=+
  SCN-specific regions: Sequence locations=1-181,216-370
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccacccaaagcaaaacgatataaccaaaatataaagaaaaattttttaaaaaattttttctccatcttcctttttgatactaaagcatcagagtgctaaaattaagttgtaaataaaatttggtgcgctttagagcactttctgaaaaaaatatttatgaaaccaaaaaatcgattttttcaagtgtccggttggggtactcaaacatttatgg

SEQ ID NO: 51840 - DNA, 147 bp, Heterodera glycines
  Genomic contig location: Contig_ID=SeqID_3777; Location=56..202; Strand=+
  SCN-specific regions: Sequence locations=1-90,127-147
atgctaccggaatggaaaatttcaacgcaaataattgcaacctacaacggtaatggaaacaatgccacaatctattcaagtgaatctaagtatttttttacattcaaataaataaattttaaatttctagctcggaagtaaaataaa

SEQ ID NO: 51841 - DNA, 723 bp, Heterodera glycines
  Genomic contig location: Contig_ID=SeqID_3777; Location=2957..3679; Strand=+
  SCN-specific regions: Sequence locations=1-198,230-723
caaataaatgcagcaccgccgccaaatgtcacagcactgcccgcaaatgccaagtcgtccatccggcgtccttgttcaaagcgggcaccaaaggccacttcatcaactcgccggtccagcacgcgccaggtcaacctggctgaatgccgcgtggtcgtcaaaatgccaaaactggtggctttaactttttcgaaaatcatatttttaaattataaataattattaaattgttgttctataatttggtcttttttcaagcccaaacgaaattcgtctgaggcggaggaggaggatgtggagattggcaactcggacgtactgcgaccgcgaggggaacgcagcacggaaatgccagcacattgtcaaccgaatgggtggtcaataggtgggcagatagatgattgtcaattcggggaaggggaggctggtaattaaaggtctggtgatggatgggaaattagccgcaaaatttttcgtttttccttatattttcataaattttttctctcttattcacaggtcgatcagtcggaactgacaatctcaccgctcattcactcatcgtctgttttgcgcgagtcccattccaacttcacgtccaccagaaatgcggtccgttcgggagccaaattgatctccaaatatggaggacgcgagacgactgacaaagtgggttttggggaccaaatgaaattttctaagggggcccagccatgtaaatag

SEQ ID NO: 51842 - DNA, 669 bp, Heterodera glycines
  misc_feature (233)..(233): n is a, c, g, or t
  Genomic contig location: Contig_ID=SeqID_3778; Location=865..1533; Strand=+
  SCN-specific regions: Sequence locations=1-669
atgtgtcaattgttggtgttgctggtgctgatcctcctcgacatgttgctgctgctcctcctcctcctcgacatgttgctgctcctcctcatcaacaatggctgcgccgtcgacgacaacctccacgtccggtgatgggacccgggggaaaacctggtcctaaatcaaaaatttgactgttgacatgtcatgactcatcattaccaagggcacctttctttccccaatcaacncaaacaaagcaaaatcctctgcgtgcacgtccacagaagcgatgacgctaaattttttttgtgtattacttgttcatttatcgccaatttccccacattttgcgggccctctcgatgtcgatgacaccaccaacagctgcatgggtatacacagcttccatcagacgagcgagggtatacccaatctataaaatgcatttgcagttcttaaatccccgttctcgctaattttacgtggtcgagcagctcctcgtccttgaggaacgtctcatcgcatgattggtatccaattagataccaatacctcacagcaccgcagatgcgacgatggcgccttgtcgtacagggccaaagacgtcacttcatactcagttgtgccatcgtcgtcctccgcgatgtcggcagcattttgatccgggtgtcgatgttggcacta

SEQ ID NO: 51843 - DNA, 870 bp, Heterodera glycines
  Genomic contig location: Contig_ID=SeqID_3778; Location=2012..2881; Strand=+
  SCN-specific regions: Sequence locations=1-150,179-596,635-870
atgcagtggattaaatttaactgcacgctttgcccgatcggtctgcattgtttttatccgcgcaagtacgcaaagcctgtgctgtgtgcgcatcctagcgtcaacaacatcaccgactttttgagcaccgggcagcttgaggaagctgcaacgacagcaacaacaacaacaccattcccgacaactgcggatgtgtcggcggcggcagaatgcgcacctccgcccgcgcagctgaccgcatggatcgcggtgtgcacagcgctggtggcgcttttggtgattgcggaggtctgttaattttgggaatttatccgctaaacccctatttcaattaagcttgtgcgcgccggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcgccgactccgctgattttgccggctatgttagccggcgtttctctgcgcccgacgggcgtcaatttgactgtggaccgggtgggcaattttaattaaattaaaatctttatatattttaatttctcactcattaaaattacaatttaaatttaaaggcagcggggcagcgccgcgcggatggtgcaattgaggagggcgaagagcccgtgtacgatgaggtgccgcttgacagcgacatcgtggtcgagatgcgcgatggagaaaatggggaggaggaggaggaggatgacagtgatttttagtgattcggcaagcgatcactcaccatttaaccaatcgatcgatttttcactttaaa

SEQ ID NO: 51844 - DNA, 486 bp, Heterodera glycines
  Genomic contig location: Contig_ID=SeqID_3779; Location=370..855; Strand=+
  SCN-specific regions: Sequence locations=1-216,243-252,277-448,474-486
atgacaacagcaaaacatcaacggacaccggacgacgaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaaaaaagcgcaaaactcgctctgccctatatataaaagttgatgattgctgctcaatttgtcataatttttgaaaatgttaaattctcaatcgttcagta

SEQ ID NO: 51845 - DNA, 100 bp, Heterodera glycines
  Genomic contig location: Contig_ID=SeqID_21249; Location=624..723; Strand=+
  SCN-specific regions: Sequence locations=1-100
gtatacatttgagacaattgggcaggacaagaaaagaatgaagttgatgcctcatgaaactcggaattggttatgttttgtcgaaaatatccttacataa

SEQ ID NO: 51846 - DNA, 1052 bp, Heterodera glycines
  Genomic contig location: Contig_ID=SeqID_21252; Location=1..1052; Strand=+
  SCN-specific regions: Sequence locations=1-123,145-1052
  Gene Ontology: Mol. function=methylenetetrahydrofolate dehydrogenase (NADP+) activity; Cellular component=mitochondrion; Biological process=nucleobase, nucleoside, nucleotide and nucleic acid metabolism
gaacgagctgttcacaccagtaaatgcccgcgttttgtgtggttcgagattctcgagtcctgctaaatttctaccctcgaccatctcaaatacttcgccaatatcgttcacctaatccgtacaacattagcttccttttttctgatcagccaaatcattcaattttacagtaatttaagagctaccgtagttttctatcactttttttaaacagagacaatatcccatttatcaaagtaaataaaaaaaatttgatccatttttcaaaaaaaatctttaataaaataatttgccaagaaaccaatgccaagattctgatggtaattctgattttggctcttaaatgactcattttgagagtttttggacccatatcattttggaaaatggtccatgccttaatcatggccacggaaacatggccctttttgccatgtccatgttcatggctatttctggcactcccttcagttgcccttagaatgcacaaatgccatcgacactgacgcgctgctggaccggatcaatcctgaaaaggacgtggacggactgaaccatgtgaacaccggcaaattggccaggggcgagctgggcgacggcatctcagtgccatgcactgcgttggcatgccttaagctggtgcaaaatgccacgggccaggaggactttgccaagggcaaacatgtggtggtggtgggccgctcgcgcatcgtcggcggtccaaccgcggcacttttcatgcggttagtacggcacggcacccgtgaattgataagcatgttatctgcttgcactgatcatccctctgctccgatcaaatccagagagttctgccatgatcggataaattcagtcacacttaattaccggttcccacactaattaatgtgccaattttgccccaggcatgatgccacggtgaccatttgccactcacgcaccgagcggctggcggagcattgccgcgaggcggacattctcattgttgcggtgggccagcgtgggatggtgcgcggtgattggattaagcccggcgcggtcgtcattgactg

SEQ ID NO: 51847 - DNA, 513 bp, Heterodera glycines
  Genomic contig location: Contig_ID=SeqID_21254; Location=292..804; Strand=+
  SCN-specific regions: Sequence locations=1-111,136-513
atggctattcactcctcgtccggacaatgtgccaaaggtgttcaaatgcttgttgaagttgtggtatggggaatttaactcgagcatggaagactttaaagcggtgatttcaatttgattttatttgatatttttacggtcttttgggttcgctggcaaaaatattttgttttggacgacattcaactcgtttttggcaaaagtgtcccatattttaggcatttgccaatgcttcatctcctgtcaatttcattgttgccgtttggatttcggcgccttttgcttttcccgcacaatttgatcagaccaacgaagtgactcgggaacaactgacgtttaaaagaattggaaaatctattcgccatttacttctgatccgttgtccaattgtgcgcgacacgaacaaatgggcgaaatgggaaaaggaagcgattgactggcaattcaatgatcaatggaacagaatcgacattcaaattaataatgagcgtaagatgggtcagtgaatgctta

SEQ ID NO: 51848 - DNA, 703 bp, Heterodera glycines
  misc_feature (536)..(536): n is a, c, g, or t
  Genomic contig location: Contig_ID=SeqID_21255; Location=645..1347; Strand=+
  SCN-specific regions: Sequence locations=1-50,77-100,122-271,294 -435,468-494,517-595,634-666,688-703
atggaaaagcttaaaaatttcactgttgtcgatttatgcaaagtattggctctaccagacaaagaattcgaagaattggcagtcacagatcacttttttccacatacatttctgattttttgtggcgtaagcaatttggaggaccggacattttttataatttgtggacccaaatcgcggaattgtacccaataatcacataaatcttcttttatttgttatttaaagcaattgcgacaataaaaaagaaaaaaaaaatttgaaaaaatttgacccaaaagggggacccaaactgtactagttccaaatattgattaaaaaaatgaaattatgagaagggctcgaaaaaatatggaaataaagtcgcaaaatatggaaataaaatatggaccaaaaatcgcgaaatatggacataaatttttccaaattgagagtttaaattctcaaaatttattcaaatttgttaaatgtaaagtaagtaatactttcaaaataatagaagaaaaatacacgataaggctaaattatttaatctntagcaaaaaacaatccgaaaattgaaattttaacttttttttttttgcttatttttgacataaaatttatcaatttttaagaaaatttaaatttattcactattgtcaagaaaattttgcgaaaaactgatttttgggaaaaataccaaaagtagacaaatacggaa

SEQ ID NO: 51849 - DNA, 415 bp, Heterodera glycines
  Genomic contig location: Contig_ID=SeqID_21255; Location=102..516; Strand=-
  SCN-specific regions: Sequence locations=1-168,190-415
acagtttggaattgtcagttctccgttggcgacttcgtttccttctccgatgcttttctcgtctgctgctgccactctcccggatcgcttgccgttacgcgctgaacccgtcgttcagtttgaagaaaattgacaaaggttttacgagaagaacattgacattttacaacataattctgatttctcagactcttcttttgcgttcgtcgttctttgtcgtcatgagaacacaatttatgctacgcaagtaaaactccgaaacaattttgaatattttcatttaaatgcaatcggattaagattgcaaatgtgctcgacgtgggcgaattgcgcaacaacaaagtgaagttcaaggagctgatcgtgttcgaggaaatgccccaggatttttgtgttctcattgaagtctgctatg

SEQ ID NO: 51850 - DNA, 89 bp, Heterodera glycines
  Genomic contig location: Contig_ID=SeqID_21255; Location=782..870; Strand=-
  SCN-specific regions: Sequence locations=1-89
ttaaataacaaataaaagaagatttatgtgattattgggtacaattccgcgatttgggtccacaaattataaaaaatgtccggtcctcc

SEQ ID NO: 51851 - DNA, 842 bp, Heterodera glycines
  Genomic contig location: Contig_ID=SeqID_21262; Location=534..1375; Strand=+
  SCN-specific regions: Sequence locations=1-192,216-361,384-536,558-842
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaattttggtgcgctttagagcactttctgaaaaaaaatatttatgaaacaaaaaaatcgatttttttcaagtgtccgtttggggtactcaaacatttatggggagcaaaatccaacgcagaattaaagtacaggctatagggcagcagagtgctaaaattaagttgtaaataaaatctgggcgcatcgctttagagcactgccctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcaaattttt

SEQ ID NO: 51852 - DNA, 787 bp, Heterodera glycines
  Genomic contig location: Contig_ID=SeqID_3781; Location=414..1200; Strand=-
  SCN-specific regions: Sequence locations=1-31,53-156,180-640,663-787
atggacatttgggcggcgggaattacaatttttacaatggcatttttcacaacggagacaaacgcattggaagaacatcaaaaaattggtgaattgtttcgaagtgaaaaattgaattcggtggacggtggcttatcagattcactgatgcataaattaaagctgccaagagaaagtgcacagtccggctcaaaagattggtggcaacgatatttgagtactgtaacgaacattctgtcggtttggcaaaaaatgccagcgattgcctttctttcagcggtaagtccgagagtatctaaactttaacaaaaattctaacaaacaaaatgaaaaaattatcccggcaaaaaaataaaaaaccaaaattttatgaaaatttacagaatatgttaaatattgagccgaagaagcgaatgactgcccaagggatcgttgcctttttggatgggaaatgtaagccaacggattacccgaaaacccatttgaaaatggcactgtttggcgaagtatcggctgaaaaattgctcaaaatgataaattatgaaaatgagagatttatcaaaagggaatgggccactgctgagaaaagtgtacgccgctttttgaaagaattggagaaccgaaccgaattttgtgaccaataaatttgcaaattgtcctttgctcgtttttctttcagcagctttttgaagtgaatgcataaaaattcgtcttaatttgcaaaataattaccaaaatttccccaattgtgtctatcggcaccattggacccttccatggaaataaa

SEQ ID NO: 51853 - DNA, 1371 bp, Heterodera glycines
  Genomic contig location: Contig_ID=SeqID_3781; Location=1380..2750; Strand=-
  SCN-specific regions: Sequence locations=1-162,187-399,435-477,514 -701,753-934,959-1086,1200-1203,1226-1371
atgaatgctgcttcttctcttctgctaattgtgttccttttttatttccaatttgattgtgcccttttgtctttcgaatgccgcggtgttccgactgatcaaatggaaccatttcaatacccttcgacccaatggaggaggccaactgagagtactgcgcaaatcaaaatcttttttaaaaaattggcacacaatgtaattacttaaaaaattaatgatctttggtacttccgttatgcccccccccccccgacaaagtaaagcacttttctagggtattttaggcactgatcaagaacctggcgtcaaaactgcaaaaatctatgatttattatgatttagtcgagtgtgcggtgttttggccaaattaggagggtgcggcagaacagaaaagtgcttgatttttcatgataaaaatttaataattgaatttcgaagagttcgaatcgattttgaaaaaaattatgaccgaaatacaaacacaaagcaaataatttttaaaaattacaattagtttttttacagattttcatgggtttttccaccgatgcaaatcattatctgccaaaaaacaaatgcattgccatcaaaatttatgaagaagagtttaaaaaagaatatttgaatagcgtgaaaattttgaaaaagttagcagaaaatgattcgcagaatgaacactttgtccaattgatagactagtgattttataaataattctgattattatttaattcattttaattaaaattattgagaatttaagtggtaacattgatgaaacaaatctgatcattgatgataattcaaatttgaccgtttttgagcatggcgaaagggatttagatgaagaacttcaacgtggaaatttttcgtcaagagaacttaacagcatggttaagagtattataaattcattggttgcttttcacaagggtaatttaattaattcattaaacttgtttattaattaattatccacattttagttgggattcatttggatatcaagccaatgaatttaattgttttcgaaagaaacgatttttttggaaaagtaaaggaattaaaacttatcgattttgacggtaatttttatgatttgtattaatatttatttaaaaaaataataataaatcttcaatttttaatcgcaatattaaataattatactttttttaatttaattttttgtttatttacgccatttcattgtttgttttttgaagggtcagttttatattctgacgaacagagaaagatgattaaaattaatgaagattcaataggttgcactaaaacttatgctgcaccggagctgcttcaagtcaggattaaataattaattcaaattgagaaattgcattaattaaa

SEQ ID NO: 51854 - DNA, 122 bp, Heterodera glycines
  Genomic contig location: Contig_ID=SeqID_3781; Location=3679..3800; Strand=+
  SCN-specific regions: Sequence locations=1-9,32-122
atgggtgggtatatatatttttttttaatttcaggtttagggatgtattttcgtttttattgctcttttaagtttcagaaaatcgtgagaatagtctgcgatgtgataaattgataaaaata

SEQ ID NO: 51855 - DNA, 1599 bp, Heterodera glycines
  Genomic contig location: Contig_ID=SeqID_3781; Location=4564..6162; Strand=+
  SCN-specific regions: Sequence locations=1-32,62-67,106-137,167 -209,260-275,314-388,410-464,502-547,573-599,705-952,974-981,1006 -1011,1033-1101,1123-1351,1387-1450,1472-1476,1499-1529,1551 -1571,1595-1599
atgcgcgccattctcttcctggccatggtttgcttggtgatggctgttattcttgagacaggtggccaaaattaattaaaaaattaaaaatattttattattttagccaactcaaaggcagtgaaaaataagaaaggtataaataaattgataataaatattaattggaatatgcttttaaaggagcagttgcaacgccagcaaaaggaaaagcggcgccgaaaggagcagcgaaaggaggtaaagcagaaaagagagagggactaattaatacaaattaattgattaatcaattaattaattaaggaattaaaaaagacgcaaaatcaaagggaaaaggaaaaaaggacgccaaaggcaaaaagggtaaggattttaatataaagcgaaatttaaaaagttaatttttgaattttagacaaaaaaactaagccagccaaagggaaaggagtgcctaaaaatggtaaataatattattataattaaaattgaataaatttagacaaaaatccccagcggcaaaagccaatgacaaaaagagcccaagtaaataattaattatatttaatattgtgccaaattgccaatttgaagtcaacccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaatggcaaacggaacaaaacgggacaaatgacacaaaacaatttttcataaaatttatagagaagataaaattctattaaatcattcatttctgtgcttcaaacttcgagaaatcattttaaatttttataaaaaataactcaccattaaattatcagacaaaaattattcacactgaactaattggaaaatatgcactgttaataggaccgtatttcaaaattattaatctaaattgagaggaaagttagttcctaaaaaatctgttttaatttgctttatttaaggaaaattttaacaaagaaaatttaagaatgtatctttttgataccatggtttagatcattttactaaaaactccgctaaacacacttaaattacctatttattagcaaatgtgaacaatgggaatcattgcaatggcaaagttcggcatttatttaatcatgttaatgtaaatgataaaagtattgggttaactcttaacattcacatttattcaaaaaacattaatccaatttcattaatattcattctcaattattttccattcgttcttttcgcggaatgattcatttcgatggaaaagcaaattttactttacagactgatgaattaatggaaagaaaacatattcatttattcgtttgcactgtccatttagcatttattactttattttggtttagttttggtggataggactaatttttaaaattatttttttagaata

SEQ ID NO: 51856 - DNA, 2271 bp, Heterodera glycines
  Genomic contig location: Contig_ID=SeqID_3782; Location=388..2658; Strand=+
  SCN-specific regions: Sequence locations=1-298,321-537,589-671,693 -700,807-809,831-1022,1072-1078,1102-1245,1278-1700,1722-1748,1771 -1837,1865-1904,1929-1965,2003-2271
atgaagcgcatttcgagactgatatgtcgcgttggatcagtgcacgcgttggggcacagaacaaacgcggcacgactcattcgcactcaaatttcagatcaccggaaaatgcgagaatgggtgggaattaaaaattttaaactattttgaaagcatttttcagctttctgatttgttatcccggcgctttggacccaagtgcaaattcggcatttggtatgagaccggaagtgcaattccaagtgccaaatcacccgaaagtgagcaattaaggattctcattaaattaaaaagacgcttaaaataacatgtccatggtgggccaaaaattaatcataaaaaaatttctcttaactccaaagtaaaaattgcttataaatttagagcaaattgggggcccaatgcttggcgcatcagaaaaagtgcaacaattcagacccagggaataattgcgatcgtagaaaagtttggcatggcatcagtttgaaaacgtcgaatgggagaattatgcttgaaatgtcaatcgcggcgaaaacgtaaaaaaatattgaaaaataaaaaacaattttaaattatatatatatttaagctacaatcttggcagctacaacaaagcagagatttttagcattcaattgggaaatccgaataatttaatgactaccgcaatacacccaaagggtaaaagtggcccaatttcatttattatgaattcttatttaatataaaaaaataaaacaaatttttcatttttgataattatttaaaattaaataaattaatcaatattttaaataaaaataaaagagtaaaaatgccaaatttaagtgggccaaatagtttttgcggtcgatgactctgtccgtgatgcttattttgctcgaaaaatcaaaaaggacgtcatgctgatcaattatgctggcctttggatgctcggcctggactttttgccgatgaacaaccgcgacactttgcaaatgcacgtctaccgcgactgcggctgcgaaatgcacgcatgggtggggaaaaaaggaatttaaaataggaaattgatattgtttaaagattgaaatcgctaatttgttataaaataaataattaactaaccttatttattaattatgccaattaacaaatttttgaaaacccgacagttttaattgcccaagaaagccgtttcgaatattaattttcaattttgtctaacggctggagctatcataaacatttttgataaaaaatgtgttaattttcatttaaaattatttttatttattcgttacgcctttcaaagtttgcccatccgtccgatgattcgccgctcaaacgcagtaggcaccccgacgtcagcgcggattgtcccgcaaaaattgtcgattcgttagccgaacattttgcattggaaaagccattgcaaatggacagatccatccgacttcgacaacgactgaacaaaaacccgaaaaagatgctgttttggtttggcaatcagcacaaaaagcatttactcgaaatgaccgtggaggagccgccgaacggattaatcgatatcaaatcaatgcaggcaaagacacgctaattaataattaattaatactaatgggggtggaaaaggacaaaatggcacagacactcacgaagaagggctgttggagtgccattgcaaaaacagtgccaataaaaaccttttaaattgttgccagaatttttgacatttaaaatatgaagccgaaaattatgcaaaattttaaacattcccaaaataattttctccattcgtataaattacggaagagattatttgccaataaaatttctaaattgctcttttaagctgtttaaatttcactttttaaatgaatttaatgcgaaattaaggacaataagaccaatgaagaatttgtggacaatgagatgagaaagttggccagagaaagaaaattcaaagcgatggatgacgaggatgaagaagaaaaaggaggaggagaagaaggagaagaaggaagcgggaagggaggaaaaggcaccaacaaagataaatacatcgaagtgcaattggtggcacgcaaatatttttacgaagtgaaagtgggcgaccgcaaagtgttcaattacttcccgaagagcgacgaatggtggaaaacgtggcaaatggaggacataacgcaagtggaggcaagtggccaagcggaagggcaaatttaggagggcaatgggcaatttgtgggggacaaatgcttttaaattcggcaggactttttttaaatgcca

SEQ ID NO: 51857 - DNA, 346 bp, Heterodera glycines
  Genomic contig location: Contig_ID=SeqID_3783; Location=886..1231; Strand=+
  SCN-specific regions: Sequence locations=1-197,219-346
atggcttttgaagtgttccctttgctcagtgttggcgattccattctgatcgagggaaaactgaaagacaacgcaaccattttcaaaatcaatttgttccacgatgtgaacgagaaaaacccatacggtaagaccatactgtaaattacggcaaatatttatccaataattaaaattgggcaatgaaaaattcttcgttgttttttgcttttctttcccattttgcaataggtcatttgttaattaatatccgcttctcttcttctcagccagtgatttggttctgcaaattttgttcaacttcaccggggatggcacaattcaattgagctcattgattcaccag

SEQ ID NO: 51858 - DNA, 1071 bp, Heterodera glycines
  misc_feature (1033)..(1033): n is a, c, g, or t
  Genomic contig location: Contig_ID=SeqID_21263; Location=1182..2252; Strand=+
  SCN-specific regions: Sequence locations=1-102,124-147,170-274,296 -318,340-340,363-589,616-1071
atgcattttcctaaacacttcattttcttggcaattctttttcttctgttgggaactgctcgaagtaaatttattgaaacactaacgcaaattaagttaatattttttaacaggtgctttggtggagaatgactgccccatttgcgataatgaaatgaaaaaagaaaatcaaagaattgtttcattgtcatgtgaagtaattttttattctactagagcatatcttgtaagtgagccgcttgggatacaaaaacccaagaaattatatcaagtcaaaatttataaaaaatattaacctgataggctcgcaaagtttaggccatgtttgaattggcatacccattttaatttaatatgcaaatatttcagcatgaatttcatcgtaactgcatgaaaaaatggtaatataatttgtttaataatagggctcaattgctacactaaccagtgtgcaacagcaacctcagaatgcttcatggtggactcaccaacaccaaactaatatgcaatccgggcaatggccgaatccatggaataatgtaaatcaacagccgtggagggcatattaccaacagcaaatgccaaacccaccatcgggggcacaaacacacccacaaaatgtgcaacatgattcacgaacaaatccagagcatgttcggatgccatggaccaatttgcagcaacaaccagcgcatgcacaacactggaatgccaatgagcatcaacaagcgccaaatgcaccatggtggtcacattatacatggcaacatgcaggccatccacagatgccatgggcatatgcaccacagcaaagcacacatacaccttggtggacaaaccctgcgcatatgtggtggcaacaagatgccaatgcaagccaagtcaatgcccacaatattcatgtggatggtaacgcaactgttgttcaagaaggaaatgatctgatcataaatgggcaacggcaccgaaatgcagccgcgaggggtgtcagtataagcactggcggacgtgttaatcatgacggtgttcaaancagggagacatcttttcagtctaaattctgggcagaat

SEQ ID NO: 51859 - DNA, 659 bp, Heterodera glycines
  Genomic contig location: Contig_ID=SeqID_21264; Location=198..856; Strand=-
  SCN-specific regions: Sequence locations=1-339,369-625,657-659
atggtccacaaacccttttctctttgcctttcagtctttttcatttcggcgttcttttttgtgtattcagctgatgaatcgattaaaccaccgacaagaagtcagagacaaaacaaataaaattagggattaaactcattaattacctattgtaattaattaataatctatacctaactctttaagatgttctaatcacagcggaagaagagaaacaaagagatgttgaaggtttcttggcaatcaaagccatccatgccgttctcgacgatgacaattcgggctcaattgatcggtttgaatctgccgatgtatgtgctagtgaaatgacacgaacgcaccaataatttaaatgtatgaataagcctccctttagttcttgaaagaagatctcaaatttggcggttcggacaaaataaggcgagaaaatgcatttcacagtaacgacgaggcgataactgtggacgatttgtgggagaattggttccaatccgaggaacgcggatggaccaacaaacaagtggtcgaatggttgaccaaccaagtcaaactgccgcaatatgccaacggttttttgagtgctgaagtgactggcctggaccttccgaagtaatcactggaattctttactttaatttcatttaatttaatttaataaa

SEQ ID NO: 51860 - DNA, 293 bp, Heterodera glycines
  Genomic contig location: Contig_ID=SeqID_21265; Location=534..826; Strand=+
  SCN-specific regions: Sequence locations=1-242,268-293
atggggaaaaattgcgggaacgacgagaaatcgaagggggagcaattcaacggaagaatgatggtccacccgagaacgaatcaaggtaaaatggcatggtggcaatcaatttctgacgaagcaatgctaagggaccatttggaacacataattggccaactcgtcaatgtatcaaagcctctttcaccggttcgctttgtgtccgaaaaggcgacgacttcgtccgccgaagcggacgtatccaatggcactcactcggaagaacagcccgaatgttctgtcgcacgacttaa

SEQ ID NO: 51861 - DNA, 237 bp, Heterodera glycines
  Genomic contig location: Contig_ID=SeqID_21268; Location=230..466; Strand=-
  SCN-specific regions: Sequence locations=1-212,234-237
atgcatggattattcattctcggccgccttgtccccgtgctggtactgcttgcactgcttggtgggctcttgcacaccggtgcgcaggagtccatttccacgcgctcaacacgtgcggagggcacactgatgtgcggaaagttgccggcctcaaaggtgtacgtgcggctgttcaagaccaactccgatggtcagcaagcagcagaatgggcatttttaattgcaattaaaatttaa

SEQ ID NO: 51862 - DNA, 601 bp, Heterodera glycines
  Genomic contig location: Contig_ID=SeqID_21269; Location=608..1208; Strand=+
  SCN-specific regions: Sequence locations=1-342,364-465,487-489,513-601
gaatttggttacatttagggcccgacccggacgacactttggacgaaaagtttgtggacgctgccggtgcatttaagtgagtaattaatgcgccgctatttggaataccgtagtatttgtctcaaactacaaaattcccccacccatacgggagccatactgtaggaccaatagttacagtacccctatgggtgaaaaaaaatgcatttttttgcagactcaatgggtacacacgggaactcactgacattgatccggtgctgtacgtgtggacagactgtaacgacgggcatacggtagggtgcggaaagtacaaaagaaaactgtcgttcttaaaaagccgtatttttcggtaattaatttccccggattgtaccgtatacagattagtgatttgctacagcattctaccgtaatctttctttaattttagccatgccatcggaaaatcaaatttttgatcccaaaaacaaaggtattgttttaggaaattttaattgattattctgatcactatgtaatcagatcattggtgaagacccgaaagccaatgattggcttgacatcggagtggtcaatctccagtcagggagtgaagtaa

SEQ ID NO: 51863 - DNA, 244 bp, Heterodera glycines
  Genomic contig location: Contig_ID=SeqID_21270; Location=190..433; Strand=-
  SCN-specific regions: Sequence locations=1-244
atgggtaggtgatttttgttgaatttttcatttatcgcccgctttgatggctttttataatggctcagcaccacatttgtggccagttttgagaaaaaaaaagtttatttatgacatgcttacattttatccctttcttacagtcatttgtgacaaaatgatttgcattttgcccgtcctgctgttcttctgccaggcgttggacggccaacaaacgcgcaaaattcatgcattggatgggaag

SEQ ID NO: 51864 - DNA, 2364 bp, Heterodera glycines
  misc_feature (1685)..(1685): n is a, c, g, or t
  Genomic contig location: Contig_ID=SeqID_21270; Location=970..3333; Strand=-
  SCN-specific regions: Sequence locations=1-8,30-492,514-1030,1052 -1532,1554-1845,1869-2143,2165-2280,2302-2364
atggacaatttttcgaattggatcatttcaaatgctacaaaattctactgtttttccattattttgtccgttccttcgatccttttgtacattggcgaaatgtttgcaattgtgaaaaacaaagaaactcgcgcaaattccttttaccgtttgttctgtgtgcgtggcatttccgtaagtgcccatatctactaattagcatttttaaatcgtttaaataaatcaacaggacattctaatgatggccgcctcctgctacggtaatcgactaccgtctctgctcggcccctcacttttgcccatttaccgcgcgttgcccaattgggcgttggcactgttctatttcttgaccaccttcacctaccaagtgacgaacatcgctacccttttcatgcttttaaatcgcttcacggcaattgcttttccgctgagtcataaaaaggcaatttttaatgagccaaaactaattaaaaattcaaaagtctataactccattttgaaatattaaaaataaccagggttgccagattaaaattttcaaaagcctcatttggcaggcaaaaaagcctcatttttacaaaaatttttcaaattgttcatttgttaaccgatttgtccacaaaaatggctaaattgcgatttgagccgatttaagaagatgaatcataaaatttaacagattctgacgattttccccaaaagcctcaaaaatcctcaaaagttctcaaaaaggcacaaaaatcctaattgacctatcaaaaaaccacaaactgaggataaaacctcagtctgggagccctgaaaataaccgatcatttttcagttttggaataaattgttttggcttctgataatggtcatgttggccattccgtctttgacttgttatccaattatgcaaatgcatgcaactttgtcggagaatgctaacggcacttttctaattatggaaccggtaattaataaatagggcgcggttttttagtggcgaaaaagtccaaatatggacttaaatagggaaaaaaattttgaatacatttttccaaaataaatattcaagaatcaaaatttgtcaaaaaagaaaataaattacaaaaattttggtcaagaaaaaaacatatttagtggaaaattttttgaacaagtcgcctgtaatcgcgtcaaaaaaatgtatatttttcagtgcatttttgttagaaaatttgtgaattttatgtgaaaaaatttaaaaatcgcgaaataagggcgaaaataggggcgaaacgcccaaatagggataaaaacttattttaggggcgaacactcaaaataggtattttagtggcaaagctccaaaataggaatttctagggtcggatatgggcgttaaaacgaagaatttccgaacaaaaaatgtgttttcgtgcatttctcgtcgagttaaagccgcagaaaaaataagtaaaaacctaagaatcctcgccctatttatcagtacccccggttttctgttatacccgttttggaccctttttcgttttttggctgaaggaaaagcttaaattttattttttgtaggctcacagcattttttcctataaaaaccaaacgccttcgcacgcagcgcaattccaacgatacacaccgctgaagaagatttcaacgctctacaaaatcagcacttcagttggtgattatgtgaaaantatattgggggtgttgtataagttctgtcacccttcttatgctatgctaatcggaattttttgcaccgttaaccgcaagtgacagccgatcaatttctgtcctataggaaagagcagaaatttttgcttcggttaaaagccatttttcgttcttccccattcaaattgattttttaaaattatcccaatggagcaccctaaatcccaaatccgatcacttttattgtacgggtcaaaactttgctttgatcagttggaaatttattaaaagcagtttttgtggccaaatcatgtccggagaatccaaatctggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagtgggtgctgaatcttggcacttttgagcacccattttcagacaggacaatttaaaaaaataacccgtcggttttacacttcgttcatcattttatcattcatattttattctcatctccccctcccaataagccaaataggaaggggaaattcgatgaaatggaatgaataaa

SEQ ID NO: 51865 - DNA, 483 bp, Heterodera glycines
  Genomic contig location: Contig_ID=SeqID_21272; Location=1120..1602; Strand=+
  SCN-specific regions: Sequence locations=1-183,219-339,375-439,480-483
atgtttggcctcaaattcaaattaggatgtgcttatttcacttatctcaatcggtattacgttatgtgcaggtaaaatgtctgtttttactcctattattttacttcagagacatggtcttatccgtgaatatgaagctaatgaagaacttagaacttaaattaaattattcaacagacggagtaattaattgaaaattattctttaaatatttaattgatgggcaacttgtgcagcagggatgttgcaaaagggaaaataaaatacaagacacgagatacgagaaaaaattctattttgttaagagattttgtccataaaatgattgcttttctggttttggattaaattttaaaaattttagggttttgggtcaggttgtttcggaaatcttgtaaaaatttattaaaagatttggcataaaattggattttttggctatatttaaaaaatgaaaatattttattgtttttatttttgtta

SEQ ID NO: 51866 - DNA, 924 bp, Heterodera glycines
  Genomic contig location: Contig_ID=SeqID_21273; Location=156..1079; Strand=+
  SCN-specific regions: Sequence locations=1-194,216-434,479-573,595 -691,713-740,786-924
atgccgacggacaaacaaattgacgacgggacggcacttaagacaatgcacgaacaaattgtttggaagttgctgaacaacaaagcattcagggacaagctgaaaagtgcgtatggcacaaagagtaccctggaaaatccaaaaagtcggagtttgggattaggatccaaataaatggagcgcgagatccgagattaagaatggaacggggtacgggactcaaaaatggctcagcccctggctaaactcctgttatcggtttgtgcccgccaaagaactgccgtgaacccggcccaggacaggaattaaaaaattattttcactaaaacagaaatacatattttaacggatttaaagcgaaggaaatcaactatttattttatcgttttatttattattagcacaaaatttcgatctgatctcattaaccagccttttttaatttcttaatgatttaaattttaattaaaaaaaatttcatcgaattcataagattaaaacgaatgtattaccaaaaacacataaataatataatgaaattgctaaagtttgtgctcatgtaactttagcatttttcctaaaatttaagaaattgaaataaacaaaaaacgaatgtccgatttaattggcgatggcactgaaattggcaataatttgttaagtgaaagtcacaaaaggaaatttgagccgaaagggaaggaaataattaaaatgggaaaccaaaaagaaacgcaaaaaggtaataattgaattaattaaattatttaaaaaatttatttatttttcatttgttagcagcaaaaggaaacggacagaaacagaacgaaacaccaaaaagtgacgaacaaagtaaaaaaaaaagctaaacgattattgaattattaatagggctgccaaaaatatgtacaaaaagcggtcacataa

SEQ ID NO: 51867 - DNA, 495 bp, Heterodera glycines
  Genomic contig location: Contig_ID=SeqID_21273; Location=1242..1736; Strand=-
  SCN-specific regions: Sequence locations=1-72,106-474
atggcacaaaaactaaaaatggcaaaataccgtatgcaacatacagtaagtaacccaatgtttgataacaacaattaaattataaattcatattattaattttaagtcttgttaaattactatttaataattagggctgccaattttatgtaaatacatattttttcctgaattctacatggtctaaattcggaaaaacattttgtattccgaagtttttatacatttacatatttagggattttcaatattttacatcttttggactttttatacatttttgaggattttttatgaaaattttatgaaatgcgccaaaaaacctaaatttcgctattttttatatatttacatttttttgtacatatttgggaatttttaagaatatatagaaatttctcgtgaaatagctaacatttttttttgaaaatatatccctaaaataacggatttttcaaaaaaaaagaaatatccaataattttaaaaataataaa

SEQ ID NO: 51868 - DNA, 868 bp, Heterodera glycines
  misc_feature (86)..(86): n is a, c, g, or t
  misc_feature (117)..(117): n is a, c, g, or t
  misc_feature (129)..(129): n is a, c, g, or t
  misc_feature (171)..(172): n is a, c, g, or t
  Genomic contig location: Contig_ID=SeqID_21277; Location=424..1291; Strand=-
  SCN-specific regions: Sequence locations=1-157,202-323,345-355,381 -518,540-642,665-719,743-868
atgaaaattaatgacggtaagcagataactaaatattcaaattaaaattatactttttttatcggacgtgaaaaatgaaatttttntgggaacgttttatataactttttcacattnacaatagccttnttcaaaaaaatttttcctttgaattttcatataaaaattttnntaagagtttttattatttttttttaaattcgtcggctaaattatgtccggcgaaatttcggcgacgaaatcacatgtaaaaattcaaattgaatgatcactctttatttttttgacagttcaatccagaaaacgcggtccgcaagtgtctcactaagattttaaatattgttccttcgaaattccatcacttttaaattatagatgtggcaaaagcaaaccgaaccctgaacaaccatacaaatgccttagttgtggaaaatgccttttcctgacaaaaaatgtttccgaattgaaacaacaaaaaatgtcaaaaattcgagcggaatttgaaccgatgatcaaagaaaatgaattaaaaatgaaaaattcggaaataatcagtgatataaagggtaaaagcaaattattgtcataaaaaggagagaaaaaagggaaaacgaagtgcaagaaaaaaaatcatggttttactttatttttattttttatttttgggttttcgataaaaaatttatgcataaacattcaaagtaattgcacaaatgttggacaacaaaatttcaaggattttctgaaactataaaaaatcaagacacttttaaagatttcttattttactaccaaaatttggttaaccgaataattataatgaaaaaaattacaaatttcctatcatcactcgggaggggtaaataaa

SEQ ID NO: 51869 - DNA, 858 bp, Heterodera glycines
  Genomic contig location: Contig_ID=SeqID_3785; Location=291..1148; Strand=-
  SCN-specific regions: Sequence locations=1-140,162-272,304-546,619 -672,725-729,751-858
atggctcattgtcatgactatgagtcaaaacttggacaagcgaaagttcgctggggtatttagtttagtaaaaagtgccaaatgggaggggaagggggcaatatgcaaatggattccgtgagaagggcgattgtatatttaaaaggtgtaaaatgagaaagtgacgacgccttatactttgaaaggtcaaaattgcttttcgtgattatttgtgctttttctcacaaattcctttaatttcatttttacagtttcttccaaatttcctgttgtaaatattttttaaattaacaaatatttttagtagagaccgagatttccaaaagtgccggaccggaccggtctgatattttcagaaacaaccggtttccaggcccggcctctcaaaaaccggtcaaaccggattttcaaattgccgggcccggaaccggtttccggtttggtaaaatttaaattctcacatgtatttcaaccccaaaatcaacaaaaatcgtgccaagtgttaatttcgactctttttaacttcaggcgtcaaaatgcctcttcaattataaattttaaagattttcaaaaaaaaatttgaattttttaaagaattaaattttttgaaaattttttgcgataattcatcacaaattgaaaaatcgttaaaaaattttcttatatctttggaaatttttttatgattttttaaaatttctgtttgaaattaaaaaaaaaatttcgaggtaaatgacagaggagataaatgaagtggtgcctatcagatagcaacaccgggagtttaatttggatgcctcaagaaaaagttatggtgcactaaagtttcaaaaaaattttatggttgtgtgaaataaa

SEQ ID NO: 51870 - DNA, 850 bp, Heterodera glycines
  Genomic contig location: Contig_ID=SeqID_3785; Location=1489..2338; Strand=+
  SCN-specific regions: Sequence locations=1-194,217-413,449-705,727 -757,780-850
atgccgtgccagtgtaactcatcgaaattgcgtgctgttcacgtccgagtatggcaacaccggatgtacgaaagtggacctctgcaattcattacgcatgacgctgttttgatcacttggcattgccgggcgtgcaatggccgtttctttcagacgtttgagttctccacgtccggcaaatcagatcggtgagttttgatttatttttagaaaaaataaacaagccaaatatttttttagttggggccgttatcgcctttaccaatcaaaggaaagacgcttcgacatcaacgtgacttaccaggacatacgccaggtgtacgatcagatgccgggcgcgggaatgtaccacgtcatatacagaaactgcaaacattgggcggacaaatttgttccccttagtgagttcattcaaatataattaaattattaattaatataaataaatcatttgtgaattaattcagttaggtccaaatctcggatcgatgatgttacttgtgcgtgtgacaactggcacttcagagcaactaagattgaaggtaagcattaatttacaaataaggaaaattgggtttttttaaaaagttaaaattttatgcaaaatttgcagtgtacatgaatggcgaagagtgggttatattggtgcgatttatttgcgaaaattgccgacggtttccgaacatgatgttcagcgtactttttggagaatttggaaaagtcatgaggtaggtgttttccgaatttaggtaccaaaccccctccttacccctccttgttgtcatggcaactcgtacaagactcgtacccagggcaactcgtacaaaaaaaaaattctaagaattttcaa

SEQ ID NO: 51871 - DNA, 860 bp, Heterodera glycines
  Genomic contig location: Contig_ID=SeqID_3786; Location=675..1534; Strand=-
  SCN-specific regions: Sequence locations=1-140,162-218,240-272,304 -547,621-674,727-731,753-860
atggctcattgtcatgactatgagtcaaaacttggacaagcgaaagttcgctggggtatttagtttagtaaaaagtgccaaatgggaggggaagggggcaatatgcaaatggattccgtgagaagggcgattgtatatttaaaaggtgtaaaatgagaaagtgacgacgccttatactttgaaaggtcaaaattgcttttcgtgattatttgtgctttttctcccaaattcctttaatttcatttttacagtttcttccaaatttcctgttgtaaatattttttaaattaacaaatatttttagtagagaccgagatttccaaaagtgccggaccggaccggtctgatattttcagaaacaaccggtttccaggcccggcctctcaaaaaccggtcaaaccggattttcaaattgccgggcccggaaccggtttccggtttggtaaaaatttaaattctcacatgtatttcaacgccaaaatcaacaaaaatcgcgccaagtgttaatttcgactctttttaacttcaggcgtcaaaatgcctcttcaattataaattttaaagattttcaaaaaaaaaatttgaattttttaaagaattaaattttttgaaaattttttgcgataattcatcacaaattgaaaaatcgttaaaaaattttcttatatctttggaaatttttttatgattttttaaaatttctgtttgaaattaaaaaaaaaatttcgaggtaaatgacagaggagataaatgaagtggtgcctatcagatagcaacaccgggagtttaatttggatgcctcaagaaaaagttatggtgcactaaagtttcaaaaaaattttatggttgtgtgaaataaa

SEQ ID NO: 51872 - DNA, 234 bp, Heterodera glycines
  Genomic contig location: Contig_ID=SeqID_3787; Location=24..257; Strand=-
  SCN-specific regions: Sequence locations=1-234
atggccaaaccgactgtgaatattccgtcgaatgctgggcccatcacttttgtgcctccgattcgctactacaataacagaccacttcaattatcgattgatttccaccccacacctgttggcttcttttggggcgagagagtgcactctctaacctctacagcgacgagagagtcaccgtctaacttctctcgccagcagggcccgtgcctatgggctgcttggtcccggtga

SEQ ID NO: 51873 - DNA, 1456 bp, Heterodera glycines
  Genomic contig location: Contig_ID=SeqID_21278; Location=523..1978; Strand=-
  SCN-specific regions: Sequence locations=1-528,551-614,677-717,740 -838,1050-1092,1215-1227,1249-1271,1313-1385,1414-1456
  Gene Ontology: Biological process=N-linked glycosylation
atgagcgaacgatttttagcagacaccaaaatgtataagcaaatggtgagcgagaagaaggtgagtagcagaaaataataaatgaacgaataactcaattttcattaagttttggaccgaaaattcaaatttgcatttatttttgtacatatgaacagtttatatattcaatttttctccgtagaataatatatgaaaataaaaacaaaattatctgaactttttaaaaaacccgcaaataaaatattccccgccatgaaaaacttatgcttaaatattatgcttttgttttagaatgttccgcttctgtgggagaatggacccgaggacgtcactctgctgagtgttctcgcaatttgtaccgaagaaatattcgcacaaattcggcgaattgaaaaaatgcaaaatttctccgcaaaaaataaggcgacagaaaaattttctgaagaatttcttttagaatttacgctgtgtttgaacagaaatttaaaaaaagtaaaaaagaacaattttttggggaaattacatttaaagaaaattagcaaaataattaacgaccaatcggaagatgaagaaaaacataaaaaaatgttctccaaaaacggtttttgttgtaattaatttttaaaaatattacaaataattctttagaaaaattactgaaaaattttttaaacggcgaagaaattgcaaaaattaggaaaatgttagcaccggtaatttattattttaaaaaatagaaaaaagtatttcaatttaagatcgaatatttaacagcaaatgaacaattgtctgcttcttctgattcatccgatggagaagaaatttttacagatgcaaaagaaaatttcaaaaagaaaaatgaaaaagagacaaaaattattaataaaattgaagaaaaaacggaaaaaaattcagaaaatttaaatgaaaaggaaaaagaaagttcaaatttaaatgaagaaaattccaaaaaagaaaagaaaaaggaaaaggaaaaagcgaaatggaagaaaaaagaagaggaaaaaggcaaaaagaaaggaaaaatattatcaaaaagtgaaaaattcaaaaactcaaaagcatcagaagaaacagagacaaaagaaaaaggaaattcggaagaattaaaaatgaaaaatgaaaaagaaataaaaaatggcaaaaataatcgaaaatgggaaagaaataacgaaagaacggtggaaaaacattcagcagaacaaaaatgggaaatgacagcagagacaagtggtaaatggaattggatttaaaatataaaaaattaaaacatgaatatttattattagggatgccacctttaataatttttataaaagtttttttggttgcaaaaacccaaaaaggctaaattttcgttctatttaaattttaaaactttaaaaatttccaaggatttaaaaaataagcaaaccttaacagatataataaa

SEQ ID NO: 51874 - DNA, 339 bp, Heterodera glycines
  Genomic contig location: Contig_ID=SeqID_21278; Location=2146..2484; Strand=-
  SCN-specific regions: Sequence locations=1-58,84-233,256-339
atggcaatgattagcaatgcacaccatgaaacactggggtttttatgtcggtttaatgaattaaattaaaattaaattataaacgattattttttgttttttagtttctttccaacgatacaatgatttgtacgcgcaattgtacgaatctttttttgaagcgaacacaaaagttggtagatggagagctcgaattgttttggacacatttttatacggagaatgggccgaagattttttggggaatgaatctcagaaaatatcgacgggggcaagttcgttttaattgaataattgtcattaatgacatcggcatttttacccgttcatgcaaataaa

SEQ ID NO: 51875 - DNA, 836 bp, Heterodera glycines
  Genomic contig location: Contig_ID=SeqID_21279; Location=131..966; Strand=-
  SCN-specific regions: Sequence locations=1-271,303-412,464-500,522 -630,652-836
atttattcgtaaaattcaacaaaaaatgcttgcttgaatttttcttatggttttgctgtttttacgctctttctgatcacggatcactctgtccgatgaccgaagctgttacaacctccctatggtcaaaatggcttggcttttgtggcaaaatcaatacaaaaaattacagataaacccgttgcattgcatggcctgtcaatgtactgtagccaatggataccgttcgccacataacaagtgaaccacgcgaattgttagtcaaaaagtgggtataaatttggtatcattggatagagcagcgtcgagcttttttcactttctattaatttccatcctttacatttttttattcttttgcttattttctctaaagaaaaactattatacattttcttagtctaaaaaatgctttttaaaattatttatttatattaaaatttattaaaattaatttatttttgtgtggatttgaacccgagctccaaaaatgcgaatttaaccaactgagccaccaatttttagtgaaaacacagtcaaaatttcgatttttgaggccataactttatattttcctatataccactattactaaaaaaatcacaatagaagtcgaacatgctctctatccaatgataccaaatttatacccactttattgctaacagttcgcgaggtgcccttgtaagcatattttcagttcgcccacactagattattttcttttgaacccctgacgagaattcgggcaaaaagtcgaaagttcaaaggatgcgcgattacatgccgaggggaatccatttacaccgtatttgtcacagttccatgcgttttaa

SEQ ID NO: 51876 - DNA, 593 bp, Heterodera glycines
  Genomic contig location: Contig_ID=SeqID_21280; Location=557..1149; Strand=+
  SCN-specific regions: Sequence locations=1-593
atgctcattttcaaggacgtccttgcatacaaggacattttttattttcaagaaagagggcccaatttcagggacgtccttgccattcaaggacggatggcaaccctgtctaagccgctatcaattcagtaaagtgatcaaacagatttaaaaaaaaactcattaattatgaacaaaaagaagtgttaacaggaatttttaatcatttttaatagcctattatttgagcatttagtggtgaaatatttacaaattagtccaaaaatggccgtcggggaaatttgatagattttaacctggtcagtaacatattgtgcatcaaaaataaggaaaatttaaaagacttaaagcctcatttagaaaatttagccttattgacatacaaaaaccacaaaatgaggctaaagcctcagatcttggagccctggatataacagattataatagtcaggatgagaaggatgatttagagattgatcgaacatatttggtcaatcgtaaaggcactgatgtgataactagagaccgcatttgaagaaattccaaaatattgaacaaaactaaaaaaaatttgtggaagaacttctgaggaa

SEQ ID NO: 51877 - DNA, 2268 bp, Heterodera glycines
  Genomic contig location: Contig_ID=SeqID_21281; Location=533..2800; Strand=-
  SCN-specific regions: Sequence locations=1-305,328-370,392-676,698 -733,1007-1124,1146-1510,1533-2135,2168-2268
  Gene Ontology: Mol. function=neuropeptide Y receptor activity; Cellular component=integral to membrane; Biological process=G -protein coupled receptor protein signaling pathway
ctgatagtgccattttcgctgccaattcgatgcgtcgtcgtccgctcatttcgcccactgctgtgctcattttcggctcccttttctctttgttgacttttgtcggtcttttgggtaaattaaaaaatccaaaaattggagagaaaacaaacacttcgttaggttggccttatttcaggcaatcttctcgtaattgtcgcaatcattggagacaaacggatgcgcaaaagtgtgatgagtgagtgcccacgacttttgctggtcggaattccattggctttcccctcgtgatccgatcagtgcttttccccattcactgatcacttctttttgggcctttacccctccccccccccctccgtctccctctttttgcattttccattcagaccttttgttgttgaatttggccattgccgatgcgctcaatcttctcgtatgttgtttactgatcagtttttctttttacgcctttcctttcttcaggcaacaaccgtcgaatgggtccctacccttcggcacaatggccccgtttgggttttgcctgcgggtatgccatccctttcgttttgcttctctccccacagttccatcccttcgaaagttttgtgccccatcattcgttatttggaatgcgtgttccttttcacttccatcctcacccaacttgtcgtttgcgtggaacggtcggtgatttgagctcggaacattcgccttttgatcagtttttctcctttttctctctctctgtctctcattctctccctttctctctccttttctctctctctctccctttcatctgtctctcattctctccctttctctctctctctgtctctccttctctccctctttctccttctctctctctctctctctccctttctcaatctttctgtctctcattctctcctcctttctctcaccctctccctccctctctctcattctctctctcctttctctcaccctctccctccctctctctcattctctctctctctgtcccgtcttccgttcattccgatcactttcacttcctccccccttagatttattgccattgccgttccactccatgcgcgccgtctctgttctcggaagaacattctgctcacaatttgtgccgtttggtgcgttgtcgctttggccgccttgccatatgcgacgcataacaaaaaggcggaaaactgtaagaagacgcacgcgttttgagaaggaatccgacgattgaattgttttccgtctttcagcttttgcgtgcacaaatttcaacaggaaaagctacttttggcacttttataaatttgcctaggtccgtccccccccccccttcgtcgcctatcctttacaaaattcatttttaagttcgtcgttctcttccttttgcccggcattattttcctcttcctttacacaaaaatttgccgaattctctgggcaaaaaatgacaaattatacgaaaatggaaaaggtaaaaatggagaaaagatattaattgggcacaaaaagtgatctgtaaaatgactgaccgaagtgattttccccaattcttccggtcacaaatatttctaaaggttgcgcatcaatcccgagtatttccttttattagcttgccaaaattggcccaaaacgatggcccaacttccgttgttcaacgatttctcgaagggtaatagccgtgccaattcctgcgttggctttgcgcccgtttcgggcgcacacgaagaagcactgaagacgaggcgaacggtggtgaaaatgctggtaaataatgaggagaaagaacgccgaatacacaaataagacgaacgttaattaattagtgacaaagggccaattaatggcgctgacagttaattaattagtgccaatgaatggcgccgatgccgtgcatccgtcccccccccccttcaggtcgcttgtgtgtccgtctacttcatctgctactcgccaattcaggcttttcttatgcaggtccaattcttaatacatcaccccaattagttagctaattactcgttaattatgcccctctctctctacccctgcaggggtctcttcaacttgtccatccatcccccctacgaattcgtccttctgatgaatgccttggccattctttgctccgcttgtaaccctttgctgtacactctcttctccagtcgtttccgcgcgcgaattggccatttgttgtgcctttgctgcgacattttctatcgccgcaacaataagtgaaacgccaagaaaaatagacaatccaat

SEQ ID NO: 51878 - DNA, 789 bp, Heterodera glycines
  Genomic contig location: Contig_ID=SeqID_21282; Location=407..1195; Strand=+
  SCN-specific regions: Sequence locations=1-526,568-789
atggaggagctacagcggcgcggagtgcgcccccggcggctggtcgccacagggctgcgcgtctacacgctggagctgggcggccgaaatcagcgcagcgtggtcgccaaggactcgctgaactttttcggctgtgccctctccaagctgccggccatgttcgggctggacggcgtgccggaaaagccgttcttcccctacaactacatccgggccgaaaacatggatgtggtgcatgtgggactgccgccggctgtcgactatgacccggaccggatgcgcccggcggagcgcgacgcgttccagcgctggcatgcggaggagcaacagcgtcgacccaaccgactgttcgtgctgcgccgggagctgctccgctactgtgccaacgacgtgcgcattctgcggcgcgcctgtctgcgcttccgccacgtggtcggtgagctgtcgggaggcgtggagccgttcctggccgcctccaccatcgccgggctcgcgttggtcatctaccgacaacggcatctgccccgtgatctgatggtgcacacgccggagggcggcttcctgcgcgggcgacgcgcttccgccgcctcgcgccacttcttcgcgctgctggagcgactgcgcccgcaatggcgtggtcgactgcgcactgcgcgctggtccatcggcgaagcgtgcgtggaggacgacggctaccggctggacgcgttgctctaccgcccggtgccgctgcgaccgctcgtcatcgagttcaacgggtgcttctttcacggtaaggaaggagagtag

SEQ ID NO: 51879 - DNA, 925 bp, Heterodera glycines
  Genomic contig location: Contig_ID=SeqID_21283; Location=63..987; Strand=-
  SCN-specific regions: Sequence locations=1-14,38-218,241-495,559 -596,618-925
atgggcagtgacggcgaagaggaggaggaggtagaaatggaagagcgaggagatcagcaaggacagacggatgaagcggaaaaacggatgagaaacggccggacgatgacggcgtacaatgccaacgaagacaacgccatgaacaacaacatcattagtccatgtagcagcagcagtactatcacaattgaggggcggacgacgagcgacgacggagtgcggcggcacggcatcgccggcggcgcggtgaacagcagcgaacagagttacgaggcaccgaagctggtcagtgaattataagctatgacatataaaaccaatctcattcaaccggtgtttaattgaccaattaacactgtgtgtcttatggagtgtgaaggttgaaggaactattagcgcttcattactaaaaatggttatggaatgtgctgttgtaccccttccccccaatttcactactaccttaccagtccccccccccccctctctgatttgtttttaatttaaaatttattaatttttctaaacaattttaagtaaaaaatttttgaaatttttcagagattttttcgaaattttatgaagaattactcttagaaaatatatgggttttttctgaaatttctaaacttgaataaggggaatttgactgaacgcatgcattcaaattttccaaaaaattctttgttgcactcaaaataaaaacctcccctttcgttgtcagaccagcgtcgaatttgaacacttccaattgccctcctcggccagcaccgccgagtccgaactgtgctccgatgacgaggcactgctgcagcgtgacccggtggagttggacgccatgaagcgcgagctgttcgacgctttggtggacaaaaaggcgcgccaacagcagcggaagcgggtcaggttctcctgcattcgacag

SEQ ID NO: 51880 - DNA, 390 bp, Heterodera glycines
  Genomic contig location: Contig_ID=SeqID_21284; Location=188..577; Strand=-
  SCN-specific regions: Sequence locations=1-222,253-390
atggcgacattgtttcacctcctcatccctgctttcgcccaggtttgggtgctgtcctcggagctcacccgttacctgttcatcgatttggcctttgcccgcccgttcttcttcacgtacgccaagtcgtgtctgctgtccctgctgctgttgcgctactcgtgcaattgctgcacggaggaggcggacgcatcgaaaaaagacggcacggaggacacagcgggcggagacggaggaggaggagggcaccacaatgatgccaacgatgacgaagacgacggcatggcaagcggcagcagcagaaacggtgtcagcaacaggaagagcaagaagaaaaggtcgagcagcagcagtggtggaggcaccgcaaagacgacaaagtcgggaacg

SEQ ID NO: 51881 - DNA, 381 bp, Heterodera glycines
  Genomic contig location: Contig_ID=SeqID_21284; Location=767..1147; Strand=+
  SCN-specific regions: Sequence locations=1-359
atggttaattcatttaaataaccgcgggatatttcaaaaaaatggccaatggattaaaattgtagggaaaacaaaaattgttgcgcatcatgggaaagcttccgaaaatggtcaagttcaaacaccacaaatttggtgtgcttttatgaaatttcttggcgggcaccacgcaattctctccatttaaatgtcccagtgaaaaaaacttacgacattgacgagaacgagcagcccaatgccgagcagtcgttgcgaattggggacaatcatccgatggaatgaaaatggcgccgcccgaatttgtcagttgtttttagttgttgccactcttctgtccacagcacacgacgtatgtacacaaacacacttttaaatgcaaaa

SEQ ID NO: 51882 - DNA, 210 bp, Heterodera glycines
  Genomic contig location: Contig_ID=SeqID_21289; Location=15..224; Strand=-
  SCN-specific regions: Sequence locations=1-142,164-210
atggcccgcaactcggtgtccctgttcgacaccaccatcatttgtgcctacaacgcgtcgttcgcattcccggtcaaagcagctgagcagcgcgaacattggcgaccgggtggaccagcggacggtggcacagtgcagcagcgtcatcggagaggaggaggagacggcgacgatgactacggacggggacatttgatgagcgatgactga

SEQ ID NO: 51883 - DNA, 393 bp, Heterodera glycines
  Genomic contig location: Contig_ID=SeqID_21289; Location=1565..1957; Strand=-
  SCN-specific regions: Sequence locations=1-191,213-393
gagaatattttggggatttatggacattttatttaggaacggggacgaaaaataaatttttgggtgtgagtgggattgattttttggccattcaattgcataaaagcaaaaataagatgggggaaattaatttgcataagagggattcgaacctgtgggggcaaaaacaaacgccaaacgcacaacctccgcaccaccgaacaacacaaaacggtacaaatgtttattcgatttattgggatagaaaaaagtttggcacgtcatatctcggcactcgtactcatttcgcagaaaataaaaccacttttcttaagaacccatgggtgctctatgcacccaccaaatttcattccgaaactccacggacacctcaagaccttcctttgttagcac

SEQ ID NO: 51884 - DNA, 1437 bp, Heterodera glycines
  Genomic contig location: Contig_ID=SeqID_21291; Location=57..1493; Strand=-
  SCN-specific regions: Sequence locations=1-557,579-1271,1293-1437
atggacgaagagagggaaagagagacaaacggaaacggagagacggtaggacgaaagacagtcggagcaaagaaccaaaagcaaagaatgatcagtgatcattgagcacataacagagggacgaagccttggtcagtagcgagacgagcgaaacattccgacgtcagcaaatccaacctaaagaaagcgtcgcggagggagaaacgctgcagcagaagcagagaatggcacaaagcggcggagagtgccaacggaaggaatgcgtggagggacggcaccgttgggaggaggaaaagcagcggatggaagaaaaagtgacggaccaaaaggggagggggagggaatgtttacaaaatattcgtttagcttcttctcagggacaaagggatgacccaaatggaggaaaaaaggcacgaaatgagtgccgacttggaacaagcaaatgcgcaattggacacactgcggacagagcatgccatccttgtgcagttggcagaaacacggctttgtgaaatcaaagccatccaaatggctcttaatggagcgcaggcaatgctaaacaaaaggcattttaaaacattagttaaatgacggcatttaggccgaacgggacaaattggagcaggcattggcatacattgaacgtcgttgccacgtcatggagcagatcggactcgaccagggcattgtgctgggtcgactcgacgagttccgaccagccccgggggacgtgttcacgttcagaggctcaaaaggcacacaaacaatgctaacagcgaaggcgttggggtacagtgagaaggaattggacgaattgcaagtccaaattcgagtgagtaaaagggcaaaaggacaattaaaaaagcaaagcaaaatgaaaatcgaattaatcgccgtaaaagtcaatgcaaatggcatttgcggaggacaaaacgacaatgagcgaccgattgaaagacatcgaacaaatgctgaccatgaaaacggagttggtcaccacactgactgtccaattggaaaatgctgccaaaaacatacggtcggaggacgaacggcaccagcgagaaagagacgcattcactgaacgcgttgcagagatgggaaggacgacagaacgcgtgccgatcctcgagaatgagttggagagggcgaggggtgagaagagtctgtgcgagttgagaatgaagcgagtggaggcggagacggacgaacgcatggaaaaggtcgtcggggggggggggggcaaaacttggccattgaaaatgattttgaacaaattttggttgaatcaatgcgcaacagcaaacaaaacgaggaatattgggcaaaaaagtgtggggaattgaaacaaaaaagtgccaatttggcagcacaacttaaacatgaaaaaaaagcggcgaacgacaagcgcatgggctggcagttcagtcgaataaa

SEQ ID NO: 51885 - DNA, 1020 bp, Heterodera glycines
  Genomic contig location: Contig_ID=SeqID_3789; Location=300..1319; Strand=+
  SCN-specific regions: Sequence locations=1-289,316-439,461-505,527 -1020
atgaatttatatttttacattttttcctactacttggcggttttgagtagggtaggtcgggtccaagacctggacacggacaactgagtacaactgagtaccaaggtcccggttttgaccgggaccggcaaattcccggttttttccaggttttcccagccaaaaattcccgggttttcaacccaaaaagtcccggttgtgcccaaaattcccggtcccgacctaccctagttttgagtaacgccttcttattaccgcatgctagaattactgtagataaattcattccaaaatattattattattttattttttgctaaaatgtccttcactgaagaaaaatctaatttatcaggcgataacaacgcccaaaaaatcaccagcagaagcggaaggaaaaaatgaccgtaatccggcttattggaaagggtaccgtaagcattttgacaaaatgttgaaacagatgtggaaaagcgcaaaagccaaagcaatgagcgaacgcaaacagttttttaaaaatcaacaaagaagaagcattgagcaaaaggaccgtaatcagacagagcaaagtgaaatggccaaaaaatgtgccgaactcaacgacaaatttggcattatttacaaagcaccaattatttgcttttgatgggagggagtgacaaatttgcgaatcgaccaatttaagacacaaaaattttttcttgatcaatccaaccggtttattgtaatactggcgatggttgccaccttttttggaaaaaaatattttttccttttaaacatcatgtaaacatttttcaaaagactttctgggtcgctgatcacgaatctggcgtccatttcgaccaattccgaaccccggacaagattttagattttcgagttccgattttttggtcgaaaatgtttaaaaatttttttattaagcattggtgacttttagtttgtttccttttcatggtctttgaaaggaaaaattttttttttccaaaaaagggggcaaccatcgccagaattaca

SEQ ID NO: 51886 - DNA, 161 bp, Heterodera glycines
  Genomic contig location: Contig_ID=SeqID_3790; Location=244..404; Strand=+
  SCN-specific regions: Sequence locations=1-161
aatttttgagaaaaaaaccgggttaggtgcattgtgtcagtttatcctgacaaggacagggtctccaagatggagcaggacggggcaaacaggactaaagtccttgcttaacaagactattggtggtcccgggaccaacaaaccctaggaaagaaaatcaa

SEQ ID NO: 51887 - DNA, 2718 bp, Heterodera glycines
  Genomic contig location: Contig_ID=SeqID_3790; Location=537..3254; Strand=+
  SCN-specific regions: Sequence locations=1-203,225-361,383-972,994 -1206,1229-1235,1257-1287,1338-1564,1600-1944,1966-2480,2515 -2601,2623-2718
atggacaaaaactatttcccgctgcacaatctgatttcgaaacttggcaccccaacgctattagacgagaaaaaatggttgaacaaagccggacaggtcagtctcggacaaaacattggcgcccagaaaaaagcaagtgtaacaccaagcagctcacaatcagcagaagcactttcaaacaaaaaggtactggagatcagaaaaatctttgtgtatttataataatagagtagagcgttgtcggttcctttaccgatcggtaattaccactaattaccgttttttattggtaccggcactgatttttcagaatcaaaattactggtaccagttttttgtagtaccggcggtactggtactaacctacaaaaataaaaatggataacccgagctgaaattattcatgaaaatttgggaaaagaagttttcataaatatggaacttttggccaatttttaaacaattctttttttcattttgctattaattagagagcggaccggaccggcccggtactggtttttaccgggcccggcaaaccggtccggcgatttttggaaaaatccggttttccggtttgaccggttttccggtttgaccggttttccggtttgaccggttattgagaggcccggcccggaaaccggtcgttttgaaaatgccaaaccggtccggaaaccggcatttctgaccggtttttaccggtttatgatatagccaaaaattcttcatttttgtacatttccctttgaaaatatccctttgacatgtttttaatttttttttgaattttcggttgaatttttaatttaaataatcttattttgcaaattggcctatttaaaaaacgtacaagaaagactcatacagaaattctgtattttagacaaaaaattgaggggggggggggcatcaacttgcgaagctgacctttttttttgctttttgaccccaatttacaattttttcgggaaattcaattgaaaatgtgtcccaagaatccacacaattcttgcaaaaatttaatctaaaaatcaaaaagcatttatttttttgcaaaatctgttatgaaattcacttaaacaaatatttttcgcggtggtgcctatcgtgtatgcactcactttatttatcgcctccctcatttaccccgaatttttttttaatttccaaacagaaatttcaaaaaaaaacaaaaaattttccataagaatatcttaagaaaaaatgtttacgtgatttttcaattttatgatgaattacttactgttttttttagaaaatcgcaaaaattttagaaaatttaatttttttgaaaatttttgaaatttaaaattgaagaggtcatttttgacgcctgaagtgaaatagagctgaaattttacacttgacacgatttttgtcgattttggggttgaaatacatgtgaaaatttaaatttttaccaaaccggttccgaaaatccggtttcaccagtttttgagaggccggcccgaaaccgattgcttctgaaaatatcaacccagtccgggcatttctgagaatttcggtctctactattaattttgataaaaatttttagaattgtgaagacaaaattgttttttttttgatgaaaatttcaatttctttcttcgacctccttcaagagctttctcacccaaatttcccaaaaacttcgtaaaaattgaagaatttttaaaatcctttaaatgtttgttttgacaaatgaaaaaaatactcaaaatcgcttttttgactttaacgcgattttattatttatttttcatttacatttcaccccacgaaatgtgctactctcgtcatttctttttttacgaaaaaaggctaactaaatagtttctaaaatactaaaaattccaatatagttgtcaaatattagaataatactgctcaataaatgcaaaaatctcctaaagataccacctcattctttatccatttcgctagcataactgcaaatcaaaatcctttcaaatcagcacgaccggatcccaacgatcttttttttgagacccaaaaatggcaaaacaattaggattttggcgaaaatggctataaatttctgtttttctccccgaactaaatttttaaaataacaccaggggttcgatcgatttttttcaaaattatgacatcgctggtcaacaataaaaaatttttaggaattaaaaatattaacatttgcatgcattagtttcgcattttggttagaaacagtggcctaggacttaaggtataatgtaaaaaaatttgacggattcatttttttttctaagaattcaaattgcttaatttttgtttagaaaaaaatgagcaaacccgtagtgtacccatggcaaaatgccaatttgttgtccaaaatacaaatactcatcacaaaagaataatcaaaaatttaagtcggttgattttcattcacaaattgtttttttccagccgaagtcaaagtcacaagcaaaaggagtaaccaaaaaagactttaatgaattattaaaacaaatgtgggaaagtgcagaaaaagaagcgatggaaaagcaaaaactttttaatgtagaaaattctaatttggcttcatcaaacaaattgaaggatattttagagcgtgaaaagctgaaaataaaacgtgccgaactcgacgacaaatttggcatcttttacatagatgagaaatcgcctttagctaaggtgatttag

SEQ ID NO: 51888 - DNA, 922 bp, Heterodera glycines
  Genomic contig location: Contig_ID=SeqID_3792; Location=1947..2868; Strand=-
  SCN-specific regions: Sequence locations=1-159,181-443,544-597,623 -834,866-922
atgaccctaccagagcgtgccagagatgagtacaacgcgtacattgcgctggcaaatggagccaccgaagagcagaaaagaagagggacgcatctcgcggcatttataaatttgttttatttttttatgcaatgcgtaatggatgatgaggatcttaaaggttttggtttctcaacttcagagaaattcataaagaaaataattcgcaaatttatgttcaaaaaagttaagtaaataagaaaatttaatggaaaaaattagttaaatggttaattagtgctaaatgctattaattctagcgtgttgccaaatagagtcatttttttcatttacccgtaatattggtttgttttttgagaattttgaagaataagaccattaaaaacccataaaagtgtctttttggataagaaaatctttaaaaaaaagagaccagctggcactaaattattttatttttaaaataaaatagacaaaatttcaaaaaaaaattgttaataatcgaaacactaaataaatatttaatatttttgtaattattaagcaatttattaccagatttgtccaaaatggccaaaaacattatgccaacttatcaaaaataaatttaaattaaaaaaatctgagaattttccccaaaaacatcaaaaatcttcaaaatttctcaaaaagccacaaaaagcctcaaagcctcattttgaaaatttagcctcattaacctatcaaaaaaccacaaaatgaggctaaagcctcagatctggctaccctggattattgacttgcccttattttaaagtttggattccaaggacgtccttggaaatgagcatttggaaaagtttttaaaagaaattcaaagaaattttggaaatctttgtttttcatcaatattttgattaaattatggcattatgtcaataaa

SEQ ID NO: 51889 - DNA, 1140 bp, Heterodera glycines
  Genomic contig location: Contig_ID=SeqID_21292; Location=68..1207; Strand=-
  SCN-specific regions: Sequence locations=1-192,216-362,384-827,849 -980,1007-1089,1132-1140
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttactgagcacatcgctcgggggaactatttagaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 51890 - DNA, 633 bp, Heterodera glycines
  Genomic contig location: Contig_ID=SeqID_21293; Location=504..1136; Strand=-
  SCN-specific regions: Sequence locations=1-122,190-468,490-633
atggggacgggtattgctggggttcgggttggagttgtattgtattgtccacttattcaatatatgagggacttggatgttctgtcacatgactttagtgcacaaaatgggtgtttttctagaattaaacaattattttattcgaaaattaaaaatatttctaaaatattaatttttataattaaaattgaaagagagtgaaagcgttaatgtcacctctcgaggtataagcatttataactgaattcttttcatttttgcattttattttcctttttaagctttttcgtagggacaacggcatttgcccttttcatcagtgctgggacgtttctaaattccgccacatatggacgtttcctaaatccgttaccattaagaagacaaataaatatggactaattccaattttggcacgaaaatttgacatgaattcttcaaaaactaaataacaaaattacaacgtgaaacacaaaattcatcatttttcacgtatattcaagaataattttgtctgttgcctttatcaaagaattttgctttataaaaagcttctattgttgtcatctccctcatcaatgggctaattaatgcctttccatgccaaattgaaacagatattttaaaaataaa

SEQ ID NO: 51891 - DNA, 456 bp, Heterodera glycines
  Genomic contig location: Contig_ID=SeqID_21293; Location=1989..2444; Strand=-
  SCN-specific regions: Sequence locations=1-456
atggtcaaattttccaattttctcccggcggcgcctatcggcaccgacgggcccacgaaacttatttttcataaaaatgactcaaacgcaaaaatttatcatttataatgaaaatcttttagcaaattgtactcaaattttcaaaaattgcacagcctaattaaaaaggtcactatgcttaataatttttttttatcacagctaattgacgaagatttgatcatattgctgaatgatctgaaggcaactcctgatcaagctaaaaaattagatgatcagtctagaacttctgctgttgatcaacacaaaaagaaaatgctcgaggcatattttggctttatttatttgatattttcttttttgaaccagtatttttacagacattgtaataatcccatctctgaacatacgtgcagctctcagaaaactgagttggatgtcgaaaatctattttga

SEQ ID NO: 51892 - DNA, 553 bp, Heterodera glycines
  Genomic contig location: Contig_ID=SeqID_21302; Location=1161..1713; Strand=+
  SCN-specific regions: Sequence locations=1-110,193-553
atgccatccctggaaaagataccgtcaatgaacaatgggcttcgtcaagcgacaattcattctccataccgcttgatgccatcagactcagaggaatatttaatcgttcaagaggaagagggagaggagcaaaaagggaaagagacagtgagagaaaagggagtggatgagagagcggaggcagaaaagagactggcagggaagcagacagttcgtcatcagacggaacaatcttcaaaatcgacgatgcaaagcagtacagagacgggactgatccttatgccggaagcgaaactcgggtcacttccatcagcagacgcaatgacaacgaaaagcgaggtggtagtggaggaaacaacagaggtagaggtacatgaagagggcgagagagtggaggaggaagagaaacagaggactgagagagaagcacccgatgagagagaggaagagaggccaaagagtgccgcttcacggacgggcacaccgaccatttgggatcagtacaaaatactgggtgatcaattcgcaaaatacggatcacttgaaatagaaa

SEQ ID NO: 51893 - DNA, 731 bp, Heterodera glycines
  Genomic contig location: Contig_ID=SeqID_21303; Location=284..1014; Strand=+
  SCN-specific regions: Sequence locations=1-118,195-502,524-731
atggagcagtacagagagaccgataaagaacagcaaaaaaagggagaattaggaaaaaagcaagagaggcacggaatgaagtggggagaattcgaagaggaagaacgagaggaacggaaggaaaaagagggggaaaaaaaggaaaaagagggggaggaggaggaaaaggaggagcagcggggagaggaaaaggacgcaggcaggtccatcccagcggacactttacgcgagggtgccttgagcatcggctttgtgatgccatctcaagtcggtgcccagaggaaagtgctgacccgtgccgctgatcagtctcatgccgccccgccttttccgcaaattaaacgtcgcgcttttggaagtaaaacaaaatcttaacaaaagataaattgaaaaagaacattttagatgaaagattattcgagaaaaaaccagcagaacctaaacaaacatttgtaaagaagccgatcagagggactgattttgtggtggtcaaagggcgagcggaagaagggaaggaagtgagggagagcacgagatcaatgatgggacagaggaagagagacgcatttgtgaggggacagcagagagatgcacagatggaagagactgaacggatgagaggagagtcccaggaagagagggcactgaagagagagtcccaggaagaggggctaaggaagagagagtccgaggaagagagggcacggaaaagagagtcacacgaagagggg

SEQ ID NO: 51894 - DNA, 457 bp, Heterodera glycines
  Genomic contig location: Contig_ID=SeqID_21304; Location=1893..2349; Strand=-
  SCN-specific regions: Sequence locations=1-195,241-457
attggactgctgacaatgaccgccttttgctacccaaatgagatggtgcactccgtccgcgttggcattgcccactcgcagagtgcatggcacaacttcaagcagggtgaggggaagggagcaacgaaagcaaatggggacgcacatttatggaacaggcgttattcgtctcccctccggaaatttaaacaatccataattttaataaaatggagaaattgtttttattcttctaaaaaactaaaggatacaaattatgattttccattattaaaagttataattttacagtccaattttatttagcgcctgaaccgaagagcagttgactgatgaacaaaattcatttgtgcatcgtttttggccattgtcaaggggtgacgaacacacacattttaatgttgtaggatttaaattttaaattctgtttttcggtctgataaataatttcaattaa

SEQ ID NO: 51895 - DNA, 919 bp, Heterodera glycines
  Genomic contig location: Contig_ID=SeqID_21306; Location=175..1093; Strand=+
  SCN-specific regions: Sequence locations=1-69,91-197,221-485,507 -876,898-919
gtactgatcagtgatcaaccgatgaacaccaaaaagccgagcgcaatcaaccgggaggcgttgaacgaatcggtaagattttgctaacattgaacacttattaaggctttggaaaattttcaggtttcggcatccccaggacacggcagcaagtcaaaagatttccgcaactgcaacgacatcaaattggccacccgaaaaacaaatgaatgggggaaagcccagctgaagggttgcaccaaagaactgtgcattcgttgtgtgctcgacgcggacatgtactaccgaaccatgcacatttatgacggacatttggccaaaagccgagacgcctgcgaacagatggccaaggagaaggcccagttggcggaagaggtggcacggcacagacgagacagaacggagttgaccacaaaataccaacagttggaagcgctgctgcaccatgaggagcagggacaacagcggcaaatggacgacattctgaaagaaagaaatataaaaatgggagagttgcaggcgaaggtggacgaactcaccggcatcatcgggcagagagatgccaaaatagcggaaatgaccaaccaattcgcaatgacaatgtcaattaagatggagaaagccgaacagaagcctgaagtgccgaaaaaggttcatctgttggcactattgcagtttatacgaccaaaaaaggatttgacaactctaatgcaccataactttttctagaagcatccaaattaaacattcttggtatcattcgatagcctcaagagttctctattagcctgcaaacttccaaagaacttcgttgtgtttcaaaaaatgtgatcataatgttcgaaaattcaacttttcgttgttttctggccataacctttttgaaacaaaatgaaatcctttgtaattttgcaagcta

SEQ ID NO: 51896 - DNA, 270 bp, Heterodera glycines
  Genomic contig location: Contig_ID=SeqID_415; Location=329..598; Strand=+
  SCN-specific regions: Sequence locations=1-270
caagcaatcagcggtgcagccgatcaagcaagtgaattgttttcgcagacacccggctatcccgaacattgtcgacacccaccacattcttgtgtcgcgttctccgcatggctttacagaagggtcttcggtgtctgcgggttcatttgccgcctttttttcactcatgatcaaccgttgctttcgaatggacgacgtggccttttcgggacaaatcggactcgaaagacaagtgcagtatgtccagcaaaattgtggagaaagttgtag

SEQ ID NO: 51897 - DNA, 418 bp, Heterodera glycines
  Genomic contig location: Contig_ID=SeqID_416; Location=152..569; Strand=-
  SCN-specific regions: Sequence locations=1-43,96-248,306-418
atgacaaatagtaagaaattggttcaaagtaataagaataagcatattaaatttaaaaaattcttatgattaattaaaaaaaagaataaataaatcaacaaaattacctgcgttaatgggtcaaattggccagcagcgaatgaaagttctccgggggccaagttcacaactgttgacattttgacacaaatggcgacaggatatccttaaaaaaggagggttttttgagtgtagaaaactaacagatgtttttataaaattaaattggtttttcaaatatttttatagaaaatataataatttttcaggttttaaaactaatttcacatgttttccttattttctgtcatcaaaagtaccaagtccgcgcaaaatgaatcctctcgtttgcacagccgactttgcagttgctaaataa

SEQ ID NO: 51898 - DNA, 75 bp, Heterodera glycines
  Genomic contig location: Contig_ID=SeqID_416; Location=4239..4313; Strand=+
  SCN-specific regions: Sequence locations=1-75
accagggatgtgccgagccagacaaaatccgattccgattaaatcgccgattccgattatggccaaaaatccgat

SEQ ID NO: 51899 - DNA, 978 bp, Heterodera glycines
  Genomic contig location: Contig_ID=SeqID_416; Location=736..1713; Strand=+
  SCN-specific regions: Sequence locations=1-180,202-228,250-353,375-978
atgctccgagtcggtgttggaacggttgaactcattgctggaaccaaaatgtgccattatgttgaccatttcgggagcgcatcaaagcgtcgacatttggcaccatgccacattggttgtggtggtggtgaaacagtgacagcggccaacgagtttccaaatgccaaccggtaatcgtaatgaaatctttcgccatgagcacggagaggacttgaggacttcagagggattggaaaaatcctttaaagtgatcgattgttgtttttttcacttgaaaatttccgttatgaatttttttctttgaaaaacatttataaatgaacatatatacttgtgccttttttaaattagatgagaaatggaagcagcagcataacatatattgaatcaataccgtattaaatttgataaaacaatgacaaaaaaacaaaacaaataattgtggaattaagagaaaataaaaagaatttatagtgataaactttagattttaaaacctaaaaaataaaaaaaacatattttgacgcgttttgctcaaaatttattaaccaaaatacaataaaaaattaaaaatacaccgttaagggcccaaagtttatagaaaaataccctaagcttatcaaaaataaacaccctaagaaatgaaaagttttctcaaaaataaatctccaaaattgtttatttattttcttgactttgaggctttttagtgcctgtttttggtgttttttatgacctaaaacctaaaagttttggctgtcttcccccccccccccgttcaaaaaaattgcaaaatttttttttcttaaattaaagtcattttaagggttttcacggtcggagaatccgattcttacatctgtttcgacccaattcgaatcttgaacccaaattcgaacaaaaagtcgaaacttcaaatttttttctagtttcgcacttttggttcaaaaccgacgtaaatacatataaagaaacaaa

SEQ ID NO: 51900 - DNA, 1534 bp, Heterodera glycines
  Genomic contig location: Contig_ID=SeqID_416; Location=2199..3732; Strand=+
  SCN-specific regions: Sequence locations=1-29,53-435,458-696,718 -1011,1133-1534
atgccatcgaatgttccgctgagaatcgtcgtgctgcgcttggcccggcactcttcaaaattcgtttccctcatcctattggttgcatttgtgaaagaaatcggtagaaattcaactattatttatcgacattaccctctttttgcagttccttctggcatttttacaaacgatgaatttgtctgcgtttatcaattcaatttctacctaattcatggtgtgccggggctttacccgttgaaatttccaattcaaaatcgaatttctttttggaacattgccaaagccaacagagggactcttgcgatggaaattgagaaattttctgaatttgcgcgagaagtgggacgaatgcaattcagcgatgccgtgggcataaatggctttcagtgggaaatatttgcaggaataaacacaaagaaaaaaagcacggagaaatgcctgggctttggccttttgttcactactgtttcggaaaaaagtgaaaacaatgttaatgtgtgtttaatatttaaattagagtgcgccgggaccgggacctggacacggacaactgagtaccaaggtcccggttttgaccgggaccgggactagtcccggttttttcccggttttcccagccaaaaattcccgggttttcaacccaaaaaggtcccggtcccggttaagcccaaaattcccggtcccggcgcactctaatttaaatggattaattaaggtgtaaaatggagttgcaaatgttcggcgacctttcaaattgtttcactaaaaagcggtacggaaaatcccgttggaaaaatttgtgatggaaattgacaaattttcagaatttgcgcaagaaatcattggtagtgaacggagcagtgaaactgtttttgtaaagggattccgttgaaaatatctgtacaaacagacactgatgaacgcaatgaaaagagtttggcctttgccctcgagtgttcccctcaaaatgaatttcatttttgtcgaatgcattcttttcatttttcgtttaattataatttttttttaattttgacagtgaaaatttatttatagagtttaatattataatattaaagcaataataagaattttaatgaatatttaactttaaattttctttaaaaatcagtaaaacagtgagataattaactttaaattttcatttccttatgctatagtaacaagtgactcaaaatgtacggtaatgttggtgccctgtcagttcccatcactttttttatcgcttttgctattggcggcattttgccattctgaggaccgtacctttggtggtgaagagcctgaggaaaatcaaaacaattttaaatgcgttttccgtataaaatttgtgtaaaatttccgccggtgtgtcacaatgtttgttgataaatcctcctttgaaatgagaggaaagagaattttaaacagctaagcgcagcacggcgatttccagaggaacaatcgatgccattttgacggcatttttcgtcggcccaatggagtgccaaaaaacagaaacaaatagcaa

SEQ ID NO: 51901 - DNA, 808 bp, Heterodera glycines
  Genomic contig location: Contig_ID=SeqID_416; Location=4158..4965; Strand=-
  SCN-specific regions: Sequence locations=1-564,586-808
  Gene Ontology: Mol. function=transposase activity; Cellular component= nuclear chromosome
atgggagataaggttgatgcaaatgggactgtgaagagaaccgcgtggcataacaacaaagaccttgtattaccaaccattttggacccgcggttcaaattgtcaaactatttggatccagatcaaacaatttgttcactgaatttgaacaagaaatgaatttggataattttttgttggcctcgccaattccaagtcccgccgttttgaacgcccgacaaaaatcagaggcgaactaaataaaccagaaattaaataacaaactattttttatacaggttgaagtcaatgaatatctccgagccaaaaaaataaatatcaatgaagatccaatttcttattggtctggcgcaaacgaattgaaatggcctcttttgactaagctatcaaaaaaatatttctcagccccagctacatcaactgaaagcgaacggcttttctccaccgctgggttgattgtgacagatctgagaaaacgtttattgcctgagaatgtggacaaacttttatttttgcatcacaatcttaaaatttatgattttgattatgaataaaatttttgggaaaaaattattttaaaaaaatcggaatcgtaatcggaatcgcaattaatcggattttgggccataatcgtaatcggttttaaaaccgtatcggatttttggccataatcggaatcggcgatttaatcggaatcggattttgtctggctcggcacatccctggtacaaacagacactgatgaacgtaatgaaaagagtttggcctttgcccttgagtgttcccctcaaaaaggtgcaaaaataaa

SEQ ID NO: 51902 - DNA, 845 bp, Heterodera glycines
  Genomic contig location: Contig_ID=SeqID_416; Location=5145..5989; Strand=-
  SCN-specific regions: Sequence locations=1-406,464-728,751-845
atgggagtaaaaggaaaaaacggaattcaaagggattggcacataatcataactggacacacatattcacatgataaaaaaggagggggacggggaaaagctgaacgttcgacgataagggaaattcatcgttgcagggcgaaaggcgatgtgaaagcgaaaaacggctggaggggcagaaatccgagggttacattgggagtgataataggaacattaggctggggaatggttgtggtaaagaaaaccaaagataacccctcgcagtaatgacgtcatcatctttgcaatatatagttgacaattatcctttttatggcaattggtcgcatggccgagtggtagtgtgttgggttggtggcagaccaaaaattcgagtccgcctgcctgcggcagaattattcttaataaaaaaacaaaaaattaataaaagtaaaataatttaaaataataaaaaaaaaaaattagcctcagttggcctggcgctcagatggccctgacaggcacccaacagctggcgctcagatggcctgcaccagggatgtgccgaatcggaatcgtaatcgtaatcggaatcgcaattaatcggattttgggccataattggaatcggataatcgtaatcggattttgccttgaaatccgattattacacccctaagaattaattgcaattttcctatcaggtgcgttggtcatccaccttccaaatgcttgatcgttttttgcaaaacaaaacagttgttgggcttctgtgtgcagaggacatttcgtttccgaatttctcagcggatgattggcgtataatttcagcattgaaacaagtagtaccgaatgcatgttaa

SEQ ID NO: 51903 - DNA, 903 bp, Heterodera glycines
  Genomic contig location: Contig_ID=SeqID_416; Location=8344..9246; Strand=+
  SCN-specific regions: Sequence locations=1-87,109-547,570-762,792 -815,842-903
atgctaattgcatttgtgagaaatgagcagaaaatgcaaatcagtgaatattcaatggaaaaatatgagatacactttggcattttgtattatatgagaaagaattggaaatgttcaaaaatttcggaggaatttgaagaatacgaatggacagaatgccaaaaatatcgcaaatattttgacattttatacgaatatttgtgcagagaatacgttggaattcccacagtaaagccaaagtttgtatttgaagaccgaattgaaattgaagggccaataatttatgcggtgaattgtttggccagaatttcgcgattttattttaattcggatgagttttataaattaaacagattattcaaatgggtttataattttgaaccaaaattgttaaatgaggagagattgaattttggaataaaattggaaaatgaaccaaaattgccaattaatgaaatgattttgcaattggcaattgacacagcgaatgaatggcaaacaaatgaaagtttagaaggaataattcgacaaaattttgacaataaattggaggaaatgtacaaaaaagcggaagaaagggcaaaagaatacggtccttggggtgccaatgaaataaatgatgataagcatatgataattgcgtattcgaaattcgatgatcaaaggacatgggtaagacttaacgttcaatgataatttaataaattcaaaatttagactgatgatgctttcttttcggaatttgtcaaaggattaacgacaaattcaaagaaattttttaaaatggcaaaagaatattcgaattatttacgtctaaagaaagagaaaggaaattatattttaactgatgaaagaccaatgattctttgggttaaaggaattgagaacagaaaaagtatttga

SEQ ID NO: 51904 - DNA, 6453 bp, Heterodera glycines
  Genomic contig location: Contig_ID=SeqID_417; Location=1..6453; Strand=+
  SCN-specific regions: Sequence locations=1-204,246-592,614-776,798 -1124,1162-1174,1203-1258,1288-1387,1409-1428,1511-1562,1611 -1650,1695-1702,1724-1782,1804-1963,1985-2114,2136-2157,2179 -2262,2284-2349,2371-2423,...
  SCN-specific regions: Sequence locations=...2447-2487,2518-2815,2837 -2918,2954-3113,3135-3158,3180-3483,3525-4160,4187-4482,4504 -5415,5437-5575,5635-5675,5697-5806,5828-5842,5864-6055,6077-6453
  Gene Ontology: Mol. function=profilin binding; Cellular component =actin cytoskeleton; Biological process=actin filament-based movement
tttacattggcttcacattgttgccaattatttttgatcatataaacgtaaccaagataatattcatattgttgcatcaaatgctccgctttaactttttcaaaaatgtcgtttcctttgattaatttaataaatttcgcaaaatctatcgcagcatatcctttcacgaattcaaaaaataatgcgtcatcaatctaaataagcataaattaatataaaatgcatttaaaattaaaaatttttttctcagatttcacccaaatcgatgaatcatcgaattccgcagcattaattattgtatttaaatcataatattcttcttcttttccattttcgtccacttttttaaacatttcttctaatttattttcaaaattttgttttattattccttcggcactttcatttatttgccatccattcgctgtgtcaattgccaattgcaaaatcatttcattaattggcaatttactttttaatttaaattcataattcaatctgttctcattcaacaattttggttgaaaaagccgatcaatcgaattgaacaatttgtttaatttatattcattaaactcactctcttccgaattaaaataaaattgcgaaattttggccagacaattcaccgcataaattattggtccttcaatttcaattctttggattcattttccaatttcaaaattcataatttaatctcttttcattcaacaattttggtggtttaaaacgatgagaaaaatttgtttaatttatatttgtaataattactcgaaaatgaattaaaataaaagtacgaaatattgatcagacaattcaccacataaattattggcccattaatttcaattttgtttttaaatacaaattttggcttcactgttggaattccgacgtactctctgaacaaatattcgtacaaaatgtccaaatatttgcgatatttttggcattctgtccgttcatattcttcaaattcattcgcaattttctcacattgccaattcattctcataaaatgcataatgccaagatgaacttcgtatttctgcttcgaatattcactaatttgaatttcttgctgacctttcgcaaaatcaattagcattttgtcatcagcctaattaaaatagattttaataaataaaattttaaaaagtcaaaattcaccgatggattttcatttgaaattgaaaatgaaaaatggaggaaaataattataaagaatatagcagaaactgggttgaacattctcttatttttcataaatattaaaaaatttatgagagaataataatatatccgacaatttttgctgttttattgtcgctaataatatagttcgcattaaaatatatgatttgtctagtatcaaatatttggatattaaaaatgaaaatttatatgcattttgtagtttgtatcaaatatttgtttaaaataaaaaatttattatacatattcaaaatatacaattaaaaaaaataattatttttaatattttatacaaactacaaagtgccaataaaatataatatttgatacaaataattagtggcaataaaatataataaattttcatttttaatatcacaaatattttaatacaacttcacaagtgccatgttgtataataaagtgaatttgttttaaagaaaaattgaaataatttaattttaagtaatttaattgcatcgttttttaattacaatttgaaataaccgtttgcaccgaacacttcgccataggaaaacttgttctaactactttataaattagtgaaaaaatttaaatttaaaacaagaccagtagtaacccccccgtgaccttcgccgcttgacgctaattagatgtgacagctggcggggaggggtgtcaattagtcactaattgactgaccggggtactaattggtcagcggtcaagagggcactaattggtcagccgtagggtgtggggtagcaattaattaattaattggggggacccaaacctattgaacggtttcaaattgtcttgtacttttttttgacataaaatttgattgatttaaaaagtgacagccgagggggaggggtgaaattttttgattgatttaaaaagtgacagccgatgggggaggggtgaaattttttgattgatttaaaaagtgacagatgaggggaaattggaatttgattggtcagcgaagtgacagatgagggatgaaattcaaatttctgatgggcggggggacgggaattttgattggtcaacgaagtgacagtttttgatattattaaattattcaaatgaagtgaaataatttgttttgcactcggtctttatcaaacttgttatgaatgtgcaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacactttcccttgtttacccaaaatggcaccacgtgatgactccagtaacaataccaatggtcagccagtcattcaatttgatcaacaaattcgccaggaccctggactaaatgccgtttttgactttgttcgggaacagggcgcgcgggtaatttgtcacaacaaattaattttttcatttttttgattttgtttagcatggctttttcaacacgcccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatggaaattctgaattattttttttttcttacatgacttaatttgttagcaatgctaaaacaataaataaaaatggaaaataaattgacaaattggtttaatgttagttgactccggtcccctcctcttccccctttgtatttttctctggttgtctcccttgttgacgcactatttcactgcccccaaagtgtataaatagcgcgagttttcgtctgccaccctcacttttcaaatcattcgaaaaaatttcaacaaaaaatggcgctcaatatgcaggacaaaaagggtctcctccaccaaattcttggcgaagcagacatcacggtgactacgagcggcatcacgatcagcggtccccatctctcctccccccgttttattccctttgatgaggccggccgctgccgctcatgtcgtggcaccgaggtggaactggacacaatggtcaccaaggagggcatcaccatttggtgtacacgtatcgaccgggtgcaatttgtccctttcgacatcatttacgacttgcccggtcactgcttcttccgggtgaagaacaaggcccgcgtgttcaacattccctacggggacctgcctgccatcacattcccaaaccatcaagaacaacagcagcagctgcaacagcaacaacaacagaacgatttgcgccaaaaagctaacacggcgatggatttggtggagagtggactgctagctgattcgttgcgtgaagaaggcgtgcagagggctgagctaaagcggaaggcgaaagtcgcgctcgatctgattgatgccggtttgaccggcgatgcactgcatgaggagggacaacgttggaagaaggccaaaactgcactcagcgttctcggaaacatgttgttggccgattcgttgccggaaaagaagactgcggagctcccgcttccgccagccgaaaaaattgaatcactgccacttccaccactcgaaaaaatgaaaacacccccacttccacctgccgacaaaatgccttcgccgctcccaccatcatcaaaagtggaaagtgatgagcaacaattctacgacagcatttctgcggctaccactatgatggacagcgcctcaatgcagcagcaggcgccgctgaagagaaaacagctgactccaaaaggcaaaagcaacaatggtatgaagaaggcagctgagccgcagcatcatcacaatgtgggggacatggacaagactcttgacgaattctttgagagcgttagcgcagcgacgaccaatttgtctatataaattgttgtttcatgcaattgtattgaattttaattaatttattaacacgaaatgcttaattctttctccaataaagatatttgctttaaattaccatttggactaattatttccggtccctcctcctccggtaaaacccaattcctattgaaatttgttgccgaatgcgatgaactaattacaccaaaacccgtctccaccctttactgttttggtgaaatgaatcccgctgtacccattctccaaaagtcgggggttgatgtttattcgggtgttcctccggaagagctgatcaaacgcatgccaaagccccttttgctgatcctcgacgacttgatgctgtccattgatgagcactatttgtccgacttgttcaccaaaaagtcccaccaccaccaatttgctgtcgtgttcgttacgcagaatttgtttgagcgaaagatcaaagtggcccgtctgtccgcccagtacctggtactgatgcgggcacccaactcgctgttgtccatccgtaacattggcgtacagcttttcccgcgtcaactcgacttctttcttgacgcctatcgtaaagcgaccgctcgcccatacggctatttactaattgacatgcacgcctcatctgaccccgtgctgcgcctacgcacaaatatatttaaggacgagcaagaggaggatcaaggcttagttgtgtttgtaccaaagaatggagtccaatagtcaggaggaacaagttaaaattagtcaactcatccacgacaattccaaatggctttgtgcgctggccagaacgaggtccgcgaaaaagtgttgcaagctgatacggaaagcgaacgctgatcaactgctagcgctggtggaaatttgtttgaacattgtcgcatctcgatttcgcttgaacaaacgtcagaagaacaggctgatgccctacgcagattttgttcgctgcctgagcagagtgagaagtgaacgaggcgcgagacgtatgattgttcagaaaggagcaggggttggcggactgttcgctgcactcctaacacccgtgttaattgaagttgccaaatcatttgtgagcaaaaatgtataaataccgtaaaaaaattgttgttatttcattcatttgtttcataaaatggcaaataaatttgtgcttgtaccacaagaaatttaccggggtctcacctctgcggcggacacgggtgacatcaatttggatgctgtacgacacgatttgacgcgtgccagggctgaacgaacaaacccttcagctaaaaatgtcagctacaatcaacagcttaggcgctacttgcaaatgagacgggaagtcgcggacaaaccagcacgggttgagctagtcaagggattgagtgttctgatgaggcgaggcggtgcggatgatgaagcagaagttgtagatacaccaccccgccctcctcgtcctcctcctccaccaccgcctcctggtcagcatcctcctcgtcgtccaccaagccctccaggcccaggtccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgatttgcccgttctgcctgacaacgcggacgcaattgaggagatggacactgcacagcacaggattgcaaccagaagaaagttaaagaaagcagatgacgatgatggcgatgacgattttcatcgcaaaaaataccgggtctattatcctcctcccccttctcgcccacccccgtctcgtccacagccaaaaattgaaacacctcgacctccaccgcgtcctagcctcaagaaagaaccacaaccactgctcgatcctcggccatccacatcacaacaagttgatcgcaaacctaaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacactgccgcggcagcaaccttctcctgctgccccacaagtgccgcctgttccgccacctaggagagggaccaaacgtcgccacccccc

SEQ ID NO: 51905 - DNA, 964 bp, Heterodera glycines
  Genomic contig location: Contig_ID=SeqID_3795; Location=694..1657; Strand=+
  SCN-specific regions: Sequence locations=1-111,133-243,265-335,357 -403,425-543,565-913,946-964
atggtcaaaaccgggactttggtactcagttgtacgttttttcagtaccagatcccggtcccgtacaactctaatttttgacaaaaaattattcataattttgctcaatgcaattaatttttaataaatgttctctttaaggccttcaaatttttaaaaaaatcatttgtttctgaaaaatcatggctaggagaacttaaaaaccctggtgttttcgaacatttttggccatatcatttttaaaactaaagaaattttttaaattttccagaccagtataaaacacttaaggctaacgaaagaaattaagaattaagacttggttacatttgcgcaaagttataagcaaaatttttaattttgctgggttttgagtaacttcataacatctcaagactatcatcataaacaaaaattttttaaatcggttgctaggctttttcataacaaaaaaaaaaacccaaaaaaagaaggccaggccaaggccgcagcataacaaatacagaaaattcctaaatcgttggctaggcctgcactatgctttaggaatcgctgaaagtaaaattttttttagttgggccaccatgactttgtcccgacaaaaacacgcatttttgagggcacaaatttgtcgccgtgccacggcattttacgcctaaaattgacgtttatggaccgcggtacaatgcattttccatgcctttgggggggggtgggggtgtccacattttgtgccaattcaattcgtttcgcccgggagggcgccgatgtgttcgttaaacacattttctgctgttgttggtgcgccgtgccaacaaaattttttttccccaaaaatatattacatttttaggcgtctgttttggaaagaaaagaaaataatggcctaaaaatttttggaaatcgaattttcaattttttattaatttttttttttcaaaaaatcgaattagatgcattaaaa

SEQ ID NO: 51906 - DNA, 1708 bp, Heterodera glycines
  Genomic contig location: Contig_ID=SeqID_3796; Location=1703..3410; Strand=+
  SCN-specific regions: Sequence locations=1-87,109-323,381-703,734 -1047,1093-1421,1444-1625,1690-1708
atgctaattgattttgtgaaaggtcagcaagaaattcaaattagtgaatattcgaagcagaaatacgaagctcatcttggcattgtgtattttatgaaaaagaattggcaatgttcaaaaatttcggagaaatttgaagaatatgaacggacagaatgccaaaaatatcgcaaatatttggacattttgtacgaatatttgttcagagagtacgtcggaattccaactgtgaagccaaaatttatatttaaagataaagaggaacaatttgaaattaatgggccaataatttatgtggtgaattgtttggtcaaaatttcgcgattttattttaattcaaaatggaataaaatttataaatataaattaaacaaattattcaaatcggtttataattttgaaccaaaattgttaaatgagaacagattgaattatggaataaaattggaaaatgtacaaaaattgccaattaatgaaatgattttggaattggcaattgacacagcgaatgaatggcaaacaaatgaaagtttaaacggaataattcgacaaaaattcgaagaaaatttgcaggaaatgttccaaaaagcggaagaaaatgcaaaaaaagactattcaaggagagtcaatattataaatgatgacaaacataaaataattatcttttcaaaattcgatgatcaatggacatgggtgagacttaacatttaatgaaaattaaataaattcaaaatttagacaaaagatgctttataattaattttatatcaatttatgcttatttagattaatgacgcattgttttctgagttcgtgaaaggacaagcggcgacaaattttaagcaattttctaagaaattcatcgaaaaatattcgaaaaaatgtttagaaaactatgaggcccatctttgtgttgtttattttatcagagagaattggcaacaatgtgaagccaattgtaaagataatgcaaagtgtcaaatgtaccgtaaccattttaacattttgtacgaatatttgttccgactttatgccgaaggtatatgctattatataatagtttaaaaatatttaaaacattaaattaattaagctaaaaacccgagtgagtcgaaacaattagcaccggtaattaggccaatattttttggtccaaatggcatagctctaagcttaattgaggttgttagcagttttaatcatgtttcgaaatattcttgcaacgaaatgtttgggcagatttccaaactgtatccaatgaaattggtaaatgaggtggaattcaattatgatgagaataataaagatgctttaaatgaatcgacggatttaaatgaatcgacggtcactgatgaaataattagaaaggaatttgagcaaaaaatgaaaaaaatatatgaaggataaaagtaaaagagctcgaaaaaccctttgtttattggataagatggaaaaaaattatgtcgaaaattaaaatttagatgaagaatttgatggaaaatttaaatttgtcgcatttaaaatttcaccattaaaaaccaattagctttactacaaatttataaaaaaaatacttttctttacgacattgatatatataattagaaacaaaccccaaagttttctttaaatttttaaaaataagccaaaattcaaaaatagaaaagaattattaattaattaattaatgtaagtcctcccattttta

SEQ ID NO: 51907 - DNA, 1531 bp, Heterodera glycines
  Genomic contig location: Contig_ID=SeqID_21307; Location=1355..2885; Strand=+
  SCN-specific regions: Sequence locations=1-39,61-348,371-533,566 -1157,1180-1420,1443-1464,1493-1531
atgccgttaattaatcttggctttcccattatttgtgctcatttttgccaaattttgtcaaatcctgacgataacagagcaaatgaagatggacgccttttatcattcaaccaaatcggcgaatttattgaggctattaaagagccaaattttaaacaaattatcacttttggacgcccaacagtgccaatcaatgaagtcactgaagaaagcgaagaagcggattggacagacaaattgggtatgatcaatttaaagtgccgatttatccgaactaaaaatttcatgatgtgttgtcctctgttttcggctcggccctttaattttcgtcccaggcatttggccatatcaagaagccaataaaatggcttttttgtcatcatttttacccccattatcctcaaagcataattagattatttcctgtcccctgaattcgtgtccagacatttgcgcctcggacatttgcgcatatgtcaaaaaatcgtgttcaaacttagatttttcaatcatagaggtctttaaactgcattaatttaagaaaacttgttcttttggtttattaggaacagtaatgacgtgttgtttgaaaaatttgttattttttcataaatttgctgacgatcaaattatcgaatacactcactttcaactgcttatttaaaactgtttagtccatctaggattgaaaaaatgtaagtttaaaccgattttggacataggcgcaaatgtctgatgcgcaaatgtccggggcgcaaatgtccggggcgcaaatgtggggtaaccccttagttggatcataaatccaagccataattaggtaactttacttatccatatttggccatttctacctctctgtcccttgccacacagcatttgcattaatggctaaattatgcttaacaaccattacataaaattggttaaaatattttatcctttgtttttaggcaataaaatgattcaggccggtgaacaatatggaacaactaatctgatccgggagatcaattcgcggattaacacagctgaaccaatcatttttgaatatatacgaaacgaaaacagtgtcacatgcgcggatcagcctgacaattgccaagagatggtcaaagtggcaaaagcacagctgagtgtccgactgttgatctccatggccaaacaaattgtccaagaaaaaattttgcaccaaatttacaacaatccgttacaaaaagcccgactttgcaaatggtggtaccggttcaggtagggcgttttaaaggcatttgaaaacagaattaattatcgattaaagtgtccaatgtttcaaaatcataaataattaaaattaaatctaacattgttggtatcatccaatagccctaactgtcctctattagcctagaaaattctgagaaatttcgttaaggggtcagaaaactttaaaaaactggttttcgaaacattttgcgctataactttttttaaattttaaagaaatttataagaattttctaggctaatagaggacatttggagctattga

SEQ ID NO: 51908 - DNA, 311 bp, Heterodera glycines
  Genomic contig location: Contig_ID=SeqID_21309; Location=406..716; Strand=+
  SCN-specific regions: Sequence locations=1-172,195-272,300-311
atgccatccgcttccgctgggacggttagcgtcagcaatggcaccaaggccaatggaaaccaaccgaacaaacacatgcaaatgttggctatggccggcccggctccgttcagcgactcgccggaggcgattgccattcgcgacgcggtcgactacacgcaaaagatcacgctggaaatggcatacaacaacacgggtgagcactcggcactgtccgcaatgactcaaataggaggagcctggggttattgatttggaagcggaacctgggctttaaatcatttaaatttacaaaattgaattaaaaacca

SEQ ID NO: 51909 - DNA, 417 bp, Heterodera glycines
  Genomic contig location: Contig_ID=SeqID_21310; Location=290..706; Strand=+
  SCN-specific regions: Sequence locations=1-93,115-165,188-193,216 -228,250-334,356-377,399-417
atgctgaaggaatggacggaccgatcggacgaatttattcgaaacttcaccagcacgttcaacagcgacggaccggtcattgccaatttgttaaataaaatagtaaatgttttttcaattttcagattggccgttttctgagcagtcgcagtccgacgccggcattggaggagcaggaagaagcggcggcatcggacgacgacgaagacgaagaacacaacgaagcttaattgattcaccaacaaaaaaggtgcttaattgatcatatcaactaaccaaagaggatgagaaatgaatgatattatattatgttatcatattgtccttttgtgattttcttacaatgattgtgccttggcttgatattatgaaagagtaaagttatgataaatttttgaaggattttccgaattgtga

SEQ ID NO: 51910 - DNA, 851 bp, Heterodera glycines
  misc_feature (22)..(22): n is a, c, g, or t
  misc_feature (74)..(74): n is a, c, g, or t
  misc_feature (218)..(218): n is a, c, g, or t
  Genomic contig location: Contig_ID=SeqID_21310; Location=959..1809; Strand=-
  SCN-specific regions: Sequence locations=1-147,169-243,265-361,383 -531,553-597,626-851
atgaccgaaaaaaggttaccancggatgcaattaatggatacgaatgtctttgtgtactagactcatagtatanaagcattgcattatgcaattttaaacactctctctcatttctcggatgcctttattcactctcgaagcgcgccgtttgttttttctactcttgcaaattacctaaatatattatttcctgttttgaggtcgcacaccaagattntaaaaaacaacaaaaagcgccaaattcattcactcatattctcaagcttatccattacatttgaaaatgtgttcgatcagaccgaggtggaggatttgtgtactgaacaccaattgcaaacaattccgttcggtgagtgcggaaattttaaaattaatgggtttggtcaagcttgggttctctgatcatgaatttaatgccttgacttcattaaacagtacattggcccgaattcatcgtttccggcctgaccacaacaatgttcgtcggttcgttccctttgtgcttgacaatacggtgggcggtgccacgcgtcagcagcggggccttcgcgagaggggcgtcgtgtgggaattgtcagccgatggacggggtcggcataaatttaaaaaataaaatttaattttgatacaattttcaacagatgtttacgccttcccgggcccacttcagcgaaccgttgaggccattccgttgctcaaatatatgccatttatgccaaagcagaaaaaggcaaatgccaatttaagaaacggatttggagagaacaaattctgattgtgagcagagtatattatattattattgtattgatcatcagagaatatgtgtattaaaaaattgcataataaa

SEQ ID NO: 51911 - DNA, 1249 bp, Heterodera glycines
  Genomic contig location: Contig_ID=SeqID_21317; Location=662..1910; Strand=+
  SCN-specific regions: Sequence locations=1-12,34-98,120-332,356 -366,388-660,682-901,949-1084,1127-1220,1242-1249
atgcccctatccgtcccaaggaatccctattttgaacattttggccctaagtaagggcgtgcctatttcggcaccttttggaatttcgcccttatttcggcattttttaaaaatttattactaaaaaggcaataaaaaagcacccataagggcctgcctgttgacctcttgaatttttcaaaattttgttaaaagtaacaaaaattttctgatttttaaaaataacgtaaaaatgaaaaaattaaccgaaaagtcgaattttcggaaagaaaactttttttctttttattcaggaaaaagatgagatttaattcttttgtaattaaaaatcgtgatttagggttcgggaaaagggatttaaatttcgggaaccgggattttcaattcgtgaacgtgctttgtaattggggatttagagttcaggaactgggattttgaattcgggaaacagaatccttagaaatgccgctattaacccaataataactttattgattcattaattgaggtatcgaatgacattatcaaagccccctttggtgtctttgccttacatgtccgacaaattgctcccatttgtgcccaagtcggcaatatattcgcaactttttgtttcaaatcaaacacaaaatgagtggcacgaggacacattccgtctaaaactgaatctagaaggctgtaagcatctgtggaaaacaaagcaaccgcaaatgatgtttaaaattgagaaggtaaaaaaaatatggcataccatttttttgaaaaaccttttttggcgttacttgcaaaatttgtatcttcggaattttattaaagggatacaatttttggtgctaaaattgacaaaacagtaagttttaggttctaaaaatacctaaaaaggtgctaaaatttgagacacataattatataatttaaaattcttgtcaaaaaaattaaataaattttgaagatgaatttttgagaaaatttttcatttcttcggagtaattttttcttttgaccatttattatataccccaaacccgaactttagcaaagtctaaaattcaaatttctcgttttcatttcataaatttacggcttattttaaataatttttcatatttttaagttaattttttaaggtgttgttagcggaatgtcccttctgtctacagtatacggatgacgaagataaattaccacatcgattaaaagcgtgcaacgtaaaaatttttcataatgaacactgaactttttcaaatta

SEQ ID NO: 51912 - DNA, 822 bp, Heterodera glycines
  Genomic contig location: Contig_ID=SeqID_21317; Location=2463..3284; Strand=+
  SCN-specific regions: Sequence locations=1-426,453-501,538-610,640 -640,662-822
atggattatccaccaacggattgtccatttatggtttatccactaacggatttgtccatcactgacggattgttcactcatggtttatccactaacggattgtccactgatggtttgtccactgacagattgtcttgaagccccaaaaaacctcgagaacgttcttagcagttttataccatcgcgctcctcacaaaccagtttttttttatttaagtattaaaacaacggataacaagatatgtccagtgtgtcgtgaagacattctgtttctggaatccggtaaaaaagaccaaccagcgcagaccaacaccataaaaaaagtggtatatcggaagatgaaaaaggaaacggttcacgaatttgtcatcagacagccggtcctccaaaatggcgaaggcggtatccgttttacgtacgaattagagctggatgaaaatggcaaaattagtgaaaagaatgtcaatgaccagtcattgaaagtggttgacgaaagagcggtaattatgtttatataatttttaatttaattttaatcattagtaaaatggcattgagtttaaaaaaatttatggactgattcatgatttattgcatttagtgaccatactattaaaaaaaattctaaattaatattttgatagagaacacttagagctatttaatgatatttggttgaatttgagccaatttatgaatttatatgtcttacaatttttgttttcgaaccccttggcggatttaagatatgcccatagtggcggaatctaagaaacaacctaacaccatacatttgtatcagggatgggcctaaattgaaaa

SEQ ID NO: 51913 - DNA, 734 bp, Heterodera glycines
  Genomic contig location: Contig_ID=SeqID_3798; Location=576..1309; Strand=-
  SCN-specific regions: Sequence locations=1-152,174-368,401-555,578-734
  Gene Ontology: Mol. function=cytochrome c; Cellular component =mitochondrion; Biological process=positive regulation of embryonic development
atgtcatttcggtcagcagcggcattagggcttaacttggtaagccaaacaaacaaaaatttttttttgaatttctccgcctgattttcgccaaatttcagcgtaaagcatccaaatttgtgttgttcggcgcattggccaccggtggcagtgtgttgctgtactcgttggagaatagcggtgcgcgtgcctacgactttgttgtgcacccgagccatttgccatggtcccacggcggactgatggacgcaattgacatgcgatcgtccgttttttttcttgttccacatttaacatctttattttaatgtgccaagttttcaaccgtaatgtctccaattgcctaaacaaaatttggatttggcccgatttaaaaaaaaaaaatttttttttttttaatcaacgcctgaaattaaaaaaaactcgtcgtccaagaaaccgttgaaatcaatcctttctatttacctcgcaataaaaagggcacttttctatttagtttggtggatatatgcaagcaaaaccattatggatgagttttttggtccctcaaataatacccaaaattggaacccctccatgttttttatgaattattttattttttcagggttcgtcgcggttaccaagtgtacaagcaagtgtgtgccgcatgccattccttgaaattcatccgttacaaccattttgtcgacaatttcatgacacgggatgaggcgaagacggaggctgccgag

SEQ ID NO: 51914 - DNA, 1011 bp, Heterodera glycines
  misc_feature (897)..(897): n is a, c, g, or t
  misc_feature (994)..(994): n is a, c, g, or t
  Genomic contig location: Contig_ID=SeqID_21319; Location=35..1045; Strand=-
  SCN-specific regions: Sequence locations=1-850,874-1011
atgaagcacacaacccgcatgctgttagtgccggaggaactgtaccgctccttgttggccaggagctcggctcctgttgccgacgcatcctctgcgaggggcggcttaccgcagcatatgacgccaattgagcacacggcaaagcgcatggcgcgcgctgcacacagcggcggcgtcacccagagcacggatggcgtatctccggcatcgaaacaacaccttctgaacgatgacgaacggttgatccactaccaacaggagttcaagaggttcaaaaaattgctggaggatgagcaggagcgtccagcgcctgttcgtctcacccaactgcccaccgacgaagcctcgaaggggctgctgcgcgatgcactttccgaggcggcgcgaacaattcaacaacaacaacctcaaccaagacagccggcgccgcaccaacaacaacagcagtcgtcgcagtctgattcgtcaccaatgaggcagcctccacgtcgcagacaacgaccagccaaaaggacacaccgtacgacatcagcctctacggatggcgccgaagctagccgcttcccgtcatcgtcatctgccgtctcattgttgacacgcactgataatggaggaaaaggaggagctgagacgactgagcgcgaagacagctccaacgacgaccgaccccaaaatgtggcggcagttgaccccgcaaggaaaggacagcggaaagaagcggacgtgcaactgcatccatcaacatcgacagcaactgcagtaccagcagcagtcttacgtgacacagagcagcggaaacgacaagccattgactatgcgttacgcaacgcgggcacgctgggcatcggagatggacagcaggtgtaccggctgatgcaaggcgcgtaccgtccgatncagaacagcgatttggatgcgttactcacttttcattttgctgagccccaaccggagaaggcaccgcctgggtacaaaacatttattggcaatgctncgcaagatccgcgcatg

SEQ ID NO: 51915 - DNA, 2110 bp, Heterodera glycines
  Genomic contig location: Contig_ID=SeqID_21322; Location=30..2139; Strand=+
  SCN-specific regions: Sequence locations=1-41,64-111,133-536,560 -566,588-1387,1410-1471,1494-1720,1743-1783,1806-1885,1908-2021,2064 -2089
atgtttcttctgttggtcggttgtggcaccattctttggttcttttttggacttttcaaaaaacgacgactccctcacaaaaaaatgtaagaaattcaataaaaaaatttgagaatttcataaattcttcaatttttcagttttatctgcagcgattgttggcttttggtgttcgattttcttgcgccttctcagctcggcctcgaaattgcacttatcagccatcgctttgacttttacgtcgacgaacacttcaagacatgcaaatggaaattgaacaaacaatttcttattcaatgggacattgaagaaaatgggaccaagcaaatgcaaattgtcaattccgatggaaatccattgccaatcccgcaaaatccgttgcccaacaaagtcatcggattccgtgacattcagatcatgtaaaaaaaactgatttttttttctctaaattttctgaatttttcagctacatcgatcaaaatgtcgtcgcatttctccgccattttcaccgtcgcattttcgctgtttgtacaatggatttgtacattatcactgaaaatgttcgcattttggactttgttttgctcaacatttggccaatgctccgcgacgccattcgtgttatgtatttgaacaccatcgcttttcgccgtttgcgccaattggccccgtcactgctcagcgattgtccatcacttcgctttgtctcattcaaagatgccattctgcccgcttttccgcccgatgacagtgccaatgcgtcggatggccaaacggtggcaaaatggtcgtttacgccctgcccggatggtcggtccaagtggctcaaatgctttgtgaatgcaccggtggatcagtggtcgtcaatgattgaacagttcaaagcggtgattatcactatttaattggttttttctatgattttttgtccccatttttaggcattttccaatgcttcttcttcggctacttttttcatttcttttcattttccgccgtcttctccgcttgacttcattgtgccatttgatttgatcaacgaagtgactggggagcaattgacacttggacaatcgtcagcaaatgcttgttggctcacccgttgtccaattgcatgggatgagcgaaattgggaaaatatgaggaacgaaatgtatgttcgactgaacccaattgagattcggatcagagacggtggatacggtgatgggtgagcaattttttgaaaagtttcattttgtttatgagtccattcaactattgaacaatgtttttttcagtcttctcctcgacgccgcttctcccgggccgagtgatcattgatcagcagctgcagaaattaattaattggccgattgcaatccgtgattgaaatgatattggggcattatattgtattgtgtataatttgtttgtaggtatttgacctttgcttgctcgcaaatgcatccatttccattgtacatacctatgtatatatatttatgtgaaattcagtgtgggtaatcgttgataaaaatgacatgaacaaaagcgagttgaagcattctttcctttagtgatctcaagcattgtgcaaaaaactgcatagtcctggtcaaaattttaggacccagaagtcctgaaaaaagtgatttgttaatcctgaaaaccggaccgggtcaaaattcttttattctttccggaattttttcaaaggtccgaatttgatacatatctcaatttatgaaccaaaacaaaaattgatcagttctcaaataataattcattccgctggccactgctggtattacataaaatggcattcgcgttaaacgcctcattccttttatacccgacaaatgccgactccgacttttttcccacccccgatggctctgggcgctatgctaatatttgctgtcagggctcccactcgtccttgaatggcaaggacgtccttgaaatcgggtcctctttcttgaaaataaaaaatgtccttggatgccaaggacgtccttggaaatgaacatttggaaaagttttaaaaaattcaaaaaacattgaaatatattaaaatttttcagataatttctttcaacattttttacaatttagggtttttaattaa

SEQ ID NO: 51916 - DNA, 613 bp, Heterodera glycines
  Genomic contig location: Contig_ID=SeqID_21323; Location=993..1605; Strand=+
  SCN-specific regions: Sequence locations=1-123,150-291,313-328,412-588
atgatgatcattaatttcggtcctcataaattttctattttaatcatcggtgtcattactgtccaagtttgccttttctcgtccatttcatcaaattcaattcgttcaaaacgccaatatgttcagcaacaacaacagcaacaacacaatgaagaatattttgtccaacaactaattggtggccaatttcaacaaaattcttatgttgtgccaaatcaacaacagcaacttaatccaaatttggcattacagcaacaacaaattgtgccaattaatggacaaccggtaaatgcttaaacttttaaattatttgcccaaattttagcccattttaattaacttaataaaaaaaattgttttttttttccatttaattataaattttaatttgaaattattattatattttttcttccaactaaatcataaattaaaaataaatttcaattaaagcatttaaactcacagccattgccacagcaacaagaaagtgcacaacaacaaatttcacctattaatggacgacaatctgtatgctaaatgttatatgtaaaaaaataatgaaataattttcagtaagcaataaccaattaaattttatttaattatttta

SEQ ID NO: 51917 - DNA, 503 bp, Heterodera glycines
  Genomic contig location: Contig_ID=SeqID_21323; Location=1883..2385; Strand=+
  SCN-specific regions: Sequence locations=1-65,89-153,175-175,340-503
atgtcaaaccaaaacagaatgccaatgccaaacactaacaaaaataatgctaaacggcttacacgttacaatgaacagtatgccaaaattatgttggcattgtccgccggtgcctatttccgctcagcgcattcagccgaagaatgtgtggcgaagtgagcgggatttgtttttcatattttataatagaatttcaaattaatttttaaattaataaaaaactcttaatttataaatcttcaccagaaaaaaagtgaaatttattacaaaaatttattttattataaataaaaaactttataaaattaaattaataaatatgttaaatattataaaattgtcaagaaaattgaagcctggaataaatatttataaaaatagagaataaattacaatcaaattccacttttaacagttggttgccagaaccgaatcaatggcatatttatgcatccataaaccaaacatgtgacattcttgacaacccatgctcatcgtataca

SEQ ID NO: 51918 - DNA, 294 bp, Heterodera glycines
  Genomic contig location: Contig_ID=SeqID_21324; Location=526..819; Strand=-
  SCN-specific regions: Sequence locations=1-173,195-294
  Gene Ontology: Mol. function=cytoskeletal protein binding; Cellular component=cell-cell adherens junction; Biological process =intercellular junction assembly and/or maintenance
atgtctttctccctaaggcttcgctactcgcgaaacgtcgaagaggaggagcggcgagtgcgcgaagggcaagagaggcgaaagcgcgaggaagaagaacgccgaaagcgcgtggatgagcagcgccggcgatgggagcagcaggaggtggagcagttggagcggatacggcgtgagagagaacgaatggaacaggcattggaggcgcaagcgttggaccgcgagagggtggagagggaccgcatcggccgcgaccgggcggagcgtgaggcggccgaaaaacgacgccgcgag

SEQ ID NO: 51919 - DNA, 66 bp, Heterodera glycines
  Genomic contig location: Contig_ID=SeqID_21324; Location=274..339; Strand=-
  SCN-specific regions: Sequence locations=1-24,60-66
aaagtcatttagtggactaattacctaattaattgcctttataaattttaaattaaagaacaaatt

SEQ ID NO: 51920 - DNA, 1128 bp, Heterodera glycines
  Genomic contig location: Contig_ID=SeqID_21325; Location=1862..2989; Strand=+
  SCN-specific regions: Sequence locations=1-371,393-615,638-973,996 -1128
atgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaactttgagactctgaaagtccaattcgagaccttaaccgaaagagttgatatgttggaccaagacagtgatgggacgaattcaggtgggactgttagtattactaatttgaatagagcgtcgcgtgcgctgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcacaagactcaaattggctctgagggacactcctcgggcactgtttaaggaattattgccagcacaaacggacactcttgactcagcattgagcgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtaaagagaaaatttgcgaggaatttttggatagattgaagcctaacattagttttctgatccgtctggtgggtttgtcacgagcaaaagacttggacctggtaagagcacaggcagaggagctggaagctttactgttgatgaacaaaggtgatgaagcatcacgcctctctcaggcagtccatgcgctgagcaatcagtcaccacagtcgaattggtctacagaagcgaacccgaacaatgaccgtgctggacaatggtcgtcaggcaacaat

SEQ ID NO: 51921 - DNA, 383 bp, Heterodera glycines
  Genomic contig location: Contig_ID=SeqID_21326; Location=22..404; Strand=-
  SCN-specific regions: Sequence locations=1-213,235-383
atggaaaatggttgcggattgaaactgaggaatggaattgaaattaaatgtgaaatggaattgaaattgaatatgaaaatcggtgaaagtgattgtgatccgaattccaagatatttcagtgaaaaacggccaaaaagggaaaatcctgagggaaggtccgggaagggcgcggggaggaaaaccagaaaatgaattttgtccgggaatcgaagaaaggaaaaacggaaaaagggacggagaagattttgcttctccggagttgctcggtgtggaaagtccgggatgagccaactgatcttgcgtttcccacggggaaaaggatcagcgaaaaatgctgatcctttatcccgccctttttattactgtctgtgtgggaaataaa

SEQ ID NO: 51922 - DNA, 401 bp, Heterodera glycines
  Genomic contig location: Contig_ID=SeqID_21328; Location=20..420; Strand=-
  SCN-specific regions: Sequence locations=1-401
atgaatgaagaacaaatttctgctgatgatgctattgtttctgccacaagtgatgacaaattagagtccttttcgaaggaaatggctggtttaataatttctccgcatgatggagtaaaaagtgagaaaaaaacaccatcggaaaaaattgccactttttctgatggattctccaaaaaatttttttgaatttcttaaattatggtaacctaaatttgaacaaaaagccgaaacccataaaagaatccaaaacttattcctttttgctttcagtacaaccaaaacataaatatgcgattgtttgcggaaagacgcttattaccattatgggcaacagaatgttgatgacattggttggggttgtgcatatcggtcttttcaaactggttgttcatggctaa

SEQ ID NO: 51923 - DNA, 174 bp, Heterodera glycines
  Genomic contig location: Contig_ID=SeqID_21328; Location=559..732; Strand=-
  SCN-specific regions: Sequence locations=1-174
atgcaaattcgtggaaaagatttttgctttcaaaaatgtactggtgaggccgaatggtaattgtggcgaacgaatcgatgtgttttgtgatttgtatttggctataaattatttcagcagaaagcgattttttttcattttattacaatgtgtaattttttctatttgaataaa

SEQ ID NO: 51924 - DNA, 90 bp, Heterodera glycines
  Genomic contig location: Contig_ID=SeqID_21329; Location=226..315; Strand=-
  SCN-specific regions: Sequence locations=1-90
atgaatttggttgaggaaaatctggaatcaacttccaacgccaattcgttaattgaaccaattattgcatcaccaaatgcacaagggacg

SEQ ID NO: 51925 - DNA, 641 bp, Heterodera glycines
  Genomic contig location: Contig_ID=SeqID_21329; Location=764..1404; Strand=+
  SCN-specific regions: Sequence locations=1-134,157-641
atgcgccgggagacagaagaaatcactcgcgaacgagcagttcatcgtcagcagtctcttcggcgtcctccgttggctcggacaatgaacggatcaatcggcggcacaaaaatttacactccgtttgttagggtatttttattcatttaaaaagggattgtgcgttttagagttcgtatgtcaaccaattgtatatgaacgcagcttttggctcgggcgatgagtcatcttcgaccgaaacgaatgctgtggacgaaaagcggaaggtaacggagaatgatgggggagtaaagccaaaacgcgaattgtcaaggctcgcgtccgaggacttctcgagcaaatccccgtggacatttacacggagggagcgaaagggccggcggagtgtgcgatttgcatgggcgactttgaggtgtcactttggtcttcgtttatgatttatggaaagagcatttgctcctcaggagggcgactccattcgctttttgccctgtgtccattcttatcacctccaatgcatcgacggtccgttccaactgtcccacagatgtcacttttcgttttcagattggctcctccgctccttcacttgtccgtcctgcatggaaccggtggactccgcgctgctttccgtcttcacg

SEQ ID NO: 51926 - DNA, 291 bp, Heterodera glycines
  Genomic contig location: Contig_ID=SeqID_21329; Location=1478..1768; Strand=-
  SCN-specific regions: Sequence locations=1-291
taatattacaggatttattcaaaatgataagtgctcgaagatggattcatgttgctcatacaaaaattttaggaacatcagtcaaaaagtcgaaattaaagtatttggaagacttctacatgggaatgggtgaaaaatgcatacaaagggatttggggataatttcggtgtttggagacagctgccgccatttcgctcccttattccatttaaaacgcggaaaaaacaccgatcacagtttgttgatgttttgggttgtcacttctccgccttctttcgctgtgttctgtt

SEQ ID NO: 51927 - DNA, 61 bp, Heterodera glycines
  Genomic contig location: Contig_ID=SeqID_21329; Location=2127..2187; Strand=-
  SCN-specific regions: Sequence locations=1-61
agactcaactgtcgaggagaaaacaaaagaaagtgatttatcatcagttcagcaacctaat

SEQ ID NO: 51928 - DNA, 194 bp, Heterodera glycines
  Genomic contig location: Contig_ID=SeqID_3801; Location=936..1129; Strand=+
  SCN-specific regions: Sequence locations=1-7,31-146,188-194
atgcgccaaattattaatttttatttatttgttctgttcttcgcacctaattttgctgaaaaacttcggtatgtacagattatttggcgccacggggacagagcgccgctggaaaagccttaccccggcgatttgaatggtcaacgaaaaataaattttaaaaataaataattaattaattaattttcagatga

SEQ ID NO: 51929 - DNA, 1208 bp, Heterodera glycines
  Genomic contig location: Contig_ID=SeqID_3801; Location=1211..2418; Strand=+
  SCN-specific regions: Sequence locations=1-102,126-302,324-334,356 -789,842-967,995-1208
  Gene Ontology: Mol. function=acid phosphatase activity; Cellular component=integral to membrane
gatggaatgcgacaaatggaggagcttggccaattcctccgggagcgttatgccgctgcaaatttttgccccaacattttgacagaaaagaggtaagaaagcattgattgattattgattgattggggatagcaatttgtaaatatttatctccgaaatcaaaaagtgcggtcaatttttaactggaatttaatcagaccgctatattagaaattgaattaaattgtaaggccaaattgggaggtgactgatcagttcgtcactgcttgttacgtcactgagaaatattttaaaaacattggtttaatatataaaaaaaaattgtttctgttttttaattgttttagttttcacgcaatttccagataagtcctcgattaatttttttttaaaaatgggctaattagctttgagacagagaaaaagaaacttccgcgagaggaagtaatggaccaattaaggagacaattgaacgccaaattgggaaggttgacaatagaagttgtttgaataaaatgtgctaattaccgaaaaatcaatttggggaaggacgaaccattatgagaataggtaattattttattcgtttctaagataatcattcgttccaccgacgtcgaccgggcgctggaaagtgcgcaatcgctgctaagcggaatgttcccgccacagtccgacggggaccgattcgacccggcgctgaactgggcgccaattgcgatacacgccactcgggaagcgaaccacgactcggtgagacagacagagttcgaaaatgagacggacatcaataaattaaaattcatttaaatattgtttaatcaaaaaaaaatgaaattttggcgatcaatttttgggaaaattttcaattcttcggggagtattttcttcctatgggtgtatttccccgattttattgcattgtaatggaatttttcggaaaaacgccaaaaaaggcaaaaaaaaggcttatcttttaaaagcttttgttttatatttttcagttgttaaatccgtccggttttccgtgcgcccgttataagcatcttcgccaaattgttgccgatgagattagtgcacatttgttggacaaatatcgcccgttggtggactttgttcgtccccacctgaacatctcgaaggaaaaaccaatcaaaatggtccaattaatggcactccgtcacataaagcccgaagtaaaagcgtag

SEQ ID NO: 51930 - DNA, 1009 bp, Heterodera glycines
  Genomic contig location: Contig_ID=SeqID_3801; Location=2965..3973; Strand=+
  SCN-specific regions: Sequence locations=1-89,171-299,330-343,412 -551,573-592,636-1009
atggaaatacgacaaaaaagttggcttccctatttcaatggaaacgaagaaattacgcgtttaaatggcggtaaaataatacaaaaagcaaaaaaaaatgttaaataattattaattgaaaaataaaattaattaaaaagctaaaatatatttttattttattatttaaactttcaggagttttgttgaacgatttattgcgtcggtttaacattgtttcacagggaaacgcgaagaagcttgacgcgagcaaaatggtgctttattcttcggtaaatttttaaaatacaatttttcccatttttaataataattaaaataatattttactgttctttcccactttttaaataattaaaataatattttgctattttccccattttttaataataattaaaataatattttgctatttttttcaatttaagcacgactcgactctgctcggccttttgtccgtccttaacgtaaaagtgccgagcaatgcactcgatttgcctccgtattccgcttgtgccatgatcgaattgtacgagaaacgcaaaacccagaggcaacaaaaacttttttgtcaaagtaaaacgggaagaaaaataattttaattaatttatttttaatttagttattttatcgacgaaatcaaattttggagccaatggcaatcgccggatgtgaagcgaaatgcgatttgatcaattttcttcaaattcttgagcctcggtcaatccgagggggcgaagaggaattgaaaattgtaattaaattagcaccttaattaagttaattataatgtgtaaaattacagttatgcgatgaaaaagtgccgaattcggccgcccggcgcatgggaaacattcccggttttgcaaaaagtttaattattgccatatttataagcattgcagccataaatcacggaacacaaagcacagtaataaatgtacggtaaaaaagttttaaaaattctgcattttctatttgttaaaaaacttcaattgaaaaata

SEQ ID NO: 51931 - DNA, 1150 bp, Heterodera glycines
  Genomic contig location: Contig_ID=SeqID_3802; Location=663..1812; Strand=-
  SCN-specific regions: Sequence locations=1-31,53-90,112-213,235 -331,353-488,510-731,753-816,838-1150
atgttccaacttctccgtattcagcggatccaattgattgtgcaaaaacaggcaaatggaaagttcgttgtttcgtctttttgtcctccgtttcttcgtcttgtcttcatatttgctttcgcttccgttaattaaggctgtttctcgtcctccgccgccgtcgtcgggcaaaaaaacggatgcaaaaaccaaagcgagtttcactgatgtttttgttgtttttcgaatccacaacttttctttaaggctgtctctcgtcctccgccaccaccggccaagaaaacacataaaggcaaagtgagtttacctaattgcctatttatttgttttgttgcctgggatttctttttcccattcaaaattcgtttttaaaaggtcgttattccgccgcgtcgtcctccgccttcggataagaaaccattcatcaaagccaaagtgagttcgttcaggaagacaccaaactcttagttttcgacaaaaaaatcgtcataatcattttttcttattttatgaattcgtttgttaagaccataaagtcgaccaaattaaacattcttggtatcattagctaaattgatcaaattttttgaagcttggcatatagatagagcagtttaaggactattgaatgataccaactatgttaaattgggtcgacttaacaaaaagttatgacgactttttggtcgaaagacagtacgagttgggtttttaccgttcgttcatcatcattttttcttgttttatgaattcatttcttaagactctttcgcctcgttttccgtcaccgttcacgaaaaaggagccactcaaagtgagacacttcccccttttgctgtctctttctttttctcttccgtttaggctgtccctcctctttctcgcttcccctccatggaaaagaaaaacactgtgaccaaagtgagttttcggcttttgcattttttcctttcttttctcaattttcccttaattgtttaagattgtgcctccttcaatgctttcgaaaccgcagaaaattgaaccattcaaagtgaaccaatcattttttgcccattcttccccaatttgcctgtcatttcctctgtttaagccacagccatcgccgatgggccttccgcatccgaaaaagggcgtccgcactggaatt

SEQ ID NO: 51932 - DNA, 2669 bp, Heterodera glycines
  Genomic contig location: Contig_ID=SeqID_3802; Location=2067..4735; Strand=+
  SCN-specific regions: Sequence locations=1-15,42-282,304-336,360 -363,393-670,719-721,743-944,983-1016,1039-1140,1162-1467,1489 -1548,1571-1581,1614-1717,1739-2411,2433-2669
atgaatgccgaagacacaataacaacaacaataacattcactttgcctaggtcggcttttttgttcggcgcgctcggagcagcagaagttggagcagtacgaggaacaagcgaaggcggaacagccgaagaagggcccgagggagcgattggagtgggagaaacgacgacacccgcggcagagggatggacgggcttaagcgaaaaaagggaatgaaaaagcgcaaaaagaaatcggcggcgtggacaaaacccacttttttgtcgtaagcaggcgaatttggccgctttttcttctcctttcgaccgaaacacatttatcagtacaggcaaagaaaatattataaattataatgctttgagcaaaaaattataaatttagaaattattttagcaaaaaagaggaaaaattagcaaaaaacgaaattacggaaaaggattatcagagaggaaaatgacgcaaatgaaatgatgaaatggagagcaaaataattcatttatatacattcagggatgggccgaattgaaaaataaaaagcgaaatgcgaaaaagcaaaactgaaaaatgcgaaatgaaaaaaaaagttttgaaatgcgaaacggcaaaatgtgcgatataaatttgactatttttttcttcaaaaccacttttttgcggtgcaagaaaccggaaatttttcaaaaaatatacaatataataaaaaataaatattttaataggctaaatttttaattcttaaccaagtaaaaggtatttcacaaatgtttttagtatattcgcttgaaaaaattattcaattattttatcaaaatcttttttttctgatttttcattattttagaaaatttttgggaaaaggagtgactatttacacgttttttacagcgcgattatttcagaaactttttaggaacttagaggagggtacagcggtgccgataggcgccgccgggaaatttttaaaaatttcagttcaatttattaacagaaattgtgcaaaacttactagttttttgaaaaaaaaaattaaaaaaatttccgacttttcatcaaaaatttcggaagtcggaattccgaccccaaaaatgtcggaaatcggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgcgttaactttaattaaattcagggctgccaagtgtcctttttttaaagattgtcctttattttaggcttccccaaactttttaaattttttgtgcttaatgatttatttcgctgatattttatttatttattttcgttttaatactattttctcttcctctctttccctctcaccataactttttgttttttttgtgcacacaacctattgtcagacgcataactatttcccatttttagcttttttacatttcccaaatgccccaccaaaaatgcaaaaattttattgtgaaaattatgcaaaagaattccggcacataaagaaaagtcgaagaatttgccctttgtatcgtctgcaacgatgatattaatctcctttccattggaaaagctgccatttctcagcatcaaaatactggaaaacaccagaaagcggcaaaagcagcaaaccgatcaattccattgcaagaatttttgccaaatacttcggccccatcgactgaagatcggaaaattcttgctgcggagggtaagacattcaaaatcaacaaaaaaattcctctctcacaaggagcctgggcttatcacaccgcgcagcactcccattctttcaattccgttgattgtgtgtcttcttctggactgttccgaacaatttttccggattcggcaattgcaaaaaaattcagttgtgctcgtataaaaacagcaaaaattttgacaggtagaagaattaataggacggtaaattgactttttacaggggttctggcaccatattctgtgaaaagtttgctcgcccgactgggaagtcaaccgttttctttgtccatcgacgcttcgaattttggacatgaaaaactctttccattggtccttcgtttttttacaaaacccaacggaattgaaataagattgcttgaccttgaagcattgcccggcgagtcatcaatcgagtaataattcaaacataaacttcttaaaatgatttaaatcagggttcatcaatggattaccaaaatcgtcgaaaagcacaatttggacttctccaatttaacggctttctccgccgacaacacaaaaagcaattttggtggggaagagagaagaggagaaaacaatgtcttttttcgacttcgtcaacaacaagaacgattgatcggtgtagggtgtgtctgccatgtattgcacaatgcagcaaaaagagccactgacaatttgagaatagctggcaatgctctggacattgaagcagtggtttttaaattggctggccatttcaaaaactcaactttgcgaactgaggaattaaaagggttttgtgacgaattggaggtgcaatcccgaaattga

SEQ ID NO: 51933 - DNA, 357 bp, Heterodera glycines
  Genomic contig location: Contig_ID=SeqID_21330; Location=386..742; Strand=-
  SCN-specific regions: Sequence locations=1-142,164-169,212-357
atggttaaattttggttgacattatttttcgtttttaccggcaacaatttgtattcaatttttgcgcacaaaccaaacttttctcagtgtggcatttccgactttgagcccgacttggacaatgtgccaaatgtgaaaatcggcacaaaccatgtgagagaaagaaacgaatttttaattttaataaaatttaattttcaaaaaatttattgtttaagaaagtaataaaaatggaggaatttgtactagtgtaatataagcaaatttagatatataaaggacaaccagtggaaaatgccaattcaatgccatggatggtcactttgctttcattacaaggttttgttaagaaataaa

SEQ ID NO: 51934 - DNA, 1056 bp, Heterodera glycines
  Genomic contig location: Contig_ID=SeqID_21331; Location=363..1418; Strand=-
  SCN-specific regions: Sequence locations=1-57,84-99,121-414,465 -596,621-662,707-799,830-949,985-1056
aagccaattgcattcacagcaaatgctcgtcccatttgtttaattgaatatggttgctaattaattttaaatatttttaaattcaaaaacattttgcttatattttcaggctcgaataatcattccacttttattgttgctggttggggtattacttctccgtactgtttgaaagacagtaagccaggtccaagcaaccaattgatgtacggtaaaatgaaaatcagtccaccagagaattgtcaaagtgcatcaatcaaaaaatgtaattttaaattgtaataatgaaaaaatgaaaataaaacattgatttagtcaaaagagttgcaattgaagatgatgaaaattcttctcatcataataagcattaccagatcatttgtgttgtgcctggaccgagcgtaatcgaaagtgtaaaatttgaaaaataaaaacaatttttttttaatttaaattatttttatggtgacagcggtggtccattagtgcgtaaaattggccaaaataattgggtccaagtgggcgtctgcgccgtctgcacttcaacatcagtaatattatttgtataacaatgtttgcaaaaacaaggcttttcctattttttataaatttaaaataaaccaaatttaccatttacattcttctggagcaaaaaaactcttttcaaataaacataataattagggatgatatttttatgttttagcctatttttttcctgaactcccaatgtcctaaaacacacgaaaaacaagttgttttttttggtggttcttaagctacttttcgagttattagcaattatttttagttttattttttatttttagagcctataaattgaatagattttgacattttacacctaaatttaagacttttagagcctattttccgggattttttaaagcctgatgcctaccacctattttggttatcatccctaacgatatattctatatttttataatttttcttttaattcaggtcaatatgctcaaattgattgcaattggattgaagaagcgacaaatggagaagtgaagtgcatagaaa

SEQ ID NO: 51935 - DNA, 476 bp, Heterodera glycines
  Genomic contig location: Contig_ID=SeqID_21334; Location=757..1232; Strand=+
  SCN-specific regions: Sequence locations=1-476
atggacgtttcttcccgcgcatgtccaacacaaaaggtgcagagaacagcgccgcaaggatcagcggaacccaatggtttgaaccatggaatgggaagggtttttgaatgatcttaatttttgaaaattcaaaaaattccaggcaccccggaactttagcagccaccaaattcacagcaatgcgcaccagtgaataaaaggaagaggacagcaccttcgaaactgcaacaacaattactaactaatggtttttgatctgaggggagcacaggaacgaaattttaattttagaaaatttgacacttgaagcggcagcggtggatgatcaaactcagcaaaccgtccaaactgagccggaaatggtgagtggtttagagcttgcacaattcatcaaatttgtccctgttttttttcagaacctacaggcggcaccggaggatctgcaaaacgttgtggaccaaaatgagtcggaagtg

SEQ ID NO: 51936 - DNA, 517 bp, Heterodera glycines
  Genomic contig location: Contig_ID=SeqID_21336; Location=491..1007; Strand=-
  SCN-specific regions: Sequence locations=1-4,26-135,157-276,298-517
atgttctcaaatgccgacagtttggtgcagcgaatgcgccatttaatgaccactggggaaggcgcggatgtgcactttttggttgggaaaggagacgaaaaggaggcgagtttttggcagagatgctgagcattaaaaaatataatacaaaatttgcaaatgatttaaaattatttttcagcttataccggcacataaacttcttctgaagactgcctcaagcattttcgacaaaatgttttcaaccaacactttcaatgtgaagagcgaagatggtatggaaattaatatgtaaaattgaatgaattaatgctaaatattttcgcatcaattagccacttgggaagtgatcagctcagtggaagtgatcgatgttgacgttggaacattcaaaacaatgttgcgcttcatttacacgaacgaatgttgcgggttgaatgaacacaacgcaatggaagtgctttacgctggtcaaatttattctttatttatttccaagtttataattttaatttaa

SEQ ID NO: 51937 - DNA, 853 bp, Heterodera glycines
  Genomic contig location: Contig_ID=SeqID_21337; Location=505..1357; Strand=+
  SCN-specific regions: Sequence locations=1-51,104-403,437-853
atgggtcatcataattcagcgacgttcctttttggcttacttttaggtaagaaatttaaaattatttataaaattataaatcaaatattatttttcttttaaaggttattttttgcccgaattggcggcacagcttagcaaagatgagcaggattattgcgtcaaattcagcaacaatcttcgcagcaatgtggccactgggaatcagcagaacaaaggcggcggcaaattgccatcggccacgaatatgttggagttggcatataacgagacaattggccaaactgcgcaagtgagcgacaattttttattgaggccttgtggagatattcgtgctttgtcgtttcttaaattcagccaagggccacgaatgattaaaaaaatgcaacacataaatcacaagtttaagcaaaattttttaaaaaattttgaaaatcaataatctgctagtgaattcctagagctatatatatgtataatgatactataaaatattaattaggtagttgaatttgaatcaaaatgaattgaatgtgttacattttttagtttttatcccttggctgatgggtcgagagtctcgacttaagacgacctttcgatttttttttgtctcagtcctggaattctatgtatacattcctgaaatttgttagtattgactctcatccctgtataatgaaacatttcccacgtaggcatgggccgacaaatgccaattttcgcattccaacacggcagggctgggcgagaacatttactggtccacgaaggaagggttcagcaacagtaaactggggaagttgttcaaaacacaaattatgtaattaaatatttttagccgaagcgttaa

SEQ ID NO: 51938 - DNA, 773 bp, Heterodera glycines
  Genomic contig location: Contig_ID=SeqID_21338; Location=396..1168; Strand=-
  SCN-specific regions: Sequence locations=1-454,485-525,547-773
atgaaatgctctacagatctaaagacatttgacgccaaggagcttgtcgccaattttctcattggcgacgagaaggcgggtgccaacccgccacggcgtgcgcgagtgctcgcgttcaacaagggcacggacgggcagcgaatcgggaaagaatttgacacggacgaagaggaccgccatggggactcagttttctcggtaccgaatacgaacccgtgggccggaccctcaaagacgaagaaataccgaaagaagggcaggaaggcaacgagacgatcgggcggactaccgattcatcaatctctcaatcgctgatttcgatcattttcctttcgttattcgtaccctccaacaccattttcctattcttcttgtcccatttttacttcacttttcaaattcatttctcatcggctggctaatctccggcccaaactttgtgcaaaacaattttgcacaaagttctttcttttcaaattccttaacttttcacatctgccaatttacattttaattttatgcgccatttctttgttcacacttttcacatcacaatttctgcccatttttttgtcccatttttcttatcgcattatcgggccgtctgtcactccgcccattttttcgaatgtctatttaagcggccctgcccaaggggtcgctctcttcgcttcctcaccccccaaccattcgcgtttattcgtttgctggacttttcgatcaatttttcaccatttacgcatttttaattcgtcgatcgcttcgttaataaa

SEQ ID NO: 51939 - DNA, 946 bp, Heterodera glycines
  Genomic contig location: Contig_ID=SeqID_21339; Location=499..1444; Strand=+
  SCN-specific regions: Sequence locations=1-5,35-98,120-210,232 -290,323-490,538-946
atgactttttcatttttcatttattccatttattatattgtgtatattaatcttaataagattttttcttgttttttattaatgcttaactttttattgcttttattggcaataaatgcgactaactttgatgagattgcaatggaagaatccattggagttgatcaaaccgacaaacagcagcagaacaaatccgatgaacacaacaccgcttcttctgcttctgctgatccgtcaccaccaaacatcgaatttgctgaacaaaaagcgcaaaaacaaaaaaacatcagtaaataaaaaataaatatttttaataataattggttgacaaaaaaaacataattttgttaaaagctgctaagatggcatttaaaaccaaaatcaacgattgcttgtcaccgaaaaattgatgcaaaaatttgcaaaaaattgggcatttgtcggggaacaattggacgctggaagaaggaatttgggaaatcaattaagcatttatttttttttattaattaattaattagtgttttaaaataatttcgattttttcagttaaaaagggtcgcactgatgctgaaaaatatgaaattgttaagcaataccataaaattaaagagcaaaagccgaaactgcgaaacattgacatagcggaacaattgaacatctcagagacaagccttcgcaactggagaagagaattaaaaagaagattttagaatttcacactaaactttttccgaattccgatccgatttcgtttttttaaatttatggtaaagattttgctcactgccaaatgcttggagtccaatctcaaaatttggccacgccataaaactgctgaatgacctaatctttttggatcagaaaattgagtgcatcttttagaaagatttcttttaggaaagtcattcaccgtgtggctttgttggtgttgttgttgcgaaaa

SEQ ID NO: 51940 - DNA, 947 bp, Heterodera glycines
  Genomic contig location: Contig_ID=SeqID_21340; Location=222..1168; Strand=-
  SCN-specific regions: Sequence locations=1-90,112-277,299-460,482 -580,602-947
agggaattgaacgtgttcattttggactttatgcccaaggcgtgtgccggccaaaaagtaagcgacgatttgtcacggaagcaatggcaaattaaaatttaaatcagcagaatcgcctaccaacgcttttccatggctttgtctcccgcttcagatcaatttgctgtcgcttggctctgccgatgtcactgatcaaattgggcacggcttttcaaaaatcagtggcaaatggtccgttgaacaggtcgaagtcgaggggggcgccacgcggcggcggttggtgttcctggacagtgccaatctgatccaatccgaggtggaggtggtgcgaagtgagtgccgtagcaaaaaggggggatttgctgagaaaaattacttatattgtgactgacattttgcattatttttaagagtcaaaaaatggcaaccgttggcacattgtgtggtccgatttgtcatgccaacaccacaaaatgatgctctctgcgtttacacttttgccgtcgttgtcctctgccggtttggcggatgcgttggaggcgccgcttcgcattgcactgctcggccttggcggtattggaaaaataggcttttgcaaaaataacttaaaaatgccattatcaggtggaattttggccaagtttatgcacgacaagttcaagcaggtgtgtgttttagtttgtctttttgtttcgctgtgttattttctgtatattaattgggcattattttcattaaactttttttgaccaaattataaaacgttaaatctccccccccccccctaaaaatagtctttccctttcagtccgaaattgttgcggttgaaattgaccccgaggtgttggcaattgcacgaaaacttttcgactttccgacagaatccgaccgattggaagtggtcatttgcgatgcgatggattttttgtgcgaaaattctgcgcaag

SEQ ID NO: 51941 - DNA, 1703 bp, Heterodera glycines
  Genomic contig location: Contig_ID=SeqID_3803; Location=1231..2933; Strand=+
  SCN-specific regions: Sequence locations=1-1561,1584-1618,1650-1703
  Gene Ontology: Mol. function=microtubule binding; Cellular component =microtubule associated complex; Biological process=microtubule cytoskeleton organization and biogenesis
atgattttgcatggaaaaccgacggggcactcgggacttgttatcaataatccattggcaacaattacttatcttattttagataaaaagcaatcttcaccagttcggcaaattgatccgaatggcgaaatatcggctgtaaagaatgccgcttctgctgaccaaattcccgacaaatctgctgaccaaattcccgacaaatctgctgatcaaatacccgacaaatctgctgataaaatacccgacaaatctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgcctcttctgctgaccaaatacccgacaaatctgctgaccaaattcccgacaaatctgctgatcaaatacccgacaaatctgctgatcaaatacccgacaaatctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgccgcttctgctgatcaaattcccgacaaagcctccgctgccagaaatgccgcttctgctgatcaaattcatgacaaagcatccgctgccaagaatgccgcttctgctgatcaaattcccaacaaagcctccgctgccagaaatgccgcttctgctgatcaaaccgacaaagcctccgctgccagaaatgccgcttctgctgatcaaattcctgacaaagcctccgctgccagaaatgccgcttctgctgataaaattcccgacaaagcctccgctgccagaaatgccgcttctgctgatcaaattcctgacaaagcctccgctgccagaaatgccgcttctgctgatcaaattcctgacaaagcctccgctgccagaaatgccgcttctgttgatcaaattcccgacaatgacaaagcaccaggtgtcaagaatgtcatgtccaattccgtgttcgctgatgagcccaacaaaactttgtctgtccaagccgctacagatgaaaaaaatgctgccggaggaaacaaatcgaaatcggctgaaaacaatgcattgtcatctgctgccaatgatgaatcattagcttcagatgaagcggataatgccgtgccgaattcttctgatgaaaagtctgtgccaaaagctggcgacaacaccaaaaaatcagcttcaccaaacggtaattcttctgtgccaactttagttcaaaattgggcggtaaatctaatgggcgggttttcgatcaatgatgccaaaaattcgttattttaaatgcgaaaaaacttttaggcaaatccgccccagttgttcgaaacaattctggcaataatttggcttctccgccaaacggaacggcaacagcctctaagaatttgttggcataaacacagatgcattttgatgaaatgatttgataataatgattttattccattaaaaagaaattgcagataaaaagcaaaattatgtaaaacttaacttttaattttggttataaattttctaatttattttaattaattgtttcttagcttaaaatataatagctacacaaactgttgaattttttgaaatta

SEQ ID NO: 51942 - DNA, 611 bp, Heterodera glycines
  Genomic contig location: Contig_ID=SeqID_3803; Location=4910..5520; Strand=+
  SCN-specific regions: Sequence locations=1-25,49-170,193-239,291 -467,515-611
atgcgttttacttcaatcccgttgattttttgccttattgcactggtttgcgtcattgcatcagttcctgaactcccgcaaaaattcctcaaatcctggtcggttgatcattccgaaaatttcgacgaatacctggaggtgcattttttgatccacttttttttgaattccaacttcaaatttgttttattttaggccaaagggtacggctggttcatgcgccaagtggtcaagcttggtaattttaatttttctatcattttcaattttttaatttaattatttattttgtttttcaacttttagccggcatcaccaaaacattttcgaagaatgagaacggcacatatgcatgcaaaattgaaaccaccaaaaagaatgtggagtggcccagcttcaaattgggcgaggagttccaagccgagtatttggacgactcagtgcctaaggtgggggcaaacaatttcattttattttaaataataataattattattattatttatatttataagcaaattggcttcactttattcacgaaaagatttaaaatgaagcttctaaaaagcacagagttctcaatatttttgccaaaaagaactccattttga

SEQ ID NO: 51943 - DNA, 1498 bp, Heterodera glycines
  Genomic contig location: Contig_ID=SeqID_3804; Location=50..1547; Strand=+
  SCN-specific regions: Sequence locations=1-113,167-563,608-780,802 -997,1067-1329,1351-1402,1446-1498
atggtaaaaaaaatatgaagaatattctatcccattgggaacttgaacccaagcgagaaataataaaatcagaaggtttagccacttgaccacttatccatatgaacaaatgctttaaatgaaaataaataatttaattttttttctcaaaaaatttctccttcttcatcattccctactcttttctcacccagacccccattcttaccagtgcaaatttttaccggcggtaccggtactagacaaaccggtaccgatactttgatttttgaaaaaaccggtaccggtaccggtaccaaaaaaaccggtaattaccggtcggtaccgctcaaccctactaaaattgaccaaatgtcgcactttttgactcaatttctcgttgcatatatttgtcagggacatgaaaatttttaattttttctaagatttgttaactaacggcgcgggattttgcgggatcccactccgaatcaccaattctttgtaatatgtgtaatctgcgagattgcggaattctgacggagattattgatatttttgaaaaattttgtggactgaatgccaaatatttttgaattaattaaataataaatttaattaaaattaactcattttcatcgcaaatttcattcaaaatttgtgaaattttcccggcggcgcctttcggcaccgccggatcggcttttacttaataatcctgtagaaattgagtcaaaaagtgcgacatttggtcaattttagacaaaatctatccgcaaatttgaaatttccggtctctagtaataattaaataattaaaatgacccactgccaattattttttttaattatccaactttcattttttgaaattctcagatcaccttcgactacaacccaacaaccgacgagctgatcgaaacgcacaaaaaggtggactcggaggagaagccggacatctacaaatacaacatcgactcggacggctttctggtgatggtgaggaaagagaagaagcaattttaataattaattattgtaattaaaattaatttggattttaaatcatattttatttattattttagcaaatggaatataacggagtgaaaacgaagcgcttctataagaagaatgaatgagcggagggtgaatgctttgtgggggtcaagaacgatgtgcagatggagaagaagcgacggatgattttgatttttgcctgattaattgccgatgttcattaattaattaaatccaataacacaaatttttgcccacattcataaaagcaatcagttaacacggataaagtgtttaaatgatagcaacttttaaattgcaagcaaataatgaaaagccaaaatgaaaaatggtcagtttttttaaattagttaatctgcgaaaaaataatttattttaccccattaaattatttattccaaaaattaaaattagaatattaattagaaaatgttaaaagatgaaaaatttggtatttctgctaagctccatcgactaa

SEQ ID NO: 51944 - DNA, 1596 bp, Heterodera glycines
  Genomic contig location: Contig_ID=SeqID_3804; Location=1801..3396; Strand=-
  SCN-specific regions: Sequence locations=1-17,44-152,174-213,276 -403,489-663,688-775,798-900,944-955,978-1068,1099-1221,1303 -1319,1395-1553,1587-1596
atggttccgcctccaattccgcctccaccaccaccgccactgcttgcgcagcctttgccgttcccaaattgtccaccgccgtgcatgcaacaggtgtgaaaaaaatagtgtaaattcataaaaacatttagcatttttttttcaaatattagtttgtgatgagtttgccaatgccaccaccaccaaatccgataatgttttcagctccagcagtaattttattttttcaaaatgtttcaaattttttaaaaatttatatattttttaattttaaacaaacattaagccacaatttttgcctcttccggatgccccaatgccattctgccctccgatgtgccagccggtcaattggcgttaatttaacgcataaagtggaaaaatcttatttccagctggtgatgccgccggtgccatttccgcctccccctccgcccccgccattggcgccagccgttgcgctgtcgccgcccctccccgtgccgctgaacaccttctgcatgacggcctgcgcgcccgacctgccaccagccattctgcaaccattgccggtccctggcgcggcacctcaaatggtcaaaaataaaaataaaaattgttattcactaatttaaagtatttttgcagtaacctatagaaggtgtccgaaaattaaatttcaggaattttaaaatattttttttaaaaggctaaaaaagttggcaaaccctttttcgaatggcacccgtttttagagcccggattcgctatttcggtttataccattttcgctaacttattttacattcttttttaaatagatcgttccaattccacctgcagtgcctccgccaataccgccttcgcctccaattgttttggcacagcccctccccatggtaccgccaccgttgcccgctgtaaataataattattaaaaatatataatttaaatttaaatttaggttccgccggctgtcacattttgttttagccttcccgtcgcgggcggtatttttatgaatttaaatgatcaaaacacaaacaaataaatatattatggttaaaaaagaaaacaaattctaagtgatataaagaaaaaatttaattaatttttttcgaaaaaaaattatgcataattcttggcattttttttggcatctttattcataattgctctaagtgcgggataaagcaattatttatttctggtttaatggaaaaaaaaaattcataggcattcctcctccaccactgctgccgccacctccaccgccgccatttccagttcaatttcagccaccaccatttccacctccgccaattggtagaaaattttataattaattctctaattaagtaactaattacccatctcattaagatttaattatagcatttaaatatttaattaaatttattgtttttgattttcagctcctggtggttgcatttgtccgcccggctatatgccatgctccgctcatatgtgctgcttaagaagaaggaacagaacgccaaagtctggcaaaagtgccgacaacagaactgaaaatggccaacaaacgtgagccaaaaaaaatttttatttaaatattttttaattaccctaataaa

SEQ ID NO: 51945 - DNA, 1587 bp, Heterodera glycines
  Genomic contig location: Contig_ID=SeqID_3805; Location=151..1737; Strand=-
  SCN-specific regions: Sequence locations=1-15,60-213,235-277,316 -463,495-551,575-807,901-957,1004-1038,1060-1160,1212-1262,1285 -1302,1331-1367,1392-1436,1461-1587
  Gene Ontology: Mol. function=protein binding; Cellular component =actin filament; Biological process=actin filament organization
atgattaagttgttgccaccacctcctccgccaccaccaatgccactgccaccgcctccggtgcctgttccgggcccggttatgccacttggaccaccaccatgtctgccggtaattaattagcgtgaaaataatcgcggcttaattaatcgtcaatgtataatgtttttttcaggtgtgtcagccggcctgtacaattcattgcattttcccgcctgctgctgcaatgtctccaccaattatgcagatgccaccttttgcttcacctgtgccgttcccgccccctcctccgccaccaccaccaccgccaccgcctgtgccaatggtcgcacttttcgtaaacaatgtttttattattttttagttttggcattttatttaattatttattgtcgctcctctccccgaaaaatttgtctgcataccgaagacacgaccttgaaaatcattaaaaaagcacaatgccaattgagaataataaaaaattcgatttgttttaattttgcataagtctttaatttttccaagaaatcctttggcagtttgacatctcttctaacaaaaatttaattaatttcgaaatattcggcatttttcaggcacctcaaatgccgtgtgcacctccttgcatgccgacatgtgctccagcttgtgttcaggtaaaaaaaaattcaacctaattaattactaaatttatatatacactcttttttcctgtactttttagcattttatttttggataaatccaattaattatcattaattgatttaaaaacaaattaaggaattcccaccaattgtctttccaccaccacctcccccatcaccacctccgatctacttacaaccaccagcaattccaccaccgccaccacttcccttgccaccaccgcctccagcgatcatgccatgtccggcaatgtgtcagccgatggtacaataataaacatttctctaattaattaattaaatttttgttctttttaattaatgaaattattcaaaattcaatgattcggattatttattattttgtaaaggaatatttgaaaaataatctctgactgttggttttgatacaataagatgatgtatgtcttaaaagtatatattggggtgtaattgttgattgatcatttcaaaataaatgccacacacaaaaattacaatataaattaacaaattttatttaaattttgaaaaaattttccacacggacgcttcatgacttcggcatatatctttgatacccaaattttttggaaatttcaaaatgcctatttatcctaaaaatttatggaaatatttaatttgaaaattttattttagtgcatgcctcaatgtatgatgccaatgcctccacctctaccgccaccaccgccgccacctatggcaatggcaccgccaatgtttgttgtgccacccgcgcaatttgcaccaccaccaccgccgccattgccaagacttcctccaatggtgggacaattaattattacgagacaaattattgctaattaaatattaaatgaaggcattaatggcaccgccgcctctccctccaatggaatgtgttgcacaatgccag

SEQ ID NO: 51946 - DNA, 651 bp, Heterodera glycines
  Genomic contig location: Contig_ID=SeqID_21344; Location=384..1034; Strand=+
  SCN-specific regions: Sequence locations=1-427,463-651
atgtgtcttcacgctaaggtcggccacaaattttcgtgcaagtgcaatggtcacggattggccctgcgcagtggcataaccgacgcaaaatgtgacgatggcaaatgggaaaaggtactgcttgaacttgacggcgtggtgcaacagcatttttgagatggaaatgtgctaaaaagtgaaatatgtgcagacaatataaatgtgtctgaaagtgccaaaaatactaaaaattcttatggagtggcaaaatattgttagaagttttccacactagctttttattttttgattgaatttaagcaaaattttattgttaaactaaatgatttaaattttaagctaaatgatttaaatttcaaaaatgcccattcatgcataaatttaccaaattgtaataatttgtgcaccaaaatatttgttactgtgcaagaaaatgctaaaaaacatttctaaatttaaaacgaagttttcccgattattttttcttgtttgggtgattaagtgagattttataaaatggttaaatatgcttgttttaaatttcaacttccacattgattttttttatttttagatgaattgaagcaaatttgcaaaatttctacttggtttaaatttcaacttttcgcaaaattttattgacaattaaaa

SEQ ID NO: 51947 - DNA, 526 bp, Heterodera glycines
  Genomic contig location: Contig_ID=SeqID_21345; Location=513..1038; Strand=-
  SCN-specific regions: Sequence locations=1-73,105-159,181-405,427-526
atggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaaatcgagaaaaattagtgggccaattttcaatttttgcatggtcgggaaaaaatactaaaaaattgaataagcaaataaa

SEQ ID NO: 51948 - DNA, 789 bp, Heterodera glycines
  Genomic contig location: Contig_ID=SeqID_21346; Location=781..1569; Strand=+
  SCN-specific regions: Sequence locations=1-295,317-596,619-757,779-789
  Gene Ontology: Mol. function=guanyl-nucleotide exchange factor activity; Cellular component=actin cytoskeleton; Biological process =transmembrane receptor protein tyrosine phosphatase signaling pathway
atggccatcgaattgaacaacaacaacgcatgtgcatcaaccgaagaggacacaagcagttcaccgaacgcggccaatttgaccggcacgcccagcggagaggcaatgagcggcgaggaaagcgcacgactcaaacgaaggttatttttgcggatgaaacagttcaatcctaaagaaactcattgagttggccgatgcgtcaataagtaaaacttaaaagaagcttttaaatgtttctgtggtttctgggtggcaatggacccgtaatcagagatgggggggaagcattcctatgaaaaagtgaaaggaaaaaactaatttcctttgattttttcggttgtcataaaaataatacttttgagtcttttatgactttttaatcaaattttcatctctctggacctattacattacaccagagtatggaaaacaattgtgctttttcgcatttaatttctatgcattttcccttttcttaattttttacctgaccatagttttttctgcaaaaaaaaattgaaattttttgttcagttatgttctgcaagaattggtggagtccgagcgcacttacgtccaggacctggcctctatctcaggttctaatcccttcgaatgccggacgaattcggaaatcgcaaaatgcgctcctttcagacggttacatcgcctccctgcgggaaatggaactgagcgacgaggacagagagaaagtgaagatcattttcgccaacatcgagcagattctcgactttcacaaaacattctttttgaaagaaattgaaaaga

SEQ ID NO: 51949 - DNA, 657 bp, Heterodera glycines
  Genomic contig location: Contig_ID=SeqID_21347; Location=268..924; Strand=+
  SCN-specific regions: Sequence locations=1-314,345-534,572-657
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaaaaagggagatga

SEQ ID NO: 51950 - DNA, 816 bp, Heterodera glycines
  Genomic contig location: Contig_ID=SeqID_21347; Location=793..1608; Strand=-
  SCN-specific regions: Sequence locations=1-495,532-659,686-770,808-816
acaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattttgcaaataaataaaaacgaaagact

SEQ ID NO: 51951 - DNA, 910 bp, Heterodera glycines
  Genomic contig location: Contig_ID=SeqID_21348; Location=805..1714; Strand=+
  SCN-specific regions: Sequence locations=1-220,242-732,754-844,877-910
gaagttttgcaaatcggcgcgaaattggccacggattgttggcggagaaggcattgcgccaagtgatgcccgagcaattcccgtacaccgtccgactggcgtgtcaggtcattttgagaccggacagcgggggtcggagaggtcccgatcaatccctagaatttaaaataggctcgggacggatctcgagtcggccagccctgggagtgtcagggatggatttatagcaaaaaagcaatattttagggtaaattaaaaaataatttaaccgattttgtataaaaatgggcccttttggttgtgttctctctctctctcccactttaattggctttttcaggtcctcgagtccaatgggtccacctcaatggcctccgtttgtgccggttctttggcactttttgacgccggcgttcccctcctggccaatcacgtggtgggaaaggaaatggcaaccaaaaaagtttttttcatttttaggccggcctggcacttggacttttcaccgacggagagggaaagcggtgattaattaatatcatttaaaactccaattataacttttttttaaatcgaatcgttttttttcgtttagcaccgagtacactctgatgaccgatttgatgggctacgaggattatgccggcgacatggatctcaaaattgcgggcactcaaacgcgcttcaccgccatgcaaatggacctcaaaatttgcggacttcctttgaggtgacaaataattaacactaaaaatcggaaatccgccttaaaaacccatcggaattgttgccaaattttccatgtatttttagtgttcttcgcgacgctcttctccagggcaaaaagggcattgtccatctgctgggactgatgcgcgacacaatcgcggaaccacggtttgtgcaataa

SEQ ID NO: 51952 - DNA, 995 bp, Heterodera glycines
  Genomic contig location: Contig_ID=SeqID_21349; Location=60..1054; Strand=+
  SCN-specific regions: Sequence locations=1-271,293-467,490-625,647 -718,740-995
atggtgggtaaactaagggaattggccgatccttaactaacttgtaaggaaactgataagtcatagacatcaatttccagttggaagtatatgagggaaattcagtaaataattttcattttgttatccctaactataaattactcttttttagtcaagcggccgcgctcgcagagaaaatggctcattttacattattgtcgaggagcgaaatcacgctaaccttatggaaaagcttgaagactacgctaagatagaaaaggtgttttaattctgtcttcattaattttctctgtccctttagtttattatggaccattacaattcgggcaatgaaattctgaatgaggctgagataccccaaaatgtcgacgatttggttccaccgtatgtcgttgatttgccttcaggaaaggctcaagtgacacttagcggcgcaattccacttataaatcggttgcattttcacttctttttgcattcctttttctccttccttctcagatattgttccaaattgccttctgatattttcacgcgattagttccccattatgtcgttaattccttacaaaatgccgatggaaagtgttcttattttgcacaacttcttcttccgatcaattcgccgttaaaacaaagtatttgttcggatgcaaattgccaaattggtgaaacaagcgctgtttttgcttcgaagtcattggcactaatgtccgttgcattggaggtgaatgagtcatccaaaagcttaatattgtaagcaaaatattaataaaaagttttaggcgtgtagaaaattgcatcggcaaaaagaactgagtgatcagttgacaccaacgggaaaagaaataattaccaaccttttcggggaattggaagacgaagaggaatacttgccatatttgatcaacaaatgcggaccttcaaagcgacgacgcctttacgaccgaaaggtttggacagacggtggggaaacgttagaaaatgtttaa

SEQ ID NO: 51953 - DNA, 783 bp, Heterodera glycines
  Genomic contig location: Contig_ID=SeqID_21351; Location=382..1164; Strand=-
  SCN-specific regions: Sequence locations=1-45,69-593,616-631,654-783
atgggcacgatcgtcaagcgcagccttcgcgcaaaagccatcattgggctgctgcagcgagaggtaagcaattggacttgaatttagctttgatctgactttaatttctcattgtcttccaacaggtggtgttgagcaggagtgcactcgaccgcaccaaagccaagtttcgaaagcgtaagaacggattgaaaagtgatctccgtgcaacgctcaaaaaccttggcgcggccgaagacgaccttgctgcggccgaagacgacctggctgctctgagagctcgggccgctgctctacacaatgtaattttttttccttattaatatacaaaatgtgcatttacaagggtagtacccatgtaaatatacagttagtacagggcttcttttgcaccatgtaattatctataaataaatatgtactaaatatacatttacaagggtaccaatgtaaatgtacgttttgtacatccttttatttgtatttttaattaatggttttcagcaagtgcaacagctcaaacagatcgctcctaaggctaagctgaagaagctcggtctcgcagacattggcccggacctcagcagcgaaagcgaagaggacgaggaggaagagaatgcggccgacaacaccgagcagcagcagcaggacgatgccaacgacaatgtcccagacgacctgacaatcaacgaaagggccgatgcagctcttcggacgctgatgcctcttacgacaagcagggaaagtcgtgccgaaaatgccactacccaatcgacgttctga

SEQ ID NO: 51954 - DNA, 678 bp, Heterodera glycines
  misc_feature (22)..(22): n is a, c, g, or t
  Genomic contig location: Contig_ID=SeqID_21352; Location=855..1532; Strand=-
  SCN-specific regions: Sequence locations=1-678
atggcttttgctcagtttttgnttaatgcaagcttaagtctattgaaagcaccgaaagccacgattaccattgcgtggaaaagccaaagcattaccgatgttgaaatcgagtgctatgaagtgcagtacaagaatgtcaatgaagtttggaagacgataaagtgtccgcaagttagtaaacaaaacagggagtgcaagcaaaaaggaaggcattgcatagcaaaaaaaaactgggctaagcatcaccacacaaaaaatgactgaaaaattcggtatgaagaaaggaggggggggggggttggggtggtcgagcccgaagccgccctccccatttcggcgcggaaggccaaaaaataaaaacaattgcaaaaatatcctcggtttaaatggatcaacccatttggcacatccacggacaaactttttaaatcgcgaaatgccgcgtttttcagcacgcgtttctcccgaaaaaatcttacaccgcagtcgtaaagaatctgaagccggcgaccctttacgcgttgacagttgtggcgctaaataagcatggaaatactgttgatgttttaacaatgagccccgtcgcaactaagcctcggtttacgtgatttgcttgttttctaaatcctaatttatatctttgaattggtttgttgtcttttgactctcatcaataaa

SEQ ID NO: 51955 - DNA, 150 bp, Heterodera glycines
  Genomic contig location: Contig_ID=SeqID_21353; Location=672..821; Strand=-
  SCN-specific regions: Sequence locations=1-150
atggaagaaagaataatcgagaaatttgaccaatttaaagaagagatggagcagaaaataacaacgaaatttgaccaaatatcaacgaaattggacgaaatgaaagacgagttacgccttgaatttaaccaaaaattcgacgctttggag

SEQ ID NO: 51956 - DNA, 925 bp, Heterodera glycines
  Genomic contig location: Contig_ID=SeqID_21356; Location=377..1301; Strand=+
  SCN-specific regions: Sequence locations=1-342,444-514,540-619,644 -686,780-925
atgagcctgttgtggcttggtaaggagaacattccgccttcgtttgagaagcatgaaatattggtgagttgtgagttagtccaattaaaaagaaaataacaattttttttttggtttataattcttacgaaaagtttgaatttttttttaattttgggaaacatagaaaatcatgacaatagggacgaaatttattgtgttatccatggtccactatactaaaaattaaaaaagcttaatccatgcatgtagcgagaaaaaaaaccattttggaggaagaattcagaagttttttgttgcttcaagaaatttaattttggacaatttttcacaaatttttggaaaaaaaatttgaaaaaattttttattattcttttttcctaataattctaaaaatttctaacaataagtttgtaatatttaaaaaacaaaattttttttttgggtgggggagaaatttaatacatccaccaaaaacaaaatagtaataaatcgaaatttttgccgaggtttcaaaaaaaaattttttttttttttttgtagttgaatttttcgtctggcactgacaacagctccaccggcgccgccactgcctcttcgctgaacagttcaaattcatcaacaacaacaacaacaaaaacaagcgccaatgatggagatgaacagcgaaggattaaaaggaccaaaacaatggcaacgacgacgaccaccactgacagtggaaaaagtagcagcaaaagccgaacaacaacaacaacaatcaacacgacgacgacgacgtcgagcagtacaagcagcagcaaaaaattgttggtggtggatgaaaatgcaaaaacgtgtggtggtgttggcattggtgctgatgggtaagaagtggttgttacaaaaaaaatggaaaattggaaaaaaaaaattttttttttga

SEQ ID NO: 51957 - DNA, 565 bp, Heterodera glycines
  Genomic contig location: Contig_ID=SeqID_3806; Location=420..984; Strand=+
  SCN-specific regions: Sequence locations=1-84,110-379,409-565
atgacaagcgacgatggacaagcgtcactatcaactgttcatcaacgaaaaatgacaacttcaataaagacaactgaacatttgtccaagaagaagaagaaaaaatgtaagaagcacccggagaaatgtcacaacggcgtctactaccacgaccaccatgaccatgaaaaaaaagtacatataaaattttaattaactatagaaaaaatgtggtaatttttaagggatgttgctgatcagcttggacgtaatgtcgaggagaatgaaaaccaatgcagaaaatgggagaacagcagaactttcggattttctttttgggtggataaattttatctttttctttccgtagattagcttattccttcgctttttcctatcgataaatttttcaaaattatttaattatttgataatgagaagcaaacgataaatttattttatcgattttttcgggaaaatccttaaaaattttcgtgttttattttaggtgcgattatataaaaatgcgagtaaagatcatcatctgcttaagattcactgtccctcaaaaaccaacaaaacagta

SEQ ID NO: 51958 - DNA, 1934 bp, Heterodera glycines
  Genomic contig location: Contig_ID=SeqID_3807; Location=67..2000; Strand=+
  SCN-specific regions: Sequence locations=1-113,135-589,619-834,924 -995,1034-1297,1319-1501,1538-1810,1835-1934
atgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatttgacggccccaagggtaaaactaataagagacaataattaattaattatgcgatctcttaaggtgatcactagggacgtgaattttaggttttaactatttttttcgctcaattgatttgaagaaaggagctcaaaaaacgcatttctgcattaaaaattttcgattctgatgtcattatcggtcactagaaatcactattttggcaatttcgtcactaaaatagttaaaaatcactattttggcgttttgtcactatttttcactatttcgacattttttggaaaattctttaacaaaaatgcaataaaaccaaaaaatacacccctaagaatcgacctaaaattttttaaaaaaatacacccctaagaatcgacaaaaaaaaatttcaaaaagcactcctaagaaatgaaaaaaattttctcaaaaaggtattttcgtggcaagaattttaattttaaaaattatttttttatgtacctattgtgtttttttgcccttacaaatagggttcgagccccgcccccgtcacccccgcccccgccggggtcgggacatgttttttgggctcacccccttccccgcccccgtgactcagaccttgcaacccccgcccccgcgaccttcacccccgcgggggcgcgggggtgaaaatacacccctaagaatggcatattcgttgaattaaaggcaaaaatttatacaattttgaattttttaatcatcttttacaaatttttatgaaataaagtaaattttgcttatattttttaaaatatttgtggtttagtggttagtgcttcagcactaatagaaatctttgttatgagttcaacgccggttgacgttttccttaaataaattttttttttcctttaattaattttttttctgattaatacagggtttctttatgttcttgtttctaagtgttctgatttgggagtaaatccttattttcatctaaaaagaggaaaacttctgaaaaattttgctaagttctaacaaaattcatataatttcttaaaattttcccctggaggcgcctataggcaccgccgtcccccaaaattcctatctttttttcttaaaaattagccaaagatcgaaaaatttgcttattttttgtacaaaatttgttaacaaattgcattcaaattttcaaaaaatttccccggcggcgcctgtcggcaccgccggacctctcccctcgcacattcagcaaattttttggaaaaatgtaccgcaagaaaaatttaaaaaatctgagttccaattttccttgagtaaatcatgattagggctgctaattttatgtaaatacatattttttcctggcttctccatagcctaatcagtaggaaaaacactttcttttttgtgtttgcaaacaaaagtttggacttttatttacatattttagtagatattttgcaaatttgaatatctgttagaaataaatttaaaattcgctcctatcggcacgccggcccccccccccccaaaaaaaacctttttttcttaaaaaattacccaaaaatcgctaaatttgattatttttagtcaaaatctgtgcaatttatgtcaaaataaatattatcaaggcgatcaacgaataaaagaatgtggagccaaagaaattattcataaaaaatattttttttgtgagatttttggagctaattcaaagcaaacccccgcccccgcccccgcgacgcggaattatcgtgcccccgcccccgcgaaaagccacccccgcccacggggctcgaaccctaataagaatacagaa

SEQ ID NO: 51959 - DNA, 600 bp, Heterodera glycines
  Genomic contig location: Contig_ID=SeqID_3807; Location=3839..4438; Strand=+
  SCN-specific regions: Sequence locations=1-109,178-536,558-600
atgtccaaaaatggaaaacagaagcaatttgcgaaagagttgggcattgacagaaaaacattaagcaaatggaaaaaagaatttggcattgaaatgagcaaaagtaaattttaatttaatttttcaaaataataaattaaattttaatttaatttaataattatttatttttaattttttaaggatattcgaatgaagagaaaatgagcaaaatgaatgattattatgaaatgaaaaaagcaaatccttctttaagtgacaaagaaattgctggcattttgaaaattggatttgccactctaacgagatggaaaaaggaaaataattcgtaatttttcgtttttcttatttgtattggtttcaaatgatgctttttattctaatttttgttttttataatttttccctcttttatatgtttgttttttaattgacccatacaaattaaaattgtcaatttctcttaatttttttttactgtttttcggtgtacaaaaaccctaaaataattgtcccaattttcttttccgccagcatataaatttcgatttgacaaaacatcgaccaaaaaaacatgattgagtaattgaatgcaaccaa

SEQ ID NO: 51960 - DNA, 1710 bp, Heterodera glycines
  Genomic contig location: Contig_ID=SeqID_3807; Location=5647..7356; Strand=+
  SCN-specific regions: Sequence locations=1-39,61-94,144-214,236 -342,364-493,516-809,832-906,928-1012,1035-1088,1124-1149,1173 -1240,1262-1542,1565-1710
  Gene Ontology: Mol. function=structural constituent of cuticle; Cellular component=extracellular; Biological process=cuticle biosynthesis (sensu Nematoda)
atgggcaaagaaatgcaatatttgaaggcggaggccgaatccatcagaaatgttgcaatttttggcgtttgcattgccacggtggccagtttggtaaaatttcaaaaatattttaatttttttttgaaatttaaaaaatttttccaaggtttgcacaatgtccattccgttggccgccctttactttcagcggatcagcgttcagatggaaggcgagctgcacttttgtccaatccgatcaggaaatatcatgcaagaagtagggaaaaactgtttatttactaaaaaaaatgaattaactaaaatgcgatatcgtaatcaaaaaagaatttaccgtaattccttaaagaatttaatcaaaagatggtacagtatttcctacaataaagtcccaacctcttaatttcccgcttctaaaataatatctccccctttttttttggggggggggggggtttcttactagctttctaaattaaaaatttggcaatttttgaaatttttgaaaattgtgacaatttgacgtttcacaaatttggctaccattggcattttgccaaatttcaccgaaccaacatttttgctcttacttggcacagagtttgtccaatcaaaaattgtgcaggtaacgcgcacccaagtgctgtccgatgtgaatggtggcgcaccacgggcgcccgccgcgggcgcagcaacgcccaagcagcgccagacgcgcagcgcccatcaccacttggacacggtgctgcgcaatggacggctcagcctatggaagcgcagcggctatggtgccgaaagtggaggcgttacaggcggtggcggtggtggcgcgtgctgcggatgcggcacctcggaacagggaccgcctgggccaccggtaggcgcgagaatttccatattttttcaaatttaaaaattgctaaatcatttagcaatgctttttaatttagggggccattggtgaaccgggcgctgacggacaaccgggcgcagctggcaatgccggcgaagacgcggcgccaccgccgccggcgccgtacattgagccgtgccaagaatgtgggacggcacaggacggatgtacgtacaaatttaatattttaaattaatattattataatttcacaattatttagcccaagctttggcatttaatttttttaaattttttagtcgagtccatttctacaattcagaaaaggccgtaaaatttcagatttttatgaaatatatgtatatgatggaaacatttatttcgatgtttctgtttttagaaaatttttgtcggcacttttcgctaagcgccgtcaaaatttttatttattgttgaatttttgaataatttacaaaaatttagtgcccgggccgcaaggcgcgccaggaccggacggacggccgggcgagcccggcgcgcctggcgagcgcgccattcctggaccccagggtgatgaaggcgcgccgggagtggacggagtgcctggaacgcctggaggtggcggtcaaaataaattttgcaaaaaaatttccaatttttcagagcctggccctcccgggcctcctggaagccttgaacaaggtgcagaaaattttgttttccttgatcgaaataattggaacaaaatgccagattatgccccaattgttggcccacccggacccccgggcgcaaatggacagcccggcacagacggaacgccaggcggtatgtaa

SEQ ID NO: 51961 - DNA, 417 bp, Heterodera glycines
  Genomic contig location: Contig_ID=SeqID_21358; Location=1678..2094; Strand=+
  SCN-specific regions: Sequence locations=1-116,205-209,232-236,294-417
atgccgcgggttgagaaaaatttcgggttcgggtttcgggtcgagtcaaaaaacctcgggatacgggatcaggttggcatcactgttgtgacaacaataatgttggattttgatggaaaaaaagaaattaaaaaaaataatattcaaatgacaaataatttttaaaaacatttgacaaattaaaaatgaaaaaagttaaataaacggcaaattgtaatttgtaaaggaaacaatagaataattttaaattttatttcattataaaaaaatgaaattttattacaatttaataagataaagcatccaacgcacacacgcacaaaaacttcagtgaacatgatgcataatattttaatatcttataatatttccttttcagttttaaatcattagtttctgtttggaatttaaagttta

SEQ ID NO: 51962 - DNA, 58 bp, Heterodera glycines
  Genomic contig location: Contig_ID=SeqID_21358; Location=736..793; Strand=+
  SCN-specific regions: Sequence locations=1-58
tgtagaacataaaaggtaactcgcccggtgggactcgaacccacgaccccagcaatcc

SEQ ID NO: 51963 - DNA, 552 bp, Heterodera glycines
  Genomic contig location: Contig_ID=SeqID_21359; Location=327..878; Strand=-
  SCN-specific regions: Sequence locations=1-184,207-408,430-552
atgcttttcgtctctttattggccaccttttgcttccaaccgtcgcgctgtgccttttttgacaagcatcggaaacggaatgccatggacaatgtcaacggggaatgtgccgaagacggatgcgtcagcgatgttgaagccggaagtggtgccgaggacggggatgaactgttggatgacgacgacgttcagcagcagcagcatttgaaaagtgaagaatcagagttcaaaatgttatgatcgggaaaaagtgatcgaaatttcgttttatttattttttcgccaaatttactcataattaaaaagaccattcttaaaaaaagctgtggttatttttcaatattctcttcataattaaggctttatgtttgattgactaaaacttgcacaaatgctagtcaaaattttctatctcttcatttaaaatgggacttttatgcactttggttaagctgccaattatctgacaaaaacgaaaatttaaaatccgggccggtggtttggaaacttgaattttggtacttatgcattttacagaccataaaaaataaa

SEQ ID NO: 51964 - DNA, 1286 bp, Heterodera glycines
  Genomic contig location: Contig_ID=SeqID_21360; Location=1008..2293; Strand=-
  SCN-specific regions: Sequence locations=1-195,232-371,394-395,436 -648,698-921,943-1041,1065-1258,1280-1286
atggatgggccaaaggcaactgtcatccgaatggcaccacaacagcaacacgggtgggctttaggaaatgggagggcggcaacaacaacgggagaactccctcatctcagacgacgggatttcatcggaaaaaccaaaaacatagccaaacggtcaacggcaggtgaggtccaatttcaacaggtgaaacaaatttagaagttaaagaaataaaaatttggaattttccttcaaatgcgaattgatggccgggaagggaatgggggggggggcagaagccgtacgcctttcctccattgctgtgcttcttcaaaacgggagaattccaaaaatagaaaaatgccattggaatttctcgccaataaatcgccaaataaaaacaaaaataaatttgcatatatttttatgtgcctttttatttgttgattttgctggccagtgttttgatatgtttgttatcacttatcattttctgtttgtgagtatttgcttttcgcatttattggagagggaaaatggccgaaaggtcagaaaaaggcaaatgaaaatgaacgaacggataaaaagaaggaaaatgaaaaagacggacggacgcaatttaataggggaaaatatggtaaaaaggcatgaaaatattgaaaatttggcaattttttatttattttaaacttactaaatcatttcaaaatatttttttcaacatttcgaactcatttttattcttttgagcaaatcggagagtgaaaagaagaaatcaaaggcttggtaaaacattgaaaaagtttcgactttgaaatcaaaaattttgatacgactaaggtaaagcatagaagaaagtgtaaatcatagttagtaaatttcggttaaatgtctaaatttatgaaaaagtcactaaaaattatagaataataaacaacgcatagtcaaaagtcaaacaaatttcaaataggattgataacatggttgttgctgtcctatttaagacagtttaagactttaggactacatcaaattatgggggggaaatatattaaatcagaatatgcaaaataaaaattaaacaagataagaaaaagctggtattattataatgtaaatagactcaataaaagaaatacaatgaatagaaaacaacgcaattatcgattttttaagttggcgttggaactgttcaaaaagggaacatacaagccaaaggacatgaaaaagtaagtcaatcaatgctacatattaattggcacttctatttttgagaaccaaaatttttgaaaatttaaagcaataaa

SEQ ID NO: 51965 - DNA, 178 bp, Heterodera glycines
  Genomic contig location: Contig_ID=SeqID_21362; Location=455..632; Strand=-
  SCN-specific regions: Sequence locations=1-3,25-178
cagaatggccaccagaaacaacagcagtccgtacattttgccccggaggacccccaacagcgcacgccctgggacatttattaccacaaggaatctgtcagcgctgcacatacaaccgcggcctacaccatttttgagtgggactatctcgaaatcctcaccacagccgttgcgagtg

SEQ ID NO: 51966 - DNA, 966 bp, Heterodera glycines
  Genomic contig location: Contig_ID=SeqID_21365; Location=1184..2149; Strand=+
  SCN-specific regions: Sequence locations=1-76,116-235,259-418,440 -560,607-609,631-692,717-966
atgctgctcaaattggccgactacttccaggtgagtcttctgatcacttatcacatcctcttttttctgtctgatcattttaatttaaatattaaatatttatgaaaaaataaatctagtattttgaatgagacaacgaaccgttctgtgatttttcgtaaaccaactttgtgtttttataacctttttctacctaactaaaattttttaatttggtaggctaattgggactattaattgccatcaaatgactcaaaacttgctaatgaatttgctatttctaaaaaacgaactgttctgctttgaggtgaccgcgttgaagtcgcgttgcgaaacgcatctgatcaattgcgtggaaatcccactgatcgaccgtttccttctgattgagcgctacggactcgaccatttgaaagtgattattatttaaaatagagttgagcgtgaccgggaattttgggcaaaaccgggaccttttcggatcgaaaaccaggaccgggaaaaaaccgagacttggtactcagttgtccgtgttttggtcccggtcccgctcaactctgatttaaaaaatttaaatttacaatttaaacaaattttaatttatttcccaattttagaattattttttgaatttggatgtcaataaattccgtgcctttttcaaggcgaacaatgaacagttgtttttggttgtcagcaaagaatttttgtgtgttttatttgtccgactttgtggatgaatttgttaaactctgctgattggttccggctttgatcaaattgattttggcatttccataaattttttttacaaaattcatttcgatgataaaaaaatttggttaattttgggcaaagttatgaataattttcggtcaaaaattttccatttgatggttttttgagtaacttcttacaattagcaccaacgataagtacaatacatgtgaatagaccagtgataga

SEQ ID NO: 51967 - DNA, 378 bp, Heterodera glycines
  Genomic contig location: Contig_ID=SeqID_21365; Location=2297..2674; Strand=-
  SCN-specific regions: Sequence locations=1-39,61-108,141-163,185-333
atgggagtgaatatttatgatgcatttgtataaatgtcgttaaaaaagttaaatagagaattcttatgggaatataaattaattttgggacaattgcactttaaagactttaaaattttaaatgtttataattttatattggagatcggtattttgaaaaaagcctggacttggacctggatttcctggacaaaaatccgggaaaatccaggtccagaaaaaatccaggctcctcgggacctggatccaggaaaaatccaggcctggacccaggtccatgccgatctcttctattatatatgaccattgtaaaaaacatagcatgttcaatgctttataattttgttttaattaagaaaaaaattttgtaaaattaaa

SEQ ID NO: 51968 - DNA, 356 bp, Heterodera glycines
  misc_feature (35)..(35): n is a, c, g, or t
  Genomic contig location: Contig_ID=SeqID_21365; Location=2770..3125; Strand=-
  SCN-specific regions: Sequence locations=1-8,31-243,273-356
atggatgtagaaattaacttcactgccctttttgnagtatttgggtctaaaataatatttgttaggtaattaaattatacgcttgatcatttctttaatacttcattttgatcccatttccaatggataatttgtgccaatggttccgaattcgacggattaaaagcatggccaatgtccgtgattttcaattcgatgatgccaaagtgtttgacattaatcataaattgactaaattctttgtatattttaaaattacaaaaataaaattacagtgcagcaaattgggtgacatcacggaatgaatagatgccaatagaaaattcactcatcactttttcgtcaacaacaataaa

SEQ ID NO: 51969 - DNA, 2411 bp, Heterodera glycines
  Genomic contig location: Contig_ID=SeqID_21366; Location=17..2427; Strand=+
  SCN-specific regions: Sequence locations=1-540,562-739,761-834,856 -1039,1067-1168,1192-1193,1244-1396,1418-1671,1693-1902,1924 -2069,2093-2372,2394-2411
atgcgttcattaggctcatcaattagtgcaaaattgacgccaatgcattcatttgatgcattgatgagcgcacaattggcaccgtcgcactcatttgacactgctgccgacctaattggtcataatcactcatttgatcaaatggacagtaaaaaagcgggaaaatcattgatcaatgataagaaacaaaaacatattgaattggaagctgatcaatttgtggcttttatgttgaagaaaatgctgaagaaagtgccagtggaatttaaagaacgattaaaaattgtaagaaaaaattgggaaaaaattaataaattgcggataatttttagtttcaaaaacagaagagaaataggacacttgctgaggaattgagcaatttaacgtcgaaacaaaatctactgatgcttctcgaattgtattatatggcgaattctatgggtgaaatttttctaaaacaaatcgctgcaaatgatcagacggatttaagaagattcggaggaaaaaactctctgatcgattttgaatattacgaagaaacaaaccaaaaattttcaaaaatttaccaaacaattcttataaatgagccaactaaaaaaagtgccaataaaatgtttccctttcggagaacgaaaagcggcaaagccttcttttggttcaattcccataaaacgtttttggtggctaatgaatggcgcgacggggcggagaatattttggaatggaaatttaagggtaaatttgtaatttcatttttaaattgaatcgaatttagtcaaaattgcttctacaaagcttggtaaaataatcagaacaattggccaatttatcaggataaaatgtggcaaatatttgtggaatttggacgaagaaacggatgaaattcaaaactgtgcaaaacaaataaatttcagtgaattaaaccaaattttcttaaagaaatttgccaaaaacaatgaaaatacgttgggtttgcttaatttggtaggaaatttattaaacgtcgaagcattaacaaattcggacacaaatgaaaaggtattaattaataaatatttttaaaattggaattgattcttagggatgcttttttggtttatgtcgctttttgttaatggatttagtgaaaaattctatttttaaggttttctgtttggaaatcttaaatattttggtcattttttggaaaaatctattaaaagaataataataataataaactttttagtaatattaaatttttccggcttactttggcatcatcggctctttgttttccatgctttaaatgctaaattttacaggtttcttctccttacagtgaagacatttttacagaaattgaaagttatgaacaaaaaattcacattctcaacggacttcttaattttggccgtttatttatgaatagttttttggctttagcgatgaaaattacggaagaaaatcgaacaataaattggaaaaacatttcaatcatattcactcggaacaaaaacgccgaagaggaaaattatttgttgaaaaaattaatgatagaaggtaaataaaaaaggaatctatgagtaaatggtaaatttcctcctaattacaataccttccattaaaatgaaaaaaaatattacataaattaatcgccagtaaatcaatttaaaattcttaagctggtttaatggaagaagcaaaggaaaaagtaagaacataatcatcaagaagttaaagagaattcgtcgacaattttttcgttctttcggatttcatttttaaatcgccaaaaacagtaagtaatttacatcgaaattacattgtaaaatttagtgatgtcataaagaattgattcgacggtggttattgttaaaataatcaaaaatttacacgtcaaaaccgcgtcctgattaaaaatattatatttcccaatttttgtcgtaaaaatatattattgagagatttcgtttttttatatacagattgaaattctttggtatcttattcgaaaatctggctggtatttttgtatttggtaattagcctagggaggaggaattcttattaagagagaggttaaaaagtagaatttttgagaattttttaaaggacgttgttaaatcttgaattaggtgaactatagtgaacgccccacttagaaaaggttaaatgatattactaatccagtggcggaaatagctttgaacctagttttaaaccggtttaaaactcgaaaaacgaagaggaattggcactttagcttttttaaaaattcgaaccctgacatttttgttgtcattcgaattcttgacaagctaaacgtaaaaaatcagggtaaagtcgaaccaatgccatctgctgacaatgagagattctgaaccggtttaaaacaaagaaatttagtgcaactaatgccaaatttgaaa

SEQ ID NO: 51970 - DNA, 346 bp, Heterodera glycines
  Genomic contig location: Contig_ID=SeqID_21366; Location=2618..2963; Strand=+
  SCN-specific regions: Sequence locations=1-346
attatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaa

SEQ ID NO: 51971 - DNA, 1180 bp, Heterodera glycines
  Genomic contig location: Contig_ID=SeqID_21367; Location=854..2033; Strand=-
  SCN-specific regions: Sequence locations=1-502,524-1094,1118-1180
atgcccgcgtttgctggtggtggaggatttgttgtctctccaatgaatgccgttcaaaatatgcaccattcgacgaagaacaaagtgacaattggtaagtggaaccgaaaaaggacgaacgaatcgggaccagttcatacaaaatcccatgaaattcgtccattttcaccaaaagatgaaaaagttggaaactttcccgtacgaatgctcgtaattttggtctgttgtccttcttttccatccccatttatgggtattctccccttttcccaggtgaaattgtgcaaagtggtcgaatacaaaaaaaaattggtcaccaatttaaccagtgatgaatgattatgcggagaaaatgaatcttttggggaattagttacccgcacgaatttaaggtcatctttcccaattttgagcttttaattttcagttttcgtcatttcaccatttctctaattctaggtccgatttgctcgagttggtcattgatttggagtcagtcaacagacttttccgccatttatttcgctgcccttcactcccattacgccacacttttacctcatttgagtgaaccacagccatcggatagaccagaatttttgcgaaagcaatgcaacacgacggcataccaaattgtgaagcattggtaagtaagcgaaaaaaagggcgtggagggctctgacaatgtttttttgttattattaatttaaccaaacttcccgctcattgtcagcaacactgaactgagcgtgaggaataaaaggacccttcagcttatcacttctttggcctccttaatgcttcaggtgggtctttgccaattgaattggtctcatttctcgtcatctttcagcttagaacaatcggcgctcaaaataaaagatttacttgtgagttatctcaaactagcttcgtttttacatgtttttcctttagcatccgatatgaacctcctaagagaatcaatgaagcaaattcgatcgcaaattatgccacaaaatgcggctgctttccaagactacgtagaagtacacatgaaacaaatatttactaacagaggatgaatgaggtgcaaagtttcaatgtttgaattgtattatgtcacaaatgataaatgctaaaaagcgatgtgttataaatcattttctgatttgtcgaattccgagagatggaaaataaa

SEQ ID NO: 51972 - DNA, 430 bp, Heterodera glycines
  Genomic contig location: Contig_ID=SeqID_3810; Location=213..642; Strand=-
  SCN-specific regions: Sequence locations=1-1,23-430
atgcttttcgcctcttccgtcttccgcttctttctccgtcctcctccaaagcgttattcgtccttcctcctgaacacaatgtggagccctctcttctgtctgctggtcttcgctggtttggccgcgtgttgcgtttgtgagtcttttcgtccgtttcgtggcactttccccgcttcagcccttccacagattcaatacgtcaatgacaagccgtactatctgatgcagaacatggaatgtcgaggaggcaaaatttacgagatcaatcaggtccaggtaaagtttaatgggcctagttttcacttttgcttaattcgaatgcctaaactgaaggacatcgacgagtgcaaggcggcatgtgtaactcggaattgccgggcagtcaacctcttccagctgggcgagttccaattcaaatgcgaaattttgg

SEQ ID NO: 51973 - DNA, 398 bp, Heterodera glycines
  Genomic contig location: Contig_ID=SeqID_3811; Location=1..398; Strand=-
  SCN-specific regions: Sequence locations=1-87,109-158,194-197,223 -258,280-291,338-358,384-398
taagctgatcgcacggtcttgtaccggcgacgtgtctttcaagtgtctgccttatcaactttcatatggtaatgtatctgactaccatggtgatgacgggtaacggaggataagggttcgactccggagaagggacctgagaaatggtcactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagaggtcaagtctggtgccagcagccgcggtaattccagctctcataatgcatagaattattgctgcggataaaaagctcgtagttggatctgtgctagccgtccggt

SEQ ID NO: 51974 - DNA, 1463 bp, Heterodera glycines
  Genomic contig location: Contig_ID=SeqID_3812; Location=300..1762; Strand=+
  SCN-specific regions: Sequence locations=1-567,589-943,965-1463
atggcttggggtttcttctcgcgtccgcttggaacttctacgccctgttctgatgtgagtttgggttgttttttgtttcattgggttttcttttttagaccggcgacaaatacgttggctacgcttccagcaaatacaaacgccactcgccctctttcgaccaagcgactgttcgtttcttcgacaccaaaaagatttctccggacatttcgcgttggattgcccatgcaattgttgcgttttttgctctgctttttttcacttatattgcaaaagcgcactccgagaccgtctccagcggaatttcgcttactgctggttatttcaaaataattcttgcattgtttctgaccataattaaggttttgctgtgtccacctttcgatttctttacaactacgcatttattcccatcattggaatttgcatcggtacttccttttctcataatactgaagaactgttttccggcgcaaaagtttcaaattattctaatatagaaaagttaaatttgtgaaaaagcatagacatagcaaaacatcaactcgaacccataatcaacgaattttttatcctaaaaataaaaagaatttgtttttttttgtttttgccataaaataggttcttcagtattaccctttttcttacaattgtttcattttccattttcagttggacttttcatttttggcatttacaaattggcttcgttccgtaattatcgaaaggttgaagagaacagaaagcttattctgttggtcgaacgtatcactgacatcatttacgagtcgggcacttccggcgttgctgagccgcacgtgcgcgatatgattatgccgcctacgaagtaaggaaggagttcgagatttacaagtcttaactgaaatcactacgacccgttcaaacaatcattcgtgttttaaggcgttcggaagaggaagccaagcgatggaaggaggcggcccgtttcatcaacaacgaggactcgcgcattcggaccgaaattcgtttgataaatgggaccgagtgcaacgtgtggatttgggtcggggcaggaaaagaacgctggcagggaaccggtaattgaaaacatagggagaagaacggaaaaagccggccgcaacaaaccaaaagataatccaattcaatgttatgtcttttttgatgctaacgatactcatttgccttcctttatttgtttggttttttaaggcacgtagccgttaaatccaatgctttttaagctaattgtaagtttcaaatacttgctgccggctacgagccttaaacattatgattgttttgctttgaatgttccgtttattgtcgagaaataaatttcaaaaaaaaaacattttaaacttcagcccttctcgaggggtcgcctatggctcgggtacccgaacaagcattgacgcgctgtttgaagttacgcggagttaatttttccccgaagtgagata

SEQ ID NO: 51975 - DNA, 90 bp, Heterodera glycines
  Genomic contig location: Contig_ID=SeqID_3813; Location=399..488; Strand=-
  SCN-specific regions: Sequence locations=1-90
gaatcatccggattgcgacgaaatcaccctactatttggcccgtaataccgagcatgaccctccgtattggcgaggaccaatttggataa

SEQ ID NO: 51976 - DNA, 109 bp, Heterodera glycines
  Genomic contig location: Contig_ID=SeqID_21370; Location=2098..2206; Strand=-
  SCN-specific regions: Sequence locations=1-109
ttttgatgccaccaatcagcggaaatggattgcgcaatatgaaaataccaaaggaatttgacgggacagaagggggagaaggacgggacagagaaacggtgtggggcgg

SEQ ID NO: 51977 - DNA, 1084 bp, Heterodera glycines
  Genomic contig location: Contig_ID=SeqID_21371; Location=420..1503; Strand=+
  SCN-specific regions: Sequence locations=1-153,175-322,344-345,368 -559,581-786,817-946,970-1039,1061-1084
atgcatttcatcgtccggctcgcgcagcacagtctcgcgcacggcgtcgcccgcactttcttcgacttcgtccaatgcctcccgaagacagaggaagaattacaacaaaagtggacgcgtaccggtaagaaaaaatttgcaaattcaagccaaacacacacacacacacacacattcacttcctagataaatgtgaatgccgattgccccaatgttccgcccggtgtactgccgaacccaaaaactcgccagtaccaggtcaagagcgttttggcgcaattcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccacttttggaacggaataatttgagggtgtgggccgagttaacacagtttagcttcgctacctctcttgctatttcactttaaattttctttttctttttccattaaccaatccattttcttctctcattttttctcgcaattataggctttcgcggtcgcaactcatggtgtttgtcggaggacaccgactgtacagagtacattgaaagatttgggacagtggcaacagtcgacgcggtactctctgcgctattgggcgaaagcgtcccagcttcgatagctgatgagctccaggccaatcctaaatttggacaaggtgtggagagtgaggggaattaaaaattgcataattttttgtcagtgttggcaaagttcgatgacattgaagatgaattcatattgcggacaactaagtataatattttgttcgcaaaagggcttatggaaagcgccgagggccaaggaataattgaggatgtaagcacacaaatgcactttttaatttaaattatatatttcctaaggcgaagagtaaactgggacgcttcgtggcaaagtgtatgagctgatgagtgcactggccggccgaattgaacattttcaccatttaaatttcaccatttaatttcacca

SEQ ID NO: 51978 - DNA, 543 bp, Heterodera glycines
  Genomic contig location: Contig_ID=SeqID_21372; Location=839..1381; Strand=-
  SCN-specific regions: Sequence locations=1-543
atggcccaattcaacgcaatgtttccaaatttgaattcgtccgtcgttgagtcagtgctgcgcaattgtgacggcgatgtgagcagaaccatcgatgaattattgcgacgaagtggccaagaagaaggaaataattcggagacggatgaacggcgaaagagtgtgtccactccgccgagggaccaatgtgccaatgacgagaaaatcgctttgctggtccaaaaccgcgagtttctgaggtatctccgtcgcgacccaaacttccaacgtgaaatgctcggccgttccaattcatctgattatcgacatcggcaccattcttcgactcatcgaagtcgcaatttgcccgttctattaacgtcgtctcgcacttcccaatcgcctaattcaatccgtttttttcgtacatccgccgatgttatgaccaatccagcggaagattctgtgggacgggttcctgaaggacctctcgtcgaatttcagacatcggagcaagaatgcaattcccgaaggacctttgattgtaagcgaaaagaagagtaa

SEQ ID NO: 51979 - DNA, 480 bp, Heterodera glycines
  Genomic contig location: Contig_ID=SeqID_21373; Location=1219..1698; Strand=-
  SCN-specific regions: Sequence locations=1-162,184-306,343-376,407 -425,447-454,477-480
atggtttgcgttttaaaaatttttaattgctccattcaaatgtttgttactattattcattattatcatattttttcgctttaattttcaaataaattttttaaacttttgttgtgcgaatttcgttgagaaaattttttgagtttatttataataatctttatagaactaattggtggcaactcactagttagtttgttttattttgttagataatatttgccaacttgattcaaagtatatttattttttaatgaacttgctcataagtcgaagaaacagtttgatttttagtagatcatatcgataagtatatattttttgtatattaatttactacactattttttttaattactcatatttattggtgttgtttttaaaaaattatacaaatttatttttaggtacagttaaaaaatttcataaacattcattttcaaacaattgaaatatatattacttgctttaaaaaataaa

SEQ ID NO: 51980 - DNA, 118 bp, Heterodera glycines
  Genomic contig location: Contig_ID=SeqID_21373; Location=213..330; Strand=+
  SCN-specific regions: Sequence locations=1-118
cgaagcggccttaatagcccaacaaatttagaaacgggcgcgaagcgcccgtataagcccaacaaaatttaaaaaacgggcgcaaagcgctcgttcgaggccgcgaagcggcctaaaa

SEQ ID NO: 51981 - DNA, 726 bp, Heterodera glycines
  Genomic contig location: Contig_ID=SeqID_21373; Location=2085..2810; Strand=+
  SCN-specific regions: Sequence locations=1-90,112-115,166-308,340 -469,494-584,606-684,707-726
atgcgacgacctttttttctgggaatgagcttcatttgtaggaaaaagactcaaaaagtgtgttgaaatttatttaatatagtctaaatttccatttggaaaaattcattagttcaattttttacttaaaaaattttttaaataaaaataatcaaatttataattctttggggggggggtaggggtgttcggtgccgataggcgccgccgggcgaattttgaaacttatgctctctttttaacagatattcaccaaaaatttttttagatttttccgataaatttttgttcttccaatcggttttttgtaaaaatgttttaaaatatttaaatttttatgatttacttaaggaaaattgaattgttaattacaacgaaattttcatccggcggtgccatcagaatttttttgataaattgttcaatttgttaacaaattatgccaagatgggtgttttgttattaatcgtaaaaaataaatcaaatagaaacgtcaaccggcaccgaactcataaattttgacttttgtcccagaaaatattaactacatatttcagaatatcgcctcaataaaaatcatgacccttcaaatgaatataatatgagataattaaaggaaaagtggaaaaactttttataaaaaatgaaaaaccatttcataattttacatggtatgaattgaggtattttaaaataattaaaaattctaatctgtgatttaattaa

SEQ ID NO: 51982 - DNA, 652 bp, Heterodera glycines
  Genomic contig location: Contig_ID=SeqID_21375; Location=251..902; Strand=-
  SCN-specific regions: Sequence locations=1-450,473-525,547-558,623-652
  Gene Ontology: Mol. function=organic anion transporter activity; Cellular component=integral to plasma membrane; Biological process =anion transport
atgtgcctttccctgcgcgaggagatgaccttctcgctgcttttcatgttggctggcaaagtgtgcattcagggggctttcaacattctctacatgtacgtttactcccccactgattgaattgcctttccgtgccgtcccttcgttcagcttcacctccgagctgtaccccacggtgatccgcaacagtgccgtcggcacttgctcaatgatggcccgcttcggctccgctgcctccggttacatcgccattctttccgacgtcactttgcccaccgtcccaatggccatcttttgcatcttctcactgttcgccggtgtgctcatttatttccttcccgagacgagggatttgccccttccggagacaatgtgggacgcggtcaggtgagaagcgaaaagcaacggaacggcacacacttttaaggatgctgaacaacacggaagccaatcggtgtgttggaggtattcaaatggaggagggcgacagagacgaaagttacgggcaaagtgagcggaaaaagcggaggaaaggacggggagacggaagggatggaaaggaagaggaggaagaggaagagagggaagaggaggaggaggaggaagatgaagaggaggaggacgtgccattgtacacaaacgcatcgaaacg

SEQ ID NO: 51983 - DNA, 2447 bp, Heterodera glycines
  Genomic contig location: Contig_ID=SeqID_21376; Location=586..3032; Strand=-
  SCN-specific regions: Sequence locations=1-156,178-668,690-871,904 -1188,1212-1581,1603-1680,1710-2096,2163-2411
atgctgtttgctcaatcgtcgcaatatgacgccgatttgccatgcacaagtgcacaggcgttgcaggtggttgaattgtaattatggggtcaaaatttaaatttccagtttcatcaaatttttttaaatttcaattttagcatgatcaacaacgacagcagcaagtgctggtggagacgttcatggatggccgactgcgattgttgtgcagcacgcgcccggatgagaacggcgttggcgacggaggtggttgtggcgaggacggtggaacgactggtgccaatgccgtcggtggcctggaacggatgagtgccgatgtgttggtcaacttttgtgccagcgatattctgtcaggtcagcctaacatgatgtccattcattcagaatttgacactcaaaaaaaaacgatgacccccccccccccgtgggtctatcaaaagccggtcaatccgggtttttccaaaaagcgccggatcggttttgccagtccgttcttctttttaatttttttttccaattttaggcgatgaaactttcctgcgtgtccacgatttggccggccctcagttgaaggacttctgtgcccaataccaattcattggcatcggcaactgtcgtctgtccaactcttacggcttgaccaacttcaaaagtagccgacagattttaaaatagagaaaatattttattaggaactacctatataaaaaaagtaaaatatcgtaaccctacatgaaaaaagggggggggggggttcaaacaaattttttgagcaggggtcttgccatgtaaagacctatttgcgattttgagcaatttttaaaggaaaattagaagctttggtggtcatctgccggagaaaatttttgagaattaatttatttaaaaaattttcatatttttctctttttatctttttccatttcgtttgcgattcaatctttccttttttcagaaattgctcacgccattttgccccgacctgtccaaggcgatgtggtcgacctggacgagttggtggagttcgacttggccatgtgctaccgtaacgtgttggacttgtccactgaagacggccattgttccgttctcttcacgcatccgctggtgtacggggacaggttaaattcagggcttttgacatgttgcttatatttatgggtgtttttctgggtcgctctgatcacgaatccaacatttattttcaccaatttcgaatcccggactcgaattctaacaaaaagtcgtcgaaaattcaaaatatcactcgcaatttgggacaaaaatgggttgcatttctttgggtttatttggtgtttagcttttgtgaaattttatcacatttttgaagagatttttaacacaggtacggtgagacaaagttggctgctgctgtgatcacacattggctggaccattcgccggtgcctccaaggtagctgagaatgagcaatttttatttttggataaatttggtaccaacactatgctccatttcgagtttgaccctgttgaaaaaaaaattataaatgcataaaagcattaaaacaaattattatttccatgaaaatagtttaaaatttttcaaaaatcactgaaaattttccactgaaatttttttcaaaaaaattttcggcgggaaacgatactgggcagggagtgggaaatagttcacccggcaaaattatatattttttaaaaatattttagctcaattttgttggcattgcgtgccaaagtggggacattctccagtgctacatggacttgatggctgagctggcacagcatggttgggccgactttgtggctgcacattccagcgcactgttctcctgcctggtcgactcatttgacacgggcaacaaattcgagccgtccggtgccagcaaaggggctgcagcttcactggtaagaaaatataatgggacatggcatcacctcccggtcccatcagggattgcattccgaggccccaaaaaattttcgtaaacctaaactccaaggcccaagaatttttcgggattccgatttcaaaaatatcggaaatcgaaattccgtgccatccctggtccacccatacattatttagcaacaatttttatttaaaattttcgtttgaaaaaataaaaattcaaaaaaaatttttttgttttttttttgaaattccgattaaattgaaaagcaaataagtgtaaataatgatataaatacaatatattgctcattatatatattttgctattattgacacattttttaggaggatcccgctttgcgtgtccatcttgttggtgatgacccgcgacgtccaaggcgaggacaaccgaagcaattggtttcgtacgaattgggggtcagttaaaaaatacgttttacaatatttgaaatgtaccgtttaaaatgacaagaaaaaaatatgaaatttttcattttttttaaataaa

SEQ ID NO: 51984 - DNA, 750 bp, Heterodera glycines
  Genomic contig location: Contig_ID=SeqID_21377; Location=1087..1836; Strand=+
  SCN-specific regions: Sequence locations=1-332,355-598,623-750
atgtcgggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcaaacagcgtatgaacaatttcaaacaacggagaaactgaacacaaaaatggaagcagccaacacaaagctaacagagctgaaggacctggagatgaaggtggaagcaggagcaaagctgcaacgctccaaagcagacagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaagctgttaaaggacacctatggcgacaaaggcgaatat

SEQ ID NO: 51985 - DNA, 262 bp, Heterodera glycines
  Genomic contig location: Contig_ID=SeqID_21379; Location=6..267; Strand=-
  SCN-specific regions: Sequence locations=1-262
atgtcagacaatcgaaaagaagcggcggagcgaaaaatggcaaaagcaatgtaaaataaaaaatgccaattttaaattcaattttaaattttgtttccctttttttcagtttcgtttccgccgactgttggctttgtgtgttcgatttgcttccggcttatcaacttggccttggaattgcatgattagctaccgttttgacttttatgtggatgaacatttcaagacacgacgctggactctgaaatccatgaaaattaaa

SEQ ID NO: 51986 - DNA, 358 bp, Heterodera glycines
  misc_feature (344)..(344): n is a, c, g, or t
  Genomic contig location: Contig_ID=SeqID_21379; Location=932..1289; Strand=+
  SCN-specific regions: Sequence locations=1-358
atgtttgtcggatgttgtgccattctttggttttattgggaccgcctcaaaaaaccaaaaaagaaaatgtaaaaaagaaaaaaattcaaaaatttggtatttaattttcagtttcatctccgccgactgttggctttgtgtgttcgatttgcttacgccttcacaacttggccttggcatttcaatgatcagccaccgttttgacttttacgtggacgaacacttcaaaacacgcaaatgggcattgacacatattcaaatttggcgcagaattggagaaaatgacaccaaggaaatggaaatttgccatgacggtggaaatcctttgccaattcctcaaattncattgccacgcaaa

SEQ ID NO: 51987 - DNA, 63 bp, Heterodera glycines
  Genomic contig location: Contig_ID=SeqID_3814; Location=301..363; Strand=-
  SCN-specific regions: Sequence locations=1-63
atggcagagaaagcaaatgagaggaaaaagaaaatagtacagaccaaagaaaagagaggaaag

SEQ ID NO: 51988 - DNA, 411 bp, Heterodera glycines
  Genomic contig location: Contig_ID=SeqID_3814; Location=1066..1476; Strand=+
  SCN-specific regions: Sequence locations=1-58,82-96,122-370,392-411
atgacctgcgaaggctgctcaaatgcagtgaaacgtgtacttggcaaattggaaggtcaaaaaaaataaaataaaaattttgtttctcaaaacctcggcaaaaaacaacaacaacaactttgtctttgattaaatctacaagcattgagatggcacagaatttcgacatttttggggtccgaattattccgattcccgaaatttaaaaaaaggtgaaatcttcggaataacttttttttttgccaattcaattgggcatcttggccgggcattttaatttctaaaataacaaaaaattagttttcctaaaataataataaaattgtttttgaagacaaggtaaagctgctcagtgtggacctgaacgccaaagaggtgcaggtggagagcagcagtatgggccaagatgag

SEQ ID NO: 51989 - DNA, 182 bp, Heterodera glycines
  Genomic contig location: Contig_ID=SeqID_3816; Location=29..210; Strand=+
  SCN-specific regions: Sequence locations=1-90,112-182
atgaagcgggtcagtttggtcaaaatttgattcgagataaaattccatttttaaggaccgtgaagaacaacaagaagaaatcggaggcaaggagagcgacggagaaagcaatggagaagaagaacaattcgattttgaataaaaacagttggatgaaaggtttttctttgtttttacagaaa

SEQ ID NO: 51990 - DNA, 776 bp, Heterodera glycines
  Genomic contig location: Contig_ID=SeqID_3816; Location=463..1238; Strand=+
  SCN-specific regions: Sequence locations=1-57,82-776
atgtgcaatttcgcagtttttatacacataccaatagagcccggaattttgaaatggccgggaccgggatcgggaccgggacttggaaaatggaccgggacgggatcccgggaccgggagtcccgtttttccggaactcccggtcccggtggtttgaccaaaaaacccgggaccgggagtccaggcaaaatcccggcgggatcccggtcccgtccgggctctagaaaaaatatcatgacccataattcagcactgttatgtttgtatttgattttcggagtttcggcatgctgttctgttttattattgctcatgccgccgccgccgttttgcttccgctttaatacggcatttttcgcaacatggttgttttagccgcttctcaggcctttggtgacacttcactgagttggttcgattcgttggtggaccgtttattgcgtataaatcttcaaaaaggaattttaaaaatttgaaaaacaaaaatttcagaaaaccaagcaactccaaccgaatttgttgccaaactttttgctggaattactgaccgattcattgaatcggcggctggtcagtcggccaatttgccacatttttttgccgtttttaattatttttttcagctcgtttgccgttgcttggccgtcaatgtaccgacaattatggttcgtaagaaccaagatttttgtttgagcctctgggtcgggaatggaaccatggtcgaatttgctggatcaaaatttaatccaccccattttctgggtccgcttttccta

SEQ ID NO: 51991 - DNA, 383 bp, Heterodera glycines
  misc_feature (348)..(349): n is a, c, g, or t
  Genomic contig location: Contig_ID=SeqID_3816; Location=1574..1956; Strand=+
  SCN-specific regions: Sequence locations=1-383
atggcatttcgtgccggtgcaggcaccggtcgggaattggcacaacgaccggaccaatacttggacatcttggtaagtttttggagttacatacctgttttacaatggcattttttaagcggtaaaatttcagacaaattttgactgttgttggtcaacgcctgacgaagtgcacgcaattgctgaacaattagacgaatttgtgcaccacgaaattcggttagttttcattttctgaatttttcaaaaatattattttcggcaccgtttaaattagcggaatgccgttaacggacatggcttattgtcggaaacccattccataaggctgttcaagtcggtccgctnnaatgccgtgccgaaatatggaaatccgccgccaa

SEQ ID NO: 51992 - DNA, 1270 bp, Heterodera glycines
  Genomic contig location: Contig_ID=SeqID_3817; Location=692..1961; Strand=+
  SCN-specific regions: Sequence locations=1-163,185-468,490-563,585 -719,751-859,881-1270
atgttcaaccggtcccgagaagtgtacaagtacttcgttcgttgttcaaagactactgcatggtcccttatcaaagtttctcgcactgttcagcaatttcttgatgagctcagctcattcttcactttggtatgcgcattatttgacccgattattctttgcattctccaactaatttataggtctttgatttatcacctgaacattcgcaacaccagcagcaaagtgaccacgaggtttacgcaaattttgaagccacctattcttctccacttttgctaaattgtgtttactttagacggtgtcaactgatcagacgaattcggccacatctgaccctcgtcctctgcccgttgtcaccgagtcggtgccggtgagtcaatagcagttactgaaaaaatgtaaaaccctaacaattttaggaagaatcgacttacgatccgccctgggacgaccgccctctgcgtttcatcgaaaccatggctgcttttgaagcgcaccgatcaacaaatgtaattgatatctctactatctttaattgctttttaaatgttctcaattagtagcaaatttatttttctttgcatttttgataaattgtgtttactttaggtagtgcccactgttccgtcaacatcggctgcggcccctcgtcctctgcccgttgtcactgagtcggtgccggtgagtcaacagcagtttcctcaattacttgcaaaattttagaaaaattttcaaattttgaaaacagcctttgtaaagtgtaaaaatgtttatctgttgaacaatggataatttgaatttgttttggacccgggcccagccattttatggccgtcttgtttttaataaatcacagtgtaatttttaatatttcttttcgactttattaaaatcgctcattttattttagacatcagaaattcctgccctgtttgcggagtttttgcgcaccaactgtgttggacatgtgcccaaagaggttcttgtcgcttacctggaggaggccatcaaaattttgaattgtggcggcggacaaagcgccaacactcccaaaatctcaaagttccgcaaggtattgtttcattcattacaaaataatcgaacaagacgggcccagtggggttttaccgggtcgccgggtatcactttcttggaccaaccaccgggaagggccatccgataaaaccatgtttttttttttgaccgggcggcccggccccagtcaatcgtctaatccgggtgctttcaaaatatcggttccacgtaa

SEQ ID NO: 51993 - DNA, 102 bp, Heterodera glycines
  Genomic contig location: Contig_ID=SeqID_3817; Location=5139..5240; Strand=-
  SCN-specific regions: Sequence locations=1-102
ataaaagtcaacgtagaagcctcaaaccaagtggaaaatgcgttttttatgcttaatatatcgaaactagtgcgcagaaaaaaaaggcatatgcctcaaaat

SEQ ID NO: 51994 - DNA, 273 bp, Heterodera glycines
  Genomic contig location: Contig_ID=SeqID_21382; Location=619..891; Strand=+
  SCN-specific regions: Sequence locations=1-75,259-273
  Gene Ontology: Mol. function=protein binding; Cellular component =axoneme; Biological process=eye photoreceptor cell development
atgaaagactatatcgacgaagtcagtgctgaggatgaaagtgaagaggaggagagagatgatgataaaagtgatgaggaggaagaggaggaggaggaacggaagaaagggagaaagaagggaaataaagatgaggaagaagatgctgagagtgatgatgatgaggaggaggaggaggaagaaagggagaaagaaaaagggaaagaaagggagaaagaaaaagggaaagaaagggagaaagaggaaaggaaagaaagacgaagaagaagatga

SEQ ID NO: 51995 - DNA, 231 bp, Heterodera glycines
  Genomic contig location: Contig_ID=SeqID_21383; Location=636..866; Strand=-
  SCN-specific regions: Sequence locations=1-150,171-231
atgcaagtcagtcaaatgagaacaatgtccttgtcggtggcaagtcttgttgcattgctcgttttacttgccatctccagccatccaacctttgccagtcctatttcttcaagagacttaaatgatggtaaatttgaaaaatttttgaaaaattaattaattaattaatttttcaatttagctgctgaagcaggtccactccaagcagttgaaaagcgtcggaatgcagaa

SEQ ID NO: 51996 - DNA, 442 bp, Heterodera glycines
  Genomic contig location: Contig_ID=SeqID_21383; Location=2323..2764; Strand=+
  SCN-specific regions: Sequence locations=1-273,318-345,369-442
atgccaaaaatcagaaaaatgcactccctcgatgccctggagggatgcaatgttttcccatcagccgccgataagacgacggaagaaattaaaggctctcctctggccatgggatgtgttgttgtcgtcgtctacgacgaaaattccattatcttccatggaagatgggacatcggaagaaaattggaacgcatttggcggatgggtaagcagaaatcgtggccaattcaacaggaaatgatgtgatggcgaacccaattttcacaaaaatcgtattttaaatgaataaataattaaaatgcaattttaattttatagcagtcaaatttaattgggttgttattgataaataaattaaaaaattttatgcactttattttactttattttcttgataatataataagatgatatttaattgatgataatttatagttaagaa

SEQ ID NO: 51997 - DNA, 655 bp, Heterodera glycines
  Genomic contig location: Contig_ID=SeqID_21384; Location=193..847; Strand=-
  SCN-specific regions: Sequence locations=1-521,543-606,628-631
atggtcacttcgctggcgtttgtgccgcttgaggaccttacaccggcgctggcagccctagaagatcatctgccgggtgaacttgagggcgttctcgattggtttgttgagtttaattttttttcaatttcattattgactttaaaggtttgtaatcaactacgttgggcgacttcgcaacaatggcacacgcactcgtccattgtttcgtcctgaagaatggagtgtgtatgagcgcacaatgagcggcaccgaccgcacaaacaacttcgccgaagcgtaccatcgcacgttgcaacatgcgatcggacaaggacacccaacaatatggaaattcatcaatattttgcgtgagcaccagaaagtaatcgacgttgacttcgaacatttccttgccggaaatgctccgccgccaaaagcaaagcgctaccgcgacacggacaaaagaattctgaggattttgcagcgctacaatgaggaaaaagcgcagccgcaaatcgaaaatgatcaggggaatatcgccaaaaccaaaaccaaaattcgattattgaaatgcttaggggaatttcgagcaattatcaaacggattgttgatttttttgttaattttatttgttattatattttggataaaactgagatttttaaaaattaa

SEQ ID NO: 51998 - DNA, 135 bp, Heterodera glycines
  Genomic contig location: Contig_ID=SeqID_21385; Location=278..412; Strand=-
  SCN-specific regions: Sequence locations=1-135
atgttttttggttcaatttgtgcaaatctgagcttcgccggagacgaaaaacgaatggaatggtaccagaatcaactcgtgacagtttcaacctcgatcattagcaacgtggatccatatgtctctgcgaacttc

SEQ ID NO: 51999 - DNA, 1450 bp, Heterodera glycines
  Genomic contig location: Contig_ID=SeqID_21385; Location=911..2360; Strand=-
  SCN-specific regions: Sequence locations=1-128,150-385,407-438,460 -725,748-785,812-1055,1088-1328,1350-1450
ccggaatctgatgagtacaaggctctgatgaagcttcaaaagacaatggacgaaaattttgagaagttgcagagcacgattgctgtttcggaacgcgtaattgcgcttcgcggcaacctacgcgattataaaaacgtaaacgaaataaaaatattaatcaactggccagtatacagaaaaaaatttcggggagtagacccaaagaactttttatttgctctctggccttttctccaatattatttatatttagtagatatgcctgaaaatgacagaagtttgtatttttggtgtcgaactttcaaaacataatggttctaggttccgacactgccggtaggcgccggcatgaatttattttgaaattttaaatatgataagaaaagcatgcaaatttagaaaaattaaaaaaaaataagtttcttttgggggggagtgttccctcttttcccttttgttacgggcctgtaacttctttttctaaattatagatttaactattttcggaaatccttatttactactgaaatttttttgccagtttacttggtatttcagaacgttcgccgtccgatgaaaactctgcgtcgatacgtgtcgctattttgggaccctgcaattgtaaaaacagacaaagacgtggaaagattcattggtctttgtgatgaccccgacaaacagacaccattaagtattctcgacgtaagggtagcttgatcacacactaaattaattataatataaaaacagtatttttgccttttatgtcatagattaaagtaattgtttaaaataaaaatactttttgctttatcggttatagtttttatcattttaatttcatgtgaataaattatttaaatcattaagaacaaatcacctttcagtacatacaaacatacactgtcgacgactgcacaattggattgtcgcctgaacagattgaacgtcaagcagaatttgtccccatgctcaacaaaattcgtatgcaaataagcagccaaatcgaaagggaaaaattcgattcgatttcagcgggtattaaacattgctttacattaattctaatttaaaaatattttttgtatagaattagttatatggttcacagaacttgagactgacagtgcgaacagcgtgcttcaaaaagtggaaaataacattggtctgttgcacttaattcactgtctatttgctatattttaaaactaatagtctcttcatttgaatatgcatcgtcttcatcagcattttcagctgtaaaagaaattttcctcgaaactggaacatatggacccatttccgtgttagttttccatcttttttgcatttcaaaaagattttttgaagttgcttactcaatgacattgtcgtcggcaaaaacttccacagaaaggaaataaaagagcttgaaaatatcattcgtttggatgttgttaaattggtataa

SEQ ID NO: 52000 - DNA, 1255 bp, Heterodera glycines
  Genomic contig location: Contig_ID=SeqID_21388; Location=279..1533; Strand=-
  SCN-specific regions: Sequence locations=1-341,364-649,671-840,862 -961,989-1255
atgttcggaaaaaacattaatcgcttggaattgtttgtcggattttttcaccgtttgcgcaaattcgtcccgtcaattctcaacgactgcccatcgcttcacgttctcactatccatgtcaccaatttcttcatcgaattccctgccgatgacagtgccgcggcatcggatggacaagcggtggccaaatggcttttcactccgcttcaaaacgatgcgccaaaggtgttgaaatgcgcgtgggacttggatgctgtgaatttgccgtcgaagattgcagccttcaaagcggtgatttcgaatgatttatttggctcttttacgttttttggagttcattggaagaaattttatgccctaattgggccaaaagtgcccaccttactaattaggattcgtgcccatccccaaccgaaaagccatattaattacatttctttaatcaattttcccgtattttaggcatttgcctcggcttcttctcctgtcaattttattgtcattgtttggtttcgtccgttgccttttgctgatcccgttgtgccctctgtgctgaccaaccaattgactcgggagcaattggcattgaaaataattgacgacaattgtactcgttttctgctcatccgttgtccaattgtgcgcgacgcggacaaatgggcaaaatgggaagaggaggcgattggctatcatcagtggaatcaaattggcattgaaatgaatgatgaggacaacatcggggacgggtgggtgagagattggttttcccaaaaaataattcaaatttattgtggtgttacgatttttaggcttcttgacgcaattcgctgcccaaatgatcagcagcagaaatgaatgaatgaattgtttgagaagtgatcgatcaatttgaattgcggtattagataattaatttgacgtatataaaattgttctttttgttgcggtgatcacaaattgtattatatatatgtgtgggtatatgcctttaggataaattagagatttcctgaaatcccaggctcattcttttgatctaatgataaagtcggtagtcactgttccttcggtttttattttattttttatggtaatttttggtgctgaaaacgaatctgagattattttaagctaatatccattttatgttgagttacatgaaagtttacgtattagcggtaacgggagaagcggctcaaaatcggtggcattttactaaaaatgaaaaacaatgtcatgtcgacagtaaaataaa

SEQ ID NO: 52001 - DNA, 304 bp, Heterodera glycines
  Genomic contig location: Contig_ID=SeqID_21389; Location=847..1150; Strand=+
  SCN-specific regions: Sequence locations=1-238,260-304
atgggatgccaggatatgatcatgctgataactgatggagcacccggctttttccgcgaaacattcgaattgttcaatccggaaaagcgggtaaaaagggcgaagccaacaaaagtccaaaaaatgccatttcaaaattcaggtccgtttcttttcgtttgtcgttggagaagaggcaaaggattttgagcaggtgcttatcccttatattcggccaaatttgaatttgaaaaaggtccgatggatggcatgtgcaaaccgcggatttatggcacatatcagttcaatggccgacgttcaggag

SEQ ID NO: 52002 - DNA, 1461 bp, Heterodera glycines; identical to SEQ ID NO: 21390
  Genomic contig location: Contig_ID=SeqID_21390; Location=1..1461; Strand=+
  SCN-specific regions: Sequence locations=1-879,904-1243,1265-1461
  Gene Ontology: Mol. function=manganese-transporting ATPase activity; Cellular component=Golgi apparatus; Biological process=calcium ion transport

SEQ ID NO: 52003 - DNA, 627 bp, Heterodera glycines
  Genomic contig location: Contig_ID=SeqID_21391; Location=94..720; Strand=-
  SCN-specific regions: Sequence locations=1-48,70-98,121-403,430 -432,454-627
atgactaatcaggatgttgtgccttataatccatatttgattaaacggtttaaatcacacataaatattgaaaaagttgctgatataaaagcagtaaaatatatatacaaatacatatttaaaggatatgacgcagccacagttcgttgtgtaacaactgaaaaaggtactgtaaaggaattaatttatgatgaagcaggctcctttcttgatgcacgttatctcagccctgtagaggcttgctggaaaatttttaagttccaattacaagaaaagtcacattctgtacaaagattacctgtgcacttagaaaatgagcaaacaatattttttgatgaaaatgatgaggaggaaaaaataatcgagaaaaaagacaaaaaaagtaaactgatggcatattttgacttttttaaagagaatccaaattcacccttatttttatatcctgaaatgccaaaattttgtgtttggaatcctaagcaagggaaatggattttacgaaaaaatcatacaataagtaaaacaattggaagaatgtatccagttagcccaactgagggtgaaaaatactatcttcgttatcttttgcttcatgtttctggaaaaagttttgaagaccttaaaacg

SEQ ID NO: 52004 - DNA, 418 bp, Heterodera glycines
  Genomic contig location: Contig_ID=SeqID_21392; Location=51..468; Strand=-
  SCN-specific regions: Sequence locations=1-47,70-418
atggttcgtaaaaaacaaaatttttctgttggaaattcaaatgaatttccaaatacatcttcaaataatcagcaacagattgccgggttcgaagctcccgtaaaaagcggtgaaacgattgaaagggttgtaagctccctaaaaaagcagtctgaccatattgaaaatgataatgatagaaaaacgattaaacgtaaagcaaataattttgatgtgatagaccttgatgaagtatttgaagaattttttgttggtaataattgtaatctttccgagaaagacaaacagatagaaaattccgaacaaaccacaatcagcagaatgcagttatcacgtatgaatatgtccagcgaaaaagctgatgtttcccgtgaaaaagacagaaaacgaaaagtaagccgaaatcaaatgtctgagg

SEQ ID NO: 52005 - DNA, 553 bp, Heterodera glycines
  Genomic contig location: Contig_ID=SeqID_3819; Location=320..872; Strand=-
  SCN-specific regions: Sequence locations=1-553
atgcgcgagaatcgagagcaaaaggccaatgcaagcgccactgtttttgtaaccgaaattgccgctttcgtcgtgtttttttggctgtcctttgtgagttgtgccgcaatttaatccgtcgctttttgaaattgcggcgccgttttgctcccccccccaatcatttcaaatcagtgtcatctttccgcctattcattatgccaccccccccgggcttgtcaatccaaacgcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaaatgagttagaaatgataaacttttcgattcaaaccaattttcgttgctctaattaaccgggataaaaacattcgaatcaattaaatagcttctgagataataaggtttatcataaaatttcatttaaaaataaa

SEQ ID NO: 52006 - DNA, 1242 bp, Heterodera glycines
  Genomic contig location: Contig_ID=SeqID_3820; Location=29..1270; Strand=-
  SCN-specific regions: Sequence locations=1-101,137-746,768-1242
tggattcggtcgaaacactcccccgcggacagtcaaaccgttatcacctttacaattcgtctgccagtttggaaatgaattcggtgcctcaaccattgcacattcatcagcaacaacaacaccagcagcagcaggtcggacagcaacaacatttgggtggcacgccactgacaccacgtaatgcgcacgtggtgtacacgcgagtggacagacaggtcgactgtccggttttttgcaaaaatataatgtctgaatattcaatttaccgcatcgttatgtatttgtttagcccattgccaaaatggactttaccgtcagtgggtcagcagtgtccaatggtgttgttggaccaccgcatgattcgccacacaatctccaacagcggcatcagttttccggcactgtttctgcctcaggggctggcggcacgccaccgcttccacctccgccatcgttgacggctgccaacagaggcataacaacagcagcagcaaatgtgcagcagtacaacagaaatgacagtaacggctaccaaaccgttggcggacgagccaatgcagcaggcggcgctgcaatgctttcctttgtgaatgggacgacggcggatggggacgacggcaaaggcgggaattgtgacgcagcggagcacggagttacatcagcaggagaacaccaacaacaaaaagcagctaagcatcagcaccaccaacagcaaaggatggcacacattgttcgacccattgtttatgtcggaggcggtggcggcgttgccggaggcgccagtccatcaccgtccaccataagaagtgccacagggcaatcgcaagcgcaaaaaacaacaccaacttccggtaattattgtcagccaggaccgtaaactgataatgagcgtgggaaaagccagaatcgcctttttttcttaaaaaatattatttggattttgaaggattctcttactttactcttctttgtttttgagcaattgtcaaacattcactaatcatcttcatcttctccacagtccataagtttgcctacaacaacaacggtgccaaagtgccggttggccgtgcgatggttcagccccgtgtgaatttggctgtgtcgtcatctaatgccatagcgacgccttacggatgttcttcttcctcctcccaatacgcgagtgttcgtgtcaacccctcaaatgccggaagtgtttccaataatgccatcatcgaaaatgacgaaagtgaagtcaag

SEQ ID NO: 52007 - DNA, 105 bp, Heterodera glycines
  Genomic contig location: Contig_ID=SeqID_3820; Location=1119..1223; Strand=+
  SCN-specific regions: Sequence locations=1-16,52-105
atgttgttgctgtccgacctgctgctgctggtgttgttgttgctgatgaatgtgcaatggttgaggcaccgaattcatttccaaactggcagacgaattgtaaag

SEQ ID NO: 52008 - DNA, 426 bp, Heterodera glycines
  Genomic contig location: Contig_ID=SeqID_21394; Location=90..515; Strand=-
  SCN-specific regions: Sequence locations=1-426
cattcaatcactggggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcatttcaatcactgggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcattcaatcactgggactcaacccaccaacattccaatcgccgggactcaacctcagcaaatttctttag

SEQ ID NO: 52009 - DNA, 884 bp, Heterodera glycines
  Genomic contig location: Contig_ID=SeqID_21398; Location=595..1478; Strand=+
  SCN-specific regions: Sequence locations=1-330,353-459,489-884
  Gene Ontology: Mol. function=ligand-dependent nuclear receptor activity; Cellular component=nucleus; Biological process=signal transduction
cattttctcgtccgactctcagcagttccccttcccggtgcctccccagtcgcttcagtctgtgatgagcggtgccccctctgcttctctcgctcgtcctacctccttcccagccgtactctcttccccgagttcgtccttcgttgcccaacatcaaagttccgcctcttcgtccggccaacccgccgtcatttcctcgtcctcgcccgattcaccgatcacttccaatcacccggcagggccaatggaagaggggcaaatgcacgaggagcccaaattatgtgccgtttgcagcgattacgcaatttggtaagtgggaggaatggaatgaaattgaggaggagggaagggagggcactccctgcaggaaagagtgccaacgaattggtcaccgttcgtccgttattccctcaacaatcattggcatttggttttagtcagcactatggcgcgttgacttgcgaaggctgcaaaggcttctttaagcggacagtacaaaagaagtcgcagtatgtgtgtggtgagtgtccaattgtctctttttctctcaccgtctctctttaagcgggcaacaaaaattgccaaattgacaaacgctatcgctccaggtcagttcttcgctcttttggtcgtttattactcaatcgcttggcagatgccaatattgtcgcttccaaaagtgtttggaggttggcatggtgcgcgagattgtccgttacggcagtctccagggacgccgggggcggttgccttccaaggtgaaaagttcgagcggagggattggcggcagcgccggcacggcgatgccaattggcatgggcggcggagtgcagcccgagccggcgccaagtccaccgctgcccattctgaccatcattgccaag

SEQ ID NO: 52010 - DNA, 893 bp, Heterodera glycines
  Genomic contig location: Contig_ID=SeqID_21399; Location=408..1300; Strand=+
  SCN-specific regions: Sequence locations=1-49,90-116,138-146,231 -489,511-611,633-654,677-893
atggaattgttttacgcagggtgagacagttcaaaagaattgtaaaaagataaattatgaaaattataaaaaaatatttttttaattttccatttaaattaacgcaataatttcataatttaagtcaaaagaaataaattcgtacctttttaaatttttttttgaaaaaattattaaaatatctacataattattcatatttccgtatttttatcaatttatttttatttcatattcttcgtctttaaattcaatattttttgcccatttagcaaattgctcaatcgaattttggacctccataaagccgaccaaagccccacgaccataacggagcagccaaaatctgagccgaccgaagaaattggtgttgatcagaatctgaacccggtagtacaagcgggattggcccatttcagtctggtgagccttatatgctttgctaaattttttcttttttgagggtccttttagcataattttttagtcttaaaatttttatttaaaaaaccgggacttgaatcccgtaattttattccgaaaaacacgatttaaactgattatttatttaatttaattgctaatttttctttattttttgcaattcgcataaaaattcaataataaaaaacttcggtttttatcattagaatttttaaaattttcaatctttaaatttccattttttgtccttaattgtttcacagttgacgcacggatttggtgggcattcggtgcaagcggtgcttgaaacaatgatcagagtgatcaacgagtgtaacgttgtgctcactcgcaaataccaatcgccgattaatgccgtcactgccgctggccaacaaaatgccgttctatcgatgccatttgatctcccgtaattccgactgaacgca

SEQ ID NO: 52011 - DNA, 574 bp, Heterodera glycines
  Genomic contig location: Contig_ID=SeqID_21400; Location=1120..1693; Strand=+
  SCN-specific regions: Sequence locations=1-94,118-253,275-407,429 -439,461-574
atgatgctgattgacactattgatcacggaacccgtcagttgggccccggcacgtttgggccccagcggttttttggttataacttttttttctttgtcatccaaatcaaacattgttggtatcattcgaaagctgtaagtgtcctctattagcctgcaaaattttgaaaaattatgttaaggttcaaaacaattatggccagaacaactcaaaaaaccagattttccaacttttatggccataaatttgttcaaaattgacacaattttttgaaaatttgcaggctaatagagcatctgaagggctttcgaatgataccaatgatgtttgatttggatgacaaagaaaaaagttatagtccaaaaacctgctgacgcccaactgacgtagaccgccccctcactctctcattttcccatattttcaccaacttttatctcaattgaaacagatgattttttgtttaattctgtctcattgtcaggcatgagcattccccgttggtgtccacgtggagcactcggcgcggaacacgcggcgcccatttggtcagtgatccattcgatgacaaaa

SEQ ID NO: 52012 - DNA, 2041 bp, Heterodera glycines
  misc_feature (11)..(12): n is a, c, g, or t
  misc_feature (68)..(68): n is a, c, g, or t
  misc_feature (1919)..(1919): n is a, c, g, or t
  misc_feature (1991)..(1991): n is a, c, g, or t
  Genomic contig location: Contig_ID=SeqID_21401; Location=1..2041; Strand=+
  SCN-specific regions: Sequence locations=1-243,265-436,458-567,604 -1354,1377-1448,1470-2041
  Gene Ontology: Mol. function=lysosomal cysteine-type endopeptidase; Cellular component=lysosome; Biological process=proteolysis and peptidolysis
atgacaaaatnnttttaatgaaattgggaaaatttcaaactatttacactttttaaatccctggcggngtctggcggcactctctgcgaatttaaaaaaatatattttcgcatgataagagtagcattttgcgtgcatgcaaagactataattgattctgttgtcattcactttgtgataagaaagggggaagcaaatgaatgaatgataaaatggcacataaaacggacaattctctccgtttcctccccccaccccaagaaaatgcacaagggcagtttagtgccactttttggcaaaaatttgcgacaaaattcgtggagagcgtttggggagaagagcccactgaaaaggtggcgattaaacaaattaagtgccttcaaatggcttattagttttctcttctccaaatcgcttcccctcgtccttctgctgatcattttgctgctttacttccaatttcctctgaatcttttcggcccgagcgatggcaccgattttgggcgaattatttccaatggcactttcctcgccaaatttgttgattttcaaaaacggtattttatgagcaaaaggcaaactttcctttccagtttttcaaaaaattattcaaccatcgaagaaaagctgaggcgtttttcaatttttgttgccaatttcgaacaattggaaaagatcggaagggaaggcgaagtgtacggaattacgacatttttcgattggagcgacgaagaattgaaagaagtgatcactgatcagacacaaggaacttactgatcggctccattttcagttgataatgccacatgaatactttgaaagcgttcccttttcttgggctaagccaatccgcgaatttcgtccgatggatgcgaattttaagcggccgagcgaattcgattggcgcaaaaagggagtggtcaatcacgtgaagaatcagagtgagtggacgaagtgatcggagaaaaggccaaaaatgaaaagggatttgcttaagtgcgttgcggcgcgtgttgggcttttgccacggcagcagtggtcgagtcacagcacgcaattcacaacggaacactgctcactctgtcggaacaggtcactgactccaaacgaaagtgatcagccgaggccgaaacaaagggaataaatccgacagaatttagtgggatttgcaatttcatagaaatcaaaagccagaaataattctgcttgattttgcgtattgatcagattgctttgctgttgatcaactgtttgtttagcaaatgatcgattgcgaccaatcgaacaacggatgcgaaggagggaacagaccaaacgcatttcggtcggtgctccctttgatgccattcattgtctgtctttcacttcccttcctcatttgtcagctacgttcgtgataatggccttctccgtgaagataattaccctgtctctcgccccccctcccaatttgccacttttgtcctttcatttgccttttgaagtaccgcggtgccgatggtaactgcgaattgtcgccgggccccgtggacccaacgcaacggacattcgtcgacgaagtgcgaactttgccgagcgacgagcagcaaattgcggattttgttgtggagaaagggcccgtttcatttggtagacgaacagcaaaaagaaagggaccaatgggaaaggaactctttgaggaatgaatgtgaccaaaacaatgtttcattatgtggggggcattttctcgccaactgccgacgaatgccaattccattcgatgggtcggcatgccatggaagtggtcggatttggagaggacgaaaagagtggcggaacacccttctggatcatgaagaacagttggggcagttcgtggggcatcaacgggggatatatgcacattcggaggtcggcagaagagggagtgatcgggaggngagggggggggagtgatcggaaagcggtcgtcgtagaagtgatcgctgctttgtcacgacttcttttcaggngggtcgatgcgtgcggactttcgcgggaagtacacacggctctgattacg

SEQ ID NO: 52013 - DNA, 398 bp, Heterodera glycines
  Genomic contig location: Contig_ID=SeqID_21402; Location=13..410; Strand=+
  SCN-specific regions: Sequence locations=1-335,357-398
  Gene Ontology: Mol. function=alpha,alpha-trehalase activity; Cellular component=extrinsic to plasma membrane, GPI-anchored; Biological process=trehalose catabolism
gtgacaaagacaaggccaacagctatcacaaagagttccaaacttttcgggaggatgtccatgatttgttctacgataagggcgggtggttcgactacgacctgaaaaatcaaaaactgatcaatcgcttctacggaagcattgttgtgccactgttcgcgagatgctatcacacggccgacgtggaggagacggaaaaaatgttaacccaattggaagagttcgacaagaaaaaccaaataatgagccagaaatttggggtgccgacgaggtaaataaatggcaaattgaactaaaaaaagaaaaagaattgtttcagcgcaattgcttcggggcagcagtgggatttccccaatatttggccggtaaaggcggaaagcgtcgtttattacaattaa

SEQ ID NO: 52014 - DNA, 1113 bp, Heterodera glycines
  Genomic contig location: Contig_ID=SeqID_21404; Location=614..1726; Strand=-
  SCN-specific regions: Sequence locations=1-78,103-270,307-354,407 -825,855-1011,1051-1064,1097-1113
atgattggacaacttttcgcttctgttctaccgcttgtcttgttcgccaacttaataaatggttagctttttaaagtgaatttttaatttttttttaatttagttggcgaaatggtccgtggtgggtcaaattcgctttctatgactaatggtggtgggccaccaattcagcaacaaaatccgagcatcaacctggtgacgaatgtcgcccattcacttaacaatctcaggctcaatccatcggcagaaggtaaagccttcggaaaattgaatttatttattcataaataaattatttttaatttagaaaatcaacatcaaccaacaccggtaaacgcagctcagccgaaaatgtaaaaataaaaaacattaaaaaattatttaaaaaataaatttaattattttagacggcaaaacccgaataaaaaaggtgtgaaagttggaagcaaaatgaaactgcaacaaaagcttaagagtggagtgaaaagcaaagatttgggtgaaaagaaaagcaaattgggaatggcaatgtaagtggacgaaaattttgaaaattcataaaaaaacgatagaaatttttgtattaacttattattccatcggacagaatggacaatcccaaaaatatcacgagactctcgaaaataattaaatttttatgttttcgaaaattatttctaattttttgggtttgaataaattattaaaaaaagctcaaaattataattcaaggttttatgtgtttatgctgatccgtttgttcgtgccacatacacatgtgccaacaaatgtgatgctccgtaagtattttttcatcatttttttaaatgcaaattatttaaaatttaatcaaataaaggctatgacaatcattttgtgccaattgagcaacaatttgtgtcatgccaacccatggacaataatggcatcgggcaaaagtgtgaattcattgtggaacaaatggcgatgaataagaacatgccgaatgtgtcgatttgggccaatttggacggtgacaaagaaacaatacaacaattgggccatcaagttggaataattcattcatttaattaaaacatttttttataattttattggataggcaaaaataaa

SEQ ID NO: 52015 - DNA, 261 bp, Heterodera glycines
  Genomic contig location: Contig_ID=SeqID_3822; Location=426..686; Strand=-
  SCN-specific regions: Sequence locations=1-71,212-261
atgtactgcaacacaaaagtccataaaatgaatgtaagagtttttgaaaaaattagcttactttctttacgttttaaataattttcaattctttttaagagttttaatttaaaaattattttccattttattaaaatattcagattctatgtttgtgaatttatttatataatttggatgttttattttaattttttcattttttatttttccaaaatttttttcaattttcaatttctttttgagcaatgatagaataaa

SEQ ID NO: 52016 - DNA, 570 bp, Heterodera glycines
  Genomic contig location: Contig_ID=SeqID_21405; Location=867..1436; Strand=-
  SCN-specific regions: Sequence locations=1-570
atgaccgtcacatccaacaccgaattccgactcatcgaatgtgtgccaatccttgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaatatgtttcatattttattgctattttaggtgaagggtttcttaaggcaagaggacggcacgagccaaaaagtggtcaacgaatattatgaaaaatatgatggactaaatggatttgctgaatttattcggaattgggcctttacttttttttgtttccatgccttatgaggatgacacatctgatgaagactaatttcgttaatatttattctatgctctttgttacaaaccgataaacaaatccatcagggttatttgaacgattcaaaatttgcataatattttcgaaacacaatccgacggacataaaataaa

SEQ ID NO: 52017 - DNA, 235 bp, Heterodera glycines
  Genomic contig location: Contig_ID=SeqID_21407; Location=388..622; Strand=-
  SCN-specific regions: Sequence locations=1-110,209-209
atgccgtatttccgaattctgtcgttggcattctctttcttaaaaggtgttccgcaccccgactttggcgaggcggtcgtcgccgtctgcgaaccttccgatgccttcgcagaaaagctcagcggcgttgcgcaccaattgacggacgatgagaagagtgccttccgtcaaacattggcaccctacaaaattccaaaggctgtccaatttatgccgttgccacgcaatcaccttg

SEQ ID NO: 52018 - DNA, 1010 bp, Heterodera glycines
  Genomic contig location: Contig_ID=SeqID_21407; Location=820..1829; Strand=+
  SCN-specific regions: Sequence locations=1-93,119-340,372-623,645 -704,747-763,804-945,976-1010
atgttggtcaccacgtcatccacttccggcgggtaaacattcagtccccccgtaatgatcaaatccttttggcgccctttgatccaaacgaagcctaattaaaaaagcaaacaaacaattaagttttataattacacgaacaaatcatttatgggagcagaaaaagtcaacagaaatttatactttaaaatccataaacaaatttttttttaaattttccaaatgacaaaggcattttaaataaaaaaaattcaagaacttttacgaattttatttaatattttctcctcatacagtaaataagttcatttcttcctccatcactcattaattcaaaaagaataaaatttaataaaataataaataaatttcaccgttttggtcaatttcgcccatgtcgccggtgatgaagaagccgtccgctgtgaattcctgcttggtcttctccggcaggttcagatacctacccgttgaacagactcggactcttcagctcaatgactccggggggggggggcgtcgtgtggaaatacaaacaaagaaagtgtgctaggcagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaatttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaatttttttgtcgatttttctta

SEQ ID NO: 52019 - DNA, 52 bp, Heterodera glycines
  Genomic contig location: Contig_ID=SeqID_21410; Location=1232..1283; Strand=+
  SCN-specific regions: Sequence locations=1-52
atggagaaggcctgcaaaatttggagagattatatcgattttagtgcgctag

SEQ ID NO: 52020 - DNA, 701 bp, Heterodera glycines
  Genomic contig location: Contig_ID=SeqID_21411; Location=190..890; Strand=-
  SCN-specific regions: Sequence locations=1-84,106-701
tttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 52021 - DNA, 156 bp, Heterodera glycines
  misc_feature (67)..(67): n is a, c, g, or t
  Genomic contig location: Contig_ID=SeqID_21411; Location=1008..1163; Strand=-
  SCN-specific regions: Sequence locations=1-39,61-156
aaaaaaatcgattttctctagtgtccgtttggggtactcaaacatttatggggagcaaaaatccacngcagattaaagtacaggctatagggaagctatccccgaaggatcggtctccccataaatctgggcgcatcggttcggggggactgcccc

SEQ ID NO: 52022 - DNA, 892 bp, Heterodera glycines
  misc_feature (806)..(806): n is a, c, g, or t
  misc_feature (826)..(826): n is a, c, g, or t
  Genomic contig location: Contig_ID=SeqID_21413; Location=135..1026; Strand=-
  SCN-specific regions: Sequence locations=1-118,141-149,200-406,428 -583,605-696,719-892
atggttaaaaaatttttccttttatcaacgaatatgccattcttaagggtatatttggggcgggggcgggggtaaggccataaaacctgtcccgtccccggggacggggtccgaaccctattttaaatatttgcaaatgttgttattgcatttttataatttatttacttatttattcaattttccatattttattttagctatattttaattgattttacaatgctaatttttcaaaaattagcaaaatttttggaaaatatgtgtaacgaaggtattgaagcggacgccatgaaggctgggggtccagcggtgtcgttaggcgccactgggaaaatgcacaaatgaattttctgaggagaagaggaaatgaatgggtgaatcaattgggcactgttgctgccattctctcttctgcctcttcttcggttgaccacgggcagaaaaaccaaatgaatcaattgggtgggcgtctcatcgggtcggcgtcagtttggcgcggccactggcgccggtttttggtgccgcttttttggagcggccgttttagcgcccgtaatggttttttggcgccagtgtttaaaaatcaccaaaattttaatttgcctttcattttggataattatatgtcattttctttacaataactcaaactcgaatatttagaaaatttttttgaaaatttttagggatgggaaaaaattttaaaaaattttttgcttatatatagggttgtgaattatatggactaaaaaacactaaatgtggacataaaatttggactaaaaactcaaaatatggtacanaacatggacaaaaactgccnaaatatacgttataacccctcaaaatcacaaaaatgtttaaaattcttggtcaagaaaataataaa

SEQ ID NO: 52023 - DNA, 749 bp, Heterodera glycines
  Genomic contig location: Contig_ID=SeqID_3825; Location=3..751; Strand=-
  SCN-specific regions: Sequence locations=1-107,142-344,366-452,484 -609,648-749
atgattcgtgcaatcacacaatttactcattcatctcaagtggatattattggctacagtatgggatcacctattgcaagaaagttactgtaattggcggtgtaccgtaaaatttaaaaaataaatttattaattaattttccatttttaggccattcttggtggtgtttgtgtggacaccgaagaacaattgggcccaccattaacccatttggtgcatacattcatcggcgttggcggtgccaaccgtgaagctgtccatttgtgccgactttttgagtgggcaatgccgtgcaatcctgtcaatggcatgcgatgccattcccaatttttatatgacattaattcaaagtaggaattttcattttagaaaactattttttaaatttacataagccgaaaaaatcggcaggatttattattaaaaacccaaatagggccacaaaattgagaaaatttaaatttaaaatattttaaattaaagggttggttatgaggcaaccacacgaattttcgtcattcggtcaatggacgacggaacggtggggacaagggattgtgaaggacgttcagtgagcgcaattgatggacaaaatgacgaaattgtggtaaatattaataataatttaaataattaaaaattatttgtgtttattcagctgcggaactacagccatcagatggtaatttttggaactggagacaacagctcaaacttttacattttgatcaattgttttttaaaatga

SEQ ID NO: 52024 - DNA, 562 bp, Heterodera glycines
  Genomic contig location: Contig_ID=SeqID_3827; Location=2612..3173; Strand=-
  SCN-specific regions: Sequence locations=1-532,554-562
atgtgcccgccggcgacaaatcgtacaacggacactgatcacatcaaagtggcggctgctacagtagacgattcgcgcgctaccgtaggcgaggggcttgcggacggtgacgacgacgcttcgcaactgcgacacgcgtcaacaccgttgctgacgcgctactattttgacgcggtcaccgctcaatgttatccgtttggtgcgcagacatgtggcggcaacgaaaatcgcttcgaaacgaaggagaaatgcttgacgaagtgtcgcattggcaccgattgatcttttcaaatttttatgtgattcaaattttgttccatcattgcctcgtttatttgacattttggcattcttcagactataaaaaccgggttggcaaattgtctttttggcgtttggaattgatggtacatacatagaccatcaatgtgtgttttactaaatccaatttttgagttgattaaggagcatatttttataagcttaaaacctgatccctcccctaaattagacccctgagaaaacccaacttatgagggagggggagggcgtgaaaaataaa

SEQ ID NO: 52025 - DNA, 925 bp, Heterodera glycines
  Genomic contig location: Contig_ID=SeqID_3827; Location=362..1286; Strand=-
  SCN-specific regions: Sequence locations=1-13,35-121,207-344,412 -536,565-779,802-806,828-925
ccaatattctgtctttattttgctgtgcctttttctgattgccgaatttggccacacttccgcagagtgccaaaaggacaaaaccgaagcgacaaaagaagcattattgcttcaatgtatgaaataaatttaatgcaaaaatatgaaaatttatttaaaatgttttaatgatttaagtgaataaaaaattaataaaaaaaatttttcttttagagaattttttcgaaattttggcaaattttttgttagtgtattttgatatttttagaaaaaaatttcgtcatacccctggtatggatcagggatggcatagaattccaattttttaaatcacctttcacttgatattttaaatttactattaaattatttagaaaattttattattttttttattttttcaaaaattttcgcaattttttgggtttaattccgatttccggaaaaaaaattttgtgtctcggaattccgattccgggaaaattttgggcttcggaatgccatctctggtatggatgagtttggtttattaccccattaaaattattaaaattttcaaaaattcagggctaaattaatagatcatcaagggcatttgtgcctaaatttgttaattacctaattaggcaatttctatttttagcattttagacttttttgctcgtggtttcccttttctgtccgactccgacgatttaccaacagcagcagcagatgaagtcaaacaaaaattgacaaataaatgtgattgatgatggtgatcggcagtgatcggttgagaaaatttaaaaagaaaattttaccaaaaatgtaatttcattaatgatttttaattggtgattggagtttgaaaatgagaatcgcagatcatctcttcatttttggttaatcaaatgaaataaaaattgaaaaaaaattgtacgaa

SEQ ID NO: 52026 - DNA, 341 bp, Heterodera glycines
  Genomic contig location: Contig_ID=SeqID_3827; Location=3465..3805; Strand=+
  SCN-specific regions: Sequence locations=1-133,155-203,225-278,300-341
atggcctcgaagattggcggcccgggcagccttggggatccgtcattatggggaagcagtagcagaacaagcacagcaatccttctcaacaaaaatgatgctgctgatgaggaatgtccaaattggcgatgtgttattatgggaaagttattctgataagctgataatgccattctaaatatagaaaattgttatagctcataattttcattattacagtaatttgaggagttgaaattgtaacaatacatcaatttgagggcttgaaattgtatatttcttttaaatattttggaaaatttcaaaaaaagaaatttcggaaatttaacgccgataaagaa

SEQ ID NO: 52027 - DNA, 157 bp, Heterodera glycines
  Genomic contig location: Contig_ID=SeqID_21419; Location=873..1029; Strand=-
  SCN-specific regions: Sequence locations=1-115,137-157
atgagtaaagtgagtaaaccagtaaaggagaaggcaacaaaagatgtaagcatcattgaaaaggaggagccagaatgtttttatgttaaaaaaattttggcaatgtacgtgtgccatgacaaagaaaaaagtcgacttttctacattgattgggaag

SEQ ID NO: 52028 - DNA, 1781 bp, Heterodera glycines
  Genomic contig location: Contig_ID=SeqID_21421; Location=457..2237; Strand=-
  SCN-specific regions: Sequence locations=1-170,192-256,291-680,702 -830,853-1087,1129-1267,1289-1394,1426-1530,1577-1781
atgtgtgaacgacgcgttggcaatgtgctcaccgaccgcaaatgtggcggatctgatgcacttgttgtgcggcgtcaaactgaccaaacgcgagcaaatgaagtgcaaaattttctccgaaaaattcatgctcaaaagtcgacttcggcaaagccaacgaaacggtaaaatttttgaaaaacaaacttttcttaagttaattttctggaaaaaacgcttctatgaagccaaaagtgttttaaaaatacctaacatgaaataaaattcaaaaaaaaaaaaattttttttttgacaaatttaaaaacctaacgaacaatttgttttactaggaatttagggggttgagcggtttttttttctttaattattatttttgccttatttcaacagaattccaagcggttgctgagtttttctccaccaatgcgctccgggcgtacaaacgcgtgttcggctttgtgtccaacctgcagttgcagcgggctcagttggactacacgggacagaatttgttacgcgttgtgcgccagcggttggccacacggagcggtgcgttttggtgcacagtccccctccccctcgaatcaaaaaaaaattttttaaatcttttttgagattttttgaaacttttgtagaaaaacatagttttgtcatcataaaattttgaaaaaatcgctaacaaattttcaatttaaatttttctaggtttctattttgaaaagtactaattgtaaatttgatttaaaaaaaaaacttcggggggggggagaggtcgtccggcgcgtagtggagaaggacaggaaaaaaattttataaagcaaactggcatattttaactaaattttttatttgttgcagaatatcgttcctctttctactcgatgctcatcattttgcagaaagtccgaatgtttctcaaccgactggcccattatgtgtttgaagaggtacaaacaaatttaaattaattaaacaataaattggtgacagaaaattggaaaaaatgcctgtctcgaatttaatgaaaaataatcacatttgagtatgtgagattctaaatttataactgtttgattatcatatcggatcctctgtttaaaaaataacaaaattttcggaaaaaatctcactaaaaggtgatgaccacccccattctttaggtgttgctgttggagagcatttacatttttgacaaagttcgtgccacgaaggacccgcatgtactgcttgcgggcctttacccgttgctgagtggcgtgttgtgagttcattactttttatatatgtgtgataaattaactttaatttaacctaaataattgatttttgtgttttttttaaatttccctttctcaaaaaaccataatttacatttttgcaatatttatgcagggtaaaatattataaatttaaaaaaaaaattttccaggctcgcacttttcttaccgtccgctctcagcaaacttcatgaaagtgtgcagcagtgtattcgaaatgccagtgattttgtgggatcaagtaagaattttcttttttaatttaattaattaattattttttatcattttttaaatttccccttacaaatttcagtcagcaaattttgtgtgttcattgaacactcggactcggatgtgttggatgcgctgttgttggcatcgactgacgacgacgacggcaccgcaacaaacgatgaccgggacaccaacaaaaacatcagcaaccaacaccagcaggacgacgaagatggcactgatcatcgtcatgatgacctgaggtaa

SEQ ID NO: 52029 - DNA, 410 bp, Heterodera glycines
  Genomic contig location: Contig_ID=SeqID_21422; Location=22..431; Strand=+
  SCN-specific regions: Sequence locations=1-68,91-410
  Gene Ontology: Mol. function=pre-mRNA cleavage factor activity; Cellular component=mRNA cleavage factor complex; Biological process =mRNA cleavage
atggtttctccagacgaagttgctgaagagtataggttcgtatttaaattgaccaattcgttcggttttcttgaaaaacaaatactaattcagggcagcgctgtcggagctgacacgcaatgacaagactcagatcaatctgctcacaattttggccgaggattatgcgtcatatgccagcgcaattgttgctgtgattgaggaacgtctcttcaaggttttttgaatgggactttatttttgcatttctttactgaatagcattgcccgttcagtgtccatcaccgatgaaaatcgtcatgctctatgtgctcgactcgatcgtcaagaacattcccgcgacaagcggcgcctaccgtgacttatttgcgaaaaggattgttgacatgattgtccatgtgttcaaggag

SEQ ID NO: 52030 - DNA, 836 bp, Heterodera glycines
  Genomic contig location: Contig_ID=SeqID_21426; Location=157..992; Strand=+
  SCN-specific regions: Sequence locations=1-117,156-375,397-665,687-836
atgagaaaggaacatgcggacagaccaacaaaagttgagctgaccaagggaataagtgtactgatgaatagaggtggcgaagaaggcgaagttgttgataccccacgccgtcctcccgctcctccaccaccacctcctcctcctgggagacctcttcgtcgtccaccgccgagtcctccgggtcccggtggtccttcgccaccaagtcccccacctcgtccacaacgccccccgagaccgagcaggacttctcggagaagtggtcgtatggagcaatggcgacaaaggcgatacgatatacagcaacggcagccgccgccgctggtagtgcgagacctcctcgcagaagcagctgctgcgccactgcccgaaagtgacgatgataatgatgctgatgatgagtatatgttggagaacggattcgcgctaccagcaccatcacaatactatggcgatttgcctgtgctgccgacaatgcggaagaaattgaggaaatggacacagctcagcgcaggattgccatcagaagaaaattactcaaggacgaggctgacgatgatgatgatcaacgcaaaaaatataggatttatcaacctccaccactgcctcgcgcaaaagtaaaagttgagccgaggcctcctccagctcgaccacgtactaacatcaagagagaacaacataagccaaagtcagaattcaaaccgtcgctggcaccaaagcacgttgatcaccccacttctacacctagggcaaaaagagagcctgactttaatctcgatccacgaccatctacatcaagacaagccggatataacccgcctcccccgacgcccaaa

SEQ ID NO: 52031 - DNA, 575 bp, Heterodera glycines
  Genomic contig location: Contig_ID=SeqID_21427; Location=31..605; Strand=+
  SCN-specific regions: Sequence locations=1-224,247-430,452-575
atgcattctgaaacagttttcatatatgctcaggaacaagagccgaaacataatgataaaaactggaaggcgccgttaggggcggtactaaaacatcaaattttggacccgccacaaggattcggaattcctgtttcaggaataaccgatttctacatatatcttaggcgttgtgcagcattttttcctgccaatgcagagaatgcagacctgttttcaattaatattataatgccaaataatacagaaggattaacaatatggtaaattaagtttttaagctttagatttcagatagatataaaaaagatacccattaaccatcttttgtctaaaaaattatttataggtatagtatcccagctgccgattttcaaaaatttaaaagtctagcagtacatattttgtgaaagaattttcaaaaaccgatgaatatttaagaaagaatacacccaaaaattcttgtcaaaaacagaattcgctttgttcgaacggcggggagggtattttaacactaccagggtcaattcattttggatttagtacggtaaaattttatttataaacttgcaata

SEQ ID NO: 52032 - DNA, 1733 bp, Heterodera glycines
  misc_feature (15)..(15): n is a, c, g, or t
  Genomic contig location: Contig_ID=SeqID_21428; Location=1..1733; Strand=+
  SCN-specific regions: Sequence locations=1-20,42-52,74-447,474 -571,604-608,636-666,691-774,796-917,956-1045,1107-1332,1354-1733
  Gene Ontology: Mol. function=microtubule binding; Cellular component =spectrosome; Biological process=body morphogenesis (sensu Nematoda)
gagaacaggaaaaanccgaattttttcttggcgttgactcaagaccgggtacaaaaaatgtacccccaaaaattgcgtcattttcttacactttttttttcaaaaacagtgagttgaacacccatcagccccaagtggaagtggtgcgctccaagggcaaggagttggccaagtccagcgaaattggcgggccggagattgagcgccgtatcaaagcattggaccaaagttggacacaaatggtcgaattggcagaggaccggcaaaaaaagctgcaggagaggtgggaaaagggagaaaaagcattgaaaatttcaaaattatatgagtgaatttattttctccaattttctaatattttttgaaaaagttattgaaaaaatatctcttcaaaagctacacaaagcgatattttcaaattttatttgaaattctcggtccaaataaatttatttaaatttctgtaataaatctcaaatttttggattttgctttttatttattgcttaattttataaatacctaaaattcagtcaattattttgcgaaatgaacattgattgaattacccaataataattaaaaatttatttttttaaatttctattccctattttttcctccccttcccatcagtgaggagttccaaaatttcattggccgtgttgaggaggaggaagcctggctgaacgagaagcaacagatactcagctcgcccaacgtcggtgagaacatggctgcagtgcagggactgttgaagaagcacgacacgttcgaggtggacctgcagatgcaccagcagcgcattgacgaactgcagcgccaaggcgaacaggtgggagacagaatggcatggcacacgcgggggagggcgaaattgacacataataaagccaaaatttgtcttaaaaagggacatattaaaatatttttattcaaaattaataattttaaagaagctaacatatttgtttccttgggtgactttataaacactgtcgaaaaaatttctcaaaacgaaaatctcagaaaaaagatcagctactttattttattaacattaaattcctttaattttgttaattataattattaattgataattacagctcatcaattctggcaatcaccacgcaaagaacatcggcacgcgcacggaacaattactcaagcatttgatcctgatcaaagaattggccgtccaacgattgcaaaagttgcgcgacaacaacgcgtacatgcaggtagataattgactcgttgttgactggtttctcaagactgaaagtctgtctaataatattgactttttcaatactctcgaaatggtggaaatttttctgattattttaaatttttgcatgaagactgatcagtcattaatataatccggcattattggattcagagacatggcatctaattgtttgaatgacaacttctatttattcgagacttcttaattttgagactccccttaaatgaagcgggattcgaataatttttgtccaccttcaataattcgcatttcttatggcaccaaaccggatttcgaaatgccgtaacccaatggtccaatttttcagttcatgtggaaatgcgatgtggtggagagttggatcggtgacaaagaaccgcacgttcgttccgctgattatggccgcgatttgtcgtcggtgcaactgttgctgaacaaacaggacactttcgacaatgggctgaacaattttgag

SEQ ID NO: 52033 - DNA, 315 bp, Heterodera glycines
  Genomic contig location: Contig_ID=SeqID_418; Location=2273..2587; Strand=-
  SCN-specific regions: Sequence locations=1-96,119-315
atggccaaacgttcgcttttggccaagaacgcgtcaaccaatgacctcacccaatacatcaatcctgtcctcgcaaagtaagttaaaacctaattaatcttaattaattaattaattcggtttgccacatttagtcgtcgccgttcttctctgttctgcaccgctgtcgacccggcaatgaaacggctgcggcagcgcgaggcgtacaaaacggcaatgtgccaagtgggggctttcactgctttaggaaagaagcattggcttcgtttattttaatttaccttatttgtttaattatttggaataattaataaa

SEQ ID NO: 52034 - DNA, 1272 bp, Heterodera glycines
  Genomic contig location: Contig_ID=SeqID_419; Location=1814..3085; Strand=+
  SCN-specific regions: Sequence locations=1-47,70-298,332-381,404 -626,649-828,850-984,1042-1272
atgaggtacaaaagtgagtaaaaatacagtaagttaaaagccatgaatagttaaacaaaaacccatgaataggaaaatcgacaaatatatggaaggattatggggtgtataaaagtgattaattaatccacagagacagagagcgaccggcccatgcagagaacagcgacttgagtcagtttctaattgcttatttgaatgtaagctctttaaatctcaatgattcttcgagatgaaccgtggtttaagcgtgtcataaacataaatttctgaccccgcccgactaattagtgcccggtcggtctttctctgttgaattgtttaaacagtgaattaccaatgccacaattagtggttgcctgtttgctgctgatggccaacgtgttcatcttcatattcatcaacaatttctgcacgaatcagcacttcctccggccacaaaacatccgaaccgaccagacgaatttcctttttttaaattagggcataattaagcgtaattaattatgcctaagggcacctctgtcgaagtgtcagctgccgaggtgaagtggaggcggcgaaaaagctttgaaattgccgtttccaatactttgttggcgagcggaaggccaacacaatggcgcgggccaaacccaccaaagggcagccaattcaattgccaatccgcggggagggaaccgtcgtccaaccatctttcgggaatatggttttaattagtaattaaaattgttgcaagccaaacaaattcagcgacagttttggggagtgtcgcggggtcgcccccccggggcactacgttcccctcgccccgccccccgccccggtatccttcaccacccacaccaaaaaatttcaaacccagaaattttccaataaaaagtcttaaattttttaagaaaatttcaagaaaaaaaattggaaaaattttgcggttttgttggatgaaaaaaaaatttagaaatcatcataaaacttgaaatctttaaaacaaattttaaattaaaatttctgaattttctttcaaaaaaattttttttagatggcggaaagggattatattttgaagaaaaaaaatccaaatgtttcccaagtggaccttaccggcctcagtggattttttacacagggacgagggaatggggaggtccgttggactcatttgtcagtgtggtcaagccgaaaagcacaataagtaaacagcaggtaaagcagggaatcggtcgttttggcgccgccgttttggcgccagcctcagtttttttattataa

SEQ ID NO: 52035 - DNA, 733 bp, Heterodera glycines
  Genomic contig location: Contig_ID=SeqID_421; Location=723..1455; Strand=+
  SCN-specific regions: Sequence locations=1-100,124-277,299-733
atggccgcgaccaaatgcagcgaagtgctaatgatagggagaaaaaaagtaaatcgactaattatggccggattaattagtgaacttcaaggaaatgatggaagaaatggacaaaaaggtttggtctcgaatggaatcgaacccacgcctccacccacagtcgagggcaacgattaaccactgagctaacaaataagcgggcattcactactttccgcattatacctactcatagcttttttccttacatttatttcaggaaaatgcgagaaaatctcgagtttgagaagagtcgcataacattagatatgtaatttaaaaaaaaaatgcgactcacttgtgaaaatcaattgctttgccctcattcgctgcaattgtgcgcagcattgagtccacggcagcatttagcaacggagtgagctgagaagaaaacgccatctttcaatttatatttgtgcactaattactcccccccccctccctttattatgtgccgctctccaaaaaatccacgccccttttgagtgaaaagaatgtctacggtagccccattagagcaattacgataactgtgtaacggagaaaaaactcaccgccttcacttttgtgtttgagaagacggacacgttgtgcctcaacttcttccaatggtcgccggaagcgatgaacacgtggccagttttggaagaaaagtccttaaattcgacaattttttaaaaatgatcaaaaaata

SEQ ID NO: 52036 - DNA, 1380 bp, Heterodera glycines
  Genomic contig location: Contig_ID=SeqID_421; Location=4799..6178; Strand=-
  SCN-specific regions: Sequence locations=1-13,37-203,226-466,488 -511,533-966,988-1195,1217-1380
ttgggatttggccaaattaaaattaattaatttattgtttctaattttctatttttgctcatttggcccaattaattaattaaacactgacaaaaaaaagtaaccaaaactgctgaaatgtgcttaataaaagtaagcaaacatttaacaaaaatactttgatgttccaaaccttctgactagaataaatttggttaaactgataagattttttaaaatatttttgatgattttgtgtaaataaaatggtcaaagattgatgcccaattgaatttgcttcgtgcggaaaaactgtgttaataaaagtgattagtgaaggtcacaaatcggaaacgcatgtgatcatttgcaaattatttgggtaattaaatggcatttgacttttatcggcccacaaattacggtaattgtgctaaaaggccaaagattccattcaaatgattgattatttgtgctgattaagcgaattttctccgtaaaaaagccctttaaaaggcatgccaaaaatggaaattcattcaaaataatttaattttctctgttttccgaattacaaaatgccttcttttctgccaatgcttttcctcctcctctccgtccaattgctctcctttttgccctgctccttctccgcttcgctttctgttgctcccgcttacaccaccaaagacacgtgcctttccgagtcgagtgccagcgattcgatcagtgcgcagctgaacaaaccgatcagcgggggccaattcactttttacggaatcggcggacaaggcgcgtgcgggttggacattgccacggtatggacgatgatcggacaaaattgtgaattgactgatcaaaaatagacaccgaaaagtgatcagagacaggcatttggggcaacaaatttgacaattattaccgtaattagcaaactttacgtgcctttttgcttaattaatgcaattacatagaaacaattggtgcttataatttatttcttcaaaagtacatcaattttaacattggaaaggtcacaaatttgaattttccgcccaattttagcccacaaaatctgccgctggctccggcacacttttcaactccgacgccgcgtgggttgagtcgtgtttgccggacgcgcgttacttgctcaacgatttggtgtgcattaaccgatgcgtcaaaatcgaatacaaagggaacacgtaaacattgaaatttggggtttaattaattgttcaattgactcaatttggcttaattagtttgactgttccgatcaacaacaaatgttccgagtgcgcgaaagaccacgtggatttgtcggaggaggcgttcaattggttggagccgggcggcggatcggtgggagtggcgaaaagtgaaaaagcaaaaaca

SEQ ID NO: 52037 - DNA, 1071 bp, Heterodera glycines
  Genomic contig location: Contig_ID=SeqID_422; Location=590..1660; Strand=+
  SCN-specific regions: Sequence locations=1-409,431-638,660-948,1028 -1071
atgccttcttttctgccaatgcttatcctcctcctctccgtccaattgctctcctttttgccctgctccttctccgcttcgctttctgttgctcccgcttacaccaccaaagacacgtgcctttccgagtcgagtgccagcgattcgatcagtgcgcagctgaacaaaccgatcagcgggggccaattcactttttacggaatcggcggccgaggcgcgtgcgggttggacattgccacggtatggacgacgatcggacaaaattgtgaattgactgatcaaaaatagacaccgaaaagtgatcagagacaggcatttggggcaacaaatttgacaattattaccgtaattagcaaactttacgtgcctttttgcttaattaatgcaattacatagaaacaattggtgcttataatttatttcttcaaaagtacatcaattttaacattggaaaggtcacaaatttgaattttccgcccaattttagcccacaaaatctgccgctggctccggcacacttttcaactccgacgccgcgtgggttgagtcgtgtttgccggacgcgcgttacttgctcaacgatttggtgtgcattaaccgatgcgtcaaaatcgaatacaaagggaacacgtaaacattgaaatttggggtttaattaattgttcaattaactcaatttggcttaattagtttgactgttccgatcaacaacaaatgttccgagtgcgcgaaagaccacgtggatttgtcggaggaggcgttcaattggttggagccgggcggcggatcggtgggagtggcgaaaagtgaaaaagcaaaaacaaaattggcattaattttcatcttaatcattttagatgctacaataacctatgtgaagtgttaaccatggggatatgaatgatctatgaaaatgctcttaagtgatattcttctattttatttcacatttttttgttaaaataattattaaatattattattcaacaattttcttatttttattataattgcttaatttaattatgaatggttagttagtcttttttttagtcttttatttattcgtga

SEQ ID NO: 52038 - DNA, 3782 bp, Heterodera glycines
  Genomic contig location: Contig_ID=SeqID_3828; Location=1420..5201; Strand=-
  SCN-specific regions: Sequence locations=1-424,448-448,470-729,752 -836,858-909,931-1070,1092-1210,1232-1928,1966-2106,2128-2964,2986 -3608,3632-3782
  Gene Ontology: Mol. function=protein serine/threonine kinase activity; Cellular component=membrane; Biological process=protein amino acid phosphorylation
cagcaacaacagaaccgaattgttatttcaatcacatcacattgttcgtcaatgagcaccagcaacaaattgcgtcgcaaaaacagcagcagcgcaacgccctcctccgcctcactgctgcacatcaatgatgcacggattgcgggactgtacgacttggagcacaccattggcaagggacactttgcggtggtcaaattggcacggcatgtgttcaccggggaaaaggtggccgtgaaagtgatcgacaagacacggctggacccggtctcgcaggcgcacatgatgcaggaagtgggaaaagcaaaacaaaaaggggggagcaaaacaaaacggaattgaacaaagacaaattgtagggaaagtttgaagacaaaattaaccctttttattacttgtaccgaccgattgggcacccggaaacttattttttttaaattaaaattagggcaaattaaaatagaatgaagtccaggcaacggaatggttcaatacaatagttaaatctgcctaatttaatgccatggcaaaacaaattccattttttttctattactatattaacttttaaggtccgatgcatgaaattggtgcagcacccgaacatcgtccgtctgtacgaagtgatcgacactcagacaaaactgtttctaatcctcgagttgggcgactacgacatgtacgaatgggtgatgagaagaccctacgaaaagggcggaggcggcgaagcggaggcgcagctgtactttagccaaattgtcaaggcgattaactactgccacaagttacacgtggtgcacagggatttgaaggttggcaatggacggaatttcagagacaaaaacaattaataaacaaattgccgtacttttccattgcccatcccaaaaaaaagttttaaatgtctattttcctaacatttgttatttcagcctgaaaatgtggtgttttttgaacggcttggcatggtcaaactgacggacttcggcttctccaatttgttcgtccccggcgaacagcttcaaacgtcgtgtggaagccttggttttttaataaaaaaaaatagcaaacataaaataccccatttacagcttattcggcacctgaaattttgctgggcgattcgtacgatgcgccggcagtcggtgaaaacccaattaaaatttggtaattaaatttcattcccccccccttctttagatgtttggtccctcggtgtcattctctacatgttcgtctgtggtcgattgcctttccaagagtccaacgactcggaaacactcaccaggattttggactgcaaattttcgtttcccgaccacgtgtccgtcgattgtcgaaggtattccttcgccggcattttgtgtgattacattgtttcccccgccccattaattaggctaatttcgtcgatgcttttgcgtgatccgtcgcgtagagcaacccttgagcaaattgtgcagaacaaatgggtaagtcggtgaaaatggaatacattttgatgaaggatttgtcattatttccttttcttaggtaaaagccggcgacaagggacacgccgaggcactgccactgataatacgcgaccatttgcccgcgtgtgctcatgcgaccattgtcgagcaaatggtggccgggaaaattggcggagaggaggaaattctttggtaaaaaatgctatagggtcgaatttttattttttccaggggaaatggccaggcttttctgttaccaatttttttcatttccattaagaaactttcgttgacttttttgccattttcagtgccattgaattaaacgaatataatcatttgacggccacttactttctgctcgccgaacgtgttctttcctgctatcgccaggcacaggcgaatcgtctgatggcagccgttgaggaatgccaaatggggtgaataaatgccattaaattttctaattattctttttattattaattatccctttgtcaggtccagcgacctctcctcccaactgtccaacggcggtggcactgctgcaacaacggcgaatcaaaatcggagtcggagcagaagcaactcgtggcgagggccggcaccacggcgggcctactccatactgaaggaggagagcgaggaggagttgtcttcgtacaacttgcgttcctcgtcgcggcaatcgtccaggtcagtgggggggggggggggtgaaaagtgtgcggggttaacgctgcccaccgacggaatactttccgggaatcgaattaaaccaacaatttctaggtttttcaatgtcgtcccgtcgtctgctggcgttgctgtcagtgcaaagcctcgcgacgcttccgcccgttccaatttgttggccaccagccgagcgaatagcaacgacagttttgcgccgggtccatcggccattttggaggacgaagttgaggcggacgaacaacagaagccgacttcctccaccgaccaaagtcaatcccagtcggaagacgacgctctggcatccctccctccctcgacttcttcaacggcacagtccgtcgattttccgcctccatccgccacttcgacaccctttttgcaacggattctcgccccaatttgcgaatttcgcgatcaatcgccggataccgccgtcgattccgttcaaagtgcctttccgttcgatgttccgcttgttgcaaatgaaagtgcaagcggcggaggcattgtccgacggattcgaccccattcagccgtttttggtgcgtccgccccacgaccggtgcctggccgaggcgtggcacttccgtcctccgctggccatcttccgccgcttccatcatcgccagaaaaaatgcggacaacacgcaatggccataaccattcgcggatgcgtaatgcttccagcctggaaatgtttccgatttcaaatggaattggtggcaaagaaaacggctcttcatttctgctgctcgaaccgtgctcggcgaccagtccacccacgccaaatccaaacaacaacggtgttgtccactgctggccgaacatgctgctcgaacggcatccgaacttcaccaatctgtgcaatttgccgatctcttccgccgccaatttgatcaaacgcccctcctcatcgtcccttacaagaaggcgagtagttttttctgctcgggcatttgtttttgattttcattttttattcaggaattcctccccatcagcgccactcacatttcgtgccaccagcagtctccattcgtcatgcgatcggattagtccccatgccattcaagaactactagagttttcccggctgtcgggtcgaatgagacggacggtaattggccaacctgctaattattttgtttccactaacactttccaggccagccccgattcccgactgtccagcagaagtcccagtccgtcctgtctgtccagcggtcgtacttcgccagcaatgtccggcattgtttcccgcctgaaaaccaccaactttttgccgtccaccggtgggatgcgcaaattgagcagcagtccgcatctgctgggtatctgtgaggtgggttttctcctgactcattcattcaatgttaaaattgcttccaggagactgaagaaggcggagatatgcaagacttgctgggccaaggcaacagcgccttctgccccgacacattcatcaccagcagagccaacggcacaagtcggcgtcaagactttcagtgcaatggcaaaagcgcttccgcggtcgtcgttcgcagtgcgcggtccgcctccatgggattgggcaccatcgggcgaatgtcg

SEQ ID NO: 52039 - DNA, 1065 bp, Heterodera glycines
  Genomic contig location: Contig_ID=SeqID_3828; Location=2182..3246; Strand=+
  SCN-specific regions: Sequence locations=1-35,57-893,915-1065
atgttcggccagcagtggacaacaccgttgttgtttggatttggcgtgggtggactggtcgccgagcacggttcgagcagcagaaatgaagagccgttttctttgccaccaattccatttgaaatcggaaacatttccaggctggaagcattacgcatccgcgaatggttatggccattgcgtgttgtccgcattttttctggcgatgatggaagcggcggaagatggccagcggaggacggaagtgccacgcctcggccaggcaccggtcgtggggcggacgcaccaaaaacggctgaatggggtcgaatccgtcggacaatgcctccgccgcttgcactttcatttgcaacaagcggaacatcgaacggaaaggcactttgaacggaatcgacggcggtatccggcgattgatcgcgaaattcgcaaattggggcgagaatccgttgcaaaaagggtgtcgaagtggcggatggaggcggaaaatcgacggactgtgccgttgaagaagtcgagggagggagggatgccagagcgtcgtcttccgactgggattgactttggtcggtggaggaagtcggcttctgttgttcgtccgcctcaacttcgtcctccaaaatggccgatggacccggcgcaaaactgtcgttgctattcgctcggctggtggccaacaaattggaacgggcggaagcgtcgcgaggctttgcactgacagcaacgccagcagacgacgggacgacattgaaaaacctagaaattgttggtttaattcgattcccggaaagtattccgtcggtgggcagcgttaaccccgcacacttttcacccccccccccccccactgacctggacgattgccgcgacgaggaacgcaagttgtacgaagacaactcctcctcgctctcctccttcagtatggagtaggcccgccgtggtgccggccctcgccacgagttgcttctgctccgactccgattttgattcgccgttgttgcagcagtgccaccgccgttggacagttgggaggagaggtcgctggacctgacaaagggataattaata

SEQ ID NO: 52040 - DNA, 582 bp, Heterodera glycines
  Genomic contig location: Contig_ID=SeqID_3828; Location=3334..3915; Strand=+
  SCN-specific regions: Sequence locations=1-582
ctggcgatagcaggaaagaacacgttcggcgagcagaaagtaagtggccgtcaaatgattatattcgtttaattcaatggcactgaaaatggcaaaaaagtcaacgaaagtttcttaatggaaatgaaaaaaattggtaacagaaaagcctggccatttcccctggaaaaaataaaaattcgaccctatagcattttttaccaaagaatttcctcctctccgccaattttcccggccaccatttgctcgacaatggtcgcatgagcacacgcgggcaaatggtcgcgtattatcagtggcagtgcctcggcgtgtcccttgtcgccggcttttacctaagaaaaggaaataatgacaaatccttcatcaaaatgtattccattttcaccgacttacccatttgttctgcacaatttgctcaagggttgctctacgcgacggatcacgcaaaagcatcgacgaaattagcctaattaatggggcgggggaaacaatgtaatcacacaaaatgccggcgaaggaataccttcgacaatcgacggacacgtggtcgggaaacgaaaatttgcagtccaaaatcct

SEQ ID NO: 52041 - DNA, 387 bp, Heterodera glycines
  Genomic contig location: Contig_ID=SeqID_21429; Location=359..745; Strand=+
  SCN-specific regions: Sequence locations=1-82,116-138,160-387
atgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttag

SEQ ID NO: 52042 - DNA, 1677 bp, Heterodera glycines
  Genomic contig location: Contig_ID=SeqID_21430; Location=38..1714; Strand=-
  SCN-specific regions: Sequence locations=1-123,191-462,484-869,892 -1138,1160-1189,1224-1300,1330-1383,1405-1677
cagctgcgacagcgagcgcggcgattgttgcggcgtcgactttggcaccggcagggccaccaaaacaggcgacaagggcacccagcgactgttgcgacggcaccgcgacactggtgactcccgcgccgtcgtcgccgacaccgcagttgtcgtcgcaacaatgccatcgtcccagtcgctgtcgtcgtcggccgcgactgcggctgagacgacaacgagtaacaacgacaacggcaacagcaagaagaagtcgctgcgagaacgcttgcggcacccggacttgcacctcggctcgctgttcaccagcggcaaaagcggcggcggattcggcgcgtttcgacgcgccacactttcaagcggttgcaatgatggtcgtaaagctgcgcggcgacaacaccatcatgccgtcgctgcggctgctaacagtcgccatgcgaccgcgtccacaacggttgccgaggagtcgccaccgccgccgctcgctggtggctgcggcgacgacacgcagtcgctgctttcgtcggtggatctcaacaagtccgaggaacagccctatcatcatcagcaacaagtgccgtcgtcatcgtcgtcgtaccaaccggcgccggtgccgacacgcgggcgactgcagccgagcgtcagcgtcagctgttccaccggcgcgggtgccgtcggtggcagcagctacaattaccatacccatttgggcggcatgggcgcacacgggcgacgcgaaagctttttgtaccgggcgggcggcttcggcatgacggacgacacgtcgccggtgttgcagttgcgcgactatgccactgttagcggttgcggaaacagtggcgctgccggtttacaacgaccggcaagccgtgccagctctgtggccagcagtgaactgacaaccgccgctatgtaagtgccacccgccagttgtggtggtgccaaagagtttatggacaatgccaacaatggcacttgttcttgttgccaaaactttgaaacgctgcgccaagcattttgcgccaaattcaaattataagacgacggcataatctccaaaatggcaccaaccgaagcttggggatttatcccgattagtatacccttatttttggttcttctattccatgattaacgcatattttttgttttcccaattttgtcgagattatgtccatttttagacaaattgtaaatttttttcaaataatttaaatttaatttttcatgcaatttttgtagtgattagagggtttcccaacatattttgttttcgggggattatctgagaaatgagttaaacaattgaaaatgtaaaaaattttgcatatttggcgacatttatcaatttggcaattatgtaatttttttttttacgttttaatcgaaaattaaaaaattctaatatttattggatcaaaacaccaaaaaaaaaaattgtgccaaaattaaaatgcccgatgtttattgtgtggttccttccaggcacggcgacgacttcatcgtcaccccgttcgcgcaactgttggccagcctgcgcaatgtgcgtgccaacctggtggccattgccaatctaccgcaacagtgcacggcactggcgccggacgatggcaccgccatcgcaacgatcaatgtcggcggcgccacttcctcggccaatatgaacaatgtgatacaacg

SEQ ID NO: 52043 - DNA, 1227 bp, Heterodera glycines
  Genomic contig location: Contig_ID=SeqID_21431; Location=155..1381; Strand=-
  SCN-specific regions: Sequence locations=1-268,295-306,356-394,473 -507,553-556,578-616,645-1046,1068-1080,1109-1227
atggataagccaaaatgtgatgatcaatgggtgataaagcaaatgttaaacaatctcggcacatcaccaacccaagaggaaattcacatgcgcataatggcacatttgattgaaacgaatgtcccttttttcgactttatgcatcaaagtgcaacaaatttaccacattcgtttttgtctgaatatggtaatttgtttatagggcacgagttttttgaccattttctgccaatgaaaaaatttccgccctcccccttaaaaattcatcttttgaaaattaaaagaaataaacatactaatcaagagtaattttttttattttatttaatgttacattaaaaaataacttaaaaatcattctctgcttttgaagttttgaattaggtcaatttacaattataaaaattgtttttttttgtttattatttaatttttttaaatagacgaaatttttatattattcttttaaaatgccactatttttaccactattgtcattttgattcgttaataaatatatttaattttttttctatttaaacttaatttattcacttttcttttaagcctttccagttaagcatttgctgaattttaggctcaattaatgcaaaggaattaaatattttctataaaaattatttgctgaagcaatcaaaaattgttgggtcatgggaaataaaaatgataatgaagcttttgttcaagcaaagtgctgaagttgaacagaaaatgcatcagacgaaaaaaaacgaagtgcaatggcaattgaaaaacgaattttccaaagggcaaataaatgaattttatgggccacaaatgctgaaaaaagcgcaaaaaatgagcgcacccgaattaatagggcaaattgtggaacatgcgcaaatatttagcaaatataccgcggcggtatgccaaaaggctgcggagccgtacgcgaaaattgccaacgcaaaagccgaattgttcgcaatgcttaaggcaagtgcaggcgaaatgccaaaagacatagagactaatgagcaatcaattaaaaaaaatgacactttgttaggttttatttgtaaattgactcaatgttaaatttacaattttaaaaaactttcattaatctattttttaatgctgatcaaaaaaagtttattacaaaacaatgatcagatcactccttcacggagaaccgaaagccacgaaaagcttacaagggaaaattttcgcaaaaataaa

SEQ ID NO: 52044 - DNA, 944 bp, Heterodera glycines
  Genomic contig location: Contig_ID=SeqID_21433; Location=230..1173; Strand=-
  SCN-specific regions: Sequence locations=1-129,167-215,243-492,533 -700,722-764,788-851,885-944
cccggcaatttgttggtcaattccaattgcattctgaaaatttgcgactttgggctggcccgcatcttcgaccgatgcgatgtgcagaatatgacacatgaagtggtcacccaatactatcggtgtgccaaaaaattttaaaaaaaattcaaatttaaaaatttttcttacccccacagggcacccgaactgctgatgggtgcgcgaaggtgtgttaattaatgaatgaattaattaattacgcaataattgttgggagaaaagaccaatttaatttgtccccaatttttcaggtacaacgaaaaggttgatggtgagttttttttaaaaattttttcggggcttttgaaatattaaaaaaatttaaccgtggattttcattttccatttttatttcttatttttgttcgatttgcccttctccattcttaggtatgcatttgatggactgggaaagtcatgaaatttaaaatcggaaatttaaactgcggcatttttttaagtttttaaaaatgaaattttaaaatattttcagtttggtcagtcggatgcatttttgccgaggtgaattctgaataataaaaaccaaaatatcttataaataagtaacccattacactttaatttagttgctttcccgtcggattctgtttcaaggtattaaaacagataaatattttaatttttgctccaattttccattttttaatttttattttttccattttcagcccaaggcccaattgatcaggtgctttttgtcgtactttttgttctcttctttgtttatttgttcttaaattttcatttttacagcttaacatggtgattgatcttcttggtaattgccctaattaatgttttaaatatattttttaaattttcctcaggcactccgaagccggacgaaatgcgcgagtgttgtgagggggcactgaagcatg

SEQ ID NO: 52045 - DNA, 60 bp, Heterodera glycines
  Genomic contig location: Contig_ID=SeqID_21435; Location=425..484; Strand=-
  SCN-specific regions: Sequence locations=1-60
agagcccgtgaacagctgcatcggatgcaagtgccgccgttgctgtacgcctaacagttg

SEQ ID NO: 52046 - DNA, 571 bp, Heterodera glycines
  Genomic contig location: Contig_ID=SeqID_21438; Location=624..1194; Strand=+
  SCN-specific regions: Sequence locations=1-273,295-358,415-571
  Gene Ontology: Mol. function=iron ion binding; Cellular component =mitochondrion; Biological process=citrate metabolism
atgagaattttcggaaatgtccagctgtgtgctgtacgtcgtctgcacacctctgttttgcggcgttcgatggctgtgccaatgagtcgttatgagccgaacagtcgccttccttatcaaaagcttgatgctaatttggcagtcattcgaaaaaggtttttttcaacaaccggattacaaattcctgggatatccgaaaaaccaattttaaatcttttctgcattattgaaaatcgagttgctgccaactttcaggttggaccgtccccttacgctggctgagaagatcatttactctcatttggatgacccgcaaaaccaaaaattagaacgcggtgtgtcatatctgaacttgcgccctgaccgtgtggccatgcaggatgccactgctcaaatggccatgcttcagttcatgtcgtctggaattccggcggttcaggtttgaacactcaaaatcagagtcaggcaagaaaggctttctatgttcattttacaggtccctaccacaattcattgtgaccatttgatccaagcgcaagtcggaagtgagaaggacctttaccgagcaaag

SEQ ID NO: 52047 - DNA, 284 bp, Heterodera glycines
  Genomic contig location: Contig_ID=SeqID_21440; Location=84..367; Strand=-
  SCN-specific regions: Sequence locations=1-200,222-284
atggaagcacccgctgaaattgacgaaatatacaggccacatgaagccagaattcacgaagccttttttaatacgctttccaaaccaattcatagcaaaaacgaaagaaggaaccgagcagaaggaatcttcacaacatcggtcattgccgtgatttaaaatagttgaaaaagatacgttttaaggaaagtcaacaggacagggaaagaatacacgtcacatggcgccattttggtcaaaagaccaagttcttccttgaccgtaatgaacatgatttgtttgag

SEQ ID NO: 52048 - DNA, 164 bp, Heterodera glycines
  Genomic contig location: Contig_ID=SeqID_3830; Location=278..441; Strand=-
  SCN-specific regions: Sequence locations=1-8,30-164
aaactggcgcccaccgcccattggccccaactccgtgccctggtcatcgtcgtcagcagcgggcacaaaaaggtgggcagcagcgtgggcatgcgcaacacagtgcgcacctccgagctgatggacacgcgcgtgcagcagttggtgccgaagcgagtcgcaca

SEQ ID NO: 52049 - DNA, 243 bp, Heterodera glycines
  Genomic contig location: Contig_ID=SeqID_21441; Location=495..737; Strand=+
  SCN-specific regions: Sequence locations=1-243
atgacccggccacacttaagaaatgcgccagggaccttttccgttttggtgccgcacctcattttcaccgacaaaaaaattttatatgtatcggtgtttttttcatttctaattgggtgcgacgccaaaacgagaaagtgtctgcgccaacacctgtatgaattgttgtacggacaattcgtcaatggacaatcagtcagtaatggacaatccgtcaggatatttgattttttagatacatag

SEQ ID NO: 52050 - DNA, 186 bp, Heterodera glycines
  Genomic contig location: Contig_ID=SeqID_21441; Location=903..1088; Strand=+
  SCN-specific regions: Sequence locations=1-186
atgaactgtccaatgaccgattgtccaatgattgattgtccgtccgggtgccgtagagtctatttatattcgatgttgtctccgtttcatcacaatttggcgagcaattttataaatccatcttcgaagtcccacgtccatcggcaagacgaagtacaaaatggcagcaattaccagcaaaaggaa

SEQ ID NO: 52051 - DNA, 503 bp, Heterodera glycines
  misc_feature (86)..(86): n is a, c, g, or t
  Genomic contig location: Contig_ID=SeqID_21443; Location=1..503; Strand=+
  SCN-specific regions: Sequence locations=1-503
  Gene Ontology: Mol. function=serine-type peptidase activity; Cellular component=extracellular space; Biological process=proteolysis and peptidolysis
agagtggcgaggagaaattgtggacggacaccacagttgggtgaggttttacctgcaggagaaggcgggagacatcgaatacacgngatattacgtgaaaccacggcacggcaatttcatcggcaccattcagtacaaatggaagcagtacttgaaaaggatcggcggtttcatgataggcacgtcgccaggtaagcggacgcccctggggcacttttgaaaggcattccttcggtcgaaagagactttggctgaatttagcttccttttggcatttccctttcctttttggcactgtattttctctttttggcacctcccttttttctcgtccagcttttgacttttctctgctcaccgtttgcattttgactgaaccgggcgaccggaagtgcaaattccaactgaaagaaactcctatgttcgtctcctccttcctcgaggattgtgtcatcgacggatccttcagacacaacttttgcattgcgaccgcttatccgggc

SEQ ID NO: 52052 - DNA, 882 bp, Heterodera glycines
  Genomic contig location: Contig_ID=SeqID_21444; Location=520..1401; Strand=+
  SCN-specific regions: Sequence locations=1-2,25-48,77-146,200-283,309- 356,378-392,422-429,451-475,497-797,819-830,856-882
caagagtgaaaataatttttaaatttgaaaaaaacagaatgccaagggttaaaataatttttaaatttgaaaaaaacagaatgcaaagggttgacataatttttaaatttgaaaaacaatgccgagtgaaaataattttaaattcgaaaaaacagaacgccaagggtgaaaataatttttaaatttgaaaaaaaaaaaacagaatgcaaagggttgacataatttttaaatttgaaaaaaatgccgagtgaaaataattttaaattcgaaaaaacagaacgccaataatttaaataaattttaaatttgaaaaaacagaaagccataatttaattttgaaaaaaacagaatgccaagaatttaaatattttttaaatgagaaaatggggaaaataaatgcaagaaattggcaagaaataaatagggaaatttggcacaaaaatgtgcaaaatttggcaagaaataaatagggaaatttggcacaaaaatgtgcaaaaatttgacaagaaataaatagggaaatttggcacaaaaatgtgtaaaaattggcaaaagaaagggttaaaaattgtggcaaaataatgcgaaaaattggcaagaaataaatagggaaatttggcacaaaaatgtgtaaaaataggcaaaataaagggttaaaaatttgggcaaaacaaagccaaaaattggccagaaataaattgggaaataaggggcaaaacaatgccaaaaattgcggcaaaatggcacaaaaaacggtaccataataatgccaatctggcacataaataataaatggcgaaaattaatgggtaaatgggtaaacaaatgccaaagaaggaaaaattaaggcataaataaatgataatggattattgattggct

SEQ ID NO: 52053 - DNA, 449 bp, Heterodera glycines
  Genomic contig location: Contig_ID=SeqID_21445; Location=1622..2070; Strand=+
  SCN-specific regions: Sequence locations=1-124,156-449
atgaagccaatgcaattcgcctcattttcccccgttgccatcatttttttgctgtttttggtcaccgaactttgggcaggttgcgttttatcaacgcaaaaaccgaaaaaaggtgaaaaacaaatattttgttgattatttttgtaatatttattggcaatgataataattttcaaacaaagttatggccaaaagggcaaaggcacaaggtttccaaaaaaatttggccataactttttgaaacttaacgaaattttttgtaattttacagattagtagaaaaaacctattttttttttattttcttgatatcattcaatagctctaagtattttctacaagcctgtaaaatttcagaaaatttcatttgatggtttttttataacgccctttttgatggcgttttttttataacggctcagcaccatacagacagaatatctgtcgaa

SEQ ID NO: 52054 - DNA, 1125 bp, Heterodera glycines
  Genomic contig location: Contig_ID=SeqID_21446; Location=39..1163; Strand=-
  SCN-specific regions: Sequence locations=1-26,144-158,225-612,635 -699,721-752,786-826,857-870,893-923,1083-1125
  Gene Ontology: Mol. function=microtubule binding; Cellular component =microtubule associated complex; Biological process=regulation of protein activity, epigenetic
acgacgagagggtacagaaagcaggcaaaaagagagggagaacagagaaaaagaagtgcaaagagacagaagagagcgagagctccgaagaagaaagtaaagaacaaaagcaaggaggaaaagaaggaaaggggaagaaagagcactcaaaaggagaggaagagacgaaagacgaagagagaagaggagaaaaaaaggaagacgaagagagcaaagagaagagagcagagccaacggccgcggaagagaaagcaagtccaaaagaccaagcgcaatcactttacgaagaagcgaagccggcgagtgccgcagtgccagccgaagccgcgccggctgaaaatgcccccgcgggagacgccgcctatggaatggcaccaaatgcttcacaatcgccaccagagagcgcagcagcgccagctggtggcgccggatacggcgccacaaacgcatcgctgccacctcctccggccgagccgcctaaagaccaggcaaaatcgctttacaaagaagctaagacgaagccggccagtggcacagcgccagccgaagctgcgccggctgaaagtgccccagcgggaggcgcgccggccgaaggtggcgcatcgaatgcgtcacttccgcccccaccaccgcccgatcatccgccgccaaaagatcaagcgcaatcactctatgaagaagcaaataagcctcctgtgagtgcagcagcgccggcagcaggtgccggatatggggcatcgaatgcgtcacttccgcccgttcttccgccgccaccaccgccagccgaaagcgaagcgcagaaaggtgccggatacggcggagggggaaccccagcagaagaaaagaaagagaaaacgccggacgaacaattggcagatgttttgaaggagggcaaaaagaaaggattgatagtcgacaagagggaggaggagggagagaaagaacgggagaggaagaagaaaaagaagaagaaagaggaagagcaaagggaaacggaaagggtagaggaagaagagaaagaaagggaagaaacggaggaaagggggaagaaaaaggaaaagggagaggaaaagaaagaggaaaacagagacaccgaagcacaaacctcatctggagaggcacaaa

SEQ ID NO: 52055 - DNA, 1441 bp, Heterodera glycines
  misc_feature (1396)..(1396): n is a, c, g, or t
  misc_feature (1414)..(1414): n is a, c, g, or t
  Genomic contig location: Contig_ID=SeqID_21449; Location=4..1444; Strand=-
  SCN-specific regions: Sequence locations=1-133,155-341,363-1091,1114 -1441
cataccgtttcttgggccgttttatgctgaactacatttggaactcgaactacccggaagacgtgctgaagagcctgttcctgatgtgtcttacgtacgcaatgaagggagcagaagccatgaacatcgtggccaaccacttcatcttccttctgacggcacgccaccttgactacgagattgccgtgcacttcaaaaacatcaagaagatcgacggaacaatggctgagacaattctgacgcgctttgagattgtcgaccagagcaacaaggcgaaggaaaggccctcaatctgcgaagaatcgttcgtcatcgacatcacggcgatcgagagcggaaagcagaggaagaagctggctggcaaagggaggagacccgacttcaacatcccgtacagcatctgcgatgggacaactttcgagctgatgaacaacgacaacttttgtctctttcgggcgtttgaatttctgcgaatgaaacatgtgctgccacaacaacgattctcggaatataagcgcaaccctggatggcagctgaacgatgttacaactctgtgccaagcctgccggattaatctggagcatcccttctattccattgaggaatacggagaaacaatccaggcaaaacacctttttaataataataattaactagtatttttaaggaatattatgccgagcttcacccggacacatttcgtctgttctgttttgggacatctggaaaaatgaagcctttgtggaaagcggacgtgaacaactactaaaaagagctatgcgtgctctttacagaaggagaagatgacggcgccggtcactacgaccctataaaatcaattggaaaagtctttggaacgaggaactactgttttggagtaatattaaaaacaaaggaaaaaatcataataaaaattttttagtgtgaaatgccatacagccaccaaaaccagcacaattctaaatgcaaatggaagtgtcacaactgccagcgtgttggatcggacttcaggggaaattgtattgactccaacgataattttttcgagacctgcctgggatgttcaaaagtaaagcaatgaatccgttgtatttttaaatgaattattttagacattcaaatgccgaaagtgctacgaacaccactgtaaactgtcacaatgtaaaatcaagcgcgggactgaagtgacaaccatcgaaaaatcgatctgcaagagttcgaaaaagtgtgtcgactgcggaataatctaccaaactcgggtaattttagaggataaaaaaactacaatccttttgattttaggtgcacaaagacaagccacacgtgtgcggacagaagttttgcaaagtctgcctcggcttccacgttccacgtgaatgctacatcccgtaccggncaaagaagaagacggaanagcgcatcattttcttcgactttgaat

SEQ ID NO: 52056 - DNA, 505 bp, Heterodera glycines
  Genomic contig location: Contig_ID=SeqID_21450; Location=1..505; Strand=+
  SCN-specific regions: Sequence locations=1-34,70-505
tttgtttgacggacacagtttattaaagccaaacaaaaaaaaaaaattttttttttgattttttttttagatggacgttttgattgcctattggctgacatcgcatgttttctggtcctaccatcagcagtttgagatgccgacagcccaacgcacacagtccgccctgtccaatatttggtggttttggctgtgctattggtcagtgggggcggggatgtaccagggttgcatcatcgggtctcgagaatggtgccggattttgtgtgcctctagttgtccgaaaaaaatccgtattggattaaattttgattcggctgtaccgaccggtttttcaaaagacttgaactagtgtaaatcgtctttttatgcccgaaattccgtttttcaaaggtttgaaagtgaggtgcccgacacgggtcctatcgtcaacgattggaattggccgttcgcgcagccgcacttcatgcacacactgatggccaagctgaacgcgaagctgcaa

SEQ ID NO: 52057 - DNA, 307 bp, Heterodera glycines
  Genomic contig location: Contig_ID=SeqID_21451; Location=390..696; Strand=+
  SCN-specific regions: Sequence locations=1-307
atgccaccttacggctatatgccgcaaaatgtcccacaaatgggatatcagcaagcgccactcgcgccgccacaagtctcggtgccccaaggcaaaaccggtggttacaaaccatcatgtgctggccccgcaccagctccggtgccatgtgttgccgaggtgttgactcagcttgtagccgacttcaccactttcaccactgagttcaacaacaacttatcagcctttagcaccgagttcgcgcagctatccaaatggctccgtgagaatgtgggcgtcgcttaactttcctaaatcttttttaaaa

SEQ ID NO: 52058 - DNA, 433 bp, Heterodera glycines
  Genomic contig location: Contig_ID=SeqID_21451; Location=1188..1620; Strand=-
  SCN-specific regions: Sequence locations=1-155,245-433
atgaagtggacatctcatatgcgagctgcattttccaaaactttagtataagccgaaattttaaaatttttcgtcaaattcgttacaacaataaaatatttaatattttcggttttttactaatatctcaattaatcaatttatataatctatcgattattttaatttaaattaaaaattatacagataattttttattaattatttcttaatttagttaatagtatatttaaattcatattttcattttacgcttccgataattaattctttattaattgttgcaacaatccgaaaaatggaaaggacagtgggcagttgtgtgagacacaactccgtgtggaccaaatgtgataaaagacaaattcccgaaaaaggaaatgtttcaccttttggtattgacaaaatttatccttacgattcgaaaggataa

SEQ ID NO: 52059 - DNA, 532 bp, Heterodera glycines
  Genomic contig location: Contig_ID=SeqID_21452; Location=42..573; Strand=-
  SCN-specific regions: Sequence locations=1-39,62-326,350-532
atgttgtacatgacttatgcgggcgcggcaccaacattgctcaaatgtggccaacacgtgtttccggatgccgaaaaggcgaacaaacgatgcgaagcattggctggcatggccaagtaagacgtgagggggggggaggctttgaattttgacgagcaccccaaaaagtcgccggaaaattttttggaaaaaaaaaatttcaaacagaaattttacaatgaaaaaatttttagaaaatttttgaataagaaaactaaaagaaaaaaaattcagcaattttttttcaaacttttatgatgaattaattaccttgattgtaaatagccaaattaaaaaaaaaaaaatatatcattgcagaagcaaccaagcgaattgtaccagtcaaaacgctgaatgggccattcaatttcgctcagtaaatgtggaatttgatatgcattggtaaatgattaaaaaaaatgaatgaattaatatacagtatttattgaattatagcccccccccctgaattagagcccccctctgaaataaa

SEQ ID NO: 52060 - DNA, 788 bp, Heterodera glycines
  Genomic contig location: Contig_ID=SeqID_21453; Location=374..1161; Strand=+
  SCN-specific regions: Sequence locations=1-167,192-301,328-513,535 -545,568-598,683-788
atgcgcacttgccagcagctgaactctccgtcgacaaaacggtctccgatcaaccgccgcattgggccgtcggtaaatattaatctgagggctcaaactcaaaattgcttaaaaacagtggatgtcggtttaaaccgacccgaaaagtggaaaaaaggattgatctgtgccaatgacttttttcacagaatggcacaactcttgtaagtgaaattatgtaattggaatttccgattgtttgtggattcgtcgactttcgctttgagcaaatgcatgacccaaccgatagaagaacagaacgaataaataaatattttaaatattaatgcaatccttttttcaattcgataaatctgaccatcgcggggaggagagagcaattagctaattgttgcgattttaatgtgaaaattcgcatgaaaatattgtttatgtaaaggcgaatttatttttaaattgtctacgattttttgaaaattcaagctcattttgaaaactctgctgattgttactccaaaaacattaaaatggaagagttttttacattttgtcttaaaaaatttatacgcaacaaaaactaatattttttaatcaacagatttatttaattttgttttttaataaaagttatttccgttaataattttaatagaaattttagccaattttataataaatttttgtgataaaacaaacaattttaatttaggctttgaactaagcggcagggctgcaattgacataagaatttaatcaattaattacttttattaattagtcactataaa

SEQ ID NO: 52061 - DNA, 734 bp, Heterodera glycines
  Genomic contig location: Contig_ID=SeqID_21454; Location=239..972; Strand=+
  SCN-specific regions: Sequence locations=1-166,188-499,521-734
atggcccatttggaaattagtcgaaattcacaaagaccgtgggtcggaaccaaaacttcgtctgtttaccagctatgccgattttaccaatattctgaattttccgttgcccgaccgtccgctgcccgagaaaacacgctttaagcgtcttgtgatcatgtaattaaattaaaagcattgttaactgataaaagcatcccattttcaggtacattgatcattcagtcatcgcatttctccgctcaaataaacaaattttcaatggaacacgattcgcattgagtttgtcagtgcaggcgcccaagaacgctgcccagccgatttgggatgttttggcacgtgaaatttggtcaattattgcgccaaacattcgccgtttgtacgttcccgatgctgaccatttggacaatttgcgcagtcgcacttcgccgacaattctcacggatctcaacattaattccatcctttctggtcatctgttgcccgatgtgctcggtgattttgatgggccaaatgcaactgcttctgctggccaatcgttgtccaaatggttgcacactccgaccaccgacgggaagccgaagcgattgcgttgcgatgatttcaacgggcaaggaaacgccgaatgggtccacaatttcaaggaaggtgctccttcttttctcctattttgtcattcatttgcatctttttcggcaactaaattttcaacaattaatgcgatttgcttttaa

SEQ ID NO: 52062 - DNA, 207 bp, Heterodera glycines
  Genomic contig location: Contig_ID=SeqID_21455; Location=794..1000; Strand=-
  SCN-specific regions: Sequence locations=1-207
atgccaaatcttaaggacaacacttatttcgtgccccggaatcgctacgtcgtctacgccgagaggatttggctcgactacgacgcctcgcaaatcccgcccgaatggcaccgctggttgcaccacatttgcgacaaaccgccgactgttgagccgccgccggagcgcaagaaatggatgttggaacatgagccgaacaattcgatt

SEQ ID NO: 52063 - DNA, 642 bp, Heterodera glycines
  Genomic contig location: Contig_ID=SeqID_21456; Location=172..813; Strand=+
  SCN-specific regions: Sequence locations=1-314,351-356,378-410,432 -546,569-642
atgaagcgttgcattccgtgtggcggcgacttgagcagctttggaagacgatgccggacgctgaacaaatgcgccaacagctggagcatcatttcgtctcaaattggttatggacaccggcagactcgacgaattgaagctggtgagttgatggaaggggctttaaaatcttatccaactaattaagagggaggaggaacaacggtagcaagcggaggaagacaaaacgaaatgaagaaagtgatcaagaagctgacgtcgatgtcgttgactgatcgaggattaatggtttttattttcattacaagcggtagataaattttttaaaaatttgtaaacaatttttaaatcattttggtcacttttccttttatttattcattaaaatcatcgaaatacatcaatagcatgcactgggaatcgaacctgggacccccccctttggtgaccttctcacagaccacttcgccacacatacaaatcttttttggtacagcagctcagtttccggacgccgtgtacagttatggcaaaaagtatagactcaaaaatttctttttcgaaaaatacgattttctaaaaaaacgaatggaggagaaaaaagttttgtttacaccaaaagaaacgtcatttagtacacta

SEQ ID NO: 52064 - DNA, 385 bp, Heterodera glycines
  Genomic contig location: Contig_ID=SeqID_21458; Location=149..533; Strand=+
  SCN-specific regions: Sequence locations=1-385
ttaattgcgttggtctgtctcatcggtgtgctgatgttttttgcgcattctctcagagatgagccgttgcccactggtgctgtaaaaacgccaacagcaccagacgagaacactgttgatgcatattacaaatcgcatgctgtagcagaaagcagcgacatggacaataattttgcataacgtttttctttgctttcgaattttttgatattttattccctattttcaattagctattacattgttctcctgttttacagtataaaaaatgcatattatttgctagggaattgatttttatttgctaaaaacactcaaagcacaaaagtaacgcaatttgcataaaaatgtgtgttaaatattcgggacaaattgcagcacaata

SEQ ID NO: 52065 - DNA, 647 bp, Heterodera glycines
  Genomic contig location: Contig_ID=SeqID_21458; Location=792..1438; Strand=-
  SCN-specific regions: Sequence locations=1-38,60-534,557-647
atgccgattactaggcgtgtactgtgcgcagtttgcggaaagaaaattggcggaaattttactacaagacaggcataccaatgtcggggtaagtaatacatgtacatagaagtgagtttttggaaaaacggactgaaacaggatttggttctcattgatcgttcattgagcttttagaaggaaatcctgattggattattgaaaacgggccagcagatcccccccttctcctgtctgagttcaaaaaaatatttttttgtgttatttaatgagtgccgtctcgcacagattgccgaatggcatgccataagagttgtcatctgtcgacaaattgggcctgtaccaacagcagcatttttagcatgaatatgtatgtgagaaaatcgtcactccttttcaacatttaaaaattttcaattttttttacagcgaagaagttgattggcccgaattcttgagacacaatcaagttggacaacatttttaaaatttcaatggagaaaaatttatagctgaaggaattcatctcatccgttggcttatgatgaagaaaatggaaccaaacattacatatacaaaattgttaaattcttgttcaattctttgtccatcctcataagaaattcccattgtcagacttaaataaa

SEQ ID NO: 52066 - DNA, 1420 bp, Heterodera glycines
  Genomic contig location: Contig_ID=SeqID_21459; Location=51..1470; Strand=+
  SCN-specific regions: Sequence locations=1-767,799-811,836-879,901 -938,961-1104,1138-1371,1393-1420
cttcatttgcggcgattgttggttggatttgttcgattttctgccgccctctcagcttggcctcgaaattgcgctgatcagtcgccgatttgactgcttcgttgaggaacatttcaaaacgcgcaaatggacattggcgaacgaaattaaaattagaggagtaattgggcagaatggtgcaattgaaatgggaattgtcaattccgatggaaaagcattgccaatcccacaaattccgttgccgaacaaagtcatcggatttggaagcatttttatccagtaaaaaaatgaatttttgtaatgatttgtgccaatcacaatttcatttaattttcagcttcatcgaccaaaatgtgctcacttttcttcgccgttttcaccgttttttctccgtttgtgcaacaaaattgtacattctcactgagaatgttcgcatttcggagtttgttatgcgcaacatttggccactgttcaagaacaccattcatgtgatgtgtttgaaccccatcgcttttcgtcaaatgcgtcaattggccccgtcaatgctaaacgattgtccatcacttcgcgttgtttttttcgatggtggcattttgcccgaatttccgcccgacgacagcgccaatgcgtcggatggccaagcggtggccaaatggctgttcacgcctcgtcccgacttaacgaagatactcggcattgagaatttaactgtggaccaattgttgacaacagtggaacaaatcaaagcggtgattatttgattactcaaatttaattcattttttaaaatatttttttgtcttctttttaggctttttcctctgcttcttctcctgtcaatttcagcatttctgttgactttccgtcgtcctctccgattgattctgttgagccatttcaattgaccaacgaattcaccggggagcaattggtactgttacaagaaaatgcatatggttttgtgctcatccgttgtccaattgtgcccgatgataagaaacggcagaagttcaagaaggaattgggcgaccgatggaaccaaatgaaaattgccttcacagaccaattagttgacaacgggtgattaacaattttaacaaatccaatgtttatttttgtttttgtcttcagtcttctcggtggttcctcacctgggccgaatggtcagcagaaacagcaaaaaatgaaatgtatgattatttgaagtgatgttggaacttgccatttaaatgtaatgtagtcgtacataatgtatttgactttgctcacaaattcataaaatgagtttgttttaccaatattttgaaaaaaacgcataggaaacggcccccatcagttaaattggcctttttgactccctaaagaccagaaaattttccaaaaaatgattttttagcaaaattttcatgaaaaatattga

SEQ ID NO: 52067 - DNA, 1017 bp, Heterodera glycines
  Genomic contig location: Contig_ID=SeqID_21461; Location=188..1204; Strand=+
  SCN-specific regions: Sequence locations=1-561,583-1017
atggcaattccccagcacaaggacctcctcttcggaggaaaaacggtcatattcagcggtgactttaaacagtcactgccggtcgtgcctcacgaaggcctaactgcacaagttacggcctgctttcaaaccaatccactgtttggtcagtttaccacaatgaaattgaccatcaaccagaggttgggccaagggcagcaagcgtacttgcaaatgtgccgccaaatcggcctcggagagaccggagaacacttctggattcctccgcagttcctcgtaaagagcagggaagagttgatagactttgtctatccaaacttccaacaactccttggcaatgacaaagagctgctcaatcgtttgattctcgctccgcacattgacacgtgtgatgagatcaacgaaatcatgatggcgaatgtgcctggtcaagtgcgcgaatatttgtcctcggataagccgcttgacgagcgtccactggacatcgatgaaatcgagtccgaagtggcagcgttgaaccggcgcacagactctgggatgcctccccaccgtctgcgactcaaagtcggaagcgtcgttgttctccttatcaacaaaagtgataaagaaggactgatcaacggcacgcgcatcgttcttgaagaacttggtgacgatcgcctggtcggtcgagtaatcaacagcaacgctgttggtggccaagttaagttcttcattgaaagaacacgtaatgtgtatgaagacaaaacgcctggcggcttaaaatatgagcgtttgcagttccccataaaacctgcattcgccatgaccattctcaaaggtcaaggccaaacaatcaacacggtcggaattgaccttgaaagggatgtattttcccatggtcaattatacactgccttttcaagggcaacggacggtaacaacgtccgagtgtacgctcccagaagggagaccgatgcacaaggtcaaaccaaagtgttgaacattgtggccaaaaacatgctcaaattgcaataa

SEQ ID NO: 52068 - DNA, 1826 bp, Heterodera glycines
  Genomic contig location: Contig_ID=SeqID_3836; Location=36..1861; Strand=+
  SCN-specific regions: Sequence locations=1-1301,1323-1826
atgttagtgcctgtggatgaagaaccggacattctcgttggaatggcagacttctggaagttttttaacggcgtccaaagagtgtctccgcaactgttcaaagttcaaactttaatcggttccactgtctgcgggcgagatgaaattccgtcccgtccaactgccgatcatccactgtccgtcatgcccgtaaccgtccatgtttctgccaatgaagacgagatgaccaattcggctgtcaagtgaattcagaaaaatgagtccatctctgatctcgactcgctacgacaattctgggatcttcaaaacattggcatcagagatgaccctctcgaaaacgatgacgatacggcacaacaaatcttcgaccagacgactacgcgcctggcaaacggaagatacagcgtgggatggccatggaagaattttccgccggacctgccctcaaattttgccatggcccatcgccgattgtcttcaattctcaaccgtcttcaacattttcccgaactgcttgccaagtacgaagccgcaatacaagaacagcttcgactggggctcatcgaaccagccgttcgtacccgaggactcgagcatttcctgcctcatcattgtgttgtcacacacaaaggaatactcatgcgctttcgcctggctgggattgcgctatggggtgacttgaaaaaggccttcaattcactcagcctgctggaatgcgaccgagaattctgcaaagtgctctgggttaacgacgtccgtaaaccaccgttgccggataacgtggtcatctaccgatggtcaagggtgccattcggtgtcattgcctcgccctttttgctggcagccaccatccagaagcacctgaagcaggacgggtccccattggccattgaaatggctgaaaatgcctacgtcgacaacctgctcatgcaatgcacttcaccctcagaagcgctgaacaagtacatgagcagcaagactctgttccgcgcctgtcaaatgaacattcgcgaattcatctgcaactcagacgaagtcatgtgccgaattccgaaggaagaccaactcgtgaaagaagtgcccaaagtgctcggccttcactgggagttgaggccggacaagctttacatcgactttccgcccatgacaccgaaagtcgctgccttactcgtcgaactgttctccagcagctcgcctctgtttttgaccctctcggactggtgtgcccggcacttcatgttgccaaaatgtttttccaatcactttgggaaaccaagcttgactgggatgattctcttccgactgagaaagtgcaagaatggaacacgattgccacgacttggaaccagcaaaaggtccgtgtcccgcgcagagtcatcccgttggaagtgacctctcatcaactacatgcctttgttgacgcaagcaaagatgcctatggagcgtgcatcttcattcgggcacaacatgaagtcgcaatcacggcccatctcatctttgccaagagccgagtgaaaccaaagggatcaaatctcactattccgcgcatggagctcatgggaatgctgattggcattcggatgcttcaatttgccgaaaaacagctcggacttgccattcgccacaaattcatttggtgtgactccaaaccagtccttggttgggtgtcatcttctgagcagcaacctcgttttgtggagaatcgcctaaaagaaatccgtgctgtcgaccaagttcgctttctctacatatcgacggagcaaaacccagccgatgtcgcctcacgcggatgtactgtgcttgaactcacctcccatccactctga

SEQ ID NO: 52069 - DNA, 1610 bp, Heterodera glycines
  Genomic contig location: Contig_ID=SeqID_3837; Location=579..2188; Strand=-
  SCN-specific regions: Sequence locations=1-209,233-626,648-685,756 -1033,1056-1270,1299-1340,1362-1610
atgtttcaaatagctgctaacatcttccgttatgagaggaatagaaccgaaagactttttttgtatctccaaatcgtcaccgggaaatgggcccgtagaaaatgctttagtggaaaaaagtaaattctcggaaaataagtaaatttttcaatttttttacaatatgtgtaagtcaaaaattttagaatattttgaaaacaaagattagctaaattttattattttaatttttgaacctttcaaaaaattgaattgacaaattcagaacgaggtcatatcagagctgggcttttcaacgtgtgcacaatttgtgttccattttctctctcaagtcatttccgatgatttttcagctaaactgtgcattttattggattcctcaacaaaaaaaaataccggagagtaatgagaaaaaaaggaaaattacaaaattttttgtgtggatagagagagcgaaaaggaatcagggctgggcgtgactggatttaaattttttgaatctaatcattagcagggatccagtttttagggttttatctattttttcctcagctccagtggcctgaaacacacgcaaaacaagttttttttggtggttattcagctacttttcgtgtttttagtatctattttctaggttttttagagccaaaaacctaaaaaaaattgaaaaaaaactcttttgatatttttgaaaaattattaacaaaaatgatttatatagttatttcattattgataagaattttaaaaaagctaggtgaggaaaaaataggagcaaaaaacgacaaaaacgcaactattttctaagcgaaaaactcaaattatgatgttaccttaataatactacaaattaacaagaataagtggtttttaatccagaagaaatcatgaaattcgggtagtcctttaaatgaagtagaaaaaatcgttaaaaaaaattatcttgcatgaaatcgtcgaaaaacaatccaaaaacacaattacagattaaaattacgaaaaatcccaaaatccttaacccataatcagtcatgaccgggtccaaaaaggccgaaatttccataatccgtaattacgcccagcattggttcatataggccttttgtaattttcgtttcttttcctacaaatttcgtctgatgaaagcgaaacgaaaattttaaatttaaaacattatattcaaattcattaatggtttttttcaattttcattttggcagtcttcttcgtaaatatttttttattaaatctcagcctatttaactgcaaaaaattctataatttattatatttatgagtcttgcccattacattttagacttgtaccgtctttgtgaattctatgaggtggacgatgaatggacacgaaaactctgggttaaatgaagagcttctcaatttgccttggaaattttccataaatacgataaaacgaactccaatcagtcgaatgtttagatttcattttagttagtagacgacgaaaagtgaaaacattaacttgaacaagggtaggagccgagagagggggaggggggacgatccccgccaacccggggaacagggacagcggagatcggaaaaatccttaacaaaaatgcaataaa

SEQ ID NO: 52070 - DNA, 408 bp, Heterodera glycines
  Genomic contig location: Contig_ID=SeqID_3837; Location=2357..2764; Strand=-
  SCN-specific regions: Sequence locations=1-138,160-253,275-315,376-408
atggccattattcgcgacatgcttctggatgatatcgaactcttccagcgttcctcaatgtaagccaatggagggactgaccgcaggtcccggtcccggcactggtcagtaacggtccaagttttcctgaaagtacagctccggcctattttttaaattttgatagaaaatttttggtattggagaaaaataagaaatttttgtcaatttttgggtttttttaaaactagcaaataaatttgaaaatttaaggttaaaaaccaaatataatttttgaaaaaaagtttagaaggccaataaatatcaatgatgaagatttttaaaatatttaatatttttcaaaatttattaggaaatttaatttctttaaattaactattttcttttcaggtaagctttgttaataaa

SEQ ID NO: 52071 - DNA, 732 bp, Heterodera glycines
  Genomic contig location: Contig_ID=SeqID_3837; Location=3046..3777; Strand=+
  SCN-specific regions: Sequence locations=1-732
atgatgttcaacagagaactaaggacaaaactcgatttggtccagccggttttcaacccaaagaaaagggaagaaaaggaggaaaagcaaaaagttgtggacaactacagagaccgagtcaaaaggaacttcgatcgaagcacttggaaaaggtcattcgacattggcctgaaaatcttcgctaggaatttccgcgacggaacaaagtggatggaaggcgaaattgtgcgccaaatctcaccatcacttttccttgtcagaaccaaaagaggaatttggaaaaggcacttagatcagcttaaatccaacgaaacggacagcgaaagtgccgataccgattcaaattcgtcaatggcagagcaagctgagatggacacggacgttgaaaatcagccggacattgatgcgcaagatgaaccgcaaaatgtgctgacgaatgatcaagaggagctcagacgatcgagcagacagcgtaagccgagaaccatcttcgatccaagtcgatgaaccgattgaattggtggggaggagatgtcatgtctgagaacttatttgatgggactcaaatggacttttttcatatttgccctcttaatccacaactgctctgtctatttaaatgctgtctttccctcttattcccgcagtcttcccagtcattcttcatttattattttgttctccctcatcaactttgacctccgcatatatttgtttatttcttcactgcaa

SEQ ID NO: 52072 - DNA, 1060 bp, Heterodera glycines
  Genomic contig location: Contig_ID=SeqID_3837; Location=5586..6645; Strand=+
  SCN-specific regions: Sequence locations=1-224,246-300,322-338,413 -427,462-477,510-675,699-1060
  Gene Ontology: Mol. function=UDP-galactose beta-N-acetylglucosamine beta-13-galactosyltransferase activity; Cellular component=Golgi membrane; Biological process=protein amino acid glycosylation
atgtatagtggctttgtgtggcagcaacggtactgtgccggtgccgaatgggtgctcaaggtggacgatgacattgcggtccatctccgacggatggtcgaatggacggagaaaaaatttcaaaaaatagccacagaacatccgttgatttatttcggagtcccggctgatagaggcctatctcgggacaagaacagcaaatggtagttgaaaattatataatgtaaaatgccgtttaaaaaatataagtaacatgtcaacagtaacacattcagtgcagaataattatatgtggaagcgaaaagttttaaaaaataaagtgttcccacaaaaaacccaaaaattaaattcaaaaataaatttactatgtcaaaaaattgattatttaaaaacaatttttaaaattttatttccaatcctaaatcacataaaataaaaatgaaataatttatttaaaaattgggcagcgaaacaatgtattttttatttgtttattaaaataatattttgtatgatgtcatgaaaattatgtaaaaaagtaacatttattcttttatggatattttatgttttacgaaatttttccgcttttttcttaatttgtgatattttgggcttcaaatgttgcattaattagatgacatacaattagcagcagagcagaaaaagcttcctaaattattttatggccatgggttcttttttaggtacgtcccttatggaatgtttacgggagaacattttccaccgtttttgtacggtggctgctatttgacaactccaagcaccatcaaagccgtcttggaacaagctcacaaaaccgacagcttttatttggaggacgtgctgtacacgggcattttggccgagttggccaatgtcaccgtatcggaccaattgagccatttttatgggaatggattgcaggtaattaataattagggatgtcaattttatgtaaatacggaaatcctcaaaaaaagccaaaatttcgacaaatttcattttttatatatattttgagaattttcgaaaattttttagaaattttttgtgaaaa

SEQ ID NO: 52073 - DNA, 272 bp, Heterodera glycines
  Genomic contig location: Contig_ID=SeqID_3837; Location=7371..7642; Strand=-
  SCN-specific regions: Sequence locations=1-1,23-202,254-272
aaagtggaagataaagtggaagcggaacagaaagtggaagaggaacagaaagtggaagataaagtggaagcggaacagaaagtggaagaggaacagaaagtggaagaggaacagaaagtggaagataaagtggaagcggaacagaaagtggaagaggaacagaaagtggaagaggaacagaaagtggaagagcgacaactcgaaaattatttattttagaattatgacatttaacaaaaaatcttataaaaaatcacaatcatataaataaa

SEQ ID NO: 52074 - DNA, 2749 bp, Heterodera glycines
  Genomic contig location: Contig_ID=SeqID_21466; Location=237..2985; Strand=+
  SCN-specific regions: Sequence locations=1-135,157-288,350-640,662 -666,736-1013,1191-1328,1369-1382,1434-2059,2089-2377,2418-2455,2506 -2583,2622-2749
atgcgcatcagtgccatccatgaagcaattcgggacgacgatcagatgacgctgaagcagctggtggacgattgggacacggccacgggacgggaccaacacgggcggacaccgctgcacatcgccgtgggcatgagggagcgggggcgggagagggctttcggacaatccgtcattggacaatcggtcatgggacaatccgtcattggacaatcggtcatgggacaatgcgtcagtagagactatccgtcagcgacaattattaaaatcttgcgattgcgattattcaatttaatttttaaaaaattggatttcaatttaaattaattttgacattatttatataaaagcttaccttataaatacagattgtccactgacgaattgtccgggagccaggggaagcgcgacgagagtctcgactcggtccctacgattcgagaatttttcgggaatttttttatcttggtctcgggttttcggggcaaatttacattgtctcaattcttggtaaaattcatttcctgcacctttctaaggagggggaggcggtgccgttatggggaaaatgccgtggagacggcgcatggactacgaggactctgattttgatgaaatgccctccaaataatccaaaaatcaaaaacatatgaaatattaaatcccataaaataaaaaaaagaaaagaaaaaacaattaaattttaaaattttaattttttcaatttaaaatattctgccggatcctgtaatattgactccgaaaatggttaattttcataattttgttaatgatacgtgctgtgccaatgaataaattggcatgggatgagcgattaaattaacacacaaagaaaatcacttttcaatttcaattaaggtgttgcacggacgggcacgtgcggcgcgttatttgctgctgatgttcccgcgttgtgtcaatttgacggacaaggcaattaaattaattggaaatagccaaattaattaaggatgaaagaatttttatactagaataaaaaaataaattgttattaaattgctaattaataaaattattctaatcaaataaaatttttattgcatatatttcattattctaggataaaattcaactttcttaatatgtattaatccaatcatatttatattcatattaatttagatttaaattttaattttaatttaatactttaaagcaattatctttgactctttaaatatttaattaacttattactcatcttaatgctcccgactttttttttacaatggcattttctgccggttgctatggcaaaatgcaatcattcaaattcatatgaagaattgagctgttcttccattttttctcatctacatatttacacaaaatcaagagccattttaattaattaaattaaattttatttttattaaattttaattattttaggcctcccgttctccgcttcattacgccaggcattcattcattttttcaaattttctttatttttcgtgtccagttgtcttacggacgatcagcaacgtgcgcaaatgacgcgcattttgtgccgtgccggcgctgagtcggcggcgacggcgacaaaacggcacaatgaaaacgccgcaggggtaaaaaaatggctttcctaaaattggggcacactgaaattgcttaattaccacacacacacacacattaataatggattatgaatttctcattccattctctcccatcagagaatcggatcctgcttttctgaggcccttctaacaaattcccgatctcgaaccaatgtcgagcatcttgaaaatccgagatttcaattcatccgattcaatgttcaaaatgtaattcgcttaaagtctcaaaataaattttctggcggttggaatttcaaaatttggtggcttttttcggcaccaaggctggacgaatcaaacgaaaaaaagcctaaactttcgaacccaaaacgccctgcctgattggcactctcgggctcccagttttttcctaatttaaaaatgatatcacttatatatcatataggacgaacatgcaacgaaaaaggtaaaaaaaaattttttcaattaatttaatcccaaaaatgtgtccccccccccccccccattagcactaatggcttttggtcagaggcgttaaatcccccccccccccccaaagtgctaatgcctaaagcattcataaattatcggaaaaggaggcaatttttgaagagagtttattaagaaaatcgagagggaaaaatgaaaataaaaaaaaatcctttttaaatttgtcatacaatttaaatgcagctattaattaaggtttttgaacattcttcagttttacaaattcacaaaattatttaaaaatatcatttcggaaaaaataacaatatttaaattaatattgaatttttatttcctgaattttatgatttgactggagcaattataaaagcaaaaaaaaaattaaaaaattaattttataattaaaaaaaaaataaatttagcgtcacactgaagaagccgatgacatgttggtgttgaacgaacttcatcgacgcgacggactgatcggagaagaagcggaggaggaagaggatgaagacgatggaggaggaggagacgttgatcagtctgcggatgagatcgaatttgggcatgttgcggcacggagattagcggcgaaagcgaaaaacgcggcaatgatcaaagggtgggtgtgggctattcggctgatcgatatttattga

SEQ ID NO: 52075 - DNA, 384 bp, Heterodera glycines
  Genomic contig location: Contig_ID=SeqID_21467; Location=1061..1444; Strand=-
  SCN-specific regions: Sequence locations=1-21,144-152,174-246,269-384
atggaaacagttgaggaagacagtgaaaaagagagggcggaagagaagagactggaggaagagaagccagaggaaaaaggaagtgatggcaatgaagaaacagagagtgaagggaagggaaagaaaaggggagacgaagagagtcaactgacagacgacacagcagagaaagagaaggaacttgtgagtctaaccatagaggaaaagacagttgaaataagcgaaagtgaagttgtaaattgtgatgagagagagggaaaagaaaagagtgtgccaccggttgaaacagaggcagcagggagaagcacacaaagacagagagtgcagggcagcacaacagcagacgaagaagcaacaatagcagcgttttttgatttcaagtaa

SEQ ID NO: 52076 - DNA, 1041 bp, Heterodera glycines
  Genomic contig location: Contig_ID=SeqID_21468; Location=371..1411; Strand=+
  SCN-specific regions: Sequence locations=1-93,115-959,981-1041
atggtcaaattgaaggtcatcttaaatgaacccgtgtctcaacacgaacaaggtaagagaattgagaaacctggttctaaacaccaccaacgcatattttggaaccaaaaattgtctcaacaattttttatagttctaattctgtccatgataagtgcaacaatttcaaatccaatgctttgtcatcatagggcacagaaaaattatgatgtcagaatagatagagacacaacccaatgcaaactaattgccaatttgtttgacgaaccccaacgggaattggaagttgacatctatcaacccaattcagaaccgttcacgtttaaggcacatcggtgtctaaaggtcaaacaaagtcaaaaattttggaccaatttactaaacgataagttcagtgacccggttagtgtttccaccctcccaacgacaattgaagattgtcaagaaatgatcaattatgaaaagtgtgaattcggacctctcagtggtcagtcaaatgaacaatttcatacaaaccaagaattgcatatagactattcctggtggaaattcggaaaagacaaatccgaggtaaataactgttatcatgcgattataaccttactaggaaaaccgggatccgagagtttgggctcacccacagaggaagtgagcaaatgcaaattttcaaagggttcatgtcgattaggagataatgcgattctaatttggaacctcgattccactgagcatcaaagagcgtgtctttacaataaagtaaccacagaaaatgggaaattcaccaagagaatgtggatatcaaaaaattcacagttcgctctatcattccaagaaaatgctaagagtgtggaatcatgcggtcacacgcttaaattaagcgatcaaggttttgcagtcccctcgtggcaatttaggataattacgggtaagacaacccataggatcaaaagagaacaatggtggccaagggaaaaacctttagaccagaacgagaaagctcaacagcagctgcacaattgacggcaagagctatttaccaaa

SEQ ID NO: 52077 - DNA, 477 bp, Heterodera glycines
  Genomic contig location: Contig_ID=SeqID_21468; Location=1026..1502; Strand=-
  SCN-specific regions: Sequence locations=1-152,174-477
ttaagtgactgagatcttgctttgattggcattttgcaaatacccacaaatcagattcaccatttttgaaatattcctttcgtttctttattttggtaaatagctcttgccgtcaattgtgcagctgctgttgagctttctcgttctggtctaaaggtttttcccttggccaccattgttctcttttgatcctatgggttgtcttacccgtaattatcctaaattgccacgaggggactgcaaaaccttgatcgcttaatttaagcgtgtgaccgcatgattccacactcttagcattttcttggaatgatagagcgaactgtgaattttttgatatccacattctcttggtgaatttcccattttctgtggttactttattgtaaagacacgctctttgatgctcagtggaatcgaggttccaaattagaatcgcattatctcctaatcgacatgaaccctttgaaaatttgcatt

SEQ ID NO: 52078 - DNA, 375 bp, Heterodera glycines
  Genomic contig location: Contig_ID=SeqID_21469; Location=249..623; Strand=-
  SCN-specific regions: Sequence locations=1-66,266-375
atggccgtcggggcattgggcggtggtcgagccgaaggaagagcaaaaggaagtcggaagaaggcagaggaggaggggaagaaggagcaggcgaaggaaaagaaaggaggaggaagaggaagagagggaagaggagtagcgacagaagagaacggaggaggaagaagaagagagagaagaggaaaaggagcagcgacggaagagcacgagggagagagaaaggaggagaggagggacgggaagagggaggagggggagggaaatgcttctgcttctaatggacagactcatttatttctggctgaaagaattaagcagaagcagcagaacaaaactcagaaacggcagcagaagaagcaaaatgaaaaatgctga

SEQ ID NO: 52079 - DNA, 959 bp, Heterodera glycines
  Genomic contig location: Contig_ID=SeqID_21469; Location=744..1702; Strand=+
  SCN-specific regions: Sequence locations=1-170,200-451,481-959
atgacgcggatggacgacgggggcgacgcgtatttgagctgcggaagcgaaaaggtagggtaggaattgaactgtaacagtacgcctggctgatctgaaaatatgggtgatcacagaaacaaaacgaaattaaatcatcgaataatcttttggttttctcttttaaatcgatttaatctaatttatttttaaataatttcttaattgtccccttttagtacaccgccggtgtccgcgtggtcgaaggtgcattgtccgtcggtgaccaccaccagcagacagctgaatggtggcaacttttgtgctgccaaagtgactctgttcgcgttcgagcggaggactgtgtggagacgaagttcatcaacgactttcggcgttcctcctcgttcagttcgggcgctcaagtgatccgcagatggcaggcgatgttcgaaaacgggtggcgaaaagcaaaattaattaattaatgaattaatcactcatttgggaatccgctttttctgaagggaccgtcggtggtggcttcaaatttgcccggtggacgtggcgttgcccctcaaaaaacataaaattcgctcggatggggcggaaatgcgcgcgcgcagagaaattccgttggaatggcgacggactcgctttccgaccacgtccattcaggtgaccgttttggcattggcactatgccaccaattcggctcgccatgcattttgttttgatcatttagcatttccatcactacactttcgctgacgaaaatatggcggcggactttcgccgacggcgtgcagaaattgcaaatgcaaaagtgaattcatatgcggtgccaacagttaacgtggaagaaaatggaaaacggcaaattatgacaacaacaattgggaaaaagtcggaaaatacgactacggcacgacggaacagcacatcaacggaacatcaaccacaaaaagttaacggatag

SEQ ID NO: 52080 - DNA, 701 bp, Heterodera glycines
  Genomic contig location: Contig_ID=SeqID_21470; Location=299..999; Strand=+
  SCN-specific regions: Sequence locations=1-70,94-193,215-220,259 -467,489-701
atgacgtttttctgcgctgttgcagagcgaaaagagttccaaaaagttgtgaaagccgatgtgtgggttgaaaataaaattttatttttttttcaatccgatttagaattttgatggattaaacaagaaagttttgactggaatgtttttgggaagagataaatgtccgacggaaaatggtagaaataatctgtaaaatgaaaattaattcaaatgatagaaaattttattctaaaaaaaaaaaattaatttttaaaaggatgatttttttattacattattatcatagggtttataaattgtatgattttgcattttttttcggagcataagctatgaagaaaggggttcaaaaatggggaccggtaaattggacaccaagcggaaaactggacaccgccggaattttggacaccaaaggaaaattggacaccggaaaactggacaccatcctaaaataaacccaggaattgagttgaaaaataaatttgggtagggtaaatggattaataattaaggcacttagaagtagatcaggcattcaacatgcaagatgattgatcaatgtgccaaaaaaatgcaagaaaaagggcaatgattggtcaatgtgctaaaattgcataaaatatgggaatcctatccaaaaaaacttttttctttatggatgttatggttgttttcttttgctgaagttttatgta

SEQ ID NO: 52081 - DNA, 1808 bp, Heterodera glycines
  Genomic contig location: Contig_ID=SeqID_21471; Location=588..2395; Strand=-
  SCN-specific regions: Sequence locations=1-242,273-731,753-1298,1321 -1625,1647-1808
  Gene Ontology: Mol. function=signal transducer activity; Cellular component=cytoplasm; Biological process=cell-matrix adhesion
caaacggaggagagaatgtgtcgttgtccgactcggaatgtggcggcggcacggaattcaatggcatggcgggcggaagcagcgacagaatgccaaatggaggcgccaaaatgagccaatcgatgcatcgactgacatcactgtccgattatgacaagcggaagaggaaaaagcatgaactgctcgaggaagtaaggttttcctcgagtcgagactcgagaaaaaagaaacattgaataaactaattatatttctttatttttatttaatttcaatctctgatttctgagaatccatataaccacatctcgagcattattattttaatcgcatataattagtcaacaaattggcacatttagaattctttacaatttttttcaggctatgaaggcccgtactccgtttgcgctgtggaatgggcctacagtggtggcatggctcgagctttgggtcggaatgccaagttggtacaccgaggcgtgcaggtgcatttgacagagtttagagaacaaaagtaatgtaaatgactatttaattttagggccaatgtcaaaaggtaaaactccttttttaattttgacaaatcttattaattaccatttaattatgtccacaacagtggttcgataatgtctgcactttctgaccaagagattcaacgcgaaatcggtgtatcaaatccgctgcatcggtgggtggtcataaaattatctcacgggagcgtaaccgggggggggggggggggggggtgcgcaaggtatgttttccctatgttttcccacatcatccattccctcccccgacaaaaaatgtaacttttttcatatttcagtttaaaattgcgcttggccatccaggaaatggtaattgtattttttttttgtaactattgcctaattcgttccaattttcaaaaaaggttgctttaacctcgccctcgtccccgcaaattctgcgctttggcatggcattcggcgaaatgaaccacgaatgggttggcaacgaatggttgccttcacttggtcttggcaaataccgtaccgagttcatggagtgtctggtgagggtcgcgtttgtatgggactcagaagcccaaatcggacccggtcatgtaaaattagggtactcaaatcccccggggacgacatctttttcaatcgtttttttgttgttgttttttactatcaatttttccgtttcaaggttgatgcgcgaatgttggaacatttgagcaaaagagatctcagcaaaatgaaaatgatcgacagttttcaccggtgggaaaagaatttgaatgaaaaagtcaaaaaatattatcctcggcttttcattattttgattggcttattttgatggttctttcaaggacaagcttacactacggcattgtgtgcctgaagaaattgaattatgatcggaagcaattggaagaacggcgaaacgcatcggaaaacgtcaacagaggtgaaaaagagggaattcaatgaaatgcaattaataattggcgatttgcaattagatctaatggtctggtcaaatgagcgggtcattaaatggctggaagagattggccttggcgcatttgttgtaaatgccgtcgactcgggcgtccatggcgcactaatggtagcaaagggaaaattatccggatttcatgaaactttaaggccctcgacggaacatttgatgtgcccgcaatggcacacattttacaaattccggacagtgacagcgcacgacggacattggaggaggagttccagaaactggtggccaattgccggggcagaggcgagccgcgagat

SEQ ID NO: 52082 - DNA, 908 bp, Heterodera glycines
  Genomic contig location: Contig_ID=SeqID_21472; Location=1735..2642; Strand=+
  SCN-specific regions: Sequence locations=1-103,125-908
  Gene Ontology: Mol. function=lysosomal cysteine-type endopeptidase; Cellular component=lysosome; Biological process=proteolysis and peptidolysis
atggaacccgccttgaaaaggactttcaaaaaaggcatcgattacccaacgcacttcgactggcgcgagaggggcgtcgttacgccggtgaaagcgcaaggtaaaaaaggagcagaaagaaattgggatgaacagctgccaattcgcaaaaaatatgccccgaaggtttgtgcggctcgtgctgggcatttgcgtcggtggcaaccacagaatcggcctacgcaattgcgcacggggagttgcgcagtttgtctgagcaggagttgctcgactgcaacttggcgaacaacgcatgcaaagggggcaacgtggacaaagcgttcaggtcgggttggacaaacaatactctttggaaaagcaaaaaagcacaggttcatccacgacatcggattggaaacggaggatgaatatccgtacttggcacaccgacagaatgtgtgcatgatgcacgaggggaaccgaaacttgaccaaaattgatgtggccgtgttcatcaaccccgacgagcagtcgatgatcgactggcttattaatttcggaccgataaacgtgggtctgtgtgaattagcaatgtcagttcaaaaagcaattccaattatccccttcaggaatttcggttcctcccgacatgaaaccgtacaaatcgggcatttaccatccgtccgatttcgactgccaatttaaagttcgtcactctgatgaaacttttagttttattttcatatttattaggtggttggcctccattcgatgcttgtagtgggctatggagaaaatatttatggagacaaatattggatagtaaagaacagctggggacaaaaatgggggcaggagcacggatatctgaactttgccagaggggtcaatgcgtgcggaattgaggacgaaccaatcggactgatggc

SEQ ID NO: 52083 - DNA, 177 bp, Heterodera glycines
  Genomic contig location: Contig_ID=SeqID_21473; Location=62..238; Strand=-
  SCN-specific regions: Sequence locations=1-177
atgagtcctttaagaacttatgtcgttcggccaaatggggcagatccattgtttgtgccaacttcatggaatcatcacgattcaatcattgcaaatttggcacgtactaacaatgcacaagaagcctttcatttggctttgagaaggcaatttgctaaagaacatccccctatcacg

SEQ ID NO: 52084 - DNA, 344 bp, Heterodera glycines
  Genomic contig location: Contig_ID=SeqID_21473; Location=1105..1448; Strand=+
  SCN-specific regions: Sequence locations=1-157,179-344
atggatttgattgagccgcttttcccaattcttttcactctcgaaaagaatgaatttttgctagaatccaaagacttcaattattcacattttttttcaatgattgaagacataaccggacggagccatgttaaggaaatttgcttttacagtaagaaattttggaataattaaatttaaataagtaatttagctaaagatggtggggatagaaaaattggacgatcacgaaaagcaatggctatagtgcttatgtatggtttgatgaatggaaaaagtcttgagttatttttatgttcataagttgtatttgtagaagctgttgttgggccttcagcaagcca

SEQ ID NO: 52085 - DNA, 658 bp, Heterodera glycines
  Genomic contig location: Contig_ID=SeqID_21473; Location=1531..2188; Strand=-
  SCN-specific regions: Sequence locations=1-8,30-73,96-96,156-658
atggtaggaataattttaattttataaaacaatttggaaattaatcaaaacatcaaatctctctataaaaggggaactcagcaggaagcagaggtcattattttatatgttaataaattaaacaataaattaaaaattatacattttatttatttgattaaaggttcacaattctcggcggtacgacaattgcggaccggcaattgcggaccggacaattgcggacgacaattgcggacgacaattgcggacgacaattgcggaccgtacaattgcggacgacaattgcggacgacaattgcggacgacaattgcggaccgtacaattgcggacgacaattgcggacgacaattgcggaccgtacttttgcggacgacaattgcggacgacaattgcggacgacaattgcggaccgtacaattgcggacgacaattgcggacgacaattgcggacgacaattgcggaccgtacaattgcggacgacaattgcggacgacaattgcggaccgtacttttgcggaccatacttttgccaaaaaattaactggaagggtgggcctcgtcagtacgatcccttccgtattacaaatttgaaatcctaagtgtgtttcggcccttccgtagacacaccaaataagaaagctcacagcaataaa

SEQ ID NO: 52086 - DNA, 1785 bp, Heterodera glycines
  misc_feature (43)..(45): n is a, c, g, or t
  misc_feature (57)..(57): n is a, c, g, or t
  Genomic contig location: Contig_ID=SeqID_3838; Location=925..2709; Strand=-
  SCN-specific regions: Sequence locations=1-373,395-438,461-981,1008 -1785
gctgcacgtggcacgggtgcaaaaggtgttaccccaacgacannncatgctgctccncagtgggaagactgcgggaccaatgcgcgaacgggatgccaagcggatggaatttctgagggggaaggtcaaccggatggacgtctactgggaatgcgaaatccatcggatgctggagaggagcaaagaaatgcgcaaagcttttgaggactacgtcgatgatgggccgctggtgatccgcgacgcgtttatgggagggcgaaccggaccactgaagctgctgcgcaaggctggaccgggagagaaaatctcctattatgacttcacatcgctctacccgtacataaattgagcacagttaaatttgtaacaacttttaacattttttccttcacagttttaccacctgctaccccattggcactcccaaagtgcatgtgttgaaccaggaagcggagtggcgcagtgcagcggacaacccctaccctttggcattgctcaaagtgtgggttgagcctccccgacgcgtcgacgtccccgttctacctgtgaaagttggagagcggctttgcttccccctgtgcatcacttgcgccaaagagcacccgacaggaggagtggacaacgactaccactgcgagcattccgacagacagcgggggtgggtgagcacgtgcacctccattgagctcaacgaggcgttggacgagggctacctcgtcacaaaggtcttccgtgtcctcgagtatgagcaaagtgacgacaagctcttccgcccgtacatcgctgagtttatggccaaaagatccaggccagtgggtttgacaacagtatcagaggcgatgcggagaaggaacaacagtttgtgcgggagtgcgcagagcagttcgacatcaccatcgacccaaccaaaatggcggtcaacaaagggaagcggtccctggccaagctctgcttgaacaacttatgtgagtactgtcgtccattattattatatttaaaaaaaaatagggggacgattttcgcttcgcaactttggactcgctcaaacactcatcactgacgacccagcaactttggcggagtacctggacaacaaatccatcgaagtgacatcaatcgacgagttggacgagcagcacatactcatcacctatctgcagaagaaggactgggtggatgagcactcatgctcaaacattggtgagacacacacactcacaataaattgttaaagtacttcagtcatttcactatggaccacctcagcagcgcgcctcgttctgctcaaggcaatgcagaaggtggtcagatcaccgggctcggatctgttgtacactggtaagtcaaactacaaaaaattttttgtgcacaaacatttattttagacactgacagcctcatcctcgtccacccggaggagcggtgcccactgaaaactggcccccatttgggccagttcaccgacgaataccccgaccacgacattgtggaattttgcagtggcggggcaaaacaagtgaattttcggctcattttgcggtaattaatgaacattaacactctagtacggcctgtgtctgcgacgaaagggcgcggaggcgggagcccaattggaacatgtactaaaagtgcgcgggctgacgctaaattatgatgtgatcaacaaccaggggatgcgctatgagaacttcaaagaggaggtggtccggtacgcgacaagtggtgaatacgagccgataatcatcacataccccaacttccttcgtccaaacatcagggagggag

SEQ ID NO: 52087 - DNA, 407 bp, Heterodera glycines
  Genomic contig location: Contig_ID=SeqID_3839; Location=84..490; Strand=-
  SCN-specific regions: Sequence locations=1-407
atggttctggtctttcgcgagctattccgtattgggttcaacccggagatgcttcgacgggtactcaattaagaatttttttgtctaaaaatattttaaaaatctcagggcaacaaaatgtatgagatgaaggtacgcaagcagaagaggcgcaacccaaacatcgtcttccgtgactctttcaatttgatgccgtgcgcgctggcggcgctcatcccctcctacggtctggacgtcgaggacaagcccttcttcccccatttggccaaccgacccgagaactacggccgtgagattcacccgacgcccgaagactacttggctagtggaatgatgcccagcaaaaggcagaaatttgatgtgtggtacgccgagcatcgccacgagcctttcaaattggatgaggc

SEQ ID NO: 52088 - DNA, 1022 bp, Heterodera glycines
  Genomic contig location: Contig_ID=SeqID_21474; Location=978..1999; Strand=-
  SCN-specific regions: Sequence locations=1-13,36-1022
cggaggtatttgagatgacaaattcaacagcatcggccacaatcgaaaaattgcgttatttatttacgcgccatggcatcccagaaacaattgtttctgacactggcacgcaattttccagttcggaatttgccaaattcgttgcggccaacggcatcacacacttattttcggccccatataatccaatgtcaaatggacaagtggagagaattgtcgacacatttaagagagcattcagaaaattaaaaggggaagggaagccaaacaaggagatcatcgacacttttctgatcacctaccggacgaccccaaacgattcacttccggacttgaagtgccccgctgaactgctgctcggtcgaaggccaaggacaacaattgatctgcttcggccaccaccacactaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcccgacggatcattcggccgttttcacgccaatcaattgcgcaacagaaaaacagccgacaattttgatcagtccttggccatattaaatgaggcatttaagttgccattgcctccggccctgcccaatcaaccacccgacgcagaaaatgccaatttagggcccaatcaattggaaaacgaggtggcagaacccattcaggacaatttggctgctccaattgaggacgtcccaattcaacgacgctatcctcaacgccaacgtcgtaaaccgaaccgcttttcacccgggccatgaactgatcagcctaaaaggggaggtgttcgggcaggcacattttgcccccgatttatttatttcccttcttcatttgcatcactgtttttgcagtgtctgctctcttcgtgctagagacagacacacgcatgcctattgattgacctt

SEQ ID NO: 52089 - DNA, 953 bp, Heterodera glycines
  Genomic contig location: Contig_ID=SeqID_21476; Location=142..1094; Strand=-
  SCN-specific regions: Sequence locations=1-240,263-953
atggcactgatttcgccccgttttgatgcgctggtggacaaacattttgatggcaaaacggaattgacactttggaaatggatactaattcacaagggcaaaggaccaaaatcagaactgtctgtatggatggatggcaaatttgtggattttccgttgccggaccgtccgctgcccatcaaaattcgctttaagaagcttcagataaagcaattttatacttttgtatatattaaagcattttttatatttcttcagttacattgaccattccgtcattgaatttctctattccaacaagcaaatttgggacagaattagcaccaatttggaattgtcaaaatattgtcaccagtcaatttgggatgtttttgaccatcaaatttggccaatttttgctaccaacattcgccattttggcttttgtggcgctgatttggacaaattgcgtcgccgcatttcatcaacaattctcgctgatcttgttcaattgaattcgatcgattctggttatctgttccccgatggaattgctgacgatgggccaaatgcaactgctggccaagcgttggccaaatggttgcacactccaacaaaaaatggccaaccgaagcgattgtatcgcaatggttatgtgggtccactgaaactggaatgggtcaacaacttcaaagaggtgtgccgccatatttttgttaaattgtttttgttttaccaattttgtttagacatttcgccgtgccaccacttctgtcagttacaatattcaactttatttttttatggaaccaacgtcaattgaacaatttgaattggtgaacgaaatgacgaatgagaagctgacattgaaatatagcgaagaatacaatgatggatcattgtataattggctgttaaaacggtgcccaattggggagacggagacggcgccagttaagtggaaagaccgctaa

SEQ ID NO: 52090 - DNA, 72 bp, Heterodera glycines
  Genomic contig location: Contig_ID=SeqID_21479; Location=586..657; Strand=+
  SCN-specific regions: Sequence locations=1-72
atggacgactgccaaacatcagcgactgctcacgtgggcaaatgggacggggaagaaagcggtggcctgagg

SEQ ID NO: 52091 - DNA, 983 bp, Heterodera glycines
  Genomic contig location: Contig_ID=SeqID_21481; Location=53..1035; Strand=+
  SCN-specific regions: Sequence locations=1-130,155-983
ataaatcaatgaagagcgacagatcatcatcgcagcaggagcaaatgcgaaagcgtatgcgtcaaaggaagcagcagtacaacaatgaaaatcaaattggtaaattaaaattgttaaaaacaattgttgaatttctttttaaattttctttgtgcttcttaagacgagaacataacgccccgaaagatgggacctttatgctccgatttcccttcgccttcaaccgcaccaccgcttaaacgacacattgtgcttcataattgtggtcggaaggtgcaaagtgctggtcgaacgacgagacatggggatggagaagctgctggcaacgaaccgagctcgtggctaaatcggaaattctacattgtggtgaacagtaagtgtagcgaatttttcattactctacttggaatttaaaaaatcaaaaaaaggcccatcagaatgaggttttatgcctaataaatttagacgggaaacccatcgaagtgtactgcactgatctgatccaccgggtgaagcagtgcccgcagcgacagaggctgggcgtggaggatgggcaacgatttctgcgagttgtggacaggtggcgggaggagtggaatcacggcgtgcagatgccgttaggcaccggcactgacacctttttggccgagcccaccaatctgtttcccggattggccaggacgaaaaactttcaactgtacaacacatgcattcctttttaagatttaatatgatgtttattcagtccatcgaaattggtcgccatggacacatccgtaaacaaccggtacatcgacgaaaaacactttcactttgccgcgaaaccgcccaccctctattacaacttggacgaggaggatattttatggctgaagaagcgaccaaccgcagttggtgctgacaaatgtaaagggaggacttcctccattgctccgcggacattcgttgatgcgatgaactgtttcgaactgctcacttacaag

SEQ ID NO: 52092 - DNA, 1047 bp, Heterodera glycines
  Genomic contig location: Contig_ID=SeqID_21485; Location=356..1402; Strand=-
  SCN-specific regions: Sequence locations=1-271,317-548,602-728,751 -840,896-936,960-982,1005-1010
atgcaaggattttcggatcccgctgatgcagaacaagatcccgcgggattaatcccgcaaatcccacattttccaaaaaatgcgttattgcggactaggatcctgaaaaatccggcgcggggatccgtcccgggcctggctctaccaagcaccgaccgcttttcgacggtcactgtccgtgccattgttgaggtcgcctccatgtgccatcgccgcagctgccgctaccgtcgatgttttgccaccgcttccgtttccgcttcccgcaacattgttgctgtcgttatagttgttcttggtgttgttattgttgttgctcttccgctggtgcggttgcggcggaggataacgctcccgaccgcttccgtctccgcttgctccaccgcttccgcttccgctgctgttgtcgcgcctccaaatgcgctgcgcaatccgcgtgtgcaggcccgtgttttgttgtgttgctgaattaccgcgctaataagtgtaaaaagagttgtatggcaaatttggctggtgccaaaattggcggctaaatttatgcggggaaaatttaattaaaatattttatgagtttttgaataatttttttttatattttgcaattaaaattggattgattataaaatggggaaaatgtttgtaaaagttcgctaaaaccgtgactttttcatggttcataagttgtaatcccccaattttatggtcgtcagggagacatcatcggcaaaatttttggaaaaataaattgaaattttttttttgccaattaaccaaccaattaatgatttcttaattatgtttaaaaaaattcactctttttaactaagtgcaacaatgttttaattaattatatatattattttttattcaaataaatttacaaaatttatatgtgcgtgcattaattcttctgcacatatgaattagcctgatgagggaatgttggagaaataattaatttttgtcatttgtcattgccaaaaattataaattattaatttgcagacaatattttatttttattacttttaatattgtaataaa

SEQ ID NO: 52093 - DNA, 442 bp, Heterodera glycines
  Genomic contig location: Contig_ID=SeqID_21486; Location=501..942; Strand=-
  SCN-specific regions: Sequence locations=1-163,193-329,359-442
aaagatctataaaaaatttaaaaatgagaattcatcgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatttataaaaaatttaaaaatgagaattcatgcgagattttctggaaataagcttaatatggcctagttaagctgtaaaaaaaatttggggcgatttgaatgaga

SEQ ID NO: 52094 - DNA, 601 bp, Heterodera glycines
  Genomic contig location: Contig_ID=SeqID_3841; Location=697..1297; Strand=+
  SCN-specific regions: Sequence locations=1-85,117-219,252-601
atggaaattcaaaataacatcgacgtttccgggcttgtcgctctcatcaaatttcacgatttaaacactgtggtaattggcgcatttaaaatttaatttgaaagcaaaagcattttgggctggcgcaattgcctcgctgatctgcgcgacaacagttgctgtgttctttagctcatctcatttcttaaaactaaacaaagtgcaatttctgtccgtgtgttaattattaaattaatttattatttttaattgctacgacaacattcagttgcttgcccttctgtccgttgccgacttgtgcagttgcctgggcattttggctttgggactgatgcgcaaagcgctctatgaacgaattgtggagacgagccaagtgccattggaagtgaagggccatcattatcttttaaaataatccatgtctcgaatttgaaattccgggattggtaaacaaattaaaattacaagggaaagaaaatagcttttttttattttggcattttttccagaaaaacgattgtttggcttttaaatcccgacaacgaacagtcccataaatccataaatattttcaaaatattactcatcaattattcacata

SEQ ID NO: 52095 - DNA, 626 bp, Heterodera glycines
  Genomic contig location: Contig_ID=SeqID_3841; Location=2176..2801; Strand=+
  SCN-specific regions: Sequence locations=1-52,81-177,206-626
atgctgctcatttcgctgttctccacgctgaccgtaaccgtgcccaatgtgcttttcctcagcaacattttgttctgcaaatggatgcattccgacctgaccgacccgtccaattggatgatcacggcaaaatgtgccgcaaatttctttgtgtttctgctgtttaaagaggtgagaaaatgtgtaaaatttttcaataaataaattcgttctgtaccgtaaaccccggtcattcattcccctgggtgtacggtaaccaatgtgtggtagtcattcatgccttttgtaggaattccgtgtccgaatctacgaaattcttggctgtataagccgagacccgagcaatgaaagacagtacgaagtgtcggcattgggcatagccatgacgagcagacggaggaaaatatcagtggcagtggtggagcagcagaggaacgaccagcaacaggtcacaattggaggcacaaatcaaatacatttggaaaccaaatgaatttgtggctaaaattttaatttccgcccttccaccgccggtgggcgactttctttctttttttttgcttggcacggcacagggaaattttttgatgtacttttgttaaatttagccatttttactttttcca

SEQ ID NO: 52096 - DNA, 1497 bp, Heterodera glycines
  Genomic contig location: Contig_ID=SeqID_3842; Location=1061..2557; Strand=-
  SCN-specific regions: Sequence locations=1-48,70-527,550-979,1001 -1135,1157-1215,1237-1497
atgaccacgagggaattcgcaaaacggcaaaagttcgcaatggaggagaataaaaggaaaattagaggatttggcaaggccatcgacacggcaatttttggtgggtcagtcggctaaaatcaatggccttgctaattggtgtttttgtgctccaagtttgaacataagaagaaacattagagaacgaaattttaaaaaatgcggggacgggggttaacgatgggccggggacggggcaccgtttcaaaaattcccgtccccaatatttccctcaaaaatacggggggtggaagcccagcgggggtcacgtcctcagtccggactctcgagattacacatgattattttagcaaattgtgccgaaatttttatgcaggaaaactttgtaatggcattaaatttagaaactgccgacaacgaaagtgatgacaacaaggcatatttatgtgcaattataggggaattaacggtaaaaagtctaaaattaatatgaaattaattaattgtttttagggactctaatcgacgacttttgtaaaaccaataaaagtgcacaagatgaacttttacaccgaattctacaagaaattggagttgctgctcaaagaccatttcgatgattagggtcgcataatgtgatgacaaaacgcagtgtttgagtgaaaaaatcagtcgggcgcttcccgccgaattcctcttggagtgcatttgctctccaatggtaccggcaatgcaactcccacaaacaaatgtcccgattcccgtcaacaaaaatggaccagaacagaagaaggcaaacgaacactttcccaaaacgcagaactccgttgaagaagaaatcctcctcgacaagttaaacagccaattgcaatccttcaaaaaacaattccccagctattcaagaaatagtcctgcccagacctccaacaacttcctcaaatactccaaacattcttactaaaattctccccaaaattttctcctcccataaaaaacaaaatttccctttgaccgcttcttcaactcaaattcaactatcttctatacaactacccattcgatctcatttcctatttcaaaatgtcaattgacttcagcactattacttattcgtagcgcgacatttgcgccgcccaaaaaaattttttttttaattggcaacaatttattaacgctaatatttgataaaaccctaatagaagttagcaaatgactaatcacaaagataaacgtcctgaaaaatgaagaagagtatcaacaaaacagactgcgaccattcgaaattgacgtgacacgcgggcttgatgatcgtccacgtccaaaaaaatatgttgaaaacgatgaagcaataagaagactagttgttgcctacgatgccaaagaagataaaaatgacgaggatttgatcagccacattcatgcccttcaataccgaatcggaatgaagggattcgaagaatggaattagtgttaactattagcaataggattaataaa

SEQ ID NO: 52097 - DNA, 262 bp, Heterodera glycines
  Genomic contig location: Contig_ID=SeqID_3842; Location=395..656; Strand=-
  SCN-specific regions: Sequence locations=1-262
aaaccggtttttgtaccggtttaaaactcgaaaagttgagtgaaaaggggggctcctgaccttttaaaacgcccaaattcggacaaatttggtatcattcgaaagcttttgatgagctaagtctaaaaaacaaggtataaactcgaaccaatgccatctaagcactgggacaactgagtcccagagaaaatggacacttcagtaccaaaataaataaccatttaaaagcaaaaatttcgcaaaagggagcatgcgaagacgg

SEQ ID NO: 52098 - DNA, 1423 bp, Heterodera glycines
  Genomic contig location: Contig_ID=SeqID_3843; Location=379..1801; Strand=-
  SCN-specific regions: Sequence locations=1-107,140-343,371-560,609 -681,703-754,785-1056,1078-1147,1173-1423
atgagtaagcgaactgttgatcaacaacgccagcaacagaacatgcagaaaaagcacaacgaattggaggtgattcccaattaaaagggtcacctaaaatgaaagtcatatttataatctaatttaaaaataatttaatgacacattgtccgacttttattcctcttttttacttaaaaagtttccgcttttttacagcagtttcgttcaaagttagatcagattgaaaacgaattgatggaagtgagtgatcagctgaaggatcaattggcgcgaaatgatcaatttcgaaaagggaaagggtaaagcaaaaagaaaaagcaaaaccacaattttatttaaagcaatttatataaataaatatccaattggtgtcaataaatgcgaacaggaaaaaagaaaatcttgcaatttatgtaaaaaaacaataaataaatttgtgaattttgaacaaattttcccattttaactcattttttattttattttcatttttcccttacagggaaattgaaaaaatgccaattgaaagggaaggcgaaaatagactaattaaggtgaataaattttaaaaaagtgaatataatatttaaaacaaaaaaaatttaggagagaatttttgtaaatgccgccaaaatggagcaaaatcatgcgcaattacggcagaaccaaaaagaagtcaattacgaatttgctgagattatcaaatttttcgacatttggctaagggagagccaaacgcatttcggtgccgtaaaaataaattaaatctttaatttaatttggattttttaagcttcttccccatttactccgacaacggaaaatcattcccttcggcggcaacaaaatttaaaagtgagaaaaaactaagccaaatgaccaatcctttttttattgttcagttcgaattctccctttttttccttttaggcgtccatttgggccatcgatttgttcgaacttcgtcagtttcgcaacggcaattctttggcccaatgcatggaatgcgggaaaaagttagtgccgttaactcatttgtatttgggatttcaatgcatttttaagctgaattaaaaagtggatcaaaatttggtgccttataaatttgatggacaattcgttttccatgagaatggccaattccatttattaattaatttattttttaaggtttatgaccacggaagaggcggcgatgggttggcacattgtgcagggacacccgcaatacgcagcccaattgctgcagaaacagctcgaaagggacgcgcagcaaaggcaggggacaaacggcacggaaacgacggcacagaaaaggaaacgaaaagcgacggaagagcaggaaaagccgacgaaactgttcagagatctgtgggaaagcagcaaagacgaggaagaaacggagcaaatgaattcataa

SEQ ID NO: 52099 - DNA, 54 bp, Heterodera glycines
  Genomic contig location: Contig_ID=SeqID_3843; Location=217..270; Strand=+
  SCN-specific regions: Sequence locations=1-54
aattcgattgtgattgatttcaagttttttgtgaaagaattgttaccgattgtt

SEQ ID NO: 52100 - DNA, 328 bp, Heterodera glycines
  Genomic contig location: Contig_ID=SeqID_3843; Location=3410..3737; Strand=+
  SCN-specific regions: Sequence locations=1-86,115-164,186-225,259-328
atgatcataagaattgcagcaattctgccgattatttttgtttatggcatggaacgtaagagaacatcaaaaaattgattaataggttattaaaaattttcaaaaaataattaaggtaatttagggtacccggacacaacaaataaaagagacaatttagcaatgaagaaaaagcagcaggggaatttgagctatttatattcaattggagaagacgaaaaagtgttaattgattattaattaattaactatttaattttaaaattaatcttttaaatgaatccgcagaaaactttggacgaagaaatgtatgaagctgatttgaaca

SEQ ID NO: 52101 - DNA, 123 bp, Heterodera glycines
  Genomic contig location: Contig_ID=SeqID_21488; Location=545..667; Strand=+
  SCN-specific regions: Sequence locations=1-123
atgacgcttaaacaatttgtaccaacagaacaccgaacggttggtgtaacaatttgcgcttcccccactacggcagttcgttcagtccgctcagacatttgttgccgcccgtttatgacgacg

SEQ ID NO: 52102 - DNA, 1243 bp, Heterodera glycines
  misc_feature (976)..(976): n is a, c, g, or t
  misc_feature (1023)..(1023): n is a, c, g, or t
  misc_feature (1131)..(1131): n is a, c, g, or t
  Genomic contig location: Contig_ID=SeqID_21490; Location=93..1335; Strand=+
  SCN-specific regions: Sequence locations=1-394,424-431,455-778,800 -868,890-1218
atgtcatcccaattccatcacttcttcttcatcactttactttatctgctgatctcactgttgtgccaaccatattcaggtgggaatggcatcggatcggttgcgataaatatttaaaattttcgctctttcctctcataaaaacccttggtgccaccggcgcagatggtgccattcgaaatattaggcatttcatttctctaaaaattttttcaagtccatgccgagcctccgcttcgtgtcaccgacggcgccgatgtgccggcacagtcgcctattgcttcccctccgggcgctgaggacggcggcgcccaaccatcacttagcaacagcaacaataacgacaatgatgtactgcttgaaccgtatgggccctcggcattcccggccggtgatcagcaacagcaacaacagcagcagccgaacggcccgaagaagaagaagcagaagcagttcccacaactgatcggatgggttgatcggcccggcgaacgcatcggcgagcaatgcgatccgaggatgaagccggcatgcaccgtgccaaactcggagtgtgtgggcggcgtgtgcgagtgcttggccatgtgagtttttgatggtggtggatgtactgtttgctgtctgtacaaggccataaagtcgacacgaaattacgattacaaaacttaatttatctcattcaaattttatgctaattttcccccgttgttaggtattaccccgacacaccctaccgatgcgcaccaattgacacaggtgaaaactgacgactaattaattaagcaataaaattttattttcttaattttcacaaaacccgaatcttttaagcctatgttttctttttctcatcaatttttttgttggcatttttaaaaaatttttaattgtctttcttgatttaaaggattttttggcatgtttaaaattttactttcacagatttaaaattttaaatttttgtggcattttttanattttatctttccagattcaaaaaagttttttcgtaatttttcctanattttcttgcaaaattagattttttgcaaaaattacagagggttcgctcggccgactgtgccgtcgtggcgtggactgtcggggcaacggcgagttctgccacacggnccagcgcaagtgcgactgttgtgcgaactttgcggctgtagactggcgatgcttgccggggcatgcgccaggcggaatgtaagtgccaaaatttaaatttaaaaaaaaaaaa

SEQ ID NO: 52103 - DNA, 524 bp, Heterodera glycines
  Genomic contig location: Contig_ID=SeqID_21492; Location=1878..2401; Strand=+
  SCN-specific regions: Sequence locations=1-262,285-309,331-342,364 -424,447-524
atgggtctgaacaacaaatacagcaaatggttcgaattagaagtagtttatgattgtattaaaaaacatttaatgaggtaggaaaaattaataacaaaaattaatagtgaggtaattaggggagtgattaaacaaagtcaaacgcattggacagaaactgcgtttttttaaagatggaaaatgataaaatgtaattggacgacaatttattcttaattaattgcataattaatagagccaaggaaaaaagcggggtaatgagtttttcgataattttttaaaaattacatgggatctggaaactaacccaaaaattaatttggtgttattttccgagtcgacttaagattttgtcaaaattccatgcttaaatgaatctaagaatttccagaaaatacattaaaatttcgtcgtttataattgttaaaatcccaaaaaatttttaattagccttaatcatgtccagaaggtgagcttccgaatcctaattgttattttttcaaaattccaggctctattaatta

SEQ ID NO: 52104 - DNA, 886 bp, Heterodera glycines
  Genomic contig location: Contig_ID=SeqID_21494; Location=117..1002; Strand=+
  SCN-specific regions: Sequence locations=1-223,247-461,512-771,793-886
aaaaccatttgtaatgaatgcgaataattcaggaactgttggacatgattctgcttgcttttggcatgactggggaaatgatttattccgtggccggcttactcggcctcaccggaagtgcccggacggaggagcgaaattgggagcagatgacgctgattcttcttactgtaagcgattcttttgttgagcatactgtatctaattgtaattgtatccatctgtaataattgtgccaaaaatgttttttaggttcatgtcacgcgaattttacaagtaaatttgaaactcaagtttaaatataatttaatggatctaaaggttgggctccaaagctgccttatttatattgcggtaattttgcattttctgatcagtgacaaaagcattcaaaaaattatttttttagggaaaacttcgcattgggaatgaccctattttgagggaacggcagccgggtaaaaataaaataaattaaaattaagtttaattaaaataaataaataaaataggaaaacaggcgatcacttttcttctgttggccaacatttcaatgtttctgatgaatttgctggaggcggaaaaggcgggcgttagcgatacggtggtcaatttttatgggaagagaaattggtaagacggttagtcggtaattgatcgattaaaaacattttcagggtgtttttggtacggtcattctccccactgaccattttctaccgtttccacagctcagtttgtatgtgaaggaaaagccaaataaatttcagagaattttgaatatttgaaaggtctggcagaaatatggaagagtacgtattcgtggaaagagtgaacaaaaccaatcggaagaaaagaacaacacatttttgtaacagttcagagc

SEQ ID NO: 52105 - DNA, 1139 bp, Heterodera glycines; identical to SEQ ID NO: 21495
  Genomic contig location: Contig_ID=SeqID_21495; Location=1..1139; Strand=+
  SCN-specific regions: Sequence locations=1-237,259-704,729-1139

SEQ ID NO: 52106 - DNA, 1108 bp, Heterodera glycines
  Genomic contig location: Contig_ID=SeqID_21497; Location=200..1307; Strand=-
  SCN-specific regions: Sequence locations=1-73,97-558,580-744,766 -773,795-1066,1088-1108
atgaaattggaagggaatggcacacgcggaaatggcaaaatgggaaattgtactgaagcggaggcgaacaaatgggaaaaaggggtgagcaaaaagagggacaaattcacgagtttagggggccattcaagagttgaaactgcacgacgacccggcagaagcggcgaaccaatgcaatgagaattgggtattggaaaagaaaatggcacaagaaatgggaaaatgccaaagaaaagtgccaaaaatgatttttagtggaaaacgcgtaggagagactatcagaagaacggggcagcccaaacactggtcatttgtcggattgatgtgcttatgtggtgctttctgtgcttaattaaattttgaaaagcaaaaacgaaagaaaatatttttgcaaaattaaatttcaaattgcaaaaacatttttgattttttgaaaagcatataatttgaaattaagagaaatgcgaaaaaaaagcagtgtttggtcatttgatgtgtattagttctgttcgagaattaatcatgagtcttgagcagcttttttggtattgtgtgttctgttaaaataatcattttgaagatgctcttccaattgattgaccagtccagattgattgattggtatattcttttaccaatcgattgatcgggccaatcgattgtttgatcggtttccagttttaaacgatcaattaattggtcgcttattgctcgtccgaatttgtcagtcgttctgtcggcttttgttgcgtgttctgtttttccacaatgttcagctgctgcagcttcggctttaccaaatgttttgccttttcaggacaccgaaagtgacgccgccggcgacggcagtggcattggcccgccctttgaggacggcgaccgaccggcggtgccatccgacgcagaaagagcaccgcttctgtccacaactccgaccacaatagcgtacacgacagtgccaccaccggcaaaaacacaaaatgtgctagtgacgcaaatgcgccctaaggcgtggccgccgtccgaagccgacgggcggtgggatggcggcgctcagctgacaccgggacccaaaggggaaaagggcgatccgggagtgcccgggaca

SEQ ID NO: 52107 - DNA, 328 bp, Heterodera glycines
  Genomic contig location: Contig_ID=SeqID_3844; Location=4939..5266; Strand=+
  SCN-specific regions: Sequence locations=1-240,262-328
atggaaccaaattcgcataatttgttggctaaagccgaacgattattaattgttatatttgtgatcaggtaatcatttttcaatttcgctagcacaatgttaatcaaatgttttccaatgcttttaggcgtaaatcttatggaactttgaaacccaaattcgaattcaaatagaacaatttcatcaaaaattgagtactaaagggaagataaattaaaaattacttcgtttatttatgtgttaaaatttttaattaaaattgattgtttacccctggcattcaaaaaatgaattttattatgtatttattattacgtgttatttatta

SEQ ID NO: 52108 - DNA, 84 bp, Heterodera glycines
  Genomic contig location: Contig_ID=SeqID_3844; Location=6954..7037; Strand=+
  SCN-specific regions: Sequence locations=1-84
atgaattggatcaaacaacaaacaattccaatacccggtacccgaccgggtaggtccgggtacccgggtaccaaaagtgcactg

SEQ ID NO: 52109 - DNA, 219 bp, Heterodera glycines
  Genomic contig location: Contig_ID=SeqID_3845; Location=92..310; Strand=+
  SCN-specific regions: Sequence locations=1-61,83-219
aaaatgtgcaaatcagaatgtacatcaaattggttaactattaaaaaataataagatttggaataagtaaaattgtaaaaaatgagcgaatgttaattaatcctaacttatgccaagtggcgagggatccctcaggtttagtttttagaatcttaatttttaaaaaagcacatttttctatttttgggttggggcccaaacgaccccggggcccaaaaa

SEQ ID NO: 52110 - DNA, 1174 bp, Heterodera glycines
  Genomic contig location: Contig_ID=SeqID_21498; Location=441..1614; Strand=-
  SCN-specific regions: Sequence locations=1-16,39-151,173-1174
atgttgctgccacagttgagaagttgtcaagtaatttcgtccatttccgaatttgtttatttaatccttttaatagtatttgcgagccaaggacgaattgatgtggattctgctccaattggttgcctacgcccgttctcgcgagaagaatttggtccaacagcagcagcaacaaaatggccaaagcggggcacaaatgctctccgtcgttgggttgggcgcacagaaccgggaattggttttggacatttttaacgtaatttggttacaaattggcaagaattgggttttccactccaattgcttatcaggttttgtacaccgacaagaacatgaattgggctaccacctgttccacggagaaccctctgaatatggtttttcttcatttattggccattgacttgactgactttttgttaattttatgtccgattttttgctcctgccgccatttggatcaatttggtgcatcctgtcgctttgcccattgcgtccacttcggaagaaagtcagcctcagccaccggagaaactgaaaccactcattgatttcatcggtttaaactgaacattatttatcgtcaaattatttttattttttacagaaaaacagttggatgcaaacaaaccgctggacaaaacgttggcccttctggcggtcattgccaattcgtacagcaacaatcgcgaggtgttcgaggaacacgtcagctccgcggtgtttcggattcttggccagagcattgttcatcagcagcaagtgcttatttatacaaaggctcttttacttttcattcaattgttctttagcctcatcaacccgaaaagtgttgggttttgcccggcggacggcgaactgaacagaatttgcgtgcattagacctgacttttctggactcacttactttccatgccaaattgcaaatttacaagtcaacatttcgtctctacagccaattattctataaagatgcgacacctaattttgcattgataaggtggtcaaatgttactccattttgtttgtctttttataaagtttttttcagattgccaaccccggcactcgtggaaagtttggcacgacttttgttgagcacggaattggtcagtttttcggttctttcaactattaccaaattctgctattaaccatgtcagatcgaccttaa

SEQ ID NO: 52111 - DNA, 161 bp, Heterodera glycines
  misc_feature (116)..(116): n is a, c, g, or t
  Genomic contig location: Contig_ID=SeqID_21500; Location=31..191; Strand=-
  SCN-specific regions: Sequence locations=1-161
atgttccgatcgcccgcacttttcgcgatgtttcttctgctgctgattgtttttcagctgtttggggttgaaattgtgcaggggtcgaagcgaagcaaaggccgcgcacggacaanagaaagcgaaggcatttcgaatcgggggaaagatcggcaaagaaa

SEQ ID NO: 52112 - DNA, 1693 bp, Heterodera glycines
  misc_feature (34)..(34): n is a, c, g, or t
  misc_feature (45)..(45): n is a, c, g, or t
  Genomic contig location: Contig_ID=SeqID_21500; Location=896..2588; Strand=-
  SCN-specific regions: Sequence locations=1-40,136-167,189-216,238 -244,293-327,349-678,718-1206,1287-1693
gccatataatatgatttccgggttcaacaaaatntaatgcatttntaattaaattaaatatttttaagtcaaaaaaacaatacaaaagaaattgtttttctgttttaattaaaaaaattaaattgaatttatttactgtaaaaattcattttactttttacctacccaattaaattatgataatattaatggaataattgggtttgattaaaacccaaacattttaaatcttttttgtacatccatattttctatataaattcataatttataaattttaattaaatttatacccatttttattgttaaaaatacgcactctcgacatttaatattttccaaccatccacaacattatcggataatttcctccacaaaacctgatattctcttttagtgttactattttctatattttaaaaaacgaaccgcaacaattattatttttccccaaaacttttttaatttttgttaaccacaaaactatttctgttttttgtatttttccgaaaaactatttctgttttggtttgtgttttccggaaacaatttcttttaatattttgatcattcttaagtagtgatctgatcaacttgtgcaatgcattagtttataaattcatgatttacaagaattatgttgtcatagataatgtgagtaattcattttaattttgctttttaaagatataaaatatatttttatattttttatttgttcttgatattaattgttaggtatgcctgatcaaaatctaagctctttagactaaggctagtaggtgaaacacaaaaaattttgcgtcctatatattttgtgatatgatttgtatataaagcatttttttatcaatttgcccaataaactatatgtaataatttcgtttagttgtgggtaaattttccgattaaagaaaaaaggtatgccgaaattggcatagcttagagcaagaagcactatttaattatcaccttcagtcattatttcaattttgggaattacgaaaatttattggaaaaagcattatatattttttttgacaattaggccacaaatgtcggtctccgcaaatgtcggtccgcaaatgtcggctaaccgaaagcgcattaactccaacgattttcagcatccacgaccacagtgctgcgcaatgcttcgtcaaagttttggatgggcaacttttggagacgcgatttgcatggccaaagaaggaaaaagaagagaaagaggaagaaaaggaagaagagaaggaagaagaagaggaagaagagaaggaagaagaagagggaccgatgagggcgacagggacggcgctgttcaaaacgaacggagtcagctacatcagtggttggttgaagagataaagcaggcaaaattgaacaaaaaagaataaatcacaaaggaaacggatgaaattcagacaaaaccggaaaaacggataaattcagacaaaatcggaatccatcggatggaaaatccctcgcacgtcgacccgacggtgacccttcacctgtacattcccccgtacagccaatgctattcatttgaccaagtgatggtccccattattttttacaatttaattttaattcctttttttcatggaagcgaacggggcgaaaacagcaaaatacagtaagctttcattcaaagtacggtcgaaaggtggactacggtagtgggaacagaaaa

SEQ ID NO: 52113 - DNA, 867 bp, Heterodera glycines
  Genomic contig location: Contig_ID=SeqID_21501; Location=599..1465; Strand=-
  SCN-specific regions: Sequence locations=1-14,50-221,256-783,805-867
atgaatttgttgtgtttaatatttattacaattttctttatttttgtaattgactccgacaaaattcgaccaaattttgatgaaatatttggcaacggatgggacaaaaaagaaagtgagcaaacagtgaaaattgaacaaaatgaacgaaatgagaactcacaatcagcagcagttgatcaaatgggtgaagaaatgggaaatgaccgaaatgatcaaatgaaaaatgatcacaaaaagagagaaataattttgaaatttgaagcaattaaagaaaagttgaagcaaaaaggaaaatacaaaaggaaagattatggcaaaattgagagaaaaattgcaaaattattaggcacaaatcgcaaaaaaatatacaaatggaaaaaagaaatgaatttaaataaaaagatggaaaagagtttttatgaggacaaaaagaaagaattcattgaacgatttgatgaatttaaagatttatatgcccatggcaaacagaaagaattcgtgaaggaattgggcatttctaaacaaacatttcgaaagtggaaaaaagaattggcaccaaaatacaataaaagtaagtgcattttttcgatttttactttaatttttatattaaagcaccaccgaaatattccaatgaggacaaattgatgaagatgaagcaatattatgaaataaaagaagcaaacccaaaagtgactgacaaaataattgccaagaaatttggaattggatatgcaacgatgagaaaatggaaaaaaagaatgctctcatccatttgatcagtgattttatttgattctgatctataaaaatattttgtagggcatctaaaactcgccagttttttagcattagaaaaataaa

SEQ ID NO: 52114 - DNA, 1064 bp, Heterodera glycines
  Genomic contig location: Contig_ID=SeqID_21503; Location=96..1159; Strand=+
  SCN-specific regions: Sequence locations=1-30,52-432,465-544,566 -829,851-1035,1058-1064
atgaacgaacggaccaatgaaacgttgacattggataaagaagaaaacgatgatggatgtatcgtttgggtgttgaagcgttgccaaattggggggacggttctgtgggaggacaaaaatttggataatttgaacaatgtcgactttttgctttttgaatttgggtgagtggcaacagcacattttctttgtttaaaataattaacattatttcacttaatttaggccattgtctccaccaaaggcgggccaaatgaacgcaaaaagtcgtctgaaaatgaataccgggccaaacgggagaaaaaagttgatgaaatatgtattgggaaatgaccgatgaatggaaactgatctgataattgctcttatttttaatggtcaaatgttgaggcaaaaaaggcaatgatgagcaaaaggaaaaggacaaattgcatttaaaaataataattataataatattattagagcccggacgggaccgggccccgcggggatttaaaaagttttgttatgtgacggaaaaaatttatgattgaaattcatcacattccatttccttcccttcataagcatcttaaattcataaagtgatcacaaattaaagggaaatgaattatttatatgtttaaaaaaatttccacatactcaaacaaactttgatttacaacgcttcttttacgtctgattttgctttttcaacaatgttgactttgcattgtgaaaggaattattttgaaattgaagcatcattaatttatttgacgtgtttaatcttaacttttatccaaaaatctaaaattaaatttttttatgacttttcaattccgagacctttgcatttatttttaataatgacttgaaatgaacataccacattgacattatgaatatatttattcgacgcctcatcggtcttaaaaacaaaacccaatttttaaaaaaaaattacgaaatagaaaaatgaaattcaatttcgcaaattacgaaatttgatacaatttcgtattttttatggtccggcgtgaaaatttttatagatttttacattcatatcaaaattttaa

SEQ ID NO: 52115 - DNA, 293 bp, Heterodera glycines
  Genomic contig location: Contig_ID=SeqID_21505; Location=558..850; Strand=-
  SCN-specific regions: Sequence locations=1-206,228-259,281-293
atgcagccaaccgatctacccgcatgtctgaagcagccggcgagagtgatggtgcgcggtggaatccatcctcaaatccgttcagatgaaaacgaagtctatcacctctacaattcaaatctcatgaagaaagttggatacatttcgatgttctaccatgtacgaattggggattgtgtgtggctcagtatagacttggtattgtattattaaaacataagctctctcaattttattaccgatttatgcgtcattacagtaatgtttattattttattttgtctcctaataaa

SEQ ID NO: 52116 - DNA, 63 bp, Heterodera glycines
  Genomic contig location: Contig_ID=SeqID_21507; Location=2046..2108; Strand=+
  SCN-specific regions: Sequence locations=1-63
atggctaaggatttgtgccgatacagcaaaaagtcgttgctgatgcacccggaagagattgag

SEQ ID NO: 52117 - DNA, 961 bp, Heterodera glycines
  Genomic contig location: Contig_ID=SeqID_3847; Location=1859..2819; Strand=-
  SCN-specific regions: Sequence locations=1-40,62-208,230-961
atgcgtttcggtcacggcacacgcccaccaccgctcgcatcgtccgccgccgccaccgctgagacctccgcggggccatggggcgccgctgacggacgagttcagcgacatggactccgaaagtgttcagagtggacggcgcgggagcggcggagaacggcgccaacggacgacggcggtgcggcatggcggcgccaacggtcgccactcgcagcagcagctgcagcagaggccaccgttgccgctgaagcgggaaaacaccgactcgacggtttcctcggcacagcgaggaagaacggggtcactgtgatcagcagaggaaaaacggaaggggacaagcaaaactgtgatcagtcagaagcagaccaccaagcctgcccagatttgtgattggaaatctcatcactccccggcttagaagcaagcaatcaaaatccaattggatcctcctctaatcagcgagcgggccgggctaagcccagccgacccacctgatcagggaatgatctccggtagtcagggctaaacccacttaaccttgatcctcagactgggccaagcccgcctgatcagggaaaagcagtgatcagcgtgggtcaatcctatggagaattggacactaaaacagaaaacaatttactctggattatacaatataatagcgactttgtgcccaattttccaggggacaaaacccatccattttgtgattggaaatcatttccgatcagtgatcactagtcagtcttcggcttatcctcttttcccaaaagatgggatttgtctgtctttcacctcaaaactctttctcaattgctctttttttatggattttccaacattttctgcccaatttgccattttcacaattcattttccggtgttttttttgtttatatacactcaaatctttacacaaatacactcacaaaatttattaccatttttttattgaaataaa

SEQ ID NO: 52118 - DNA, 671 bp, Heterodera glycines
  Genomic contig location: Contig_ID=SeqID_3847; Location=3280..3950; Strand=-
  SCN-specific regions: Sequence locations=1-38,62-309,491-671
atgggccaggacatggacggtgagcaaagcccaagcagtgaatgaattaatgaatgaatgccgcccttggctagccaattcaggcatttttggggggaatgcttccgctttcacggggatttgtgccgcgggcacggggggacgaaaaaatacaataaaatttttttctcttaaaatttgtgtgtaaatttttccgtcatttaggtctgttcccctatttgctgctcgcacttggccttgcactgctcgccttcttcatcattctgtacgccattctgaacgcgcttttgcagcgaaaggacgcgcaacagaacggagagggggaggaagaggatgaggaagaacgacgacggaagagacggaacagaaacagacggaggcggaggcgcgagagagtgcggcagaagcacaggacggccagagacacggaggaagacgaagagtggatgggcacagaggaggacgacgagggaatggagagcgaagcggactcatgggacgcggaagaaccgcgcgcggagcggagggagcggcgcgaccaggcgcgcaacagggctttcactgggctagaggaggacgaggtacagacgggttgccaactaatggcatacacaaacatggcacttgcgccttcatgtgccgatgtcgtgcctgaacttcgagactcttga

SEQ ID NO: 52119 - DNA, 617 bp, Heterodera glycines
  Genomic contig location: Contig_ID=SeqID_3848; Location=109..725; Strand=+
  SCN-specific regions: Sequence locations=1-119,145-350,374-490,523 -530,552-617
atggaaacgccgagccgagtgtccgccgctttggtcaatatgtgcacacaaatagcaaaagctaaaggtgagcgatgaagcaatcactaaacaaaataggggaaaattaatggtaaattcgttttaatttagaaaataaaaatggggacgaacattccgaattgattcgccaatggactcgccatttgttgaatttcctcaaggagagcgacctgtttaggcaagcactgaagacatatgacgtcgaaatcgctctaatggtcgcctcaatcgaccaatcttgttagttttatgaaatgtttttgtttaattatttttttaaattcaggatccaaaggaataccttccgtcccccccccccgcccccggggggttgtgacaatgagttgatcagtcgcgtggtggtggcgggggcgacaactcactcaccaaaccgaccgaccgaccgactcttccattattccccattgatttggtgatcagcgcggggaaaacgaatcggggagggggagaaattggtgagaaaaacggcagagaaatgataataagagagaaatgtcgaggaaatgcggggaaatgaagcggggaatggtcgaaaaattttcaaaaaatataaa

SEQ ID NO: 52120 - DNA, 603 bp, Heterodera glycines
  Genomic contig location: Contig_ID=SeqID_21510; Location=1772..2374; Strand=+
  SCN-specific regions: Sequence locations=1-215,237-434,460-511,533-603
atgttcaaacaaatgaaccttttcgttttattttttattttttcatcatattcttttggcactgtggagggatcggcttttacggatttttttactgatttgggcaataaggcttgggtgagttaaagcgtttattcctttgcattttttttgtttctaaattaaaaaaaatatacatttaaggaaggattgaaagaagcaggagaagcaatcttggatgggataaatgaagcaacgaaggcgctggttatcccagggtgggaatgtgggccaaatgatccaaaatacctcgatggaccgtcacacgtacattaattcttcgaacatttattcatacatacaactttttaagcttgcaacgcaaacaatggttatgttcacaacctgtgtcttcaaaatgagttaatctatttgaaaattcacaaaaaaaaacaattgaatttagctgaaatcaatcaaatgttgcaagaccacgacaagtatgtttgaaaaagataggaaaaattaagctaaattttattgaaaatcaatgaaaaataattgaataacaactcattatttaatgttttttttgccccaaaacataaacccgaattaaaatta

SEQ ID NO: 52121 - DNA, 991 bp, Heterodera glycines
  Genomic contig location: Contig_ID=SeqID_21511; Location=335..1325; Strand=+
  SCN-specific regions: Sequence locations=1-422,446-720,766-991
atgaaaatcacaactattccggttcttaagttgaaccttaataatcagtattgttctgacatgaaaggtaaattaaaaataccttctgattttgctatgaaacccagaacttttccggttattaagtttgaaccttaataatcagaattattctgacatgaaaggtaaatcaaaagtacattctgattttgcagtgaaacccagaacttttccggttcttaagttgaaccttaataatcagaattattctgacatgaaaggtaaacccaaattattttgtaatgaaaaccagaattattccggttgttattttgcacctcaatgtcggaatattctgaggcatcagaataagcctttgattcccgaagattgcaacggtcggttcgaactgcgcgggtgggcagggctcagttgagtcacaaatgatgggtatattttaaaaaatgcccaaattattttgaaaattaggttgggaccggtaattttaaaaaagccggacatagaaatgccgaaaaccaaaaaagtcggcattggcattccgatttttaaacataccctcaatttgttgtcgataatcaatgttgtagcgaagaattccaaacagactctggtcctgtcgatggcaagtcaagttcggaggaatgggcatataaacgcacttaatcgtctgtccaattggcaccatacagtcgggctcggcggcacaaagcaaggccatgcaattttaaattattttatttatttcaattattattgatttaaaatctttattggtctgggatttaaaatacgagaattcttataaaaaaaaagaagcatttattatgcttaagactgggtattttcacttgtcaccctctacccccccccccccagattctttaatcatcttttatggtaatttgaaggctgaaattttggtggactctattttaaccaagctcaaatgtcaaaagtgaaaatacattgttgatcactaaagatactcaaa

SEQ ID NO: 52122 - DNA, 429 bp, Heterodera glycines
  Genomic contig location: Contig_ID=SeqID_21512; Location=319..747; Strand=-
  SCN-specific regions: Sequence locations=1-213,235-320,343-429
atgtattccggcggtgggagacgttcgtcaatggtgcacaaagacggaaataatggcgacgacttcggcggtgggagacgtttgttcatgtcgaacaaaggcggaagttgtggcgaagacgacgcgcgactgtgcgctatcatcggtcggtcgcatgtgctcggcacggagcccaacgcgaaaacagcggcactgacggaggttagcagaaatgggagggaaatgccgaaaaatgttcaataaaacaaattttttttacagagcaatgcctttgacattgagacgacaaaaactccgcacaaatttccgaatgtgcaggcggatgggtcgggcgtgttcccagcggactttacttgccgatttatgctggacgtaggggcattggcccaacttttggtgagcaaattcttgcaattgactttcacataa

SEQ ID NO: 52123 - DNA, 647 bp, Heterodera glycines
  Genomic contig location: Contig_ID=SeqID_21512; Location=1088..1734; Strand=-
  SCN-specific regions: Sequence locations=1-15,99-234,257-303,325 -361,383-597,619-647
atgagtgagctgatatttctctatttctttttcttccccgctttctccgtctttgtccatctctctctctcccttctttttcatcttttctctacctcctgcagcaaccaatacataaaaaggatactgtagaatgagatatcgatttttatacgcctttcacactttcacttccgccgattttaaggagtgtatttcgcgtatctacacatgtgtttgcgtgtattaaaactagtggacaaaacagaaagttgaagaacagttgtataaaagtgtacatgaatgtattgttatctaattagcaatttaattatattattaaaacgtataaagcacaacccatttgttttacattggccgaaaattttgatatttgtctttttaaaggcttttatatcgacagcctaaaaatgtattccggcgatgggagacgtttgttcatggcgaacaaagacggaaataatggcgacgacgacatgcgactgtgcgcttttgtcggtctgtcgcatgtgctcggcgcggaagccaacgcaaaagcagcggcagtgactgaggtcagcagaaatgtgacgaaagtggggacgggaaatcgtgggatttttcagggaattaagaaaaccccaaccgcaatttggcatttttactga

SEQ ID NO: 52124 - DNA, 2181 bp, Heterodera glycines
  Genomic contig location: Contig_ID=SeqID_21514; Location=453..2633; Strand=-
  SCN-specific regions: Sequence locations=1-310,332-522,544-594,634 -664,686-725,760-792,815-1050,1072-1323,1345-1374,1398-1428,1460 -1530,1555-1879,1909-1942,1968-2181
tgccaatgaaaggtctttcgtcatcgtccaatgcgttgaaaatggtccaccgggttcaccactgactccaaaaagttccaacaacggacactgccgaagcgggctggcggtgcccaattgctggacattgccgagttgccacagccgaacaaacgccggcggaccaccgtaactgcagcaacaacagcagtgccatcatcatcaacggcaccggcgggggcaccacaaacgacacaattggcaacaatggcggatgggggggaccaaccaaagcaacaaaacctacgggtatttttttttgtctcgtttggtttgaagaaattgttttacgatcgtgttcatatgtatttgtgtttagtaatttccgaaaggaaaatatataaagaaaagaatattcaatgtcgtggggagggttcgaacctgggaccccccttccaaaaaaaatttcattgaccgcaaaatccgattttgtcatgtgccgcaaacgttcgaagtgcaaatgccggactgcatttgttgatctgtaaatgtctgatttccaattcgggttataccaccatccgtagagagctagatctcgtggtctagaagatcatttaaaagaaatttaaaaaaaaaattattttttaaatagtaagtaaactactttaagtttttgtagggcaaaaaaaaatttttttttttagtgtttcatatccattcaagtttaaacaattttgtttaagaattttatacaaataaattttaaatttttttatagaagggttcgctgaccaacaacaaccagagacactcgtcattgaacaacaacaaattgggcgcaactgtggctaaatcgccacagaaaacggcacgacaacagcgcaaacatgaggcagaagaatgcaacaacatcaacgacaaagagggagacgaaaacaaaacaatgccggagggcgcaaatgacggtttctttttgggcttttgatatttgtttgcgcatgcctgtaacaaacaaaaaaagaagaaaatttgtgaaatggcaacccggttatttatttttttcttttcgggtccaaatcattttttccatgcacttcgagagagttaaacattgtttgttttcgtcaaaaaatatcattctattttgtggctatttttgaaaaaatagaattcagtcgtttggcggtggcgtacctttttttcaaagttttggttcttttttataatacagtatatgacattcatacctctgttttcatttcagcttctgctattctggttccaattactggcacttttggtggtgccaatgttggcttggttaatgacggtgacaatgttggtggtgcacttcctcctcatccatcggctgcacaactctgcttgatcaataacaacaacaccaccaacaacatttccgaacagtacagcaatgccattgtcaatcagcaacagcaccagcaacaaacggttccaattcgaccgatgggtggggaattttaatgaatttgtgtgaactcaattgatcagtagggacttgaacagttgattaattaaaaaataaaataaaatgttactacatagtaatggattcgaacttggatctaaaaaacaaaaaaaattttgagccccacgattttttttacaattggcgccgattctcctccccaaccagaaattttttttaaagtttcagtcttacaattctggcagtttaattgttcgaactaattaagctaaaccatatttcttacaattaatatcattttgtcccctctttcagttggctcgcatccatttccaaccaacccaagcagcacaatgatggcctcctcctcctcagcgtcgtcaacgagcagcgcatgtttcaacaatttgtttgcggagataagcactgaacaacagcaattacaacaacaacaacaaatgcccagaatggagacgaatttcaatgtaacggttttttttaatttattttaatttttgaccgtcaggaatatgaccaagaaaaaaaaaacacaaaattatatttatagttttttggcagggttcgaatagaataaattaattgaccaccatgaattctttctgcttttaagaatgaagcgctgaaacagttcaacggcttgttgaaagatgccaacaaattgagcccgctcagctataacatgatcgtctcatttttgaacggcaacaaaa

SEQ ID NO: 52125 - DNA, 1261 bp, Heterodera glycines
  Genomic contig location: Contig_ID=SeqID_21515; Location=267..1527; Strand=+
  SCN-specific regions: Sequence locations=1-165,187-1209,1242-1261
atgcaccaggatatagcaatttggacaaaagcatgtgttaattgtcagctcagaaataatccaacaccggcttatagagccgaaatgtcaattactccggctaatacactctttgctaaagttggattagatttagctgggccctttccgttaacgataagaggcaataaatatttattaaacattgtatgttggtttacgaaatacgtgatatcagtcccattacctgatgccaaagctaggacgattgctcgggcatttctgactaattgttatttaaaatttggagggtgtaccgaattggtaacggatcaagcaacctcatttacgagtgagttctttcgagaactgtgcagcttgctttacattggacaaaaatgcgcgacacctcattggtcccaaggaaacgctataactgaatgaactttcagaacttttcacaatattttggctatgatgaatttattgaaatggcaaatttttgttataacacctcagttcacacatcaacaaaagaatcaccatttttcctcatttttgggagggatccaatatttagtgttgaccaaattctattcccgacaattagagacccagtagctttggatgattcatggaatttaagcaaaaattggtcaccactttaaggactgcctggaaatgtgccgcagaagcgaacgaagaagcacaattacggatgaaactacagtacgacagatttgtgcgcccgtcaaaaatcatggtaggcgacagagtccttttacgtaattatgccggaaagcctggcacttcaaagaagctgaatttgccatggaaaggtattttccgtgtcgtaagtttggacgggattcacgccataatcatttcctgtctatccccccaggcaaacccacgaaaagtccacattaaccaattaaaactttgttttgaattgccaggacctgcctgtaccaagccaactcttacagaagatgaacaccaagcccctgacagagcggaagctgaggagctcaccaacatgcccgggtattatcatcggcctcaggcaaatgcgaccgaacaaaaagaaacctccgaaaaagcccaatcagaagtggacgacactaaccaagaaacaatggacaacaacaaaaatgaagaaacaacagagaaatcaaggcgtttaagagattgaacaacaatacaacgaccgaagcgcttctcagattgaaaaatatgttaatttaattttttttttaaatgtagaaaatccattagtgga

SEQ ID NO: 52126 - DNA, 1291 bp, Heterodera glycines
  Genomic contig location: Contig_ID=SeqID_21516; Location=5..1295; Strand=-
  SCN-specific regions: Sequence locations=1-59,81-113,135-294,316 -338,395-1197,1247-1291
atggaggaaatgggccacggaaaaatgccaaacgcaggcgaagaagacacagtggacgaggacagtttgggggagaagggcgaagtcagcagggatctgttcggaggtatttatcattttaaaaatgcatttccgttttggggctatttaattttttttatgacggtgtacgaaattgcaaaaatagtaggaaatatttcaaatatcaaaacatgaccctttgagaattaaataaatcattaaaactcgaaattttgaaaaaagcctcgacctggacctggattttttgaagtttattttaaaaagcaaataaatgtttgaaaaaatcaattaattgcttaaaaatctaaaaatatttaatttacaataattatgtgtttttaatttatttaatcatttttgataactcaaataatacattggttacctgataataaattctaaatttttttccaaaatccagcctttttcatgtttaacctggacctggattttttcatatttgatagtccgaattttggtccctgtttatttggattttttcaaactatctttaaatttaggttccgacgagccacgacatccccggcctccgcacataaaataccgcgttggtcaggtggtccggcatcggattcacaactatcgcggagtgatcatcgcgtgggatgagaaggcgaaggcgcccgagtggtggataaagaaagtgcacggcgatgtgccggtagacgagcccaactacacacttctcatcgacactcggggtaaagcagaagaatatgcaatattgaaactacgcattttggtgccattctttcagaaaggtataaaagtttcgtcttttcgcgaaaaaaatattttgagaaaattctgttttgcctaaaaagtcgtcctgaaattccctgaaacataagcatttccattttcatgaattcactttgaattttaaggaattttttttgactggcatttcgtttgtgaaattcgcctcatttgttttttcttttcattaagaatttgggttcatttttccatggtttgattgtccttctttttcagaccgtctgatcccacaaattgcctatgttgtcgagcgcaacattgtgctgctctccagcggtgccattgtccacccgttggtcaaacattacttcgagtccttcgacggcacttgttacaaatcgaggccatggtaacaattaaaattaaattttttattggtattattttattaatttttaatatacacattttttatttcaggcacaaaaaagtgtacccgaacgactga

SEQ ID NO: 52127 - DNA, 1150 bp, Heterodera glycines
  Genomic contig location: Contig_ID=SeqID_3850; Location=2024..3173; Strand=-
  SCN-specific regions: Sequence locations=1-191,214-215,237-671,693 -700,790-800,941-956,979-990,1127-1150
  Gene Ontology: Biological process=N-linked glycosylation
atgatcgacttcatgcggcacaaaaaggacagcacaacaacaccgacaccaacaacaacagcgaaaatggaggacggcggcggcagcaggggaagggtactgtagaattgggatgggcttttgtaacagttacatatactgtaagtagctgtctgcaaaatacagtatgggtggccgactctgcaagagcaatttcacacatttcttcctgctggttttataaaaagaatatactgtagctaattggcatacagtaagcggtgggccttttggcaaaagtcgctactggatgtgcgccagtgggaatccagaataataatctgtcagtaaaacaatcagtcggttatggacaatctgtcagtggacaatccgtcaacaaagtatggacgagatgtacttggatgaaacgtcagtctactgacgaattgtccgtcactgatgaattgtccgtcactgatagatattgtcttccgaagattatccactgacggattgtccggataccgtcagtggttggaccgcaatccgggagtttttgcgccagaattacacattccggcatttatggcttgtaaaatggcatttttaggcgaaagcaaaacattcaactggctcctccggtggtggaccatcagtgccggcgccaaacaatcggaagaaaacgccaaatcaacaacagcaaaaaggaaacaacgaattgggaggagaaggaagagaaaatggggggaaaagagaggaaaagggaggagaaaaaggagcagcagcggaagcagaggaaaaggaaaagaaagttgcagttgaacatcatcaaaaacaacaacaacaaaagcaagaagttcaagcagtacagcagcaacaacaaaagcaagaagttcaagcagtacagcagcaacaacaaaagcaagaagttcaagcagtacagcagcaacaacaaaagcaaattttggtgggaatggagatgaagatggataacagcaaaaatggagaaacaagggaagaggtggaaaaggaaggaaatagcattggggaaggaggagagacggaagagaaagagaggaaaaggaaaaattctaagcaaggagggggagaaagaggagagaatgaagcagaaaagaagagagaggaacaacagcaaattgacactttttaa

SEQ ID NO: 52128 - DNA, 974 bp, Heterodera glycines
  Genomic contig location: Contig_ID=SeqID_21518; Location=703..1676; Strand=+
  SCN-specific regions: Sequence locations=1-18,92-313,354-623,645 -727,763-836,888-925,948-974
atgaagagcaatgatcaggaggaagaggaagagaaggaggaggaagaggatgatggagaagaagcacaagatgaagcagaagaggaagaagctgttgtagttgttggcgaactgatcaccacaaggaaaaggtgaagagtttcgtttcaaaaaagtttcaaatttttatgtcttaaaattggtaattatccccctacatttcgggagaaaattgttgagggagagggtcgaaaaatagaaaatttcgccgtagggtgggtggggggggctgaaaaatcggcaattggtacctagttttttatttgacattagataacccataaaatccaaaaatcctggaaaaattgctgaagatagaccctaaaaaagagtcgggaatttgggatgacgggataaataaagactaacgccgtccggtgacctaaaatgccgctcttggtccggaaatttggccaataagttgttaaatccataaccgatcaatcatttgtgatcagattaaggcgcaaatttcagaccaatttataatcgtaaagcactcacaaatcgttacgactacaagcatcgatcactgcttgatgcggccgactttttgttggaaaaagtggcataaaaaagccattaaaaattaataatttgcccattttagcatgactttgatgccgcattgaaacactatgaacaaattttggccacaaacgaacatagcccaaggcattttaaatggaaaaataaataaataaatatttaaacattaatttagagcactttttggccgtggacgtctccaccaattgaaggccgaatttggagctgaacatgatgatgattcggagaaatttattaaaatgtaaaattaataaaattatttaaatttaaaattttttccagggcattgcccgattacaattcagtgctggaaaatgaagacacacctgatgaactattcaagtgatttgtgattatgtacaaaa

SEQ ID NO: 52129 - DNA, 845 bp, Heterodera glycines
  Genomic contig location: Contig_ID=SeqID_21519; Location=758..1602; Strand=+
  SCN-specific regions: Sequence locations=1-16,39-110,132-358,536-845
atgaacaaaatgattgattatttgaaaatgaagaaagcaaatccgtctttgagtgataaagaaattgccggattattgaaaatctcagtaacaaccctaaaaaatggaaatataaacttttataaatttttctattagtctttgtgatgaattgatgtttttcatgcttaactaaaatccaatttatttttcgctcttcatctgttaaagagttttcattaagactgatctgaccgcaatcgagacaatgatcgagatcagtctcagaaccctggactattggcattggtatactcttttttttgtctgcaatttcattttcataattgttatttatgtgcgaaaaatttgggtcttgaaaaatttaattaatttgtaaacttaaaaaaaaattcaatttttctcaaatttctctcttttttaatgatataattaatttaaaaataatatatgtaattataaaatacttaaaaattaaaatcacacaattttatcaaatttttatattaaaatgttcattatttttctattttttgggctgatttcctcacttttttgccccaccggcgctgggtgaggcgtggcgtccgccagccggccgaatgccgccgactggaaacactcgcattggctgtgccacccacccaccacattcattcttgtggcattcatccattgtgcccattccagaagggcataaatgatacggtgctgggacgttagtcaaaaaccatcaaatgaataatttttgacagaaaattattcataatttcgtctaaaatggatcaaattttataatattgatatttttcgatagccctatgtgttttctattatcctgcaaa

SEQ ID NO: 52130 - DNA, 1341 bp, Heterodera glycines
  Genomic contig location: Contig_ID=SeqID_21520; Location=1..1341; Strand=+
  SCN-specific regions: Sequence locations=1-794,816-992,1014-1341
  Gene Ontology: Biological process=jump response
ttgtgaaaggtgagtcaatccctcccgaaatttaaggaagcgtcaattttgggcacgtatttcttgccaattgacgaatccatcgacaattcgtacattcagcgtgagaatatttttgtgggatattaccaatgggtaatgaatgatggcatgtcaagtcgaattagtggtcaaatcaaatggttaaaggtgccaattgtgctggcagcacaagcgttgctcttttaccttccttcgttcatttggaagtcgtgcaatttcagcaccggtaatgaatccgttgcgaattcgcccatttgtccgtccctttcggttgcccgccttaggcattaacgtgaaaagtgtgctgaacagtgcggcactcgtcaaaaagaagttcgacaagggcacgcgaagtgcccaagtggaaagagcagccaaccatttgacggtccgtccgttcggtgccaattaatggcgaattaatcggtgaccgtttcaggaggcattggacatgcaaagggaactgaagacatgtgagtcgatgctgctgtgcaagtgctgtaccgcttctgttcagctgccaccgttttgtcccgccttggaaaacgcaacggcgttttccttgtctgtctgatatttgttcaccaaattgttgtacgtcgccaacgtgttcctgcaatttgtcattctgaatgccttccttggccctcagtacactttctggggcattggaattctctctgacatttggaacggaagagaatggagcgagtaaaaaccgaaagctttgcgattcgcaaacgcaaacaaataaaaaggtccggccatttccctcgcgtcacaatgtgcgatttcaatgtgcgcgtcctcggcaacattcaccggtggactgtccaatgcgtgctgatgataaacatgttcaacgagaagatcttcctcttcttctggtgggtctgccgttgttcggcactctttcgtccttccgtttaggttttggttcatttttgtcggccttctctctctgctcagccttttttactgggcattcgccactttggtccccgcttttcagaaggcctatgtgtgcaaatacctccgttgcgtgggcattattgcccattttaccactcaccgagaacagcgcttaatcgactctttttttcgagactttttgcgcactgacggagtctttctgctacggatgattcaggcatcaactcaaaatttgcatttcgtccactgataacaatccatgaatttgaaacacagacaaacggaggcgatttgttagtcggagagatcgttgccgcactgttcagtcgttaccaaacaaaaattgaacggcacagcgacccaacg

SEQ ID NO: 52131 - DNA, 203 bp, Heterodera glycines
  Genomic contig location: Contig_ID=SeqID_21520; Location=1717..1919; Strand=+
  SCN-specific regions: Sequence locations=1-203
ccctaccggccaattccctaccggccgattccctaccgccaatcccctactaaggcatttgggccatttccataccaaaagtgttgaatattgataaacattgagattaaaacacacaagaaaatttattcactgctttttagaaagctcgtcaagagctttcggatgataacaaatttatcaagattcgatcgttttaaaaa

SEQ ID NO: 52132 - DNA, 523 bp, Heterodera glycines
  Genomic contig location: Contig_ID=SeqID_21522; Location=587..1109; Strand=-
  SCN-specific regions: Sequence locations=1-312,334-523
atgtccgcgcacctttatccgaatatcctcacaggtaaagcttcaattcgcagatgccaaaccaatttttgaccgtcggatgttgcggagtgttcaacgcctggcacagcacatcagaacaagtgcgcaaagtgttcacaaaattggagtctttgttgctgtacatgcacagcaaattgagcaacaattggcgcatgcattggaattccgggctcatttcgatgccacaaagcaactgaaaagagaagcgaaatacgaacgaccaaacggcgacgacttctctttccggcacgcggaggctgtctccgctggagcgcgagatggcacgctttgggagcggaatgcgcgtgccgatggtggacgcgcgtttgcgaagcacaaaactgaagatgaacggacccgagttgtcggaggcaatggaagtgccgccggagaaagtggacagacgaagacccccggaggaagaacgttgagacatgcgcgaactggcacgagaactccacccgcacatggaggactctga

SEQ ID NO: 52133 - DNA, 1853 bp, Heterodera glycines; identical to SEQ ID NO: 21522
  Genomic contig location: Contig_ID=SeqID_21522; Location=1..1853; Strand=+
  SCN-specific regions: Sequence locations=1-511,533-776,798-1228,1251 -1853

SEQ ID NO: 52134 - DNA, 713 bp, Heterodera glycines
  Genomic contig location: Contig_ID=SeqID_21523; Location=232..944; Strand=+
  SCN-specific regions: Sequence locations=1-123,145-154,202-239,273 -377,404-535,557-558,585-713
atgaaagtgggcgaaattctccgcttggccaccaacggagacaacagtgatcccgccacacgaacctcaaatatcaatgccctttgtgtgcatctgcaaaaagtgctcaaattccatcaccgactttatcaggtggacaaatattttcaaatggaataattttagttttgaattttaaaataaaatttattttttaaaaatccattaatttggcttacggctaataatttgggagaggctaattttttaaatttaatttagaatttatttaacgggttttttatttttggaatattggttaataccaaacattggcacaattaaaaaatattccgaaaacaaaaaaaaccgccaaaaaataaacgctttattaaaaatacagttattttccccatttttcagaaacacatttcgccccacagtttcttccgtttgttgaacatgaaatactccgcctattatgtgactgttgtttacctcttcaccaagtgcctgttctttgtcaatgttgctgtccaattgaacgtgttaaatcggttggttttaatttggccatccatttttatttatttttaaatttttatggctcagtttcatttccatattcccaaccatgccgttgagggtcctcccgccctacttatcctatttttttcaaaattattgaatttttttatgttttgcccaaatttattgtccgtcatccatttaaa

SEQ ID NO: 52135 - DNA, 510 bp, Heterodera glycines
  Genomic contig location: Contig_ID=SeqID_21523; Location=1066..1575; Strand=-
  SCN-specific regions: Sequence locations=1-489
atgctggacgaaggcacttcatataaaagaatcagaacccgttttaaaaagctgaaaagcgacgaagaaatttcaaggtttttcggccttcccatccaattttataagcctttaataggatcagacactacatccagaaagggggcaccaaatatgaaaagttcgaaaaaatcgaacaacacgtgctggcagtttttgcagaggcaagaagcagacatgaagcaattcatgaccaggacctggtcaccattgccctcttaaaggcacgagaaattgattttgaatttaaggtatagccccccccccccctcaaggatgagactaccgtaacattactttaggcctccgcaaaatgggttctgaatttcaaaaagagaaacagaatagtttcgaggcgcgtgaccaaaattgtaccagctacttatgcagctgatgaagaagtgctcaataagcgtgcctcggaatgttcccttgtaaatttaatttaagaaatttgttggaaaaaataaa

SEQ ID NO: 52136 - DNA, 372 bp, Heterodera glycines
  Genomic contig location: Contig_ID=SeqID_3852; Location=10..381; Strand=+
  SCN-specific regions: Sequence locations=1-189,240-372
atgatgccattggcagtcgatgcatttgtggggggagatttaaatgtgaaaccacaattggaactggtgtaaaacagcagctggacagaacccatcatcactccctaatgagctcagcaatggaagcgatcaaaacagttaaccgggacttattcacatggggcaaagggaatggattaaaagtcgagctaatttttgattttttttttaattttatagttatttttttagattattttggtaaatgagaaggattgcgaccttgatcaattgttatggactgatacgagaaaaaatttggatgggttaagtgcaacattaaagtgttgtggaaggtttcggtgcaactcggctcggtaattgaaaattata

SEQ ID NO: 52137 - DNA, 820 bp, Heterodera glycines
  Genomic contig location: Contig_ID=SeqID_3852; Location=241..1060; Strand=-
  SCN-specific regions: Sequence locations=1-623,689-820
atttacatgtccttacattccatcctattgtttagaaaaatttaaaagttttcattgatccaatcggattaaagcatttggtcaaggaaatggaaaaatttatgctagaaagaaaagccacccaaaagaaaagtgatgatgatagtgcacaaacagactaatgatctaaaaactcttcacttcgtttcctcactctgatcaccattttgacttgtgatcagtcttttttcatctccgatcactttgctttgtcattgcgtgtaccggttttcgacttctgtttcctccattttgatcagttcgttctgtccgcctttgtcagttttggtcactccatctttttcctttttgtccaatgatttctgtacatctttcatcagtttgatcactttcagtttggcctcctcacatgggtccgttgctaccatttgtttttgagttttgtattccattaacaaaacgccaatatatctttcaagtttcagagaatttccttggtcgaattggcgcaataaaatttctttcaatgttacaaagtcttttttcaaagaataatccggttcattagtaacttttttctcgtgatcctttccaacattgcaaattgttgaccaattttcaggttttaaaatttttcaaaatttaataataaatcttagctttaaaaaaaagattttattataattttcaattaccgagccgagttgcaccgaaaccttccacaacactttaatgttgcacttaacccatccaaattttttctcgtatcagtccataacaattgatcaaggtcgcaatccttctcatttaccaaaataat

SEQ ID NO: 52138 - DNA, 1196 bp, Heterodera glycines
  Genomic contig location: Contig_ID=SeqID_3852; Location=633..1828; Strand=+
  SCN-specific regions: Sequence locations=1-573,597-600,632-737,761 -762,786-1109,1131-1196
atggtagcaacggacccatgtgaggaggccaaactgaaagtgatcaaactgatgaaagatgtacagaaatcattggacaaaaaggaaaaagatggagtgaccaaaactgacaaaggcggacagaacgaactgatcaaaatggaggaaacagaagtcgaaaaccggtacacgcaatgacaaagcaaagtgatcggagatgaaaaaagactgatcacaagtcaaaatggtgatcagagtgaggaaacgaagtgaagagtttttagatcattagtctgtttgtgcactatcatcatcacttttcttttgggtggcttttctttctagcataaatttttccatttccttgaccaaatgctttaatccgattggatcaatgaaaacttttaaatttttctaaacaataggatggaatgtaaggacatgtaaatgcgccgtaaatggtttagatcatgtggttgtttatgtaaaggaatgtttaattaagtgtcatttaggcattttgtcaaaagtttatcctttacaaaattcgacaaatttatatagaccgtttcgcccacccgtataaaaaccggtacaaattttttccttataaaaaatgcctttaaatttaaatcttattataaaattaattgtttgtcatcactatttttatcacttttttgccatttttcgtcattttttaattaattaacaattttggggtttgcgcaattaaaatccgcgctaaagttattaaccaaacatttttcttgatccggtatattgaaaaaataattgtttcccatgggttgaatcgtttgccggaactttctagaaataactaattttttttattttaaaagatcgctaaaagtgtaaataatgtatataatggccaaatatttatgaaatatttaaaaaaatcttccactaataattaaatctaatatgcaaaaaaaaaaaaatttctttgatttttcttacaaaattttctgagaaaagcggtgaataagcataaaattccataaaaagacgtaactagcttacattaagcttagagtttttaattgattttaatattttttttggaaaaacatcaacttttgaggtacatttttcattttttaatgcatactcgaaaattgaaaaagatttttgtcaatgaagacaaacaattttattattgttatatagtagagttgctcggtaatcggtaa

SEQ ID NO: 52139 - DNA, 1615 bp, Heterodera glycines
  Genomic contig location: Contig_ID=SeqID_21529; Location=52..1666; Strand=-
  SCN-specific regions: Sequence locations=1-753,780-968,997-1018,1055 -1615
atggccgaatcccaagtttatgcgccggcattgctccaagaaatgaatctttacgccgaaaatgcgcatgacgacggtttcacagcgaaaaaggtggaaatggccaaggaatttttttaccaacttttgatcgaaacgaaaatgccggacattgaagaatcaattcgcaacgcattctgtgtgttgtaccatttttttgaatgtatggtgttggaaaaacaattaatagtcaaagtgatgatggcacattgtgagcgggaagtaaatgtgaaaatggcaattgcaatgcaaagggatcggatgagggggaggacgatgcaatttgtagtgaacagcttggccagcccggaactgttgatggtgcagaggatcagacggacccaaggtagtgggtgggaggggaatggcccacagcggacagtagcgaattgtacccgagttatgccggtttttaaagggatatttgttagttggacctaattaagggccctatgacgaggtatattaaggagtgggccctaattaagtggcatttgcgagtttggcgcccctgttatgagggatatttatgagttgggcaagaggtatttcgggtctttgttctccttatgttccgagtgaataaatattttgaaggtggaagaacacggatttggaaattgttgtataactacgaccaaaagattgagcaaaatgaaaaagaaatggccaatttgtgggaaactttggaactttctgatgatattattatcggtaaataaataaaaacataaatttaagcttaaagcattttttggttttgaataaaatttgtactattgtttttttttttttttttgcttacgccaatcatttttctacggggtgacggaaagcaaaattttccattcgattcaaaaattcagaattaagttaccacttaaatgactaaagcagactaaaaaattacctaaatttcgcagcccactaaccattatttaactattttaaagtttattcaaaatgattatggaaaagcaaaaattattgaaaaaatttttaaatgaaatattttctgataatttaaatgcattttaagattatgaggacaaccagcagctgatttcccattatgagaatgttctgctgaacgacgacaggaacgaatttatccgaatggaaggcaaaatgaaagccgaaatttgcttatttatcagttggattaacggtcaatttttgctcacaaaatcattttcggcaaaagttttggaaaatgtgcaaatttatttaccattaagcgtaaaaatgttggatagtttttacgaccgattgtttgatcatcagcaaattgaagaattagaacaggacgagcaggagttggtggatctgatcatggcgatcagaagtcaaatagagcaaattgtggtgggccatcagccgatgaaaagcgaaacggaactgatcaaagagtggcgaagacggaactttgccggagtgaagcgcagcaaaaagccgcaacaaattgcgaaggcaaagcattgtgccgaatatggggcatggatgaggcaaatgcatggccaaacactgatcaaactgatcaaaacggacgagcaatttgcgcagaaactgaaaaacg

SEQ ID NO: 52140 - DNA, 1410 bp, Heterodera glycines
  Genomic contig location: Contig_ID=SeqID_21530; Location=1300..2709; Strand=+
  SCN-specific regions: Sequence locations=1-61,84-238,261-262,284 -342,364-646,672-917,939-993,1015-1281,1386-1410
atgccaaaaactgaaaaggacgacggattgggtcggcacgaaatgtgcgaagaacgaaaagccattggccgagtggcgtcggcaaacagtgcgtcggagggggaatatgcggacgcggtggacgacgaccccgacttttttaagtacgacaaacggagaaataaccgaagggaaaggggccgaatcggacaaatttgaattcagccgaaaagcgaaagcccaccttttagggcggggaaaaagaggagaatgctgaaaaagttggctaattttcttaaaaaatttactatataaattcttagtttttccctgcggcgcctttcggcaccgccggacccaaaaatccaacaaaatattaaattccaaaattagcatggcgaatctactcagaatagaggtagagtctacaaaattccctggcggtgccataagctttattttttttaacaaaatggcgcaaaaccgaaaaaattggttattttttgacaaaatctgttaataaatttcattttaattttcaaaatttttcccagcggcgcttaacgacgccccaacgtatgatgctcatattggaagcaataaaacttgtgttaatttaatctaataaattgaaatacttggattttccgcggtaattgcccaatgtaccccctttttgaaaaaaccctaaaattgtctgtgaaattttcagggttttccagggtcactgatcaaaaacgagtatacatttcgctcaacttatcatcctgggccccaaattgaacctaaaaggggaaagcctagctgaacactttaaaatttggtcattttacttccaatcaatcgatcgtcggttttccccaattccgcttcttaatgccatcatccgatccgatcaattttcaaattttcatagccaaactctcaaaacccttttcagcacttttattttatcacagaatgagcagcaaaacgaatgggactaaagtgtgttctgcggttgcggactcaaaatttgtgagattatttttgattacgaatttggcacttcccccccccccgccatatttttattacgaatcttctctcctttcccctcccactttcaatcatcatttttttcatttacctataccccttttatctaaagttttttaattttcgcaatttctcaattcctcccttttttctagagtagagcgggaccgggaattttgtgcaaaaccgggacttgccgggacctgagaagtcgggaccgggacctcgatttttgttcgggaccgggaaccgggaccaaccgggaatttttaaaaattcaaaaaattaaaaaaaaatcaaattttaatttatttcaagtgaaaatattaaataattaaatttttattttggtttttattttataaaatccaaaagttaaagctatttaaatta

SEQ ID NO: 52141 - DNA, 801 bp, Heterodera glycines
  Genomic contig location: Contig_ID=SeqID_21531; Location=390..1190; Strand=+
  SCN-specific regions: Sequence locations=1-801
atggacaagaaaataaacaaaatatacaccgacccggccaatccgggcgggtatgcgggtgcgagtgccctgtacgcggcggtgaagaagaagcacccgaagttgaagcgtaccgagtttgaagactttttgaagaggaacaccacctacacgctgttcaagccaaagagggagaagttccgacgcctacgcactgtgcctacgggtttcatgaccggtaagttgtactggggcttatttcgcacaattcagggttcagatgttcaggcggacttggcagatttccaggcactttcgcgcaagaacagcggctaccggtacctgctgttggcggtggatgttctatcgaggcgaatgttcggcgcgcccgtaaagagtaagcgcccagtggacatgaaaagggcttttgaagagctatttgagcaaatgccaagggtgccagacacaatgtacaccgatcgagggctggagtttgtggcaaaaccgttgaaggagttttacgcggagaagggcattcaaaagtttgagaccagttcaaagaaaaaggccgccgtggcggagcgtgccatccgcaccctaaagactcggctgtacaaatatttttccgccaacaatacgtcggtgtgggtggatgtactgccaaagtttttgagtgccatcaacaactcggtgtcccgcgcgaccggacttagaccccaacgaaatcagcgacaccaatgcgagggaggtctgggaagaggggtgtacggcgaagggctcgcacaattggaacagacaccaaaaatcaaagcaggggaaacg

SEQ ID NO: 52142 - DNA, 552 bp, Heterodera glycines
  Genomic contig location: Contig_ID=SeqID_21532; Location=289..840; Strand=+
  SCN-specific regions: Sequence locations=1-112,134-462,484-552
cttttgtggatgaaattgtcggcactgcgttgctcctcttttttgtcaatgcgctgatcgatccgcgaaatcaagtgccaaaatgggtgcatccgatcggctttgggctggcaatctttctgatcacttcctcctttggcatggtgcgtttgactttggcacgatcattctctcactcatccattggcattttccgcttgacagaatgtcggctctccgatcaatccggcacgtgactttggtcctcggctctttcttctatttgccggctacggatgggaagctattgcgtccgttgttgtttatcccttattaaataatgccaaatgcttcctttctccatttttttttggcattttcaggtggcactcttattacttttggattcccatcattgccccatttgttggcgctctgatcggcacttggctttaccaatgtatgattggccttcatgtgccggacgatgaagctgcacagtcggtgccaacaaaaacaggcgaaaagtcaaatgattttgagtttgatccgctgaatgggccctctgactga

SEQ ID NO: 52143 - DNA, 1223 bp, Heterodera glycines
  Genomic contig location: Contig_ID=SeqID_21535; Location=40..1262; Strand=-
  SCN-specific regions: Sequence locations=1-51,73-770,793-855,878 -1168,1190-1223
atgatgccgacgagggtattcaccgaccaccgcgctttgataccgatgtttaaaagtaaaaaagagactgggaatagccgcgtggataaatggctaatggaaatgaatgctaaatttctgttacaagttgagtaccatccggggaagaaaaatgttattgccgacgttttgtcgcgttcccaggcattaaaatgtccagaagcaccgaaggaatcggacaaaatcgtcgctttccaaatccgacaaaatgaggatggtcaaaaacagcacggaatcgagaaccatcgcgaatgggcgaccaaaacgagagaaagcgaactcggctttttgtacgaatttttgacagaaaaaacgctgccaattgagcctaaagatcgccaaaaactcatgtctatccttaacaatttcactgttttggacgacctcctctataagtgtgaaaaagatggtaaaagtcgtcttttcgtcccgtccgtataccgcgaaaaactgatcaacgagcgacactcaggaatttgttcaggccatatgagcgggaagaaaatttttctccaattggctgagaaatatttttggcctaacatgtattccgactgtgttagagcagctcttcgatgccgaatttgtgctcacacccgaaatccgaggtctaacgagccaccaatgaaaattgttgcaacatccgaaccatttgaattggtttgcctcgacattttgtctatcggacccgcgcattcgtcatgcaaatacatattagtcgcggttgaccacttttcaaaatacctggtagcaacaccaatcccaaacaaaaacgcagacacaattgcacgcgaatttgtaaaaaattttgtcttaatttttgggacaccaaagaagattcacagtgatcgcggaaaagagtttgtgaatgaaactcttaacgaaattaccaaaattctgcaaatggaaaagaccctcacttcgggatatgacccacaagcgaacggcgtaactgaaagagtgaatcagacgattttgggaatgctaaaacggtcaactgcgtcaaattgggagtgggatgaccgtcttccatttgttgtgttttcatacaatacaactccgtcagaaacgaccaacatttccccataccatcttttgtttggaaaaccggcaaattttccttcaaacatttccttaccagttaatccgttgtacacaattgatgtgaatggatacattcaaag

SEQ ID NO: 52144 - DNA, 2148 bp, Heterodera glycines
  Genomic contig location: Contig_ID=SeqID_21538; Location=1..2148; Strand=-
  SCN-specific regions: Sequence locations=1-1,95-531,553-1179,1278 -1288,1310-1499,1521-1546,1580-1668,1690-1959,1982-2087,2109-2148
cctctctcttcctctgtttctctctccctcttctcctctcttaaggtctctctcgccctcgctctctctctctctttttctctttctctctctcgtactccgcactctcaggccgctttcccttcccttacactctctctgacttattccctttctgtggctcagaatcgcacattttggccaatgctcaggagcaaattcagcacttggaattttcgctgggcaccggcggtaaaggaatggagagggaattggccagccatcggttggacgacaatgtcgccacggaactgaaacttgtgctggccgccggcctctacccgcagttcggcgtcgtggacccgaccaacaatttccgagtgcgacgagtagcgaatggttacccaatagggcgtacggcccattggaacagtttctgctcatcaaaatgcaaaaaaatttgcccttccggtttccctaattccatgaatctgtctattgtattgatggctttttccaatccctgaaatttagggagtaccccccccccatttctcacttttcccattctttaggagggtcacgaccaattcgcgcacacgccctccaagccgttcggggggctgcacccgaacagtgcgcttggccaacggcccgaagtgctgcgatcggacgatttggactcggagggccattccgcgcagcaccaactcatctactttggccttctgttggagacgacgaagccgtacttgtgcaattcgtgccgcatccccgcctcctttttgttggtcatcgccagaaatgtgcgaccgttttcccgttgtttataaaatgccatgctttttcgggattttctctcctaatcaaaaagaggaaagggggagggacggcgtttgggtccttcgttatgcttttcttccaatttcgtctgatcaatgcttttcttgctcatctgtcagatcacttgcgtctctccgtctgtgctctgttgcgacggttttgtcgagtttcactttgtgaaggcgcgccattgcgacgattcgctggcattcgcctgtcgcgtgcgttcgctgtttctgcagtcgcttgagcataaattgcgcagcgacgactacggcgactgtcgcgagttggagcggctgatcatcaaattcgcacgcctccaacatcccttcaggcattgttttagatcaacaaagacagagagatggagagagagcgagggaaaaatatataaagcaagagaatggtgagagagcgagggacagagagagagaggagagatagagagagagtaacaaaaatatttctcacccttttaacacagtatccgaagacgaatagacccacccaggagcatggagtacggtgtgttcaccgccgatggaatgccgcacccgctctccgcctccgttgtgccgaccgccgatggccatggcattttggacgctgtggcggaagacgaagaagtaaacaattggaattgcttggacgcaacggagggagaatgctaattataatccaatttaaaaaggacagcggaattggacgaacaattggacaggcgaaaggcggaggaggaggagcagcagcgggcgaagggacgcgagtatttttgcgacatttgcggacggacactttggtttgcggacaatgtgcaggcgatcaaacacaaaaagggacaccagcaaaaggaggaggagaagccgaagcaggacgaagacggagaaagaacagatggatgaccaatagacacaccgtttcaaaaaacgagagatgaaccaataaatagggagtgcacagaaaaaaaaacattcttattttggcgtactatttctttgtctctgataatagagaaaaatcgaattaacaccgatagagaaaaaaattctgcatcgatttctatgtttgatttctttagaagcttctcctcatcaagagctttcgaatgataccaagtttatacactttggttgtcaaaaaacattcaaaaataatttccgaaaatcgtacttttttcattttttggacaaaagtaaataaaaagtattcatgttgaacaacggactcgaacctccaccctttgtccctttactatcttacaaaaccacctccacacatgcaaatctttttggaactggaaggccaaaattgaaacggtgtgta

SEQ ID NO: 52145 - DNA, 1020 bp, Heterodera glycines
  Genomic contig location: Contig_ID=SeqID_34; Location=337..1356; Strand=-
  SCN-specific regions: Sequence locations=1-68,90-1020
atgacacatgtgtttttcgatcccgagtcggtcgattggtcatcttttttcacttcacaacatgggaggggacagaaacaatactttgtcggaagcaagtatcaacggggattcggtttactcggtaatgtggcacgtttcttgacccatattgcgaggaatattgcctcgagtgcaggacaggaggggctcgccgctgggcagagagttctgagtgacatcgcccagggtcgtaatttaagggatgccgtcagggaacattcaagacaggggtttactaaccttaccgataagttacaacaatgtggtaaaggaaaaaggtctctgatcactaataagaaccggaaacaagtatatgatcagttaagtttgatctaaaggtataaatggaataaataatacaaaaagttaaaaatgacaactctcaagaaagtcgacacggcgagtgaggacggtctcgaggggggcctttcccttttcgacatccctccgacgaacgttgcaattaataaatccagtattcgggaattgctgccactttcagcaataaatcaatctggaccgtatatctttagacttttttcagataatcagttttgtgacctcaataaaacttttctctatttgtcaacatcaatagagagaaaagacaaaagcaattggattccaattaccacggacagtgaagctgatcaacacgtcggtgtcattcaaaattttgggcacagctttgtcaaaacattaaaggtgtcaatttccggtgtcgaatcttatgattccggtatttactatgcggttagggcatatatgatgactgaattgggattttcagaagatgtcaaaaagggtctatgtgaagcgtcctgctattacgtcgatgatgtcgaccagaatgattatacaaacagtggctttaaaaacagagcgtcacgttttgctgatggtgcaaaatgtgaaacaatgatgaaacttaattttgatctcgcccgtcagcccaatctattgcttaataactcggat

SEQ ID NO: 52146 - DNA, 809 bp, Heterodera glycines
  Genomic contig location: Contig_ID=SeqID_34; Location=1985..2793; Strand=-
  SCN-specific regions: Sequence locations=1-809
aaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgattgaggcttttgatcgggtgttcgaaaagtcgaaaattatcccgatgaaaatatatagcgacagcggactcgagtttcaggctggaaaaatgaaaaaatattttgaggaaaaatttattatcaaaaatgtgatgtatagtcctgaccttcacgccggagtcgttgaaagggcaaatcggacaataaaggagcgcttgtacagatattttacaaagatggacactctacgatgggtcgatgtaatagacaaaataataataaacattaacaacagtgtgaataggacattgggggccaagccagtatccgtaacttttgaaaatgcccggccgctctgggaaaaattatataaggcgaaggaatttaaaatttcgaaaaagaacaaatttaaaattggcgatatcgttcgaattaccaaggaaaaaggaaaatttgcaaaggggtatctcccaaactttaccgaagaattatttaaaatcgttattgttaatccaacgacacccgattcatacaggatcgaagatttggaaggaaatttaataaaaggcatattttataaccaggaattagtgaaaacagatggatga

SEQ ID NO: 52147 - DNA, 1260 bp, Heterodera glycines
  Genomic contig location: Contig_ID=SeqID_35; Location=161..1420; Strand=+
  SCN-specific regions: Sequence locations=1-293,316-575,601-656,678 -724,746-872,894-1093,1126-1260
atgggcgttcgctcttgccgttttaatgtcccgaccatagagactctgggttacaaaaattacgcttacgttccaattatgggagcccctggtaaagagtagatcgaggaaagtattctgcatattaagcattaaatcgtcaagtattaacaaaagggggttttcctgttctttaatcttattcatgtccggaatcccgttaaaagtctcaacgccctccccgattaatcctaaaatactatcattcatctcaccataacaataaagaattttttcagccgatggttcaattagattcttatgatgttttaaaaaccgtaatagccaacgggtcttaccactcccagtagcccccgagagaattagagtgaacggacgtgaaacatttttaatgcatcttatttatttgactatttatattttcatagggaacatgtttcgcacatttggggcataaccagaaattatcaaaaaatgatgtaccgaaatgcaaaagactgtgttttttacatctgttacacatctcgtaatgacaggggcagtaatgacaacacttaattttatgtggacagttcatttttcaatttaattttatttttggttgctatttatagaaggggtatataaagggagtgaaaggaccatttgattggtacattgtatcaaaaatgcaaaaaccgataatcgtaaatataattgctctcgctaatgagtactccgggattatttctctaaaatttttctttaacaaaaacgacaattattgggtattttatttatatcactttttagccctttctttcttctatcgaatgcattttgtttcagaaaaaaatatttgtctttttaacaaagacattgttgttaaatataggtgccaaagtggggaaaagcacattttttgacccccatgttacaattggtcaaaattggcacttcaagtttaaaatgtgtaaaaccgaacggactaattacgaactgttaatttgaaatagtgaaagtaaattttgttcatgattaagcatatcttcaaaatatttttttatatctaaaattaagagaaacgttctgatgagtccaaattttgcattgcatttaaaacaaaaatttttataaatattttttcccgaaattgtccgcaaatgtctggacgcgggcggaggagaagaaaaaaaaacatttttatactaaaatattagcgtagcaattaacgacggcttctgacagcaacaaaacaacaaagcagatcctgtgatttta

SEQ ID NO: 52148 - DNA, 3937 bp, Heterodera glycines
  Genomic contig location: Contig_ID=SeqID_35; Location=3413..7349; Strand=-
  SCN-specific regions: Sequence locations=1-358,381-1352,1385 -1584,1606-1732,1754-1858,1880-1955,1987-2015,2051-2451,2473 -2936,2960-3044,3066-3297,3319-3937
atgacacatgtgtttttcgatcccgagtcggtcgattggtcatcttttatcactccccaacatggaagaggacagaaacaatattttgtcggaagcaagtatcaacggggattcgggttccttggtaatgtggcacgtttcttgacccctattgcgaggaatattgcctcgagtgcaggacatgaggggctcgccgctgggcagagagttctgagtgacatcgcccatggtcgtgatttaagggatgccgtcagggaacattcaagacaggggttgactaaccttaccgacaagttacaacaatgtgggaaaggaaaaaggtctctgatcactaataagaaccggaaacaagtatatgatcagttaagtttcatctaaaggtataaatggaataaataatacaaaaaagttaaaaatgacaactctcaagaaaatcgacacggcgagtgaggacggtctcgaggggggcctttcacttttcgacatccctccgacgaacgttgcaattaataaatccagtattcgggaattgctgccactttcagcaataaatcaatctggaccgtatatctttagacatttttcagataatcagttttgtgatctcaataaaacttttctttatttgtcaacttcaattgagagaaaagacaaaagcaattggattccgattaccacggacagtgaagctgatcaacacgtcggtgtcattcaaaattttgggcacagctttgtcaaaacattaaaggtgtcaatttccggtgtcgaatcttatgattccggtatttactatgcggttagggcatatatgatgactgaattgggattttcagaagatgtcaaaaagggtctatgtgaagcgtcctgctaaaacgtcgatgatgtcgactttttcagaatgattatacatacagtggttttagtatttgtctaatcgtgaagtaatagcttataaaaagtttctaaatacattaagctttcgaatgatatcaaaaatgttggatttggatgacatagaaaaaagttatagaaacttatagtggaaaaacatgctggcgcccaatttttaaaatttagcctcattgtcctatcaaaaaaccacaaaatgaggctaaagcctcagatctggcacctctggttttgtaccagtagcaggggctaggacagagataggaccaaaaaaattgatgcgaagaacggtagagattgctgtttattaaaatcacaggatctgctttgttgttttgttgctgtcagaagccgtcgttaattgctacgctaatattttagtataaaaatgtttttttttcttctcctccgcccgcgtccagacatttgcggacaatttcgggaaaaaatatttataaaaatttttgttttaaatgcaatgcaaaatttggactcatcagaacgtttctcttaattttagatataaaaaaatattttgaagatatgcttaatcatgaacaaaatttactttcactatttcaaattaacagttcgtaattagtccgttcggttttacacattttaaacttgaagtgccaattttgaccaattgtaacatgggggtcaaaaaatgtgcttttccccactttggcacctatatttaacaacaatgtctttgttaaaaagacaaatatttttttctgaaacaaaatgcattcgatagaagaaagaaagggctaaaaagtgatataaataaaatacccaataattgtcgtttttgttaaagaaaaattttagagaaataatcccggagtactcatttttatcaatttggaggtccatattcaaaaatcaatagctgcacgaaatcccgatttccaatatcagattcctgtaatttttgtgccatggaatttcggttttcctttccgaaaattttttaaggaacagcatctcactttggccagttaaattaattctttaaagtgtaaaaataaaatatgatacctttaaaagccaaaaataaatttttatttagttttgcagtcgccattccatgttttgagatttttttaaaaattttttaagaatatatttttttccccgaaattgtccgcaaatgtccgtccgcaaatgtctgtcacatttctggtaattttgttgctgcaaatgtcttcaagaatttctaaaatgaattagaaaatttgatatatgtagggctgggatttttaggtttttacctatttttttgcggcttaattatgacgagataagcccaaaaatagcattttcttcgaaaatttttgatttagagcgacttataaaaacctaaaaacacctaaaacgagggtttcgagtgaatagcacctattttggcatttttcgagttttagcacctattttggcctttttccagaaatttcatagcaaaaatgcaataaaaacgaaaaatgcaccccaagaatcgatctaaaaaatttcaaaaaacataaatatacttggtttttccaatttttaatacctattttcgcacctattttggcctttttgggggtttttagcacctattttgcacttttttagcacctattttagtacctttttaggattttagccagggttcgcagatgaaaattttttcatttaaaaaaattcataattttgtggattttcgaaaaaattgtaattttctggctaaatttgggtgagatttccgtttgatactctattaaaaaccaaaattcaaattaaataattgacaaacattatgccaatttatcaaaatttaaaagattctgaggattttccccaaaagcctcaaaaatcctcaaaatttctcaaaaagccacaaaaatcctcaaatcctcattttccaaaaaaatcctcattgacctatcaaaaagccacaaaatgaggataaatcctcagatctgcgaaccctgtttttagcacctaaaaatcccagccctagatatatgtaaaagatacacataataattaaaacagaaaaaagttttgaataaaacacattttacgtctctacactttttgttgtcgctcgatttgcttattgtttaggaaagaattttcaaaacaattatctatttattctgattgtgtcaccaattacctaattgtaaaacggcaaagcgtcctaattgcagcaaaaaatgaatagacggtaaggaaattttgataaatttcaaaattttccattttttcctaatttttccatgtttttaagttggatgtgcggcgacatttggatgaatattctgcccttctttgactatgctaaactcggcctcaaaatagcattgctttctgacttttacgatgttttggtggacatgcattttgatggcaaaaaggaagttacgctttggcgatgtatcaaaattggcaaggacgaaggaccaaagcacaaactgtctgtacagcagatcgatggcacatttgtggaatttccgataccagaccatccgtttcccaacaaaattcgttttcgtttccttctgattgagtaatttttaactttgtgtattttaaggcttgtgtattttaataaatttcttcaggtacattgaccattccgtcattacatttctccgttcgaacaagcaaatttgggacagaattggcaccaaattggagttcaatatgaagaatatatacaattcatcatgtttttgccattgaaatttggccaatttttgctaccaacattcgccacttgtgctttgaggatggcgatcatttgaacaaattgcgttatcacacttcgccgacacttctcaccgatcttgatcaattgaattcaatcgattctggttatctattccccgatgaaaatgctccgaattcaactgctggtcaagcgttggccaaatggttgcgaactccgacaaaaaatggtcaaccgaaggaattgcgttgctcgcattttgcttttatgaaaataaacaattggttccacaatcacaagcag

SEQ ID NO: 52149 - DNA, 640 bp, Heterodera glycines
  Genomic contig location: Contig_ID=SeqID_35; Location=2077..2716; Strand=+
  SCN-specific regions: Sequence locations=1-62,84-151,174-247,269 -305,327-534,557-559,581-584,606-640
tttttggttgctatttatagaaggggtatataaagggagtgaaaggaccatttgattggtacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtttggggacgaaaagtctgatagactgtgaaaatgctattaaaaaatttatagaaataattaagggctcggggtgtccggggcttcttacaccggacacacggttgaaaatattgtttcgacctttaaattcggacgtgaaattgaactgaacgagtttcgaaaaaatcgtcgtgcattttatgaaccagaaatattttgcggtttaaatttcaagcggggtaaaagcatgacagcgttaattttctggaccggtaaagtcgtaattacgggaactaaaaacaattctgaaatagaggaaatgtatcatcatattctcccctatttgaaaatggctcaaaagaagttagggagacgataaaaatttttcatttattgg

SEQ ID NO: 52150 - DNA, 3991 bp, Heterodera glycines
  Genomic contig location: Contig_ID=SeqID_423; Location=115..4105; Strand=-
  SCN-specific regions: Sequence locations=1-74,99-637,677-890,913 -1663,1716-2246,2286-3120,3142-3403,3425-3991
atgagcaatcgatcaaacaatgaacctagcccaccgaagcgccgaagaatgccaaacatcctcaaaagtggaagcaacaacaacaacaacaacaacaatggcaaaagacgcaattttcggcactatgtacgcgcgctgaacaccgacgtagcgttcaacaaaaaattcagactaatgaatgctaaaagtacattcatgatccagactctaccatcaaatcctgagtcgcttttgcgagtcatttttggacattgcatacaatcgtcattagatgaagctcagagacgtggaattgaaccgagtcgacttggggcaacaattacttcacagttattggaccctgacatttggattccgatccgtcagataactccaaacacagtggacacaattttgaatcgcttcttagatgtggcacaatcaaagtcgcgggaaggttcactgtggggtgcacccttcagtgtaatagtaaccactctggacactgtcaatctaccgcagcgggacacaattactggtcgcggatccgaacaccgaacgctaaaaggagcgcatcacatcataaaagagaaaaatctgctgaggattcgtaataataataattcctattgcctattctacgcgttggagatcagcagaatctatcactgcatggtgatgccaaaacaaactttcagtaattatattaacaaaatgcattcacaacaacaacaagacgctgagcgcctaatgctcgatgcaggaattccactaaaccaagaaaggtatgacgccgaagtgtgggtaccacgtgtagtggaccattggaacgcagtatacccggagctaaaatttaaagtattcatcttcggcacaacgggtcagtacagacctaaatataaatatggaccagaagaattcctgacaccaatatcgctctattacaacaacgatcattttgatggcatccgttgtggagttggaacagcaatttttggtcgcgactactactgctttgcatgcgaattgccctttaaaaatgcggacactcacaaaagttcatgcattctgaattgtaaggaatgtggtcgaattggtgcggggcggccatgcagggatgatggatttaagtgtgagtgcgtgggatgtgacaaaacattcatgaacgttgactgttaccatcatcacttgtcgagcaacttttgccacaaatcgcataaatgtaaaaaatgtggggtgatatggaacgtgagaaataacaaagggaagggacgagctgggcatgtgtgcgacgagcgcttttgcagaacatgtggtgcctttcataaccgtgaacgtggatgctttattcggcaactcaaaccgcggcgccctaaaacttatcgattggtagtatacgattgtgagacaacgcagaattgtcatgtaatcggtgcgccagaggctcagcaacggcgggtacacatagtgaactttgtgtccgcattcgttacttgtacaaaatgcattcaaattggcgcatggcgcaactccctgctgaatgtagttccctcgtgtgaaatatgtggcccatatcgcaccctaactttctctcatcgacccttcacaggaacagaagtggattttcaacatgtatgcgatgatcctatgtcggcgttcactgactggttgctcttaggatcgcataacaacagaaacaacaacaccatcaataacaacaatgaaagcaacagtaaaataaaaccacacattaaatatcctattaatgtattcgcacattttggtggtcggttcgacaatgtgattctgttccgacaatttttcaacaggggactgtgtccgaaaatgatcagacggggtaataaactttatgagatgaaggtgctgcgcgctaaagacaatccggagattaaagtgcgcgacagttggaacctaatgcctgttccgttaggagcgcttcccggtgcatttggactcagagtgcaggacaaagaatttttccctcatttggccaatgtggaagacaactatgacagagtgctgccctcgctaccgcctcgggaacagtacctatatggaggaatgattccggagcgacagcgacgattcgatgagtggtacgcagcgcaccagcacgaacctttcaatttgtgcgagcaattggcatcatactgtgtaaatgacagtcgcatacttattgaggcgctagtcgccttcagaaccgaatttttgatggtcacgaacccggatgaacaacaccgtctgacggaggatgaaggagaggtagaggaggaggaagaggaagacgctggaggaattgagcttggagatgacggaaacggagggatcgacatcacttgggacgcgctgaccattgcgagcgcatcaatgaaacacttccgcctcaatcatttacggagtgatcagctcgcaatcgtcccagagagcggatatgacacggcaaacaatcagagcttgctcgcgctcaaattcatggaatggtacgcagaggagaatgggctgcaaattcagaccgcccattcctcgggcggagagcaccgcattggccgctatacagtggacggttatatacatgagacggatagcgtaattgaggtgaacgggtgctgctggcatgcgcatgaccaccaacgacaccgatttaaagctgacactgtaatgccgagcggaaagacagctgctagaattcgggaggacgatgcgcgaagaatggctttcattcgctcacaaattcgtggaactgttagtatattctgggaatgtgatattgaggaacggctaagacgggaacccgacatgcggcaggcgttctcttcctatcgaaacagcggacctattaatctaagggattgctatcatggtggtcgagttggtccgcaacgccttcactatcaggtcccggaagggtggcgtatgcgatactttgacgtccgttcactttatccgtacactaatgccataacggaatacccgactggtcacccccgctgtgtggacatcatggagggtgcgaaccgcgcagtggactggcgacatccagaacagattccggttcgcggtattctaaaggtatttgtggtaccaccacgacaagtggatgtgccagttctaccggttaaatttgatcagcgtttgctgttcccactttgcggaacatgcgcacgccttcatccagagggaggcgtctccgcttcttatcgatgcacgcacagcgatgagcagcgcggttgggtttctacggttacatcgatcgaactggcagaggcattacgcaatgggtaccgctgcaccgcctattatcgatccatagaatggacacaggaacaatggagtgagcgtgtttttcgcggttacgttgcagaatttatgacaatgaaaacacatgctagcgggtttccggaagaggtgggaaatggggaggaggaacgcgaaaaattcatcacagagtgtgaggagcgctttggtatggtcattgacccggcgcgcatgcaacacaataaggcgaagcggactatagccaagctatgcaacaattccctttggggacggttctcactacgtaacggtctatcaaagactgtggttactgattcgccatcagaactacgtgcgtacctcgacaatcctcagctggaagttagctctgtggacccattaaatgaacagtgtgtgctgattacatacaccgctaaaaaggaatggaccgatgagcacgattgctccaacattgttctctccttatggacaacatcggcagcacgcctccatcttctaaaattgatgcaacgagttgtgcgtgcagaaaacacagagctgatatacacagacacggacagtgtctgttttgcccatcgggaagaggacgggtgtccgctggatattggaccccaccttggagacttgtcagatgaatggccggataatgagctgctcgaattcgtgtcaggggggtgtaaacaatatgcactgagaatgcgccaccgtcaaactg

SEQ ID NO: 52151 - DNA, 1454 bp, Heterodera glycines
  Genomic contig location: Contig_ID=SeqID_424; Location=6244..7697; Strand=+
  SCN-specific regions: Sequence locations=1-56,79-93,116-138,165 -258,323-410,433-465,488-739,761-782,804-885,920-1200,1225-1226,1248 -1454
atgccggacccggtgcaaaatgggatggccaacagacagcagcaatacagtaagagttttgggaaattttcaaaacttacagtaagaaaattgggaaatttattttgccaaaaattttcatgctcaacttttttttttgaatgttttaaaactctcttctattcatttttgttttattcactatttaaattatatgccaaaacattttcacaattttatgtgattttgctgagttttgagtcatttcagatgcataggaaattatattgaattaaataaaaaatatttttgtttttatttatttgtttattttataatttttcagagtctaagcccattcggtcggcgcgtggaggtcttgcatcggtgcaacaaagttttgacaaaagtgcatcgccaaatggtcgacaacaaactgggccattgggagcaattcagttagcggtaagtaaaaagattatggcacaaaattggtagttttttataatgtcatcgcttaaggtgcataaatttcgggctaagtgggcgggggaggatttttggataattgggttcgggctaactgatttttttattccaatttgttaatagatttacaccgaagagcaccaattttatgggttcatagagtatcttactttaaaaattaacgaaatttgaggcctgatattgcttgaatgaaaagcagaagaaggaaataagcctcgcagacgctttaaaatttgtaaaataatttgcatctaaaatatttgtttggtttgaagttagtcttcgcttaaattttgcttaattaaaacaaattgggttttgtttaagccccataaacaacggcgccttccgccggtgccgtccgctgcgccgcaacagcaagcagtgattgtgccgcaacaacaacagcataacaacaataacagcaacatcatgcatatcatcatccacgagtacagctcggccgactgtgtgcttcgtccgggcgaccgtgtggtggtggtggacaacggtgacccggactggaagcatggcttcaaggtggggaattgtcgggtgctggtccaatcgaagggccccgtttttggataaatttcattcaaacatttttttagaaaaaacaggagagttaaaagcagaaaataccaattgcttccactcctctcgtaaaaaataattgtcaatttttggaaatattcattaagataaaccaaattattaaaattaattaaaattctaacaaacaaaatccactaaaataattgaaactttttatagaaatgaatgttatttaattaaagaaattaagtaagaatttttttaaatttcagtttaatgattgtctggagcatttgctgacattcccgagcagttgtgtggctgcctatcacatggaggaacagccgatgaaactgttgcaaagctgcaatttggtggagcaaaaaattcgtctctacagggaccag

SEQ ID NO: 52152 - DNA, 1996 bp, Heterodera glycines
  Genomic contig location: Contig_ID=SeqID_424; Location=2391..4386; Strand=-
  SCN-specific regions: Sequence locations=1-882,904-1082,1105 -1477,1499-1505,1527-1996
atggctgatgactctaacaacaactacttctttgttgtattgcctagcaatgttactgattacgtggacaacaccacgtcaaaatatcgtgtgcacctaccgaaaccagttcaattccgtggctcatgggtctgtggactgtactcaatacagtaccctcactcatgggcttctacaatcggaactgtggaggatcaatggattgacattcattacattgatggaagattgctacgtcttcatctaccaaaatcatcacaacagaacacagaaggactacagcgccatttgaacggtacactaacgaccgctctaagccgcaaaagcactgaagatggtcaaactccttccattaaacggtccaaaagaagcgtggatcaaggaaaacagcaatcacgcgaagagacggaaaaagaaagcaaaactggtactatggagataaatgatgaaggcgaaagagtaccacaagataaccgtggagtagagtataaagattgggaagctgaccaaatgcaagcggattacaccaattgcacctgaggaagaacagaatcaagagagtagcagtaaggacctacataaagatgacgattcatctaatgatgaaggtgaaagagtgcatcaagacaataatgcggtagagtgccgtaagataggaaggctgaccaagtgtaagcgcataaagccgattgttacggaaaacgataataaaaatgatggcaaagatggagaagcagtcatagatacaaaaacatcagcatctgatacaacattgaaaaattcagaaataacacccccatcaaacccctcagcacaacgacaacaacaacacgatgaacctcgagcccaagctcttacacgtggcgaacagctggggcagcgattaagaaaaactgaaaatgaagttcaatctcaacaaaaatcaccagtaaacgaatcattggaagctcagactcagttcagtgatgctaaggaccaatcgaaaacgcacgcagatgtgttaaaagaccgtctttctacaatacacggagatgtaagcatacaagccccactgcaaaaatcctcctcaaacgatggtcaaacatcaatagaacccacaataaggccaaaggagcaaagtgacagagaaccacagtccgcaaggacgcatggagagcagcttcgttcacgtgtggaagtggtacaagatgaaagaatgcaaaacgaaaggcagctgcatgaagcgaagacccacggggatttgctacgtgaggaattaaagaagatacgtcaggaaggcgagaaaagagaacaagagctaagtgtgaccaaaacgaaaggggatacgctgagggctcagatagaaaaaatacgcgaggaaagcgggcaaaaggacaagcaactaaaggtagagaagacacacggggatgcattggccaagttattggaagaaagtcgaaaaaaaatggaagagacggagaaacgattgacagaggcgaggacacatggaaaagtgctgaccgatagaataaaagaaatacaaaatgagcgtacagcgctgtccgctcctgctgacgtccactttaactataggactgacattgatcgtttccatctgatgatctccgacccggaaatcgactatttgagcatgagctcacagattgcctatgtgctagggtttccgaacaaggaacgcgtggtgcagggcgagaccgcgaaatatggggtggacctacgtgggggttttactagctttgccgtttatgccacgggacttacacgcagtgtgattttggggaattcgctaagctcgctcctccgcattgtatctaccgagggcgagtatggacaggtggtggagcgtatttatgataatccgatgttcatccctgtacacccaagagagatcaacgaacttcaagtcgaattacgtatgatgaatggacaactggttcaattcgattatggtaccgtacttgtgacgcttgtatttaaaaaagtgatcaacttttga

SEQ ID NO: 52153 - DNA, 2865 bp, Heterodera glycines
  Genomic contig location: Contig_ID=SeqID_3853; Location=1385..4249; Strand=-
  SCN-specific regions: Sequence locations=1-90,112-250,272-329,351 -917,942-1815,1837-2456,2478-2574,2596-2865
atgtcaggcgagggatctgacttcaacccagcttttttcacggtggaggaaaatgctcaataccaaaccattctcgagcgtttgcgttcttttgaagctgcagtttgcagccaatttcgaaagcttgaaagttctctgaatggaagtgaacgagccacaaaggaccaattgagccgtctcgagtcatcgctacaaaatttggacgagaatgaagagatggatgaattcgagactaaggagaaaattttcaaattggaagagaaactggaggagacacataacaaatttgaagttcttaaagctaatgtgtctgaaaacttaaaggaatgttttgagaaaattgatactcaggtaaaggaatcgaaatgtttagttgacttgataaatgagaaaattgagtcggtggagaaggaaatgaaattttcgattgacgttgtggaaaccagagtggaattccttgagctcgaaaaaatgggcgattcgtcacttgatgaatattggcaggacaacgggcaccatgacctacaaaaacaatttgcgcagggcaataattcgtcagaaaatggagagaaaagagatgcagacaatggaagggagagtcatgaaattggaaatgatgaaaataaggacgaaaataatgaggggcaggaaaaggaaaaaacactaatgggcgaaacggaggacttggaagtaatgatggctgaccctttcttaatgaatgtaattcccccgggtgtatatgacggaaacccaagttcgtctttttctcgatggtccgaaagattcatggaccttctttcgctttatccccagctcacggaagagcaaaaacttagccgtttacggataagtctttcaggacaggcaaggggggaaatggagggtatgagcccagccccaaccacgctccaggatgcatttaattttttaaaaaataaattcgagaatgaaaatacgaaatcaatcgctcgccaaacactgtcaatttgtaagcaggcgccaggggaaaaagtctatgaattcgctaatcggttaagcgaagcacttcgaaccgcaatggcgggagaaaacgagggaacgattaaaaagagacttttggaggaatttatggagcgtttgacccctgacctacaatttgaggtaaaggcaggccgaccctcaaattactcaaacgcctacgaaatggcacagcattttgaattgctgttggcatcgagaaaacagagccaagtctctgttgcagaactctcttcaagggttgaggcattaactattcagacgcaaaggaacataggaaaaagagccgacgagaggcgtgtctgttattactgcaatcgcccagggcacattgtgagggattgccgagtaaggaaagaaggaagacaaagtggaaaccgacaaagttattataggggggacagggcggctgagggaacatggagaagagattatagaaatgaaccaagcgaaagcaacagatggggtaggcaaaaccatcgcgacgaaaattgggaaaggcctaattggagaaacgatcgctcaccggaaaggcctaattggagatacggtcgctcaccggaaaggcctaattggagatacgatcgctcaccaaccccggatcagagaaagccgtggacaggcagaaattaccaaagaaaaccacatcgaagtccatcaagtgatggagatgaatccaatcgctcccattccccagggaagcgggtgcatttcaagaggggaaaagttgcagctgtccgagtagccagtccactatttttggccataattgccttccttgctctatttggaagcaacggagcatccgaagtgaaggcaaagcccatgatatgcctcccggatgctcccaccagtatttggtcattgcctgtcgaccctatctgccctaattgggttccaacgcaggtccccgttccttttgcattaaatatatatcgaccaaacactgtacaatacaaaaccgaagctacagcctgcagctgcattttaacgcgcatttcaaggaggagaggattttttggtggaacatatgaagaaataagtgcctttcattcggtagtgcctacggcaatttgcaggaaaatggcagttgataaggactctccagcaggcgaattatacgttaatgacgaaacgctaatggcaacaaataattccctagaaattgggtggggaaaatggccatcaaatttgttttggagaacggaagaaatcgataattattatgtgtataagacaattgtttttacacgtcatggaatggagggattgaatacaccaatcggagagtgctctaattgcttttataaatcaggcgaatgtcaatgcgtaaaaattagtctgatttggacccccgacaagacccaactttgctcttttgtttggttgtcaaaatggtctggtgaatatgcaagtctaatatggacgacggaaagtggtgattttgcattgagttttgaaaacacctcgtctcatagtcagcccgggtgctatgccgagtcgggccaactaattgtgtcggaccaagcgtttgccgtacctgtttcggacttccaagaaatggtcgagaaagccaaaggaagcggcaccaggaaaacgagagaaacaaccgaaattggtcctgtttatagttctcagcttgctgcacagcttacagccttaagcacaaaaatggccataacgactcagcggctatttacggagacaattcgtaaaatttgcacgagcatgcaaataatggcagaccaagctttaaccttgtctatagcaaacccatcgttattagcgaggtttttcctgggaaatccttttttatcggctcgattgatcacggaaaaactaatggag

SEQ ID NO: 52154 - DNA, 1212 bp, Heterodera glycines
  Genomic contig location: Contig_ID=SeqID_3853; Location=4568..5779; Strand=-
  SCN-specific regions: Sequence locations=1-309,339-883,905-919,955 -1212
atggcattgctttccgaccgtttcgatgttttggtggacgcgcatttcgacagaaaaagcgaattgacaatttggagaagtgtcgtaattcgcaaggacaaaggaccaaaagcgaaactgtctgtacagatcgatggcagttttgtggattttccgttgtcggaccattcgctgccaaacaaaatccgttttcgtttcctttggattgagtaaatcaaacttatacggaaaccaattaatatggttggtcgtcgtcttcattgttcccccttttcagctacattgaccattccgtgatcaaatttctccgttccaacaagccaatttgggacagaaatggcaccaaattgaaagtgtttgtgtatgcatttgatacggatgtccaaccgatttgggatgtttttatccgtgaaatttggccaatttttgcgacaaacattcgtcatttgggctttgacgatggcgatcatttggacaatttgcgtcgtcgcacatcgccaacaattctcactgatcttgatcaattgaattcaatcgattctggtgctctattctccgatggaattgctgacgatggacccaatgcaactgctggccaagctttggtcaaatggcttcacactccgacaaaaaatggacaaccgaagcgattacatcgcaataatttgttgggtccactgaatctcgaatgggtcaacaacttcaaagaggtggcccgccatatttttttattaatctctttgtttggatcaatggcaactcgtacaaaaaaaaaatttttctaagaattttcaactaaaacttagaatttttagataaaaaaatctaaattggattttctagcctagaaaaactttaaaaaaattctctaagtttttttactaattctttcagctgattttttagtttcttaaatgttgaatccccttttgacaaaatcatttatttaatttaatgatcaattttcacttatttattttgtacaacttttcttctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccttttttttactcactttgactcattcccattttacttgcatttctcacttttgctaaataaa

SEQ ID NO: 52155 - DNA, 442 bp, Heterodera glycines
  Genomic contig location: Contig_ID=SeqID_21539; Location=784..1225; Strand=-
  SCN-specific regions: Sequence locations=1-19,51-442
ttttttcttgttgcgacccagttttttatacatatatatatgtacatatggcaagtatataatgaatgataataccgatcacagtgtacaataatgagcaaatgtgatcatacattccgtgtgtcgtcaatgccaagtatacaatgaaagacgacttgataccgatcacaataatatacaattatgagcaaatgtgattagacagatgctaggctcgcgaatatgtgtctccgtttgttcatcatctcgcgggtgattcttcgctcatcctcctcactgtttctctgctggtttctcaatttgcgtcttttctcgatccgagttgcgtcttccgatctcccagtcatatggatgctcctcgatgttgttttgggcaagatatccacgcagcagcagctcgatcatctcatagcagggccggtcctccagctgcagggcatcc

SEQ ID NO: 52156 - DNA, 1681 bp, Heterodera glycines
  Genomic contig location: Contig_ID=SeqID_21540; Location=52..1732; Strand=-
  SCN-specific regions: Sequence locations=1-312,334-896,918-1432,1454 -1681
aggagaaggagtgggattggaatgaaaattgccaaaaggcattttcaaaattgaaaaaaattttggcatccgatttgctgctgacgatcgttgtcgcggcagatgcctctgattatggcatcggtgcagtaatctcgcacaaatttgcggacggatcaatcaaggccatcgcccatgcttcaaaatctctttcaccagcggagaaaaattactcccagattgaaaaggaagcgttggcactgatttttgcagttaaaaagtttcataaaatgatctatggaagacattttacgttacaaactgaccacaaacccttgctaagtatttttggcagtaaaaagggagtcaaacaatgcagcgcaaatcggctgctcagatggtcattaattttattggcctatgatttttcaatagaatacgtccgaaccaatgattttggaaacgccgacgcactctcacgactcatcgcaaaaggaatagaatgcgaagaggagaaagtgatcgccgctttggacgttgaatctgatctgacatccattttcaatttgaatttggagaagttgcctatcaaatttgccgatttggcaacagcatcgaaaattgacggatcaattcagaaggcaatcaaattcatcagatcaaattggccaaacaatgatttgctgaagcaggaatcggagactgtccaactgttcagccgaagaaaagacgaattgtctattcttaaagattgcctaatgtatggcgacagaattgtgataccaaaattctgccaaaagaaaatcatggagcagctgcacaaaggccatccaggaatcaagcggatgaagcagttgtccggacaatatgtctattggccgaagttggacgccgaaattgaagaatcgtccaaaactgccagccgtgccaagctgctgccaaagctcctgtaaagactgatctgcactcgtggccaaaggcagaacatccatggcaacggatccatgtcgactatgccggccccttttacggtaaagaatttttaatcgttgtcgacgcattttcaaagtacccggaggtctttgaaatgccaacaaaatcaacagctgccactgtcgataaattgcgttacctttttactcgacacggaattcctgaaattttggtgtcagataatggtacgcagtttgccagcaacgattttgccaaattcacagcggcaaacggaatttcgcatttattttcagcaccatataatccaatgtctaatggacaagtggagcgttttgtggacacctttaaaagggcttttcgaaaattaaaaggggagggagtcccaggaaaggacgtcattgaaacatttttggtcacttatcggaccacaccaaatgattcgctcccgaacatcaaatccccggcggaaatgctccttggtcgcaaaccgcgcaccactttggatttgctgaagccgccgctttcgcaaccctcggaaagagacgcggaaatggaacgacacttcaatcgacgttttggcacgagacaacgaatttttcagatgaaagacaccgtttacgcgcgccaccgcctctcccagaattggagggcaggaataatttgtgattgcaaaggcgtaatttatactgtgaaattctcggacggatcaatcaatcgctatcatgcgaaccaactccgagaacgccga

SEQ ID NO: 52157 - DNA, 1681 bp, Heterodera glycines; identical to SEQ ID NO: 21541
  Genomic contig location: Contig_ID=SeqID_21541; Location=1..1681; Strand=+
  SCN-specific regions: Sequence locations=1-669,705-768,790-873,895 -918,940-1359,1381-1439,1472-1551,1574-1598,1620-1659

SEQ ID NO: 52158 - DNA, 606 bp, Heterodera glycines
  Genomic contig location: Contig_ID=SeqID_21543; Location=227..832; Strand=+
  SCN-specific regions: Sequence locations=1-606
atggacgatcgacaacgaaacaggcgaagggctttcgcgcacttggatgaatggctgcgtttggatcaatggaagtcgaaggagaaggagcacaaaacggcgcgtgcgctcacactgggagctctcccgaacggagtgattggcctcaccgaagaatggttcatggacaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagctactcgaggcacacggcgagcaccggcaatttcaaggattgaggcaattgagctggtatcgcctccaatgccccaggaaatgagagcgaatgaaacggcaagttcgcaacaagaggaccccgagccgtcaccgctggtgatggaactgaaacgacaaatggtcgcgttccgctcaaaacgacgttttcaaagccgtgggaatgtcgcgactgaacgtcagccacgaatgtccgttgagcggacaaatgaggagaacggggaggaatga

SEQ ID NO: 52159 - DNA, 1612 bp, Heterodera glycines
  Genomic contig location: Contig_ID=SeqID_21544; Location=48..1659; Strand=-
  SCN-specific regions: Sequence locations=1-56,93-191,222-378,405 -889,942-1058,1080-1246,1335-1414,1457-1499,1532-1612
  Gene Ontology: Mol. function=alcohol dehydrogenase activity, zinc -dependent; Cellular component=cytoplasm; Biological process=alcohol metabolism
atggataccgctggaaaggtaaacgaaaaataaaaatacttccataataatgcgagtattaattaaacaataattttgtttattaattaaaaccaaattgaccgccgccgttttccatcggactcccggccctatttaaaaaaattattgttattgatgcaagacatatgcataagcagtccgatcgatagtaaatatttaaattattgtttttattatttcagaaaatgttttgctcattataatatcttaatttttccgaagtacataaaacaataaaacatattttgtccattataagcagaaaaacccctaaacttttattagcaaccataaaaaggagatgtttcctactaattagagtatgcagaagccatgaaataataattaaatttaaatatttactatcattttttagtttctttcgccacaagcattaattcattaatatttcattaatcacagacaatcaaatgccgagcagcggtcgcttgggagccgaaaaagccattggttatcgaacaaatcgaagtggcgccgccaaaagagggcgaagttcggattaaggcaagcgaagaagcgattgaattggattggattatacgtaaaatgttaagataatgttcacggccatctgtcacaccgatgtttttgtactgaaaaaagccacaaattcacttttcctcaatttattaattaattaagcaagtcagtggcattaatccaaacgtcaaatttccaacgattgtcggccacgagggtgccggcgtggtcgaatcggttgggccgggcgttgaaagtgttcgggccggcgatcatgtcattccaatgccgttgtgccagtgccggaagtgcgaggagtgcgctgacccgaggacaaatctttgccaaaaatttttatatttgtaaaaatagtattttttaaattaattaatttaattgtcatattcgggttggaactctgttgtcagtcattgtcagcagatgcattagttatcagtagggctgggaattttatttaaatacatatttttttcctggcttctccatgctcttaggaaaaacacttaattttttgtgtttgcgaacaaaaaccgggacttttatttaaatattttggggtttttctcatatttttatacattttggactttttcttacatatttcgcaattttgttcgtacatattttatttgtttttttacatattttgggaatttttgagaatttagagaaatttcccgtgaaaattaaaaattttttttttgaaaatgtacacataaaaaattgttttttttttcaaaaaatagatatcaaaattaatttttaaaatagcaagaggtgattctaagcttatttaggttattttcttttttttttttgcttatttcaccccctacgaaattttttttttccaaaaaataaccattttaaaattttatttacatattttggtacatatttctgggtttttgtacatatttcatacatattttagcaatttttatacatattttatttaaatatttatcgatttttcttacataaaattcccagccctagttatcagtaggtcctcaacagaaaatgccactttgagtcgacgaataaa

SEQ ID NO: 52160 - DNA, 927 bp, Heterodera glycines
  Genomic contig location: Contig_ID=SeqID_21545; Location=230..1156; Strand=+
  SCN-specific regions: Sequence locations=22-138,233-373,432-511,534 -647,736-891,919-927
atgctggacaaattggccattgtgcgggccggcaccggcggcatggaaatgttggcacacacagaaatgccagtgaataagccacggcacaaaatgggccgaactctctacgaggcatggtaagacaggaaaaaaggcataaaaatattttatttaaacaatttaaaataattgtttttttttaatttgtcgattttaaaatatttttaattatttaaatttttgtttaaatgtttttggatttaaaaaaacgttgtttaaaattcaaataggaaattgtttggtgacccaaatgccgtgcttttgttcgtcaatcagcccgacctgttcccgttctgccattttgaacaattgcaattcactacttttgaggtaaaaattataatttgtttattttaattgttttttatttattttttaattaatttaaaggttgaaaaattggcgaaacgtgacggaaacgttgttcaagtgatccgaatgactttcaaggagtgcgcggaacggtaagaaaaaaatattaattatttaatgaacgttaaatagaagaatattaaattaatcaatgaaaatccaattaaaaaaacgaattacataatgagctactaattcagaaaagaaaaaaaagaattaaaaaaaccttataaaaattaaataataataaattaattaattaaaatactatctaataaaattgaataaattgttttaaaatttaaattactattaaattaataattccgtaatttaaaaaaatgaaatatatttccatgaataatttgcagttgccatcttgacgagagcgacttttcgctgtatgtggacggaaagcgagttgcgctggtgcacatggcgtacggatatattggggaacattatccaaccgaagtcaattaaaattttaatttttaaaaaatagtgctcaaa

SEQ ID NO: 52161 - DNA, 276 bp, Heterodera glycines
  Genomic contig location: Contig_ID=SeqID_21546; Location=669..944; Strand=+
  SCN-specific regions: Sequence locations=1-186,208-250,275-276
atggccgttttgataaaaaaaatgtaatacattttgaaaatacttatttttagggacaaaatcttcgtattggaggctattcgtcccagtgaaaatcatggtcccggtcctttggatgcaaaattgatgattttatattcactgaatgatctctcaaataacaaactcaaaatgctcatcccctggcttttatgactactgtttgttgtgtcctttagttcttttaaagaattaaaaatgcttaatgaaattaatttatttatgttttctaaaaga

SEQ ID NO: 52162 - DNA, 1015 bp, Heterodera glycines
  Genomic contig location: Contig_ID=SeqID_21546; Location=1007..2021; Strand=-
  SCN-specific regions: Sequence locations=1-1015
atgatcattgatccaccaaatggcaacagttcctctccattatggagctcatcgacaaatgaaactaatgaacattctttccaaaatgattttgaaaaacattcggagtcacaagaaaatgatcaaattgagaaaaataataatgggatattcggaagtatattagcaataataaattgacaaaaataattactttaaataaattcaggcgaaaaaataagaaaaaatggaaagaaaaaaggtaaaaaagcattatacatatttttaaaaaatgatcaacattcgcataaaaataattgaaaacgtttagaaacaattcgatgggttgtgcatttgaccaaaaattggctcgacagtaaaaattcacttaaaaaggtgcaaaatttgttggcaataatttttgtgtgcatcgaattgaccgtttccccgattccaattataggtaattacttaattacattaaaaagtcaatcaaattaatttttaggtcgtgccatcggcgagcaaaaaacactgccaaactgcttaatgagtcccacagtgatggcacactttgcactgtctcttctcacaattccgccgttttacaccaaatttggcccagttttaaaggcacaaaaaaagccgggaaaatatttaactgctgtaaaatttgtggaagaaatttttaaaataattctgaaaaatgaaggagaaattggcgaaatggacgaaaagatgcgaaatttgcaattttattcacttttctacgaatttttatgcgcctttttcaaagggaataaaaaaacaatcgccgattttccgtccgaaaaacatatgaagtcgtgggaaagagcgaagcaatttgtgcaaatttatgagcaaatgttcaaacatcagctggaaaaaattgaaacgatcggattggggggaacaatggcggaacttggaaagatcaaaaggggagataaagtgattgaagagggaccgaaatgagaagcaaatcactcatttgatagtgaattatgaaaataaa

SEQ ID NO: 52163 - DNA, 811 bp, Heterodera glycines
  Genomic contig location: Contig_ID=SeqID_21547; Location=19..829; Strand=+
  SCN-specific regions: Sequence locations=1-342,368-478,654-666,688 -748,771-811
atgattattatcccatcgattgtgccccttggggattcaaaatatatggcggagcaccaacaaacaaagaatgtaagttcagctagttgtttaaagattaataaaattgaattaaattcagttttcctgttcatatttggattacgttttccgaaaggcgcaaagggaaaatcaaaggcttttccaaaacaacaagccacatttggtcatcaaattttcaaaattgcgaagcaaagctcgaaaggccacaaagtttagccatttaaagtgcggcctcaaagaatcgtttgtaaatggaaaattagccgacattcgccaggaaatgctttgccaatcatatacggtaaaagaaaatcattaagattaacattaaaaaaaataaatcatagcgatttggtcactgtcgaaaccgcacggactgtgttaaggagcacgacgttgaccttttactcgatttggaggacaaacgagcacaattgaaaagagaaaaggagcgaaaacgaaggagcaaaaaagaaacagaaaagcaaaaggaagagagtgacggagaagagaatcaaagagaaagggaagagcatgaaaatgagaggggaaaggagggcggaacaaaacggaaatgggaagtgtctaaggtaaaaggaaataaatggaaatttcacaacatcatctcttcccttccctccccccgaaggaaagtgagccgttttttgccgtatcggacgaccgcattggaaaaacgacgaagaaatcaaaagaaaattacaaaaatggagaaggaattgggcactctttcgtggatacactgaccaaa

SEQ ID NO: 52164 - DNA, 499 bp, Heterodera glycines
  Genomic contig location: Contig_ID=SeqID_21547; Location=1431..1929; Strand=-
  SCN-specific regions: Sequence locations=1-336,373-394,416-477
tggttcagtacggcgacttcttccaattggcaggtgttgtgactttggcatggcactccgcttccgttcttctgacatccctaacaaaatgatcagttgccgacattcccggattggtgcaaggcgcacatcgcaacgagggactcggcttcagtttcctccggcacattgtgcgctgcgaatgtgtgctcttcgtccttgactttacacaaggaaatctgagggaacagtacgaattgttacagcatgaaatgactttgtacgacgacgaactaagcaaaaaagaagcggcgattgtcataaacaaaacggacttattggacggagaaatggcatcattttcccttttttgaaaaataaagttgtttgcttaaaggttaagtcagcgatcgtttcgatgtttccggagcaaagtgtgtttttcgtttcgggaaggcatcgtttgggaatcgaaccactgctaatgtttttgcgggaaaaacacgagcggttcttgaaa

SEQ ID NO: 52165 - DNA, 181 bp, Heterodera glycines
  Genomic contig location: Contig_ID=SeqID_21548; Location=1040..1220; Strand=+
  SCN-specific regions: Sequence locations=1-181
aagggggtaaacatcccccgtggcccttcttttgtttgatgggcacaaatttttgtccaaatcggagttgttgatgaatggaaaggccgtcttttgttgttggccggtcgtttttggaccaacaatttttgagtaaattagtgaagtgaaaaaatgtgaaaattttggcgaaaatggttgg

SEQ ID NO: 52166 - DNA, 1089 bp, Heterodera glycines
  Genomic contig location: Contig_ID=SeqID_3854; Location=5201..6289; Strand=-
  SCN-specific regions: Sequence locations=1-206,236-617,640-1089
taaggcacttctgctgcattgcatcgcgaactgagaaatttgagtttccgtaacccgggctatcgttgcacattgcccgaaccttcacgcgctaagcgaactgtcgtcatttctgcgcaacaaccaaaaacatctgccgaaccttcggccgatcgacggagcatgagaaaacgtacggccaagaaggacgggtcaaattctgatggtaataataaaatgtataaaaaaattttaaccaaaaaagtgaaattttaaacattcaaaacttgtaatttggttcagttaaaaagtagaactcttttgaggctggtaaaatgctctaaaaaccccaatattccgtttgactattccttattgaacctcaactttgcggccgcccaggttcttatcttttttgtgcccccttacaaaatgtttttttaaaaattttttctatggtaaatttaggcgctgaaaacgaatctgacatttatttaaagttaacatccactttacgtaagttacttgaaatttgacgtgaccagtgttatgattacacaatctttttaaaatgtattttttagtttgcctcctgtttattttgaatttaaaaatttataggtttttttcacgtaaaatctgtactttaattaaatgtaagattcgttttcagcacctgaaattaccatagaaaagatttaaacataaattttttttcgctataattcatcttattctcgaattagtacaaactcgctctgccaaatccaaactccgctacaacaataaggggcgactcgtcctgccgagtcgtacagaagtggacctttgcgattgcttggatcaaaagtgcaatggatgccaatatcaggtgacgaaaagcaaaatttagtaggcaacaaaaaaaatttagtgcaaaaaatgtgggggcaataaatgcagctacgcctgtcgcgttaatcggaccacttttattgagcacatcgacacacttggcggaggtcggaccaataacccgtttttgtgaatgaaaagcatgcaagacattctcttttttcataaaacattttttatttgacaaatttctttcgctataaatgcttttaaaaa

SEQ ID NO: 52167 - DNA, 983 bp, Heterodera glycines
  Genomic contig location: Contig_ID=SeqID_3854; Location=1..983; Strand=-
  SCN-specific regions: Sequence locations=1-225,247-595,617-703,725-936
  Gene Ontology: Mol. function=UDP-N-acetylgalactosamine transporter activity; Cellular component=Golgi membrane; Biological process =galactose transport
agggagtccatccgtccaattctgcttaaatacgtgtctctgctggtgcttgtgcttcagaatgcctgccatgtgttggtcactcgctatgccatgactcgcgtgggacttccgcgcttctcgaaaccggaaatggattttttttttgctaaaatgcatttaattgcggaaatactctttcaggtggccattttgttcaatgagctcgtcaaactttgcgtgtctttgattttgttcttcatcagcacaaatgatttgtgcaagtctgctcttctcttttcttcattttcgttcaattaatttaggtttttcaaaattctttaccatcactttgggccaaattgtttggacacattaaaagttggtgttccggcggtcatttatctggtccagaatttgttgatctttttggtctgtttttaataaattaattttgtcttcaaaatactaattaaggcaattgaaaatttggaaacgggtacttatatggtaaaataaggcatttgtgaattgactaacgccaatttcttaggtcacttatcaacttaaaattctcaccacggcattctttgccgtgcttattttgaagcggaagttatccataattcaatggggggcactgctcattttggtcgccggggttgccctcgtccaatatgtgagttggcatcgtttggaggggggggggggggaatccactcggaatggatctgttaaaaattctctctgttctggtttactttttagtgcaccagggagaatgcttgtgagttcagtcttttgacgccagacgatccgtttacaacaacggcgacagtttcggcacctcaaaatgaatcgacaaaacccgtgggaccttcgccaattggtacaaattaaacacattaagccgaaggtaatttgttgaaaagttcccagcaacacacagaagaaaatgcaaaacccagtcctcggccttgtttacgtgctgatcgcctgtttct

SEQ ID NO: 52168 - DNA, 1461 bp, Heterodera glycines
  Genomic contig location: Contig_ID=SeqID_21549; Location=476..1936; Strand=+
  SCN-specific regions: Sequence locations=1-343,365-989,1012-1062,1084- 1118,1145-1461
atgaccattaaaattggaagtgaaatcatccaaaaggacaacaacggacaaaaagcagcaaaaaagggaaaaaacaaaaagaagaaaaaggcgaaaaatgaaggaccactccaaagtgccgaaatttgtccaccgacgaacatggccaccaaacccgagccaattccggatgacaaaagcgggtaatttcagagtttatcgcccgtcccatttttcgaaaaaaaatttgttataaaaattatgaaaacatctttccaagggttttctgggtcgctgattacggatccggaacgaacaattccgaaccctgggttgaactcgaacaaaaagtcgaaaatccaaattttcaaaattctgatttttgttcaaactttgtttggtaatatagtagtaccgatggtaccacatctttaaaaaaaaatttttccaaaagttataaagctgttaaatttatttcttataaggttttcggtgtcgctaagcacgaatatgacatccatttctcccaattccgaacccctaagtttaaatcgaaaatttgagttttcgactttttgttcgaattcgggcccggagtttgggattggaccaaatggatgccggattcgtgactttgaaagcgaaaatggttgttttcatggtcgctgaactcaataggaaaaagttgcgtttactggtcccctggccaaaatgattttgagaaaattgctaacccaatagccttcctcgcccttcctttggttttcaaaattaccctttttcagtagggccaaaatggccgtcaattgcgcaccaattcggagtgacaaaattccaccaaccaacaaatccaaatcggccaaatgtgcgaacaacgtaagccgatcgaaagcaaaaagcgggaggaagtggacgaaggcggtggcttcgaatggtaaatgctttggctcttttacacaaattaaattcggataaataaattcgcgcaaaaatgaaaaagtgaaatacaatattattattttttggtaataagtgctttttatctaaaactaggctagaaatgatagttttcgttaatgcgcctataattttgaaaaaatttttggtgccgaagagaaaggaaagcccttcggatcatcgtcacaaaattttttggaaatttttgacgcgtcgggggtcaattgggctccggaccagtttttgtggtataacgcctttcatagctgtacaatttttcgatctttctattttttgttcgtctgagctggcacttttccccacaaaaatgaaaaaactttttcccaagggaaaaatgcagcgaacgaaagcggcacagagcttggcgaattggtggaaaaagtcaataaaaatgccatcaaatttcgtcgtgtggtggcgcgcactgtgcaaaatccgcatgtgctccatttgctgtacgcactggaaaagcggcaatcgtccatggaaaagctgacgaaggag

SEQ ID NO: 52169 - DNA, 837 bp, Heterodera glycines
  Genomic contig location: Contig_ID=SeqID_21552; Location=870..1706; Strand=-
  SCN-specific regions: Sequence locations=1-166,188-334,356-837
ccgtcaccaacgaatcatttggtggcgttggtcactccgacaacttccgggtttcggcaaatattacagacaaaaagtaacgcaacggcaaaaaacggaccgaaaaacgttttgccccatttaaaagccattccatcgtttacattcgcttctttttaggcatcgaattcactttgcctttcaaaacgacagaatttgttgagttgggccgagaagattgcccgaaggattttttgacaaatatcggagacgaaagtattggcatggaccatgacgaatggctgcgtgaccttggcatttcgccacgttcgaaattcaaattaaaacaaaggtgtttttgcgtttaaaaatttgcttggcagcacattaggtaccgcttacttcagggaaatgaaataggaaatatcgcataaggaattggctgttcgtcgcctagggggtgaaagcgtccaaaacataaaccctggggggtacgtccattagaccgcgattatgagttttcgtatatcccttcaaaatggactgaaaatgtgaaaatgcacaaattgcctcttcctcaaaatgttcacttcagtccctctgagttggacgtgtcgtcggcttcgcttttgtccaacgaatcgaagaatgattcttccggccttactaattgtaagagtagcgaagacaattcgcgcggtttgtccgccgtttcgtccgtcgaaagttcgaagtccgccgtactcatctggtggtctttccttcctctgctcataattgcgaatgttttcagtggcgccaaaaatgtggaagccttttgccgtcttttgattggtcagccgactctttgctccacca

SEQ ID NO: 52170 - DNA, 1383 bp, Heterodera glycines
  Genomic contig location: Contig_ID=SeqID_21553; Location=476..1858; Strand=+
  SCN-specific regions: Sequence locations=1-141,164-966,988-1383
gtatggaggcgaagaaatgggaatcatcccattgattcaaaatcattcattaacctgtacggttaacagccccgctcagcatgaccggtcggaagtcaaagatttttgggcgctcgaatcaattggaatcacggattgtcctgaaatgaatgatgatgaaaaagcggtgcagaaatttgatcaatcaataaaaactgatcaagaagggagatacgaggtatctctcccttggaaaaccgagggggaacgccctccggaaaacttcaaatttgccttttctcggctcgcggccctcgttcgcaaattgaaagacgctccacaactttttaagggatgtgatgacattatccaagattatgtggcaaaaggcattaagaagtggccactcgcaccacggagcagcaatatttccttccccatcatacagttatgggaaaaaagctccgaattgtctttgatgcctcttcgcacgaaaagggagcccggtcactaaatgacaccttattttctggtccaaatttatacccggacttagccgggaaactcatacaattcagggccactaaatttccaatttgggctgatattgaaaaggcctttttaatgatcagcctgagagaatctgatcgggagttttcgaaatttctgtgggttaaggacataaaagctccactctctggtaaaatatcatagtttttcgtttcaaacgaattacgttcgggatagtttcatgtccgtttttgctggccgcaacacttaaatatcatttggacacgcaccctagcagtctcgccagggaaatagtcgagaagtcattattatacgtagataacctgttgaaaccgagactccgaatgttctcggaatgaaatgggttattaatgaggacaatttatcgctgtctttccctccggttcccggtcctgaagggctaacacggagggtggttctaaagacaattgcttccttttttgaccctttgggtttatgctccccgtgtctcgtggggcccaaaatgttcttccagaaattatggaatgaatcccagggatgtgatgatctaattccgatttctgaatgtacggaattgatgaaaatccaaaaacattgggatagtgaaatcttatcaatcccacgtcactctcgccgagtaggcagcaattcgttgcagttacacgctttttccgacgcatcgcccgaagcttttgcatgtgccgtctaaattagggcagaaatgcaaaataagaatgttgtgtcgatggtgtactcccgttcgcgaattcgtccaaagaaaatggcgactagtcaatcggatggtctaaccatcccacgtttagagctcctcggaattctaatcggaacccgagcaattaaatttgtgaa

SEQ ID NO: 52171 - DNA, 723 bp, Heterodera glycines
  Genomic contig location: Contig_ID=SeqID_3856; Location=1753..2475; Strand=+
  SCN-specific regions: Sequence locations=33-114,147-159,328-603,626 -723
atgtccgggagccatttatttttattaatttggattaattattggttcttttttggatcacggccattgaaggttatttccattttaatgctgctgcgcatcaattggttttccaaatataaattaattgtaatattttatattttcataaatgtatgcattgtaattaattattactatgattattattacttaatattaatttcacatgatttcaattataatctttgaaaattatttcaatattcttttttttttgtcttatattttggttatattttttactattatatatatattattttgatttcttttttcaatttcattaaattatcataataacccgactgcttagaattttgttaatttgtttttcttatttaattttctttcttgtttttctagttttgttgttattcaatataattgcacattattaggttagataactaaatttttaaattgtttagaatgtttttccattttagttaattttgtgggttttagtgtataaaaatgttaaatttttagtgaacaataaaaattttgaaaaaaaatgtttcagtctcgagtcaccggaattttcagtcttgagcatatttacattgacattttttaaatttctatttgcctgttaataatattattagcgatggaaaataaggaggcctgaggctttctaaggaattttaaaaaaactctaaatttgggttctccaggaaa

SEQ ID NO: 52172 - DNA, 216 bp, Heterodera glycines
  Genomic contig location: Contig_ID=SeqID_3856; Location=6095..6310; Strand=+
  SCN-specific regions: Sequence locations=1-216
atgtccaagttcaagcagttcactttcactgctctcactttccacctcttcttccattcctttccgtgggcagctctaccattaagctaccgaggcacatccgccctttcttttatggatcttatcaacccccgctttccgcgttttaaccgcccagccagcttcttccttacagctccatcctcatcgggaccggtccctcggtccattagttaa

SEQ ID NO: 52173 - DNA, 219 bp, Heterodera glycines
  Genomic contig location: Contig_ID=SeqID_3856; Location=8504..8722; Strand=-
  SCN-specific regions: Sequence locations=1-219
atgactgaaattaaatttttctcacaaagcagtgccgggttaattctccccgatataatcaagttttttgttatttagcaaaaatgtcaaatatctgggaatattctccaccgctgggttgattgtgacagatctgagaaaacgtttattgcctgagaatgtggacaaacttatttttgcatcacaatcttaaaatttatgattttgattatgaataaa

SEQ ID NO: 52174 - DNA, 243 bp, Heterodera glycines
  Genomic contig location: Contig_ID=SeqID_3857; Location=187..429; Strand=-
  SCN-specific regions: Sequence locations=1-57,152-243
atgccaaggagtatgaaaaaacaaaagctgtttattatgaaaaaaataatttctgcctattaattaaacaattaattttctctaattatataaatagattaaaaattttaaaattaattaaacgaaattcataaaaacaaaaaataatattcagaaatgattaaatattatgaaactaaaatatccatagatagcatgatcatcgtcgtcgaatcgctatcgtcaagaccatgattaaataaa

SEQ ID NO: 52175 - DNA, 1769 bp, Heterodera glycines
  Genomic contig location: Contig_ID=SeqID_21562; Location=856..2624; Strand=+
  SCN-specific regions: Sequence locations=1-814,836-1251,1273 -1691,1713-1769
atgttcccaaatgacgatggctacgaatcggaagatgatgaaattctcttgccacctccgccgatccccccgcaacttggccaccctccgccaaatgtgccggtaatttcggtctcgcttttcgttgctttttctcacatttccgagtgcttttttcaggcagttcgtgttcagccaatacatgttgggcagcagcagctgccgctcagagacttgccacaattcgaggaccatccgcaaaatgtgccggtaattttgggtcgattttcgctgcgttttctcaaatttctgcgtgcttttttttcaggctgttcgagtccaaccgatacaacaaccattgccgctgagagacctgccgcaaattttccaccctccaccaaatgtgccggtaattttgagtctcgttttcggttgctttttcaaaatcccgagtgcatttttcaggcaattcgtgttcaaccaatgcagcaacccgtaccaatgagagctgtgccacaattcccccaacctccaccaaatgtgtcggtaattttggctcgttttttgttgctttttttaattcccgaatgcttttttcaggccgttcgtgtccaaccagttcaacaaccgataccactgagagacgtgccgctatttgtcaacccaccaccaaatgtgccggtaattttggctcgcttttgttattttttttcaagatccctaatgcattttttcaggtaattcgtgtccaaccgatgcctcaaccgttgccgttgagagacatgccgcaaattcaccatccaccgcgaaatggacttcaatttggatcaaattgtggttgctttttctcagtctctgggtgtttcttcagggaattcatgttcgacaaattcaacgggaatacgccgtaccgcaatatgcccatccgccgccaaacttgccgtatcatcaaccagaaaacgttccggtagttgggtcttgtttttcgtgcgtttctcatattttcggatgcttattcaggcaatccaaccacggcaacgaccgcgccagctgagagacgtgccactattcgaccacccgctgccaaacggacaggtaatttcagaccctgtcttctacctaacaccgaaacatcttttcttaagcaaatgcatcccaacccccccgagagtgctggaagtgatccgacggctgggcgagtggatagaagaccaagggacccaagacgtccgcctcaatgaatgaatggaatttggattttgataaaatttgttgttttaattttttgaattgataagggttaaatcccattacctaaattgtttgaaaattattaaaattttaagaaattagatgctaaacctaacctttgacaaagattatgaaaaaatgaaaagaaatgacgaatttttttggaatgttccttctttttattacctatggattttttttcacgtgcattattttggtgctagtaagatattgccgaatgaattaattggtttttctcttcattttaaaacatttcacgtccccatcgccctgcccacttcccgcggaattgatcaaggaaataattgacgctctcccccctccaaaaacacatcggcttttgcgcttaaattttgttttggcatactttgttaaatgtcggttctattccatgatgagaagattgtttcgcccagagcatatatcaataccaatggcccgaagaactggaatttatttctttttcgatgtttatactccccctatttattttccactctaccaataataatatttaa

SEQ ID NO: 52176 - DNA, 60 bp, Heterodera glycines; identical to SEQ ID NO: 52045
  Genomic contig location: Contig_ID=SeqID_21563; Location=571..630; Strand=-
  SCN-specific regions: Sequence locations=1-60

SEQ ID NO: 52177 - DNA, 245 bp, Heterodera glycines
  Genomic contig location: Contig_ID=SeqID_21565; Location=830..1074; Strand=+
  SCN-specific regions: Sequence locations=1-79,101-120,143-159,186-245
atggggggggggagggagggtaagttgcgcatcattaatttattttgtaataattggagtcgacggacggaatctcgcaagaggggaagggctgctggatcattgtaaaaaaattctcccaaactatttattagtggggtaatttgcacatcattcaacttatattttaatatatgtatattgtagctcatttcttttttgcaccatatccaagtttttatatgaaagcggatccaacattttga

SEQ ID NO: 52178 - DNA, 1629 bp, Heterodera glycines
  Genomic contig location: Contig_ID=SeqID_21567; Location=613..2241; Strand=+
  SCN-specific regions: Sequence locations=1-536,558-746,768-866,888 -1421,1443-1629
atgaaaaccggaatgtttaaggtcccgtcggcagcagtggtcgtcatttccgacttttctgacattgccgaatcagtccagtcgaacatcgccgcattgttagcagcggaatcggcccagtcaactgaagcctctcattcttcagtcgcagatgcttctcagccaccaaccattgccgatgagcaggttacggtcgtccgccagtttcagctcgatcaacatcaaaattcggccatcgatgaaaacggagtttcgcctatggatgtcactcagtgtttggccgccagtctctccactttgcctcctgcttttgatatggaacagcagaagctgcaaaccgaagtaaattcggaatcgcaaattttttcactcctttctaatatattttcttgtcaggaggtctgcgcaaatatgccgaatcgaactgatccagctctgctagccaaacaggatgagcattttcttcgtgtgaatggcttccatccaatcggcattctttgtgaacggattgatcttgtttggcagcgggacaaaaaggtgaataattaatcagtttcctcactcatttcacagtcctgatacgccttttattttatttctcattgcgtttttgtgtttcttgtaggctgtggaacgtgagaagcttcgccgggaacgcgaacgtcgtgcagaggcagctgaacagagacgcaaagaacgccgagatgggagtgagggtgtgtggcgctttcttcctgccttgaaattcagtaaaaaagatttttgaaattcattaagaatcgagagaacaccgaaaagagcgcaaaagacagaaacgcgaggaacggcaccgatctccgttaggttagtttgcgagaatttgaaattgtattgaccaatttatttttggttgtttgacggaatacaaagggtgagttcattgtcattccttttcgtttcgaaccaagaaatttttctgccaaaattggttattgtgagcatggaaaggcaacaccacaagtgcagtttgggcacacttcgtcccccggcgcgttgggagtttttttttatgattttgatgtccttaattatttttttgcatcggtctttataaacaaaccaattttcccttaacaactcggaatgttatgacttcgcttacattgagacccatggggactgacgactctatagactatatattttctttctgcgtttcttatttttcttacaattttcagacaaggttcgctctgaagccgttgcgccgcaaaagcgcaacttcaaccggattgtccagtgcagctactgtgaacttattgtacggcatgaccgttttgggggtcgtgaaagtgcctattgctccgctgaatgcatctcacgacgggtggacatggtcagaaaggtctgcgacatttggcattttgtgaaaaaatataagcatttaaatttcattattatacatttttttgtctgtttaagtgtgtcaaggaatctgagcgtattttgatgatcgatctgaagggcaatatttacaatgcctccgtcaacccgaccattgaaacgttggaggcgttcctcaaccaaaatcccagctacaatccaataattgatgacgcacgacttggtcagtcgtattttcaggactga

SEQ ID NO: 52179 - DNA, 689 bp, Heterodera glycines
  misc_feature (642)..(643): n is a, c, g, or t
  misc_feature (682)..(682): n is a, c, g, or t
  Genomic contig location: Contig_ID=SeqID_21568; Location=228..916; Strand=+
  SCN-specific regions: Sequence locations=1-534,559-689
agcagggatgggccgaggtttcgcttttcgcatttcgcctttcgcattattcgcattttttggcgtttcgcatttcgcttttcgcatttcgctttttggcgcgaaatgcgacttttacacccctaagaatttgcggaccgggtcagtttagtacgggccgttttagtacgagcgcacatttttccactataacttttttatttattatccaaatccaactttcttgatatcattcgagagcccttcggatgctctattagcctgcaaaatttcaaaaaattttgtttagtttaaaaaaagttcgagccaaaaaagttggaaaatctggtttttttaattcttctggccataacttttttgaaccttaacgagatttttcgaaattttgcaggctaatataggacacttagggctatcgaacgatactaaaaatgttggatttgattggcaaagaaaaaagttatagccaaaaacttgcgctcgtactaaaacggcccgtactaaaccgaccccgaccctaagaattggattaaattcccataaaatttttcaaaattttacctataaattggctaattttcagtgaaaactgtttataaatgatcaaaatttccaatttttttcccccggcgggcgcctatnncggcaccgccgcgccccccaaaacttcctatttttctcntgaaaat

SEQ ID NO: 52180 - DNA, 1671 bp, Heterodera glycines
  Genomic contig location: Contig_ID=SeqID_3858; Location=3270..4940; Strand=+
  SCN-specific regions: Sequence locations=1-170,193-239,269-334,356 -551,573-732,789-790,824-848,870-994,1017-1088,1110-1521,1561-1671
atggacagacgaggagaaaccgacagcagacgaactgctgcaaagcacgcaactgttccgaacggcaaatgcaaaaagggtaaaaaaaatggggaagaaatgatcactgataagtgatcattgatcattggggcaatccctcagatgaaatgccaaaattaatcgccatgcattcaaacagtttcaaagcttaatgtcgtcgaatgaagagcgggcaacgagagacgaagcggcacggttgagaagtgtgaccaaagaggtggaggaaaagcttggacttgcgccatcgccggggacaaatcgccaagggccaacgacatttggcatcagtaggaaaaggggtaaaagaaggaaacgcggaaaagcacattaaaaacaattacctatattatactgaatccttattatattagtgttaattaatggaaataaaatccgtcaattaatcagctgatttgtacccttcggcaaatgaccccccggcactgttacggcgttttgttggcaccggtgaaagcgccgtagagcttaagaggtattttattagatttaaaactttaaaattggaacgtgccagaattcggtcacctccaaacgctttggtcgcttctctgctacgccagcaaagagaattgtcagcagtgcaaccaaacattatcagacccagcgttggcaccggcacttttatcggtcctttcttcgctttgaaaaatgccgacaaaaatttgggcgtttaaaaattaaacaaaaaaaaattaaatttaaataattaaataaaagaaattatagctcaacaacaacggcaacaacaacaccagcttgaatatgagcagcaaaggctggttgaacagcagcaacagttgcagacactgctccaacaattggccaccgttcagcgacagcgccaattgcagcagcagcaaatgttgatgaacagtcagaggcaaagtgggcaagccgttcagggacgaaacgagcgcctcgcgagcagagcaagcagtagcagcagcagctcttctcgggcagctaacattgaggtgggctaaccattagccgcgaaagaatccaaaaataaaacgataccctactaattagtaattactctcatgttgacagaaatttccgcctccatttgcttctcccagcttttttgggcctgctaacaacccttttcaacctccaccaccaatatctccaccatcatcatcatccgcattgttcccgggaaagtttttgccgagttcggcatcggcttttcgtctccccggcgggttgccttctccaacagctcccattttcggcggagttcagccatcagattcaaaattcgctgtccaaccgtcgccaatttcggcgccgttccgtccgatcagtagttctgtggactctgctgctgatctgtccgcacttctccaaaaattatcttggaataatcccacaaatcaaaatagcggcaattcggctaccgtagttgtgccgatccctacagtactgtcgaacgcggcgaatcgcggtggcgccgcacaatttgtggtgccaaaaccccaacaggaaaggccattggtggtcaaattggtggcagcaggcaaaagtgaacagcagtcacagcagcagaaccctaacaataacaacaacaatggtaatgacaatagttgggattactatatttaa

SEQ ID NO: 52181 - DNA, 342 bp, Heterodera glycines
  Genomic contig location: Contig_ID=SeqID_3859; Location=1826..2167; Strand=-
  SCN-specific regions: Sequence locations=1-79,133-202,224-283,306-342
atgggacttccgaatgaaactttcagggtaggtagattacctgataagcaaaataggtcaatagacaaattattctctcatataaaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaa

SEQ ID NO: 52182 - DNA, 449 bp, Heterodera glycines
  Genomic contig location: Contig_ID=SeqID_3859; Location=697..1145; Strand=-
  SCN-specific regions: Sequence locations=1-64,89-145,167-305,374-449
agcaaaataagcaggttaattgaatttactatgatttaaattaggtgattgcaattacagacaattaaaactatttttatattttaaatccttaatttggtgcccaaacttcctcctcacattcatttataattttgcttacaataattcattaaataaatgtttagataatttatagttctttctgtacttattacatatgcttcttcattctttcacaaattctttctttctttatccactaatttccgtccattctcttttcacatggcgaagcagaagttgaagagaaaggctaaacaatgtaatataaaaaaaatttaaaaaaacatattttattaattgtttttccaatgaaaaatattattaaaatcgtttgtcattttaaaaagcaaaaaataaaacaataatccatttaaaatgtaaaaaactgatttaaaatcaattat

SEQ ID NO: 52183 - DNA, 1240 bp, Heterodera glycines
  Genomic contig location: Contig_ID=SeqID_3860; Location=153..1392; Strand=+
  SCN-specific regions: Sequence locations=1-40,64-532,554-735,757 -841,903-972,1075-1118,1143-1240
atggtcacttgggtacctctcctttgtaagggttcattaaaaatatttaatggtttcttttcaattaattgcgttaatgaaattaaaatgccattttttaaatgggtcgtttaatgtgtaaaattaaattaaatgtcggaaaattttaatcaaaagcctatagttaaaatatcataataaattcttgttccagctccaacccaacagcaatcacttgctgattccaatttgctccggggattgcttcaggcattttccaatttgctaacgcctcaggccacagcatcggggggagtgtcgccatcatcatcagcatttgtaccaccaacagtaggacaacaacagcagcaagtgccaaacattggcggcacaaataattttgggaagtcacaattcgtgggtgtaccccaaccgcagcagcaacaagtccaagcagtacaacaacaatcgcaaccgcaacaaattggacagccaaattcggctgtccaatttgttgcggtgtatgagccgtggagaatggcacaacaacagcagcaaattaatggggccaattttattactgcagcaacgagtggtgatggagcagtaccggcacaatcagcagcgggtagagagggagcacatttttctattttaattcccatcctgctgttcagttctacctcaagaagttggagcagtgggacaacttcagcaacaattcatcggctcatcacagccagtgcttcctcaactgccgcaacagcaacaacaacaagttggggcagtatctgtgcttggatggcttccgaccagagcaggcgaaaccaatgcattttctgctgatggactgttttggccgcagcaacagcaacagttgcagcaaaacaactttggcagcaacaacgacaatggcaacgacattttggtgcagcgacggacggcacaacgacgacgcgaagacggacaacaaacaaatggagaagaagcagcggaagaggaggcagaagacgggggaggagcagcggaacggggggaggcagaagaggaggagggggaagagaggaggagagaaggggacgaggggttggaggacacgggcaaatgggggaatgatgtttgacacggactgaaaattcaaaaatttaaaatatttttaatttctggcaatttttttagattttcccgtgtcatttatttattttttgtcatacatacataattattaagtaactgaaatgttcacttaaattgcaaacaa

SEQ ID NO: 52184 - DNA, 780 bp, Heterodera glycines
  Genomic contig location: Contig_ID=SeqID_21576; Location=574..1353; Strand=+
  SCN-specific regions: Sequence locations=1-652,674-780
  Gene Ontology: Mol. function=structural constituent of muscle; Cellular component=muscle myosin; Biological process=muscle contraction
tgccacgatttgtgccaactcagcgagttaaacgacgcctccgttctcgcggcacttcgccagcgttactctcttcggcttgtccatgtccctcccccctttttccccccaatttcgcccattttcagacttattccgcccttttctgtgtggttgtcaatccctggtgccctttggcacccctttactctgcccaaatgcgttcactgtatgccaatgccaatggcgccactttgccccctcatatttttgcaattgcccaaagcgcttttgaagggctcagcgacggcacttcgcgattaaaccaatccattctgatcacgtagggcaacaaccaattcattctggcacccatctaaatgtgacattttttatagaggggaaagtggtgccgggaaaacggagaacacaaaacgaataatcgaatatttgatggacatcgccgaaaggaatgccaaagtcagcgaatgtgccgatcagcagaaagccgcaacggtggaaaaggcactgatcagtgccggaactgcgctggaggcatttgccaatgcgcagactgtgcacaacaacaacagctcgagaatggtgggaaacgttaactctaatattggcccagttttatcaaagactttctcaaatccgatcaaaatccctcccccttttttcccagggcaaattcgttcgcattgatttcgaccgcgaggggaaacttcagtcggcacagatcgattgttgtgagtttatttttcatttttaattccatcaccctttttcccttttttg

SEQ ID NO: 52185 - DNA, 1103 bp, Heterodera glycines
  Genomic contig location: Contig_ID=SeqID_21577; Location=37..1139; Strand=-
  SCN-specific regions: Sequence locations=1-151,173-175,210-452,515 -845,887-930,952-975,998-1103
atgttgcgggaagggatgagcaatgttttgctccatgcttttatgaaaatgtgccaccatttggttactacgatgtcgtgggctgcggcattgaattggcgacacgccaaattttttacacgaaaaacggacggcgattgggtgggcaaacaaaaaatggaatatataaaaatgcaaatttttgaaatttaataatgaaatttttctatagtaaattatgaaactcatttttttttgttcgaaaatccatccacccattccagcacaatgtttgctgggctataacttttgatgagatatcgtagaaccctaaaagatatggcattgtattttatttttttaatcattgataaaaaagcatagatttttgcagttttggcaccagattcttgattagtgcctaaaattaccccgaaaagtgttttttttttttttttttgaagcgatatgagaaattttaaacaaattttttaaagaaatttataaactacaaatttttataaaatttaaaattcgtttttgtttagattttaattgcttaactattttttcccctttaaatccacttaatttttcccctttttagtcactcccattttgcttgtcgcccctttgtccgtcgatttgttcccatgtgtttcgctgtgttgctcaaaaatggaagcgaattttggccctaatgatttcatttacaaaaattcaaatgtcattccgaaaaggacgagtgatgaatgagaatggagggagaacaacgaagatgaatgatctttaccgaattttatacatttgcagattaagcaaattgaacagtccaatcaatcaattatcatgctcacgcgactgtgaaatttaataaatttcttcaaaaaatataaaattatttattcaaattcaaaaacttaattatccatcaaggaattaatctgatgtacacaatgggaactgtcattatgtttttcttttcttttttttgtaatttggacagcacagaaagtatttctgtatgagaatcaaaaaataatattttggaacttgaaacgaaaacacaatttatcacgaaaatcaaatatctaaaagtaagattttataaatttcctaataaa

SEQ ID NO: 52186 - DNA, 1021 bp, Heterodera glycines
  Genomic contig location: Contig_ID=SeqID_21578; Location=117..1137; Strand=-
  SCN-specific regions: Sequence locations=1-57,81-279,301-358,384 -824,846-969,998-1021
atgggcgatattccatcgaaacaacatcaaaaaatggtaagtagtaaatttagacacatgattaattgtaagattaaaaattagggtgtggcaaaaaggtataaacatttacagaatgcaaatcatatgaataaagaggacaaatgttggacgacggattgtcaccaacggaaatttgaaactgggaggcgacggattggtgccaccaacggaaaatttgggaggcgacgggttggcacaaattttgccaccgaaggaagttattgatcagcaacaacacaactatggacaacaacaacatgaggcgactacggatcagagtgaccagcagaagcagtacgtggacgaggcaacgaatggcggtggggaaatcggtgagtgatcggccgattgttggccccagcggaacgacccaccgacaaaaaaccaagggccgacggtgcctctaggcgttgccggcgaaattttttttgtaaattttgttgaatttgttattcggactggtccgtgaaaaggcctgttaggaccaaaacctctcctcgactgtctttttgggtcatttttcattaatttttacattttttgatttcttcaagcaaatccaattcatagcccccaaaaaaaaattctattttggtatcacaaattaaaatcttattcgtaaataatttactatttttgtttccttacagttaaccaaattacgctcccttcgaaccctttgggcatgggcactgttgttgagggggaagagcatcagaagcaggcaacggtcagtgtggacgttcaaaaaaaattttttttttttgaataaggcgtgaaaaatgattgcatatgacacactttcattcattcatatccctcgaaaaatcttgaaatggttaatattggtttctttgctaatttctttaatcaaattttttttttcgactggcgcatctttttaacacttcggatcatacaaattccaaaaaaaaaaaaatttttttttattatacaggaaatttggggcctatgctaa

SEQ ID NO: 52187 - DNA, 679 bp, Heterodera glycines
  Genomic contig location: Contig_ID=SeqID_21578; Location=1847..2525; Strand=-
  SCN-specific regions: Sequence locations=1-133,155-412,435-679
atggtcgggggactttcgtcaacaaaagtcgcaaaaagtcggaaaaatcttaataaacttttggcattagggcgccggcgatgcaggtaggcgccgccgggaaaatgttgaaaaattagattgcaatttgttaactgattttcaccaaataacaatttttgcgattttgagcgaaatttttaagaaaaaaacatgtttttagggtccagcggtgccgataggcgccgccgcggtaaaatagaaaattttgagcattttttaaattctaattttcagcgaaaataggcaatttttaggtcaatttaatcagaataaatcaacaaatttctcaaaaacagcaaatcatcatctcaaaaattaaatcatcattgaccagttgaaagcagcaaaatgaggtacttccgtgttttgctatttgtttttctgtgctttatgtccacccctccccatttccaaattttgggtcgaattatcctccaaatttgcttcgtacaaataatgtcatcaaacccctctgtaagccaactgcgcgctctccgccggcagttgctaggattgaaactttgttcgaattcggggttcggaactggcagaaatggatgccggattcgtgatcatcgctagaaaaaattgataaaatcgaaaatttggtcatttttgggcaagatttgttaataaa

SEQ ID NO: 52188 - DNA, 4817 bp, Heterodera glycines
  Genomic contig location: Contig_ID=SeqID_3861; Location=2699..7515; Strand=-
  SCN-specific regions: Sequence locations=1-555,578-616,658-678,701 -871,894-1358,1385-1620,1642-1921,1943-1985,2007-2362,2387-3399,3421 -3639,3661-4518,4541-4706,4728-4817
  Gene Ontology: Mol. function=zinc ion binding; Cellular component =secretory vesicle; Biological process=cell proliferation
gccgtgcggtataattatttccgggccctcctcgtcgggcaaaacggaattcctactaaaatttattgctgagtgcaatgaactgatcgcacccagtcccatctcaattctgtactgttttggtgagatgaattcggcggttccgctactgcaaaaggcgggagttgaggtgtattcgggaggagctgattaggcgccttcccaaaccgatgctgctcattctcgacgatctgatgctgtcaatagaggagcgctatctgtccgatttgttcaccaaaaaatcccatcaccatcagtttgcggtagtgttcatcactcagaatctgtttgagcggaagatcaaggtggctcgcctttctgcgcagtatttggtgctaatgcgcgcgcccaactcgctgctgtccattcgaaatattggagttcagctttttccgcgtcaactcgattttttccttgacgcctaccgcaaggcgaccgcccgcccctatggctatttgctaatcgatatgcacgcatcatctgatccggcgcttcgcctccgcaccaacatatttaaagaggagcaggaggaggacgagggaacagttgtgttcatccccaaaaatggagcggtataaacggcaacaacaacgacaacaacaacaacaacaacaacaagctaaagttagtcaactaataaaagataatgccaactggctttgtgcactgtcgaaggcaaaatgtgtgaaacgatgcgggagactgatcagaaaggcgaacactgatcagctgctgtcactggtggaagtgtgcttgaacattgttgcttcccgattccgactgacaactcggcagaagaaacgactaatgccctacgtggacacggtgcgccgcgtgagcagagcgaggagcgagaggggcgctaagcgagcgcttgtcatccagaaaggagaggggtttggcggactatttgcagccttttaacccccgtcttaattgaattggccaaatcggttgtgactcgaaacacataaataccctcgtaaaattgtctcacacacgcattcattcattaataaaaatggcaaacaaattcattctcgtaccacaagaaatttatcggggtctcacctccgtctcgcagacgggagacctcaatttggacgcggttcgccacgacctggaccgggccaggggtggacagacaaatccttcggcgaaaaatgtgcattataaccagcagctccggcgttatttacagatgagaaaggaacatgcggacagaccaaccaaagttgagctgaccaagggaataagtgtactgatgaatagaggtggcgaagaaggcgaggttgttgataccccacgccgtcctcccgctcctccaccaccacctccgccgcctggaagacctcctcgtcgtccaccgcccagtcctccgggtggtcccggggctccttcgccaccaacaagtcctccgcctcgtccacaacgccccccgagaccgggcaggacttctcgtagaggaggtcgtatggagcaatggcggaaaaggcgatacgatatacaacaacagcaacggcagccgccgccgctagtggtgcgggacctccttgcggaagcagctgcggcgccactgcccgaaagtgatgatgatgatgagtatatgctagagaatggattcgcgctaccagcaccatcacaatactatggcgatttgcctgtgctgcccgacaatgcggaagaaattgaggaaatggacactgctcagcgcaggattgccatcagaagaaaattgaaaaaggacgaggctgatgctgatgatgatttgcaacgcaaaaagtatatgatgatttatcaacctccaccactgcctcgcgcaaaagtaaaagttgagcagccgaggcctcctacaccccggccgcgtcctaacgtcaagagagaacaacaacaaaagccaaagtcagaattcaaaccgccgtcgacatcaaagaaaaccggtcgccccactccggcaaaaagagtgccagagtttgttgatctcgatccacgaccatccacatcaaggcaggccgggtataacccgcctcccccgacgcccaaaataaaacatgagccgacaacaaagagacccatgccataccgtatcccaaaaagggaaccaaaagtcgaggaagcgccacaacagcaacaacctcttcctgctgccgctgttgtcgtcgaagaaatgcccgttgttcctccgcctaggaggggggccaaacgtcgctaccccgtatatgaagatgatgaggtgcagataagaaaacgagtgagacagccgagaagggtaagggtacagtactcacccgagccaggcccatcgacatctgcacaaagtgatgaacaacaacaacgacaacaagaacgcgaactgtttgccattccatcaaatcagctgaccatgactcagcgggttgaacggctatacatcaaatgcaaccattacgctgatcgtatgggcgttcgtggaaatacaattaacaccgcaaacggcaagccgttggcgcataccaatttgcgaatggccatccgctatataatagacagaagagcgggccgccccaccattagaccaccaggagcggccatattggaagaaaggcttcagcaggacccaattctgtattcatggacggctccaccaaagagaccgtcacagagcaaaaccacgcggacggcaccaaaaatcaaaaaggaatttcgtccgaaaaaatggagctgatcaacgcaacgcttgacaagctgtataacagtccatcgtcgcccgcggcgttcgcgggcgttaccgcgctgtggaaagaggcgcgaaaaagtatcaagcatttacgcaaaaaggacgtccagcattatttggaggggcaccgcacatacactctgatgcgcccccgtagggtgcgctttccaagggccagcaccgtagcggcaggattcatgaccgatgtccaggtggatttggccgattttcaagcgctatcgcgacacaaccggggtcaccgctatctgcttgtcgcggtggatgtgctctcaaaacgcctgtttgttgtgccactcaaaaataagagagccgaggagatgttggaggcattcaagctgctcatcgatcaaatgcccatggccccccaccgcattttctccgataagggaaccgagtttaagaacagattgctgaaggacttttttgagcagcgagaaattgagaatcatgaacccgtgcattcatcggtcaaggcgtcggtcgccgagcgggccatccgtaatgtgaaacagcggctgtaccggtattttgcggaaacggagacgctgaactgggtggatgcagcacagaaaattgtggacgggattaaccgctccccgtcacgtgcccacggaatgcgtccgattgatgtgggcttttccaatgctcagagggtgtggaagcgattatatgattatgcacaccgtgcaccacaaaaacgacgaccgacacgcttccgcaaagacgattttgtgcgcatgagcagagagaagggacagtttgagaagggctatttgccaaattatggcgacgaaattttggaggttgacgaggtgctgaaagcggttcgccccgttcggtacaagctacgggatgagcgcggagagaaattcaagggcagcttctatgagcaggagttggcgcgtgtaagaaaggatgcagagacgagctatcgtattgaaaaggtgtacagaaagagaaagagggcggatgggtccactgagatgcttgtcaagttcataggataccccgagcgcgaatgggttcacgagtcacaatttgttgtataaaagccccacccatataacaacatatcacattttcataaattttacgtgaaataaaaaaatgtcatcgaacagcttctttgtgtttttgcctagcaatgtgacggattacccggacaatcagcccaataaatttcgggtccggctcccaaagccgttgcattttaacggctcttgggtttgtgggctgcatagcataagctacccatactcatggtcaaccattggcacattggatgcacaatggattgacattcacttcacccagcgcagcacaatggatgaggacaggccgagagtgatccgggtgccggtgcccaagacatcacataacagggttgagcagctgagagacttcattgccgctacactgaggaaccatatcggtgcaaaaatgttgccgctccctcatgaagaggaggccgatcggaatcggacaaagccgcttggctctccaccgccacggaagagagacagaagagatgtgaacaacaccactcctccccaatcccccgtgctgtttgatgagcacggaaagcgactcgggtctcccccgttgtacgatccgaatgctggcgaagagcaacacatgagcgatgatgacgatgacatgcgagcacaaaaagggacactaattattgatccaaaaagcccgtcgcctatagcgacacccccagttccggcggttaaaccgctaacaacaacaacaacaacaacaccgactcctccagccgtaaaaccggtaacaacaacaacaccggccccccagtcgtccgcaaagccatcagcacaacagcaaaagccaacacctgtcccgccaaaaccatctgcccctcagacgtccgaaccaaaaatagcaacaacaacaacaacacccgcccctacaacaaagccagcaacgccaccgccacctaagcctaaaacgacagttgctctacagccaaagcaaacaacaccgactccaccacaacaaccaataacaacgccaacccctc

SEQ ID NO: 52189 - DNA, 808 bp, Heterodera glycines
  Genomic contig location: Contig_ID=SeqID_21582; Location=47..854; Strand=-
  SCN-specific regions: Sequence locations=1-78,107-274,311-358,411-808
atgattggacaacttttcgcttctgttctaccgcttgtcttgttcgccaacttaataaatggttagctttttaaagtgaatttttaatttttttttttttaatttagttggcgaaatggtccgtggtgggtcaaattcgctttctatgactaatggtggtgggccaccaattcagcaacaaaatccgagcatcaacctggtgacgaatgtcgcccattcacttaacaatctcaggctcaatccatcggcagaaggtaaagccttcggaaaattgaatttatttattcataaataaattatttttaatttagaaaatcaacatcaaccaacaccggtaaacgcagctcagccgaaaatgtaaaaataaaaaacattaaaaaattatttaaaaaataaatttaattattttagacggcaaaacccgaataaaaaaggtgtgaaagttggaagcaaaatgaaactgcaacaaaagcttaagagtggagttaaaagcaaagatttgggtgaaaagaaaagcaaattgggaatggcaatgtaagtggacgaaaattttgaaaattcataaaaaaaacgatagaaatttttgtattaacttattattccatcggacagaatggacaatcccaaaaatatcacgagactctcgaaaataattaaatttttatgttttcgaaaattatttctaattttttgggtttgaataaattattaaaaaaagctcaaaattataattcaaggttttatgtgtttatgctgatcagtttgttcgtgccacatacaccacatgtgccaataaatgtgatgctcc

SEQ ID NO: 52190 - DNA, 545 bp, Heterodera glycines
  Genomic contig location: Contig_ID=SeqID_21584; Location=330..874; Strand=-
  SCN-specific regions: Sequence locations=1-117,141-545
atgaattcgaatgataccattgacgacggccttttcacgagtcatttgaaggatcaaaatgcttcaaaaatggtcattttttgaaagaagaattgtaatcttgcttttttctagccttcttctatcagtgatgaagctggtccatcgtcatcatcaacaaaaactacagattttacagaacagccagagtaagaaaattttccgaattccgaaaattttactgccaaaattcaatgtttaatagcccatcgcaactttttaggtttaccgaattcaggccggagctcattgtgtggcgcaacaaattttacgaggtcgaccaagaggaggacgaggaatttgcttgggatgactttctcaagagccctgaacgacgcccattcgaattggacgagcaatcgacgtcggggcagtccaaaacagtcaatgttagggtcggagaaacaaaggttgttttaaagggcaattttcgattttagatggtatgatatggggcctgtttcgggaatctcgtttaatgagttcgagtttttagtttaattaaa

SEQ ID NO: 52191 - DNA, 1369 bp, Heterodera glycines
  Genomic contig location: Contig_ID=SeqID_21590; Location=1239..2607; Strand=-
  SCN-specific regions: Sequence locations=1-9,31-340,362-375,397 -465,525-539,561-669,705-949,989-1067,1090-1369
atgcatcggattccattcatccaacttttcattctgttgatcaacatgatcggaattgccaattctaaggacggaattaaaaatttatttgttgggaaaaagaacaataatgactatgataagtgctctgatcaattccattatgaagtgatcgaagatggcacaacagaggaggaggacatgaaaaaagcaattcaaattggcaaaacattcttttggcgagaaatgatagcaaaatgggaatgtgaaaatgaagatttgtataataacccgcaaaaaattggaaaaaaatccatcaaaaaattaaaaagaatttgtgaaaattggaaaatgaaagcattgtcagccgatgcattcgtgaaaagtttaaagtgcaagaaaaagcaaaaatattttatggtcacacttttaataaagattgatgaaggaggacagcctttaaacgaatgtgaattattttttgagaaaattaaataaaatatggaaataatttaaataaagaaaataataatttaattaattttggaaattcagtgaaatgtttgtgtgtaaagccacgctttcttgttgaggagggcgaactccaactgagctcagcaatggaagcgactaaagctgtttatcgggatttattcaaatggggaaatgggaaaggcttaaaaattgcggtaaaaatattttaaaaatttgaaaatcttatttaagatcaaatttgaaaatgagagagcatgggatttggttgacagatggctaaaagcattcaaaggcctccggattgaacaaaatgatgaagtcaatcaaatgttgaagaaagcgcagagcaaccaaattctattcaaggctgaaaatgctcttaaattcgacccatattttgagaaatttgaaaattcagaattttcgaagacatttttaaatgcgccgccacggtttaggaaggaacgtgacgaacataaaaattattagattttaaataatttaaaaaaatattgtttgctaaagagcttggataatttatttataccaaaaaagtaaaccgggaccgggacctaggaggaccgggaattcccgtcccggtcccggtcgcgctcaactctaatttataccaaaaactatttcattttgttttttattctcaaataatttcaatttgaaggcacattagcgtccattaatgaaatgacttataacgataaaaagaagaaccgttattatttgaatgaatttattaatgttgcggaagactacaaagaacaatgggactttttacagcagaaaaatttaaatgactatgaaaagtttgaagttttgaaacaaattaagcaagaaagcagcgttcaactttggcacatttcgcagcaacttggattgg

SEQ ID NO: 52192 - DNA, 215 bp, Heterodera glycines
  Genomic contig location: Contig_ID=SeqID_21591; Location=11..225; Strand=-
  SCN-specific regions: Sequence locations=1-215
atgcgttctaatgagacagtcaatcggaaagtccttttttcactaatgaccatttttttggttgaaacgttcggctgggtgtccaattggtcgctgagacttttgctaattcaattcggggccactgaaagcaccaaatggttcgtgatgagctatgctggttatgtgatgcaaatttccttggcactgaatgggccaattctttacgtgttgag

SEQ ID NO: 52193 - DNA, 119 bp, Heterodera glycines
  Genomic contig location: Contig_ID=SeqID_21594; Location=1185..1303; Strand=+
  SCN-specific regions: Sequence locations=1-119
aatgaataaaaataaatcaaaggttaaacattcacaggcgattaaaatatagtgtaaatgtggcacagaaaatttcctactcagaactcattgcttttagtaaaccctgaattcctttg

SEQ ID NO: 52194 - DNA, 2202 bp, Heterodera glycines
  Genomic contig location: Contig_ID=SeqID_3862; Location=3006..5207; Strand=+
  SCN-specific regions: Sequence locations=1-156,178-2202
atgcaacgactcgaattcgaggacgggagcgaaagcaacatggacccagcgaatgagggccatcgcaacggcgcacagcacgacgaaaatgtgcaggacggggatggtcccgtcgcttcaacgaacgaagagcaacaaaaagttgccagagtaaacgaagcaacgagaggaagcaacatggcgacaggcttggggacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcggcgcgactgttggccatggagagaggactcaaggaggcaactcaaatcttccaaggacatttcgagattggaatggcagcagcgggagcagaacccgcaggtcgccaggacttcttctacgacatactgacggcgccactgccggcggcaacgaaagagttgcagttgcgaaaccatccaacaccagctgaactgcttcaaattgcggacgagcacatcggagacttaaggacgatgcgactggcactcgaggatgaagaagaagcaatcgcgcggtctcgattgagcgggtcattcgggaccaacaacagccatccggtgggggacgacccacctccacccgaaaatcggaacatggaagaatgggagagatccttccaagtggcggccaaacgatggcaaaacgacggacaaggtgtacagcaacacaaccgcagaccaatgggacgagttgcgacacccgtcatgtcgaatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcagcaggctcacgtgaacgacgactatcgggagcgtcagacatacccgattcgacggcatgctcgagacgagggagaacatgatcggaagcacgggagggacgaaagcacggggatgacaacattcgagaccgttcggctacaaccaccgacattttccggaaagcccgaggattggacgacattttgggcctatttcaagcgagctgtggacgacaaacccattcccgggtttgaaaaacaattgcatcttctgcgctgcttaaaggagggatcaccagcccggcgggctgtcgaagtctaccctccctccgacggcaactacccggtggtcgtgcaatttttgaaagaacgatttggcgacacggacgatttacagcgggcaattcgggcccggcttcttcatttggcaccggcaaaggacaatgtgaacagcttgacgacgatgatcgacgaatttgagcgatgcgtttgccaactcgagcagctcggggcgaacgtggacgacgactcatttgggccattgctggaagccaagttgccagtgcgagtgctcacggaattgcggatcagagaaagcatgatgggatcgaaatggtcagtgcgcgagttcaggagagcggtgacggcacaagtgcggtgcatgcgatcagctgagtcagcactggcggcaatgaaagacccggaagtacgcactgatcaccgaaccgaacgtgatcatacgggacgaggaggcaaagcaggtcgggaaccatttcaaagagcatttatggtacgggacagccaacaaacccgtgcgcagcccaacggaacacgaaaagaagagcagtgcgggacgagtgcccgtttcaccgggcgaacagtggcacgcggcaacgagaacggacacacgggcgggaatggaccccgcttcgcgcaaaatgggctccctccaagcttcgggagggggaattgttcgttttgtctggagagcggacatcggccgagtgaatgccgcgcctatccgacgccgcaggcacggaggaagcgactaattgagcaaaaacgatgcctgcgttgcctgggctctgatcacacattcgaacagtgccaacgaacggtccgatgtgacgcatgtcgaaaggacgatcatcattggcttatgtgctggaagaaccaaccgggaaaccaatcccggccctccggtgaaccctaa

SEQ ID NO: 52195 - DNA, 899 bp, Heterodera glycines
  Genomic contig location: Contig_ID=SeqID_21596; Location=635..1533; Strand=+
  SCN-specific regions: Sequence locations=1-284,306-415,439-899
atgaacaaccgcaagaaacagacacaaagccaaacggacttgggatttgttgagttggaagaccctgaaaaggttgggaatggcactccaatttaatgtgccatcgtttgaattacgtatttttagatggaaattaacgggacaactttggccaaaagccttggcgacggagaacaggtcaaccacttttacattccgacaagcgaccggggggaaatcaacaaatgcagcgtcgaggaattggtgttgcaccatttcattacggtggagcatttcacgcacggattccattcggaggtggccaaaatcaaaaatactctgataaaagcccttcactttggttgggcagggcgccgtttggcattcgctctttcgccttttcttcactgatataatttttgacgccgatgttccgcaagtttggctttctcaaattcaggtggacaaacggaaattattatgcttttgcaaagtcacacattttgttcctctgcaggatgacccattggacttgaattttcccgacttttaccgtaatcggaaggcggcgattgaccaacgactccaagaaatccgttcgactcacaatctcgctggcttttcgcgtcacttttctgacaaagtcaaatcgaaagtcgcttcaaattctcacattttgtggcacaatttccaaagtgctgagcaaatcgccgtttgtctttctgcgttaaaatttgcttaacaattgccttttccagacctttttggcctgttgttcgccccttatgctccacgaccttttcaaagagttttgtacaaatttcaaagaaagtcgtagcggatttcccgatttggtcgtttggaatgaaaacgtggcggaaatggcggtcacttactctttggcatttgtgatgcactaa

SEQ ID NO: 52196 - DNA, 622 bp, Heterodera glycines
  Genomic contig location: Contig_ID=SeqID_21597; Location=1278..1899; Strand=-
  SCN-specific regions: Sequence locations=1-214,237-422,449-474,496 -523,555-622
atgacacttctgatcgacaattcaaaaatggtgacacaatttaacactcaattatggtcggtatggtaagccatcatggcttgaaggtaaaattgttgatggtaagaatttggtctggaaggtcaaaatccattctttgggtattgtggttaatcgccacataaatcaaattcggtcatttattcccaaaatcccaatttcaaaagattttgtcgaagagcagagaccaaattcgccaacaaagaccccgacgacaaagaacaatcagcctcatggttcgcatgacgagcaaccttccgttttggcacgtcctcagcgtgaacgacgcccgccgaaacgattgaatatcggcccaaatgctggcgctcgatatgaaattgagggataatttcatttaaagggggagatgttgtggatttgacaatttaaatatattttattatttattgacacgattccctgtgtcatcacttggaaatgtttatttaatattgaccttttcactcattcgggtcacttgccgttctctccttcatttttcatttcattgattgtctttcctccgtcatttatttatttgttatttatcatttatttttctgtttgtctttgctttaataaa

SEQ ID NO: 52197 - DNA, 919 bp, Heterodera glycines
  Genomic contig location: Contig_ID=SeqID_21598; Location=58..976; Strand=-
  SCN-specific regions: Sequence locations=1-101,123-284,338-423,447 -464,505-509,531-594,616-919
atgccatcatccgccaccggcaacaccacttcaacatcgacgagtgcatcgtcaacggcgtcgttgtcgtcaagcagtagttcaacaacattggcagcgtcggccgcagctgctgctgctacggcaccgccaacccaaccagcaaactcctcacaaccaacggctggagcatcaacaacggcaccaaagccggccagctacacgtcggtgatggtggaggattttgagaaccgggcatttgacaaggaccagttccgcttcaacaaactgttggacattcagcacaatgtaaaaatcagtgtcattattttgcatgttattattattttttgctttcctatatgccgggagcagtttaaccttgtgatttttttttcaattttttaggaaattttcaaaaaacttattgttcgaaagtttttataagaaagtttaaagaaaaaagtagaaacaattttcaagcgttttttttttaattatcataaattactaaaaaaaatttatccccgtttgaaaaatttttcatgaagttttttttaataaaaaatttccaataataagattttttgaaaaatctagcttaactattaagaaattatgaattggagccaattaagtggcctgaaataatttgaaaattcaatttttgacaatatcttatttgtgtgttcaggacatctatgacgaggtgttggacaagttgcccgaagtgtcctcggatgagggcagtccgtccgaccacaatttcatcaatgtcctttcgttggatggcggtggcatccgtgggctggtcatcattcaggtaactgagtgtgaaaagtgcactgccgatccgatccgacacttttcaaaagtttagataggctttaattaaaaatgaatggatttttttcggaaaaatgggaatggaccgaataaa

SEQ ID NO: 52198 - DNA, 608 bp, Heterodera glycines
  Genomic contig location: Contig_ID=SeqID_21599; Location=261..868; Strand=-
  SCN-specific regions: Sequence locations=1-83,113-178,246-608
atgccattaaaaattgacaatgccaaaagaatgcagcaaattgtgcctaaagtcaaagcatcagagaatgtgccaggatatttggaaaacaaaaatgaagaaaaacagcaaagaatttcattcaaaaattattttaatgaagtcaacgcttattttaactattatggtaaaaaagcggataattaaaaaaaataaaaattataattttcaggataattaataaatttaatatttaaattaatttagtgccgaaacatataattggactaattgctcttaaactgatcaatgcaattcaacggcacttgaaactgaacaatggtcaattggcacatgtgttgacacctgatcatttggtggctatccgtgttggtgatcaatttagcaagtcggaactgctcggaaatgctcaccttgaaatcgatgccgaaattcaacgcgtggaagacccacggcagagggcacttcccagcgctgatcaaaccaaaatcatttggctaaaagactttccgtatatgagcccacagcaaataaaagtaattctgatcagtgataactaaggaattaattaattttaatccaactaatttactacaattataattaaa

SEQ ID NO: 52199 - DNA, 1108 bp, Heterodera glycines
  Genomic contig location: Contig_ID=SeqID_21600; Location=333..1440; Strand=+
  SCN-specific regions: Sequence locations=1-90,113-187,219-808,830 -933,955-1073,1103-1108
atgtcaatgcttttatttgtgttttcaatcggtattttgacttggacatatgattatattgtgggaaatgcccatataaacctttccttaattaatgctgaagaaatatttcaaattcaacaatttttgggtggaaatatcggcgactttgtattatattgtggacgaaatgtgagttgagttcttcttatattttataatgtttttttttaaattttgaaggattattttctcggcaaaattacaatgggtctttattttgtcgaaaacataatttgttatgcggtaattgtcatttgtggatataaaatggtcagatttgtttacaaaaacttggacaaaagttcagcaagaagacaacaaattaaccgacaaatcacaatcaatttgattctccaggtaaaattgatgaataatttgaggtgaagttttagattattgtcggtttagtaaattagtatattatgtataacttaattaatacatcatgctaaaatttaattatatttaggcatttataccgttggctatgaatttaataaaccttataatttcggttgaaatggtgatttttgaattccaattgtccccgagttttgtttattcaaatgtgcatcactcttccctttcattggttgcccgtaaatttgtccatttgaatattatgaatttagaaatatttaaaaaatccgggatttatttctacacaagacgtggtttactctacctttcaggtgtatattaggcccctgatcccgaatctgagctctattgagtttcaaatcaattaaaatgtgatggagcagggttaaattttccaaatttcagaccctaaggggtcaacataccaatttccgagaaaatcgacaataactcaataggtattgattgatctgatctgaatataactttttaccatatagatatcgtcaaaatctagcaatttatatttattgtctcatgaaaagcatgagtttaaaaggggaaaagcaaaagtcatgattcgatgactaattaacatttaaaaattttgcagaaaatttgttaaaatagtgaattttttagttttttggtatttatgattattaaatttaaaaaaaaactttaa

SEQ ID NO: 52200 - DNA, 502 bp, Heterodera glycines
  Genomic contig location: Contig_ID=SeqID_21603; Location=83..584; Strand=+
  SCN-specific regions: Sequence locations=1-122,144-164,186-189,212-502
acacaatcgacgcgttggcctacgaagcggccaaggttttacagcggcagccttttcttttgtccgccgctggtggaggcggcgagaacggctcagtgatattggagaacggaggacggacagcggcagagggcggcggcactttgacaccgcacgcggcgtccgcgcccgggggaagcacggaccaccagcagcacaataacctgcaggtgctggcccaatcgagagtcttggtcatcgagtggggctttcctctcgagacttttgtggaaaatgtgccgtggcattcatttatatgggtattattttcgcattattcgtgttgttcagccgtttggctcttcactgggcggcggtcgctcctcctcgctgggtggcggttccgcctcttattttgcgggcggaaaacgcgactccaacgcgtccgccatcagcggactgtcgtccggcacctgtggacggatggagcggaacgaactcaccgacactttcgaccgattga

SEQ ID NO: 52201 - DNA, 482 bp, Heterodera glycines
  Genomic contig location: Contig_ID=SeqID_21604; Location=542..1023; Strand=-
  SCN-specific regions: Sequence locations=1-363,386-482
atgccaagtcatatggtgggaaaggatggactcacaatcagtgcagaaaatgcactgaacggtcgggactttggcggggtgccaatttccgtggaaccagcatcggaatgaaccaaaaaaggccttaatcaatctcaaattgtttacaaattatcatttttacagttttgttaatttgttactttttatatgctgtagaatttgttattttttctgcaaataataaagcgaatttacaaaatttatctgttaatgcattacgaatgttattaagtaaagagttatcggtcaagctcggcacatcagttatttatgaagaattcaagtccaatttcaagcattacgaaatgaaagacgacgacctttgaaatggcaaaaaagaaattgacactcattttctattaaagaaaaacctacaaaaattaaactgggcattagcagagcgtaatacctggagagaaatgttaaattttacaaataaa

SEQ ID NO: 52202 - DNA, 113 bp, Heterodera glycines
  Genomic contig location: Contig_ID=SeqID_21604; Location=1..113; Strand=-
  SCN-specific regions: Sequence locations=1-113
ctttatcaaacaatcccttaattaattatgtcttcggaacagtccaaacttttgctgcagaagcagttaaatgagttgaccagaaatccggtggatgggttcagtgcggggct

SEQ ID NO: 52203 - DNA, 797 bp, Heterodera glycines
  Genomic contig location: Contig_ID=SeqID_21604; Location=1204..2000; Strand=-
  SCN-specific regions: Sequence locations=1-615,637-649,674-797
atgaacgccatcggtaagaagaaagattaacagagtcagttggcagaagagaaattcgaagaatttaaaattacagcttttaatggattgggtataccaacttttttgcaaaacattgtcccaacgggtcaccattcggaatctaaccatcgtcggaatttcgaatttgccaactggtttttggccaagaaatctttcaatgatttaattaaattttaggcaccgatacgaagcaagtgctttgtttgttatggtttctaaataagttaataatttgctttatttataggtcaatccatccgttgtgcctaaactgacagaaaagggccttttgtttgttggtcagtgtgtttttcagtggatttttcatttttacgacgttttaattacctattggtatttcggttgactgtctgtcagtgtcttaattttttgtttgaattattctattttgtcagggcttggcattgatgagaattgcatcgtcaatggacaacaaaatggtgccgggcaagtcacgccgtccgctgctctcttgaaaattgttgagaagaatttggcggaaaataatgtaaatttgcaaaaattaaatacgggtgatgcggttttttataatttagtgtattaattttgtttggttggcttattgcctataatttcatttatttattttccttcagaacgaactcgctgaaaaggttgagaaaatttgtggtttcggtgccaacggctcatcattccccggagggactgccattcgaatggaaatggccgagttgccgcgcaacagtcagtag

SEQ ID NO: 52204 - DNA, 1341 bp, Heterodera glycines
  Genomic contig location: Contig_ID=SeqID_21605; Location=757..2097; Strand=+
  SCN-specific regions: Sequence locations=1-15,65-109,131-135,158 -542,585-986,1009-1282,1304-1318,1340-1341
atgaaacttcacgacaattataataaaaattcacaagtaaaattttttgaaaattattaataaacctcatcaaaaaataaatttagcacctttttcacaaaaattgcatcattaaatggtaagaaaatgtgtaagattaataatttaaattattttacaaaggattgaatcacagcaaaaaattcgttgtccgctgtgtaattgggaaccaacattcttaatggtaaatatttttttttttggatttttccagccgggccttaaaaaattcagagtagctgatcacgaatatgacatcacttttaataatccttaagccgaactcgagcaaaaaaaatcgaaaaaatcaatcttttcgatcttcgaatttcattttaatttagctttgggatcagaattggtcaaaattaaagggatccctttttaagaatgttagtggtaaaagccgtttaaaatgaaaacataatacaatataatgcttaaagctaattataatatcctttgtatttggtatttgatagctttaaagatttgtcaaaaacaataataaatttataataaaataaaaaatttatgaaaaaattcagaaagtcgagactcagaatttcagacaatagctttttaaaatgagctaatatttaaaattttagactagcttcataactattctcagaagcaagctaaaaaaatctacttactgtcttccgctagcccttccttagattctcaattaacccataaaatttcaaaaaattcgttagtttcttgttgtcatgcaattacactaaagcttgattttacaatttttaattaattcttctaagaagcgattttttacgtataattttttataaatttagaatgcaaatattactgcaatttttaatggacctagcgattttttgtcgaccttggccctgaatccgttggccaatttgttttcgattgccaatgggcctttggaaattgacaatttcaagcgaaatcaagcgcaaaattccattaagcatggcaaacttcttttacaaattatgggcaaagatttgactggcctaattttgctagagcattttatggatgtaactggattatcagttgaacacttttttgaaattggagctgatggcctcgaagaaaaaactgcagttcaacaaattcggaacaaactcgaaattgtcttaagaaagccggagatatctgtagacagaaaatcgtcggctcaggcaatcattaagttgattaaagtgatcagtaatgtctcgaacatgttagcccataaagattttgatattttgcaacatataagcgtgaaattataaaaatgttaaattttgttaaaga

SEQ ID NO: 52205 - DNA, 1250 bp, Heterodera glycines
  Genomic contig location: Contig_ID=SeqID_3863; Location=2019..3268; Strand=+
  SCN-specific regions: Sequence locations=1-192,214-645,668-806,828 -899,922-1250
atgccgaaggtggactttgactatttggacatgttttcacccatcttggtctgtttcgttggtatatatcattttcatttcctttttttcttgttcaggtggcatttatttttgcgctcatcctttttgtgagttctttttttcgtctggtcaataattgacctaattaggagtggacccgacaatcaattagcaattaaatagcaaaaaagccaatgaaagtcgccgaattcattaaaaagattttcttcttttggtgcacttaatcccccctcccgccataaaggaacttcgaacgaaaaaagtttaacgaaaaattcccaatacaattaaaaccacattccatggcactttcaaatttttaatttgatcattatttcccaatcccattttacagttcatctccttcacgtgcatcaattggtactgtatcacgcacaaggatgaccttacggtgttcgaaaaggtcggtgtactgtgtgatcggtcacacattctatacctaatttgatcactgatcatttttgggaaaaattagagctcgacattttgaaaaaaacatggaaagggattcctggacaaaatccaagaaaatccaggaaaaattcaggtgcctacgtatccccctgatcagtccccctcccgaaaaaattaattttttttataacacataaatctttcaagaaaaaaaatcttgaaacttgtttataagaaaattccaagaagaaaaattttcataaaatttatttgaatcactaaaacttcaaaaattttctaaaaaaaaactgcagaaaaatttctgagagttcttttttcttggatttcttataaaaaaaactttttaagatttcttgaaacgagctgctcccgaaaaatcaggttgctgaaaatggcacctggatttctgggcctggatccaggaaaaacacaggcccttgtaaaaatggcacttattttccagttcggcacccgcttgaaccttcgtcttggcccccattcaatggcagtgatcaaacgaggcggctacgcgtccacctacgcccgcgaggaggcaaagcggtcggaatgtaccggaccacaacagcaacaactgaacacgcttggggacggaaaatgccaaattagccacgcttgacaaaaatgattggcatttttttcaaaatcattttaattttgatgaaattttctatgggttttcaattaaccaaagaattttttttatgccaattaattcctcttcttttaatgca

SEQ ID NO: 52206 - DNA, 2171 bp, Heterodera glycines
  Genomic contig location: Contig_ID=SeqID_3865; Location=1018..3188; Strand=+
  SCN-specific regions: Sequence locations=1-744,766-894,916-991,1013 -1634,1656-2171
  Gene Ontology: Mol. function=signal transducer activity; Cellular component=plasma membrane; Biological process=invasive growth
atggctttttacagcgctgccgactcagaccgacaaccacaaggacaaccagcgccgcaacaaccaccacaacaggaagaactggtgccagccgcttctccgccggcagaggaaagtgttgcgccaaacaatcagccggttgtaccaatgatgccagcctccgctgggcccgagccacaaaacgaacttggcacgcagcatcaaacttcgccacctccgttaccggcacgggcaccgccccaattgcatttccaaatccgcaacctgggccccaacccggagggcattcccggctttggtgccaacgagtacaagcccaacaggaagccattgccgtcagctgccaaggaacagtcgccggctggcagcgctgctgctttttcacctgctccggcaccgcctgttgtgccgctagccgttggcggttctgctaatccatgcggcactgtggcagtgccgccaccagccgttgccgtgccatcatcagcggctggtgccgaatcaacgtatggtggcggaggtgagtatgtgtgagaagctctcggcttctgatcagagcattaattggtcgctcatataggaattgttagtcatttgatcagaggatgtaggtaaaatccaaatgattgaaacaacttgactgataattggtcattttatttttccttctttctgatcaaatgcgctaatatttcggctattcagttttaagctcaatttccgatcaaatcattgttatcagataaccccaaccattcagctgagccctcagccgctgcttctgctgtcggtgccgcggcaccagcaaccgctccgccagccggtggagacggcggttccgcagagacgaatgtgccgacaacagctggtggagtaaccgcatcgtcggctgtcacaacagcagcagctgtatcatcacccataacagcggcggcaccgcaagcttcatccggtgcgccatgcccgtcttctgcagcaccgttgctgccagccggtggccctgctgagcagcaacatgtgccagtaggtgtggaggtgaagccggcaccggccacggcacagattgggcccggcattgccgctgactacggcgaagagacaaacaacggcgccgcgtcgccatcgggtgctgagccacaaccggccactgtcgtcagtccggcgccaggacaacaagcaacaacagtttgtgccggaataagtgccgctccggcagtggccgccccgtccgccgcgtacggcgcggaagaagcggtcagcggcgatgggcccgcttcttcttccgacactgtgccgccttcgacgccaacgtctccatctgctgagggcggcgctgcttcttcgtccgctccgcttaccggaaccgcttcggccgttccaccgctttccgccactacgtcgtgcccctctcctgctgctgtcggaagcgtttcccctcccgctctacacattggcggtagtgaagcagatgggccggcttcagcagcagttggtgcacctgcagttgcaccatcttcaggagctaccgcatctgcatcttccggatacagtgaagaatccgcagcttccgggagcgcttctcccgctccgtccttgggcggcatttcttccgccgctccgttttccggaagtggcgcgtccgcagcgcccggacacgaacagactgaaagtgaattcgcttccggaagcgtttcatctgttgttggagtttcttccgccgctccgtctcccggaagtgccgcgtccggatcgcccggatatgttgaagaaggagccgcttcagtttctgcttccgggcctggcgaaactggtggaccgcctcctgtaagtgctccgtcagctgccccatcatacggaagtgtttctgccgctccgcgtgccggaaatgccgcatcagtctcacccgaacatggagaagaagtagccgtttcgcaatccgtgtctgaaactacttcttccggaatttcttccgccccgacttacggaagtggggcgtccgcttcatccgctgccggaatttctcccgcggctccgtcttccggaagtgccgcgtcaatttcgcccgaatatggagaagaaattgacttttcggaatccgcttccgaaagcgcttcttctgcttcagccgcagccggcatttcgcccacggctccgtcttccggaagtgcagc

SEQ ID NO: 52207 - DNA, 574 bp, Heterodera glycines
  Genomic contig location: Contig_ID=SeqID_21607; Location=156..729; Strand=+
  SCN-specific regions: Sequence locations=1-333,355-434,456-574
  Gene Ontology: Mol. function=ligand-dependent nuclear receptor activity; Cellular component=nucleus; Biological process=neuronal remodeling
atgcattcctcttcaattgatttgcattctcatggcgctgtcggcatttgtgccgtctgcggtgaccgtgctgatggccaccattacggcgtgctttcatgccgcggctgcaacgcgttcttccgccgtgccgttactttcaatttgcagttccattgcaggcgtgacgggcattgcgacatctccaaaagtaagagaattgaagcggtcatttctcagtctgcccacaaccctttgacatttgtcagatgctcgttgtgcttgtcgcgcgtgtcggctgttaaagtgccaatccgtcggcatggatcggtcggcggtccaagtgcggcgcgagatgaaaaatgtgttggttttaggaaacgcacagaacgcagaaggtgcgaaaccgtttaaaatgttaattgatcggacggacttccatcgaaataaaccaatttgaatacaaatttcagttccaacgaattctgcggattttcttctcctttcgccccctcaggccgatggccctccgttccccacaaatttgcaagtgttgggcagtgggaaaacgctcgatttggtaaagattaagtaa

SEQ ID NO: 52208 - DNA, 1289 bp, Heterodera glycines
  misc_feature (992)..(992): n is a, c, g, or t
  misc_feature (1015)..(1015): n is a, c, g, or t
  misc_feature (1042)..(1042): n is a, c, g, or t
  misc_feature (1050)..(1050): n is a, c, g, or t
  misc_feature (1057)..(1057): n is a, c, g, or t
  misc_feature (1066)..(1067): n is a, c, g, or t
  misc_feature (1116)..(1116): n is a, c, g, or t
  misc_feature (1170)..(1170): n is a, c, g, or t
  Genomic contig location: Contig_ID=SeqID_21609; Location=663..1951; Strand=+
  SCN-specific regions: Sequence locations=1-243,265-537,560-781,805 -1020,1042-1289
atgcattttccgacttacagttcgggtggttggttcccttgtaagaatacaaaaacgaatcattggcgatcgaatgtcgtctacatttttttttttgcactacgatttcttcacccatttcattttttgccagatttgtcgactggttcagctaccatttgtcaaactttgagtatcgttggtcatggagtgattggattgaatgtgtcgaggttcgtttttttttttgaaaaatctgttccattatttcgatttttaattttcttaaacctccctcccaaaaatgtttttttaaattttcacagttggattcattgcatccaaagcgcatttttgtacgtgaagtcattgaaaagtgtttgcgcttttcctaccacaaaaaattggtcgaatttttgccctccgaattggcaccgatcattccggacgagccgaacatcatttacattcttgacgaccgtcagtttttgcatattacccattttagaaaccttggtgtagtaccaatcaaccagtcatgccaatttccaatggaaatttgtttttccaatacaaaaaagggttccagtttttttttcggtctacttttggcacacgattgtcagttttggctcaaaaattagggttcgattaaacgactgctcgcgccctaagtaaaatttttgcccattttcagcccaacatccggcatttaccaaggccgaacaattccggggcctcatcatgaacaaggctgacgatcaggaaattttgagcgcccttcgaatgccaagcgatgaacctggcggtggtggtggtggtgaattttccaccgatttttccatcgatgcggtcgccatttttttctccgttttgttgaagctgtcttcgcggacaatgacacattcatttgcggcactgacaaggtatgtagggaaatggaggaattcaaaaaaaatccttggaacttttttcataagaaaaaattcaagaaaaattttttggcaattttncaattttatgatgaactgctaancataagttttttcaaaaaattttccanaaaatcgnctggttngaaagatannaaaaaaattttttggagaaaataaagtgcatgcacccccgcacgaattncactcatttgtattttatttttttacagatacataaacattgcactgatgacgntgacaatgaggaaatgcatcgacattctcagacattgtgagaaaattgaaaatttttatggtcggttaatccaatttccaggaatgaataatggatttgctaacagtctcattatttga

SEQ ID NO: 52209 - DNA, 68 bp, Heterodera glycines
  Genomic contig location: Contig_ID=SeqID_21609; Location=90..157; Strand=+
  SCN-specific regions: Sequence locations=1-68
tacgtgttcttcaaagatgtgaagcttgtccaccattaccatcgtactgattaacaaacagcagcaga

SEQ ID NO: 52210 - DNA, 909 bp, Heterodera glycines
  Genomic contig location: Contig_ID=SeqID_21612; Location=86..994; Strand=-
  SCN-specific regions: Sequence locations=1-268,291-909
atgtcggaactcattcgtcaacgtctcaccgccgaagtccgaaccctttcggacctcgtcaagcgcctccgacaaagggtcgggaggctcactgaattcaccaggatggcgccagaggaaatcccgctcgccgaggagaccaaactcgccaagggcgtacgaactgaccgacaattgctacagagaagcatcgaccgtgtcaatggcatgctacaggaatgttttgaccacattcagcggctaggcgacccgtttctgaagcaggcggaggaggacctcctggccgcactcccgaccttcgacgacgagcaagccgacccaaatgtcgaagaatggccgatcatcactcttctctctaaagcccagctcatcctcgacggcctccaagtctacatcgaggctcgattcgacacgacggacgccatctcttctcgcagcagcagtcgtgtttctgatcacggggccgacgacgaaaaccggatccaccgccaacggcaatccaccgacccaccggctcaggcacagcaagcaaacgcacggcagccttccaattcggctcgagccgatcaaaacctattcaaccagcgaaccccggcattcccgcttaatctcacatttccccgagcatcgaatcgccccacccatcgatcggaacctcaccatggccacttccgacagtcgaccaatgacgacgacgcacttcgggtcagccgaatcgaaatcccgaggttcagcggatcggcagaagaatggatcacattttgggccgcctttgactttgccgtccactcacgccaataccccgccttccaaaagcacctcctcctcctacagtacctcgagaagggatcgccaccacgacggatgattgaaggttacccaccgtcagacgccaattacagcacagtc

SEQ ID NO: 52211 - DNA, 234 bp, Heterodera glycines
  Genomic contig location: Contig_ID=SeqID_21612; Location=1254..1487; Strand=-
  SCN-specific regions: Sequence locations=1-234
ttcactttcgaccatccgtcactcttctctctgccgccagccgaccctttaggctcccggcaactcaacccttcgctgtccgacgaccatcttaggcctccggcactcatcactcaactcaagtcgccagccgccctttaggctcccgacaaaccctcaccgagtcgtcagccgcccatttcaggctttcgaccattcatcactcttctcccagccgccagccgccctttcagg

SEQ ID NO: 52212 - DNA, 396 bp, Heterodera glycines
  Genomic contig location: Contig_ID=SeqID_21613; Location=79..474; Strand=-
  SCN-specific regions: Sequence locations=1-396
  Gene Ontology: Mol. function=extracellular ligand-gated ion channel activity; Cellular component=integral to membrane; Biological process=synaptic transmission
atgaacggctggaagttttttgtggcatttacatcgaatcactgggcaattttaaggcggcggaaatggcaaattttggcacttattaatgcgagtattaaattaatcccgagcaattcacagagttttgatgccgatttgtacctctatctgagctggcaagacccctcattggcccattcggacagtgattttgtccttttgaatgacccaaaaattcgccattacatttggtaacattcaaaattaaaaatacatcccataatttgtgctcattaaaggctgcctgacctttattttgccaattctcgcaccagtcgtttccacgaagtgattgcaccgaatttaaatttatttatcgaccgaaacggcacaattgcctattcgacacggtaa

SEQ ID NO: 52213 - DNA, 277 bp, Heterodera glycines
  Genomic contig location: Contig_ID=SeqID_21616; Location=1981..2257; Strand=+
  SCN-specific regions: Sequence locations=1-66,88-221,246-277
atgtctttgctcgccttcctcacttatttggtgttcatcgttaccaaaatcgacaaaatgtgcgttttccctttcatttctcacttttgcctctttcccttaaggatcaatgatcgtgccaatttgctcgcttctttgtacgtgctcctcatgttcttcttgatcacttattcatatccctttttgccggggaatgttgaaacctttcaccaccaaagtgtcacatttccattttctgttccattttttcattttcagatcactccaatcattctga

SEQ ID NO: 52214 - DNA, 973 bp, Heterodera glycines
  Genomic contig location: Contig_ID=SeqID_3866; Location=1789..2761; Strand=-
  SCN-specific regions: Sequence locations=1-861,883-973
atggctcgccgtatggggatgaacttcgacagtttcgtcgctctcgcagtacgcgcagaagaagtgcaaaaggccacgaaatcggctgagtctggaaacaagcaccgaccaaaatttcaacagaaaccgacatttcaaccacaaaaaattttcgcgccaaagacaaaccgaattgtgtgctacaactgcaacaaaacgggacacatttctcgccattgtaggttgccctttgcgcggaagcaatccaactgtgcacgaaaaccgccacaacaaaattttgcgacgaaaagtgccgattttcgaaaaaattcagaagctgagaagaaattgattgatttgcggttgtcgaaccaaccaccggcacaaccaacgaacgtggaagctggaccaaaacggaaagcgtccaaccgacagcgcaattcgtcgtcaagttgcagcgtaaaagcaacaaaaatggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaagtgaaaggacggaaagcattcggaaaattggggacaattttttcgccgaaggccggggaggaattggcggatgtcgcagccgccaatcttgaaaatttgttgaaaatcggcaaaagcatgaattttccaattgctgatcgcaaatgtgcgcaagaagctgacactgatggaattttaaggccagaaaaaagggcggatttccgttttgtccgttgcttttacagatctgactctgcaacgcgacttcgtgccgaaccggtccactgctgacacccttgccgcccctttcaacgccgaatgcactaccgatgagcccaaagcgctgaggacatcgcttcttagagggcgaggatgtgatataattgtgatttaa

SEQ ID NO: 52215 - DNA, 661 bp, Heterodera glycines
  Genomic contig location: Contig_ID=SeqID_3868; Location=1070..1730; Strand=-
  SCN-specific regions: Sequence locations=1-9,34-36,58-241,264-359,381- 490,542-630,652-661
atggagccttttgtgtaagacaataacaatttactgaaaacattttaaattgcatattttgcaccattttcaggaatctttacgacttttggttgggcataattccgttttctgactcaattcggcatttctttcattttgtttacgatgcattggaggcaaacttttaatggcataactaaattggcaatttggaaaacaattgtaattgtacgcttattgaatggtgctgctggactcaaaattaacacagatattttaatattaatgaatgaatggcagcaattaccaatgccaacgcatccgttgcctaaaaacatataaaacccattttggctactttatttatcaagttcagttttgtgtttgctttattttttgtccttatttcaacaatcggatatattatagcacctaaagaaattcttcccgacggtgccgattggcgcgccgaaagaaggaattggcatgccactttgcttcctccacctttaatatttttcataataagtaaaaaaaatttaattattaattaattttactcgaaaaaggcgacacataaaatgcgtatgtttttacatacatttgtttatttgttttcaattttatataattagaattttggggaagaaaaattatttatcaaaaagtcgtaaataaa

SEQ ID NO: 52216 - DNA, 771 bp, Heterodera glycines
  Genomic contig location: Contig_ID=SeqID_21620; Location=214..984; Strand=+
  SCN-specific regions: Sequence locations=1-86,108-127,198-295,317 -359,396-719,741-771
atgacatccaaaaatgatgtcacttttcttcaaaaatctccttcaatgagcgatatgaagccccttcgacttcgtagaccaagcattgtcagcaccagcagaagcggacttgggaatttgggagtggtaaaatacaaaatattacaaaaaaatatatatttaaaattatttttaatttatttcattatgatattttacctcttcattagagtttcgaatgttgagtctgtcaacataactacaagtataatgtaaggattgttttcagcaatgtttgaaatcccgacaccgaactttttggttattttttagggttatttccgacctcgagactttttttaaagacgggcttctacaaattaaacattaaaatgtttttaaattccttaataattgaaaattaataatgtgaagctttcctttttttaattaaagatttatctatggatctgggattaattacccagtaattagattaagccattaattaatggttattaattacattaagccattaactcgtcatctatcgattgaaccaccggccaatttggctgatgccttgggaatgcacaatccaaattgggctttttatcactacagttcgcccaattatcggtcagcgtggccatggcgaatgttccgtgaccgtttcgatgtaagaagcaattggcaaaaatgcaaaaccaaattaaatgcattttttgacaaaaaatcgtcataattttctcgaaagtaatcaaaaaatcactatatttttctattaaccta

SEQ ID NO: 52217 - DNA, 228 bp, Heterodera glycines
  Genomic contig location: Contig_ID=SeqID_21620; Location=1113..1340; Strand=+
  SCN-specific regions: Sequence locations=1-72,112-159,212-228
atgtacaataagcacttctctgtgcagcccatctacagaaatgtgccattgaatgtgccatcgcacagaacgtaaaaaatatttttaaaaaatgaataaatttcttatttagcaatttttccaaccaccaaagagctgggtattggtcatttgactacgattatatgtaaattatatttataatgaatatttgtttagttaattaattaatggaaccacattaaatta

SEQ ID NO: 52218 - DNA, 595 bp, Heterodera glycines
  Genomic contig location: Contig_ID=SeqID_21622; Location=157..751; Strand=+
  SCN-specific regions: Sequence locations=1-180,220-347,369-430,452-595
atgtacaagcaacacgcgcaagcactgttttccgttttgtcctcctttttgtgcagtgttggcacgaaagggacagaaaaaagtgactgcaaaacgacgcatttggacaatgcaaggcaaatgtacaagcaaatgggggtgagtgagcatcgttcgaaaaggccgatgaattaattggtttcaaataaccattatttttcttgctataaattttttaaaccctataacattgtttaaatagcttaactacattttttatggtattgctggctgaatgtttgccttatagcttcatagtttcaaaaaaaaattagaaaccaaaatgaagttaaaaaacggcgccgccgaatttaacaaataaatccacaaaatagctttctttttacgattgcttcaggtgaccgacgagcagaagattaagtcggatatgcttcttgcgcgtcggacagtgttcaatacgatcattgcgtacaacgacgccaaaactggcgaggcagtgcacgcggcgattgtggcagtccgtgctgtgattagtggcggaggggacgcggcaaacgcggccgtcagctcgagcgagttgaccaacgagtactaa

SEQ ID NO: 52219 - DNA, 1845 bp, Heterodera glycines
  Genomic contig location: Contig_ID=SeqID_21623; Location=63..1907; Strand=-
  SCN-specific regions: Sequence locations=1-349,371-465,487-671,714 -1012,1045-1710,1732-1845
atgccttcaacaaatgcaaatgatggcatcacttccgccgatgatgcgactcgattgagaatggttgacccggtcgatcgttattcagcattaatagttcgtgtaagttaatcctcaatgttaatgcttacaaacctctaataaataggctattcatttaggggctgatagttggaacgggtgcgcttggattaggacttttcattcgaaattcaaaattggtaggtattcttcaacaagttttttgaaatgcaataagttaggtaagcagtttttctatgcattatttttttaaaaatttagtttgcagcttttaaccacgtgaagcaaataccgcaagattattatcagaaaggaataattatgaaaggaattgtgcgcgatttggagtcaaatggcataatcaaagtggaacatcgaccagcaattcgtattcctagactttttggtaccaaaaaatcgaaagtggtaagaattttttaaagaatagtttagtggttgactaaacggttataattatagtgtgtgtgctttgccgcctttacatttttcaaaaaatagtaaaaatcctagaattgttcaaaacagcctctttttgtgggaccagtaaactatacattcaccgaatccggttttcttccgaaaaaattccggggcctaaggcatattgcattttatacatttaaaatattttcattttaattctttaatttggtgctgtgctcaaactttccctgcagaaaacttagtccacttgcataaacttgatttagttatttttaaacctttttttaaatttcgttcgtcgattgtttttttcagtttattttgccgttttagggtggaaatttgaatcttcgcttggctggaattgaattatcccctgttggaattgaatatttgcagaaggaaatgcaattgaaaggacgatttgtgaaattttctgtgataaaattagcacaaacggaaccggacattgtggaagcggacgttaccgcaaaaaaagttgtagaaaaaaaaaaaaaaaagtttttttaaaatattcctgcaaaattataatgtcgaattaaacaatttccttccttttcatgctatccgtcacgttaacctcaacaccgaactcatccgcaagggtttcgctcgtacgccaactctcgacaaccattggcacagagagtcgctccaattcaacacgaattattcccgactgatcaccaggctgttgacctgtgagaaggtgcttttatgtgccgatttaacaaattgtttcattttttaggttgccgaacgtcgcggacttggcctttgggaacgcgccacttgggttgagcgtgttcagtcgtacccatcgacggcagtgcaaattttcaaacactccgtgcccgccaaacttgcggtttatataaactgagttaatccttcgtaaaacaattaaattgtttaggtattcagtttcgagttgctcagagatctgtccatggttctgtactccatcgcccagaacatttattttatttgcgtggaactgttcaaatactgcgcatttggttaccgaaaattgtccatcggaatatctaaggcatttttgatctacacaaatgccaaaagacatctgatccaaattggctcaaaaatcggcgcgcgacagtcaccggcggggcgagaaattgccgcaacggaagaagaacaacgcaaatagaaaatcccaaaatttgaattatttgtttaattctgctcaattaacaaagtgatcaggaatatattggacttttatgacttttattaggaaaataatttgccttaattgtttgaatacttaaacaaaataagaacgaaccaaataaa

SEQ ID NO: 52220 - DNA, 1121 bp, Heterodera glycines
  Genomic contig location: Contig_ID=SeqID_21624; Location=709..1829; Strand=-
  SCN-specific regions: Sequence locations=1-115,142-733,771-1121
atgtatccaccgaaagacagcgacagcaacttcttcccgaatcgaatgttgagtgtggacagaagccggagcagcagctcccatctcgtcggtctcaatgctgctctggtgctgtgtgctttttgtttttgttgctcctctaatgactgactaatgaatgaatgcactctcaattaatccaatcgcaaaagagtccaatcatttttgttatgagtcaaattactttgggttttgttgaccgttgtgactttgtttcatgtgttaatacagctatttagctacaattttggtatcattcaaaggcattaaatccgtctaacttcttcagacttaaaagtcatgaaaacttatttccgagggttttcggggtccctaatcacgggcatccatttcgaccaatttcgagccccgggaatgcattagttagaaccccatatataattatgttgctatactgttaaacaattttgattttgtcccatttttttgctacagcaaggctgccgttcggacattccgttcatgttgcagcgtgtctcattttccaaggacatcaaattgcatcggatgcttcgctatctgcgcgcttgcttcgtccgtgacatccgtgaacacaaccgtggcttcaacaatgggacccaacaaaccacaaaatgccaaccggagatgatcgaccaaacgaatggcgtggtaaataaaatgaattacgacgaataatgatgacattttttggaaaaaaaaaatatttttttttgaattttcatattttagttgaacaagcgaagctggctggagcagaacgcctactttgccgagaacaattgcttctacccattctacggccaagcagtgttttacgcatcgtttggccagcacagtgagggacgggtggtgtgctgcagcgatggacgcattgatgaggaagagagcttcaaggaaaattgcaagaaaatgacggatcacatttacgcagccaaagctggatggcgcaagggaaaggatgcccaatgaagggacgaaccgacgatgattgatgatgatgtgattgatgaatgtcaatttctatgcatattcatttagcaaaatattgcggttatttttgtcttaaatactgtaataaa

SEQ ID NO: 52221 - DNA, 550 bp, Heterodera glycines
  Genomic contig location: Contig_ID=SeqID_21626; Location=108..657; Strand=-
  SCN-specific regions: Sequence locations=1-138,196-235,258-409,445 -512,536-550
atggctgggatttattgtttgtttttttcaggtaagttttaggcacttaaacacattttatcaacccaattttcgcaaaagagtgacttttgaacaaaaaaactatgctaaaaaatttaaaaatgaaaaatttcgccgaaataaaaaattttcaaatttatttaaaacaaaatttctataaaatttcatataaaaggatcattgattgtgagaaagtttaaaaaatatccatattttggacaatttttggcatttcaaattattgctttttagtatttccggctatgaattattcaagaggcatataccgacgtagtaatgaaaaatgaggcaatgatcggaatttttcgttttttaaggctttctcatacttaaaatttataattcttggaaagtaaatttgttaaacaaattggaaaaatttcattttattttaagaaattacagctaaaaatcacaaaattagtcatctgttggacgttatgtgaattaattttctaaaatgagaggcttttgtaaatttccatctctgcaattatcgataaataaa

SEQ ID NO: 52222 - DNA, 995 bp, Heterodera glycines
  Genomic contig location: Contig_ID=SeqID_21626; Location=722..1716; Strand=+
  SCN-specific regions: Sequence locations=1-345,372-503,549-565,587 -626,648-995
atgatgatttatgcatatgcaatttcttttgttattcatcatttcttattgtcattttcaaatgcagtgccatcagtgagtttctcaacagaagtaattaattggggtaattaactcatgctaattaggttgacgacagcgcactaattgcatttatgaaaagcgatcaaaaaggaagtcaaaccaatgactataaatattcaatccaaaaatatgaggcccatcttggcattctgcattttatggtgaagaattggcactgtgacaaaatgggagaccaatttgagggtatgggacaactcagtctaatgccaactccgtcccaatgcttatggcaaacattgaaatatttaaaattttgtttttaacattactatttaatagtgatgctcgagagtcttggcttcgagaaaccatcgggttttttgggtcacggcttcgagtctcggggtcgactctgttcggtctcgagcatgactattatttaaacatatttttggaggaaaattaaattcaagaaattttaaaaatttatatttaaaaataaaggcattcttaaaataatttttacaactttgcatttttgcccgccaaaaattctcaaaaatagcattttttttttgcataattttacaaaaaattttcccaggacccacagtacaaaatttttcaagagcgagactttcaaggacgcggaaaacgcgtccttatatattttgggatggtcttgaccagactgaggtgacccaacttgggaatttggagactttgaacggacagaatgccacaaatatcgccaacttttggaccttttgtacgaatatttgtaccgagaatattttgacggattgccaacagtgagaccaaaatttgtacttaaaaagcgacgagaacaatttgaaattgaagccccattaatttatgtggtgaattgcatggccagaatctcgagattttatttcaattcaaattgggccgagaattctgaatggaaa

SEQ ID NO: 52223 - DNA, 190 bp, Heterodera glycines
  Genomic contig location: Contig_ID=SeqID_21626; Location=1822..2011; Strand=+
  SCN-specific regions: Sequence locations=1-11,33-190
atgaaagtgccaaaattggaggaggacaaaaagaaagtgccaagatgggaggaggacaaaatgaaaatgccaaaggacgacgacaaaatgaaagtgccaaagttggatggggacaaaatgaaaatgccaattaatgaacggattttgcagttggcaattgatgtggccaatcatgatcagacaaatgaaa

SEQ ID NO: 52224 - DNA, 631 bp, Heterodera glycines
  Genomic contig location: Contig_ID=SeqID_21627; Location=293..923; Strand=+
  SCN-specific regions: Sequence locations=1-77,99-593,628-631
atgaatattctcactgtaaagcttctagaaaacaaggggataaagtaagtcacaaccaaatctttaaaaaaatagccgccaataacagcagaaacccaattaatacaagaaccaatccacccacctaaacacaaggcattgccgatcaggccgaatatgttccgaaattgacttcacttgcggctcttaaatgaaataaaatagaaaagcatgaaaatatgagaccgaccaaagcccaaatcgaacattcggtcgacttcgtcaaagacgagaaaagttgtacggagcaaattagtcgcctcaatttttaccaggtcaatgatacggccgggcgtacaaatgcaactgaacaaaaaaagcaaggcaattaggaaaagcaattagtaattgaaaatgaaaggaaataaaatgaaaaaacattaaattcaaaaataatgtaattaattttacagctctgctccctgctccagcgccttctgttgctcatatttcgagccaccgccgtaggcgcaaacaacagaaatgttgtacggcacgcagaatttacgcgcctcgttgtaaaccttaaattaatttttaaagaatgaaatggtgggcaatttttgaaaaattttaatcaagttttttctta

SEQ ID NO: 52225 - DNA, 2167 bp, Heterodera glycines
  misc_feature (1146)..(1146): n is a, c, g, or t
  misc_feature (1155)..(1155): n is a, c, g, or t
  Genomic contig location: Contig_ID=SeqID_21627; Location=1..2167; Strand=-
  SCN-specific regions: Sequence locations=1-371,393-474,501-1213,1279 -1777,1799-2167
  Gene Ontology: Mol. function=RNA helicase activity; Cellular component=bud neck; Biological process=mRNA splicing
gtttatggacgaatatgccaaacggcacgaggaagaggacggcgaagtgtacgaatatgacgaggacgggaacatcatttggacatggaagaaggtcttacaattgactaggaccagagaagatcgaagaacattttgaatggccaggggtggactagctattcccgaaaagtcgagaccagggatcataaatcttcctagaattttcctttttctctaaagtcttcaaatgaattaagatcatcgacccattgccgccaattgaccatgctaacattgagtaagtcagccaatgagtgcaaataatgccaacatttgtgtgtttgtcccatttttatgagttgtgtaattttaggtacaagccattcaacaagaatttttatgtggaacacggcgaaataaaggcactcagtccaaaggacgtgttcgaactgagaattgcgcttgatgtcagttgtactcccccccccctcgaattatttttaaaattaaatatttttgcgggggaattacgtaatcatttgttctgactacaaatcctggtgccaatttcttggcacatttttacatccattgtcagatccgagtctacggcaatgatccgcccaaacctgtcgtcagttttgcgcatttccaattcgacaaagtgctgatgtcgtcaatatgcaaggcttcgtttgagaagccgacacaaattcaagcacaggtcataccgtaaacatcacagtttcaatggtattgtaggcaatttgaaatgtttaggctgtgccagccgcactcgccggacgtgacgtgttgggcctggccaaaacgggcagcggcaaaacgctcgcatacatttggtaaccggtggaaagcatacagtaatcaattcatacggtttaggccagtaatttgccacattttggaacaacctgaactttgtcccaacgacggtcccatcgctttggtggttgtgccaactcgggaattggccattcaggtcgctaattcattcattttcgggaatcgtagtctgaacaagcccataacttaaaaaaatctcggaaagggacaattttctccagtattatattaaaatttcagtgcctgagagcaaaaaaaaccaacaagaatttgtagccgtttttcgccaaaaaaaaaaanaaaactaanttttgccattttggtgttaaaaatggtaaaatggaggcccggcggtgccgtccgccggtaataatttttgaaattttaatgtattttattaagaaaaaacttgattaaaatttttcaaaaattgcccaccatttcattctttaaaaattaatttaaggtttacaacgaggcgcgtaaattctgcgtgccgtacaacatttctgttgtttgcgcctacggcggtggctcgaaatatgagcaacagaaggcgctggagcagggagcagagctgtaaaattaattacattatttttgaatttaatgttttttcattttatttcctttcattttcaattactaattgcttttcctaattgccttgctttttttgttcagttgcatttgtacgcccggccgtatcattgacctggtaaaaattgaggcgactaatttgctccgtacaacttttctcgtctttgacgaagtcgaccgaatgttcgatttgggctttggtcggtctcatattttcatgcttttctattttatttcatttaagagccgcaagtgaagtcaatttcggaacatattcggcctgatcggcaatgccttgtgtttaggtgggtggattggttcttgtattaattgggtttctgctgttattggcggctatttttttaaagatttggttgtgacttactttatccccttgttttctagaagctttacagtgagaatattcattatgtaatctttatttgggaattagagcgcgaattgtgagctcgggcggggtgctaataggcaccacaggaaaagccaaatttgcattgcaatttgttagaaaactgatacaaattaaataataaatgttattttcttgaccacttcagtgcaacaatgaagagcaagatcgaaaagttggtgttccatgcgctgttcaaccccgtgaaaattgtgtgcggcgacgtgggcgaggcgaacaccgatggtgaagggtcggttttggtggtgcaggacacacaggccaagttca

SEQ ID NO: 52226 - DNA, 211 bp, Heterodera glycines
  Genomic contig location: Contig_ID=SeqID_21628; Location=254..464; Strand=+
  SCN-specific regions: Sequence locations=1-59,81-114,136-211
atggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaa

SEQ ID NO: 52227 - DNA, 211 bp, Heterodera glycines; identical to SEQ ID NO: 52226
  Genomic contig location: Contig_ID=SeqID_21628; Location=528..738; Strand=+
  SCN-specific regions: Sequence locations=1-59,81-114,136-211

SEQ ID NO: 52228 - DNA, 200 bp, Heterodera glycines
  Genomic contig location: Contig_ID=SeqID_21628; Location=802..1001; Strand=+
  SCN-specific regions: Sequence locations=1-59,81-114,136-200
atggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttatggaaaattcatccaaatcagtggaaaaagattcctaggctcgctcag

SEQ ID NO: 52229 - DNA, 1387 bp, Heterodera glycines
  Genomic contig location: Contig_ID=SeqID_21630; Location=1..1387; Strand=+
  SCN-specific regions: Sequence locations=1-1090,1112-1387
tacagttatggggaaaaaagctccgaattgtctttgatgcctcttcgcacgaaaagggagcccggtcactaaatgacaccttattttctggtccaaatttatacccggacttggccgggaaactcatacaattcagggccactaaatttccaatttgggctgatattgaaaaggcctttttaatgatcagcctgagagaatctgatcgggagttttcgaaatttctgtgggtcaaggacataaaagctccactctcgggtaaaaatatcatagtttttcgttttaaacgaattacgttcgggatagtttcatgtccgcttttgctggccgcaacactcaaatatcatttggacacgcaccctagcagtctcgccagggaaatagtcgcgaagtcattattatacgtagataacctgctcttgttggcagacacgcatgaggaagctcgcagcaaggccatcgaagcgcaaacaattttcgccgcggctaaaatgcgtttatgcgaattcatcgcagcggttccgattagtcttgtcggtatacccgaaaaggaccggcttgaaaccgagactccgaatgttctcggaatgaaatgggttattaatgaggacaatttatcgctgtctttccctccggttcccggtcctgaagggctaacacggagggtggttctaaagacaattgcttctttttttgaccctttgggtttatgctccccgtgtctcgtggggcccaaaatgttcttccaaaaattatggaatgaatcccagggatgtgatgatctaattccgattgctgaatgtacggaattgatgaaaatccaaaaacattgggatagtgaaatcttatcaatcccacgtcacactcgccgagtaggcagcaattcgttgcagttacacgctttttccgacgcatcgcccgaagcttttgcatgtgccgtctaaattagggcagaaatgcaaaataagaatgttgtgtcgatggtgtactcccgttcgcgaattcgtccaaagaaaatggcgactagtcaatcggatggtctaaccatcccacgtttagagctccttggaatcctaatcggaacccgagcaattaaattttgtgaaaaaacacttaaattacgacatcaaaaaatgctttctttggtcagactctcgcatagcactttcttggttggcttcaaccgataaaatgccaatttttgttgcaaaccgggttagagaaattcgttccaatcggctggtcactttcagctatgttcggtcggcggataaccccgcggatttggcgactcgccaaacaacgcccgcagagctgaaaaacgccattctatggtggaatgggccagaatggctgtccaaatccaatgaattttggcctaaagagt

SEQ ID NO: 52230 - DNA, 594 bp, Heterodera glycines
  Genomic contig location: Contig_ID=SeqID_3869; Location=38..631; Strand=-
  SCN-specific regions: Sequence locations=1-274,296-516,539-594
atggaaaacttggaacggacactcaatcatactcgtttgactagacagcgagctcaaaatgaagggatattgctcgacagagatggaaatgttttttttcgggagaatccaccaaatagaactttaggcgtgatgaaccaaaacgtggtggtggcggatcccaatttggagaattcggagcagctggactcgatggaaatgagacggcgccttttgaacccgaacaatgacagcgcacttggacagttgcgacaaaatgaacgtgctagccttgacgaaaacgaagaagaggagacaaagcaaggttttatgcgaaaccgaacggattggacacaaaatttgggagagagggcaggcccaacccaacaaatttttcgaaattttggctttggacatacccaaaatgaagatgacttcttcgatcatccaaacattagaagaacttcgactccggtcaatgaaaaccgctgtgttggggttggcccgcaaaacctcaatgaaatagggctgttagccgaacaaattgggagggtcatcgttggtcagctaaatagtgctcatcaaaatccgaacacaaacccggcaccaaattga

SEQ ID NO: 52231 - DNA, 1285 bp, Heterodera glycines
  Genomic contig location: Contig_ID=SeqID_3869; Location=1497..2781; Strand=-
  SCN-specific regions: Sequence locations=1-307,349-512,544-864,894 -1285
atgctcggagtcggaacgtccattggcccagtggttggagctgatcggccaaggccatgcccagttcaaagtcaagtaaaagttgccattttgtaaatttgccctatttttcatttaaataagccccctcttccaagatgcttgggaacctcgacttgagaaaattttcgggtttttttggtcgcagtctcgagccttaactcgagaaaagtgtccatctattgctgccattgcctctacagaaaattattttttattagaaatggaggcatttttcaaaaaattttcttttttcgcttttcttgtgaaaatatatttatttttttaaattaaattttattaaatattgtcttaataccatcaccgaataaataaggcgtgcccattgggactgtcttggcgaagcgttgacagacgccgtctgtcattggcttccccctgggcgtcaacgacgtgaaacagtgcgcgcctggcgcgtcatgctttcgttcatctctgatcggctgggtgagaaatatattttttgattttttttttttttttgatcagcactcctcatagtcagctgggaagttttcatttccgaatatattgagtattttttgatgtcattttgatcatcaaagatcacattaatccgtattttcctgttttggggtcgcatgccaaaaaaaaaagcaacaaaaatgcgcgcgaatttacaaagtgcgtaaagcattattttgggcacataaatgcaacaacagttaaaatctcttcgaaatagatcagcttgagaatattatgagtgagtttgtgaacccaaaatgaggaaagtacacgctaatccgatgaaattcatcttttaatccgaattcgatcaagaaattaaattttttttttaatgaaaaattcgattgatgctcatttggtcaattttttaatgtaaagtccaaatccaaaatcaggaaaatttcttggattagaaccggtcttgcgataccatgggaccttggaccaagaccgaaaatccatcagatcttacataccgtatttactgaattagagccccctgaaataaaaccccactttcgagggtggttgaaaatagagcccctgggggttctaattcaataactgtggtaaccttagcagtggaaatttaaaaaaaaattaacaggcacacaaatgccgtctgctggccatcatgggccaacagcgtgccaaatgcatcatccacgaattgaattgctacagctaatcgcagacggcaatggtgctggttgttcaagtcaccaagaataaa

SEQ ID NO: 52232 - DNA, 375 bp, Heterodera glycines
  Genomic contig location: Contig_ID=SeqID_3869; Location=3271..3645; Strand=+
  SCN-specific regions: Sequence locations=1-45,74-318,340-375
atggatataaatcttcggaaagtaagttttttttagtttttagtcataaattttttgaaataaaaaaaattttgagatcttgcagcttgatagagaattattcgggctaccgaatgataacagattcattcaatttggacgactatgagttatacccaaaaatcgcgctgtcgcccaattgtccccatcggattttaaagcgatttttttcgaatttgcacctgatcagcatctgttgatcatggcttaacagaataccaagatgatactgttgttgaagcttgaggcgttgcatgctggtgatcggggacgcgctacgtgaccttgagaatattttttagacaatgtttaagccacactgatatttgatatgaa

SEQ ID NO: 52233 - DNA, 326 bp, Heterodera glycines
  Genomic contig location: Contig_ID=SeqID_3869; Location=3845..4170; Strand=-
  SCN-specific regions: Sequence locations=1-29,71-95,129-201,254-326
atgcatccaagtgtgactgaggtaagaagaaaataaataaatgaattaattaaataattatgtatttttagaaacactccctcaacggatttataaataataatcataataataacaacaataacaatttgtcgccaacaaatttagttttttgccagactgatggaccacaaagtcgtagcaacaagtaatgaaaaatgcttttatattttataaaaaattaaattatgtaaaaattaataaaattaaaattccatgtttcagccaccttcttactgcacctgaaaattcacaccaattactgcgaaggtaataaaattaataaa

SEQ ID NO: 52234 - DNA, 300 bp, Heterodera glycines
  Genomic contig location: Contig_ID=SeqID_3871; Location=750..1049; Strand=-
  SCN-specific regions: Sequence locations=1-58,84-300
atgtcgtcaaatgaagaagaagaatccggcggttcaaatgatgaccaattttcgtaagtataaatttatttaaatttttttaagagaaatgtctaaattacttgagttcacaaaagtgtggtgtcccatgtcggaaaggaccaagttggcgatggcccagttttttggttaaatgttctgtctcatttcttcgaaatgaaccaaatttgttatcatttaatattcttaacaagtaactgtgctctattagcctgtaaaatttcaaaaaattacgttgagtttcaaaaaaaaaacaataaa

SEQ ID NO: 52235 - DNA, 73 bp, Heterodera glycines
  Genomic contig location: Contig_ID=SeqID_21632; Location=1546..1618; Strand=+
  SCN-specific regions: Sequence locations=1-73
atgttcgccggcgccaaggaaaaaggcgggcaaaagttgctccagcaaaaggacggtctcttcgatgcgttcc

SEQ ID NO: 52236 - DNA, 356 bp, Heterodera glycines
  misc_feature (27)..(27): n is a, c, g, or t
  misc_feature (110)..(110): n is a, c, g, or t
  misc_feature (135)..(135): n is a, c, g, or t
  Genomic contig location: Contig_ID=SeqID_21634; Location=1..356; Strand=+
  SCN-specific regions: Sequence locations=1-216,241-356
gcgccgcattcgtgacgtcatcctcgnccttgaccaattgttcaccgatctcatagacttgacgacccgctcaatgcccaagcggcgcagcagtggcaaaccaacaaagntgaatgaaaaatgccaaaaaaagcnagtgataaatgaatcgttcaggatggatttgcccaaaaagtcaaggaatacatgaccaaatactgcccaagaaactgacaaaaagacggagaaagggaaaagacgggcgataaattggcaaggattctttaatgatggacggatttgactaaagtttgttttgatcggacattatttcaactcgtttacatttgatcgttgttataaattttctattcttt

SEQ ID NO: 52237 - DNA, 955 bp, Heterodera glycines
  Genomic contig location: Contig_ID=SeqID_21639; Location=221..1175; Strand=-
  SCN-specific regions: Sequence locations=1-390,413-528,596-642,664 -865,918-955
gttttccgcctgccaattggagcgttccaacatcgaaattccctatcgtcgtccaaccgccggcttttgccttggcggttcgcgactgttccatcgctgtcggaggcaaccgtttgctggttgtgtgccgaatgcggtaggcaaagcaaattttgaacactttcatttatttttagttaaaatttttggcctaaattttagaatttttggtgaattttttgatgcattttaaatagcctctaaatgctaatatctttaatactgctcaagatattacaatatgcaggtttattttgattggaacaaaatggatatgtattattttctcgaagcctcaaacatccaatttttgctggccgcaaaattcctttaattttgggccttaaatgtggtgttaaccctttgttttcagctccacaaccgtgttcagcctcgtctctttgagcattcctttcctcgacttcaccatttgccggttacgccttcggttttgctgccaatttccaacgaagagctttacggtgggccataatttaaattttaaaaagtttttaaaatttttttttcaacgaaaaactataaattaaaaaatttacaagtaaattcattggaggaatgggcccttcaaattctacctgaaaaccccttaaaagcaaaaatcaaacggattcatttatgcctcgacaaattccaaagaaaatttcaaatgtttcccttttcaaatttcccattttcagccccccttcagttccaaagtgtgctgaatcggccccttttggacattgtcaaccgcagccattggaacgaagccgaacaaacactcgtcgaacagctcgaccgacagaacacaaaaatatttttccgcaatttttatgtattaacatattattactttattaatttaattttctttttaagaattccaatttgagcgcgtatttgcctcctcaccacg

SEQ ID NO: 52238 - DNA, 852 bp, Heterodera glycines
  Genomic contig location: Contig_ID=SeqID_21640; Location=4..855; Strand=-
  SCN-specific regions: Sequence locations=1-85,120-164,186-217,239 -650,672-813,835-852
atgaataaaaaagttatcagaagggcaaaaccacttactctgacgactgttcagataatatgtcgtagagtaagtgataaatatatggatgaccaaaaaatcaaaatatattaataaaatgaggtcaaagtcaattgagatcgacagtataaatgccaaatcacttaaaaaattaattctgttttttgcttttccggttattaccctaatgaatttttaagttttgttttaaattaattcaaagaatttgtttttattagttctttatcgagtttattccacaattttgttaccctcccagcaaagggaatgaattttttgcctagtttatattttgtgttaaatctgtaaaaggggatgttaaagcgtgttgatggattaaaaattgaaaatagtttcagatctgttcggccataaaaatatacataaatcctaaccttatataaatgtaacaacaacaaattttattcgagaaaacagagatggagcagcattcaaagcaagaagaaaaagtgatggacgatgaacagttggaacgcttgtcacaaacgctggaattgctgttcagtgccggctattttcgtgccaaaataatggggcttggaaattttgacaaagtggggacagaaagattaggctctagatttcaaaataggtagttataaaaattcccaattttcttggccaaaatttttaaacatttgtttggtaatttttagagatcgacctggacctgaatccaggcctggatttttcctggatccaggtctaggtccaggccatttttcggcagcctggatttttcctggacctggattttcctggatttttgtccaggaaatcaaggtccag

SEQ ID NO: 52239 - DNA, 1121 bp, Heterodera glycines
  Genomic contig location: Contig_ID=SeqID_21641; Location=65..1185; Strand=+
  SCN-specific regions: Sequence locations=1-252,274-456,478-902,931 -1121
atggccactaaatcagcggccgcaacaatcgaacgactgcgttatctcttcacgcgtcacggtataccggaaacattggtaaccgacaacggaacgcagttcgccgccagtgaattcacaaaattcacagaagcaaatggaattgcacatctcttttccgcaccgtacaacccaatgtccaatggacaagcggaacggttcgtggacacttttaagagagcatttcgaaaaataaaaggggagggagtgccgaataaagaaatcatcaacacattcctggtaacttaccgcacgactccgaacgattcgctgccggacgaaaaaacccctgccgaaatgctccttggccgaaaaccgcgcacaacgattgatctcctaatgccgcctcttccacagccaacggagagagacacaaaaatggagcaccatttcaatcgccggtttggcgcccgaccacagaaatttgtgtcaaataagccagtttgggctcgacaccgactctcgcagaattggagagctgggacaatttgtgattgctccggagtcatctacacggtcaaattccccgacggttcgacaaatcgctttcatgcgaatcaattgagaaaccgggaaaacaccgaaaatggccacgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagcccaatcaaaaggggaggtgttcgggtgatgaccccgagagagacatttaatttattttatttatgtaattccctctctctgtctcccgcactatttctctcatttaattgtgtctgcactccctttgtaaaggtcagacacatcattcctcccccacattgtgacccccgctcatttccataattcattctgtcttcttgttgtattcccacatttcctccaattgtcctccgccccaaatatttatttatttgttttcca

SEQ ID NO: 52240 - DNA, 750 bp, Heterodera glycines
  Genomic contig location: Contig_ID=SeqID_3874; Location=229..978; Strand=+
  SCN-specific regions: Sequence locations=1-750
atgccaacactgatgcggacgagcagttgcaaagaaactctgaaactgtacgcagtgcaactcgaccatggcgaaacattgcggacacagaattggcacaacgaaacgaaatggtggggaggggttacggaaaatcgacagggtgaggggagatcttactcaaaaaataatgtcaaaagaaaaactacagcaacaagttgatgcatattttaccaatttggcagggattacgtggacactttggtatcccattccaccgacaccggcgttccgtcgccgtcggacgctgagaagacgtacgctcagatcagctcgtacaccgtctcccgccattccgtccatttcgcacttcgaaacaccggtgcctgttcttccattctttcagtcaaagtttgaaaatgaacaaaatccttccctcaatctatccattgttcagatttattacaacgtttgtcccgagcagacttcgccgccccatcggttgcgtttgccccgcacggtctcttcccgagatgcccatggcgttgtcactgtgccgggccgttgtgcagacaatgcgtcgccggtggtgccgacagacagcaaaagtgagtaatcgaaatgcgttactggttgtgaattcgttgtcctttcagcggggcaccgccattcttccgccgcctctacgtcctccttttcttcgccgtcgttgtctccaccgaccgcaatttgcaagtcggacggcacgtggcaagtgttgggtccgactga

SEQ ID NO: 52241 - DNA, 1396 bp, Heterodera glycines
  Genomic contig location: Contig_ID=SeqID_3876; Location=701..2096; Strand=-
  SCN-specific regions: Sequence locations=1-376,401-1003,1029 -1077,1099-1120,1146-1256,1285-1329,1359-1396
  Gene Ontology: Mol. function=electron transporter activity; Cellular component=mitochondrion; Biological process=alcohol metabolism
atggtaactttccatatagcgcctcattttgtccaattccctttttactctcaattcgtgctttcttttcaggctggattccctccgggcgtggtaaatgtcgtccccggcttcggcccaactgctggcagagccatcgttcagcatccgcaagtggacaaagtggcattcaccggctcttccgaagtcggactcgaagtgtcacgcgaggcatccggtaaaaatctgaaaaggtgcgcagtgggtgagtcaggcaattctttttatggccggcaatgagtttagaataacactcgaattgggcggtaagtctccggtcatcattttcgacgacgcggacatggaattggcagttcaacaagcggctttcggtctgttcttcaaccaaggacagtgctgttgtgccgggtcgcgcacttttgtggacgcaaaaatttacgacgaattcatccaacggtcgaaggtcagcaaaaacaaaagtttaacatttggtgggattttattccgtttgacttttagcaaattgcggagaaacgcgtgcttggcaatcccttccatttggacaccgatcaaggcccacaaattgacggggaccaaatggataagatcctcaagtacatcgaccaggtgggattggaacaaacatctcgagactaaaggacaattcagggaaggaaagagggcgccaaactgatcaccggtggcaagcagttcgggggcaaaggctttttcgttgagccaacaatttttgcgggtgttgaggatcagatgaaaattgcacaggaagaggttcattttcagtcctccccctccccatgattcaaataacattttgcttagatattcggccctgtgatgtccattataaaattcgacgggctcaaggacctcgtagaaaaggccaacagcacaatttatggtttagcagcaggagtaatgacacgtgatttggacaaggcgctctatgtggccaataacatcagagccggcaccgtttggtgacttttttgctttaattttgataaatgtaagcgttggaaatacgcctctaattattaaaggaatccaaaaaatctgttttaatttgccttttattttcagggtgaattgctacgatgtttttgacccggcggctccattcggcggttacaaaatgtcgggcatcggacgcgaacttggagaatacggactatctgcttactcggaggcacggaaaatttaattatggtaatttttcgattcttaaggtgaaaactgtgaccatcaaagtgccccaaaagaactcttagtgggaaacaattaataacgacataaattagttaaactttgaatttttattcataaattttatttattttgtttggacatataaatggaatacatacatacaaataaa

SEQ ID NO: 52242 - DNA, 622 bp, Heterodera glycines
  Genomic contig location: Contig_ID=SeqID_21643; Location=32..653; Strand=-
  SCN-specific regions: Sequence locations=1-28,57-151,173-622
atgactcttacgcttctacgtctattgaaggtcttacaaaacaaaacaataattgcatccaatcggcccgtaaatttatggtcaagatgcacacacaagacattgtaagttgttcatttcgcatgtgaattgtcatacaaattgagttcagattgggatttttatcttttttgcccttccgattggatttttatatgccgtaacttttccactttccctttcgtttgacccgttcagcaaggtatgcttaaaatggttacatttagtaattccgtccttttttatggttggcttgtgagggtcgtcccctgctcacttctcggcctcaatgtttacttaaacgcgctgatgatgttcaaagtgggaccgaattcccagcgcaatgttttgccgtcggtggtgaagcgcgactttcacttctgccacctttgccaatcgaattcgcctccgcgttcatttcactgtccgggtatttatcgtatttttacctcagattttgctcttcaaatctgacagtttgcaacttttgcgtcttccgccgtgaccagggactgttgcaagggaccgggttcttggcgtcggaagcgcccacccacgagggccttagtgggagggcccgcat

SEQ ID NO: 52243 - DNA, 379 bp, Heterodera glycines
  Genomic contig location: Contig_ID=SeqID_21644; Location=188..566; Strand=+
  SCN-specific regions: Sequence locations=1-188,217-321,360-379
atgacttcaagtgcggtgttgactgaacaacagcaatcgacgcagcaacaacaacaattgcaaaatttcgctggagtggtcgcgaatattcttccttcagcggttcctcagaatacccaacaacagcaaatggcggctgtttcaccggcgcaagtgatgtggactcagcaagcgcaacaaagccaggcacatcagcagcaacaacagcagcaaatgttgcggcatcagaagaaagtccatgtcccgcagcaaatggcatcatcgtccatgggaccatcattcttctgatgatttaaaataatggattcttaactaattatcttaaaatgtattttatttctcaaacttttcatcttcaagtttcacatgtgcctgtaaa

SEQ ID NO: 52244 - DNA, 67 bp, Heterodera glycines
  Genomic contig location: Contig_ID=SeqID_21645; Location=1004..1070; Strand=+
  SCN-specific regions: Sequence locations=1-67
ttcacccgcagaagaagctgggctgaaagtgcatgacaaaattctgcaagtgaacggcgtcgattac

SEQ ID NO: 52245 - DNA, 81 bp, Heterodera glycines
  Genomic contig location: Contig_ID=SeqID_21646; Location=159..239; Strand=-
  SCN-specific regions: Sequence locations=1-81
atgcgttctgcaagggttaatcaacgccagcaaattgaagaattggcccaaaattcggcacttctgcaggacatgacaatt

SEQ ID NO: 52246 - DNA, 1121 bp, Heterodera glycines
  Genomic contig location: Contig_ID=SeqID_21647; Location=294..1414; Strand=-
  SCN-specific regions: Sequence locations=1-673,695-1121
atggacgccgacattattgagctgactgggcgagacaacgacgagcattttttgcctcaccacgccgtcatcaacccaaagaaactgaggatcgtcattgacgccagtgctcatgccaagggcaccccaagcctcaacgactgtcttcaccgcgggccagtgttgctccccgacctttgcgggattctcctccgcttccgttcagcgacaattcctgtgttggccgacgttcagggcgcctttcatgccatcgaagtcgaacccgaggacaggcgcttttgcaaaatgctttggctgaaaaaccctgcccgtcctgtctcaggcgacaatctcttgatctaccgctacaaacggctagtgttcggcgcgacgtgctccccctttatccttgccgctgttctcctccaacacttcgacaagcacgagcacccattcgcccaagcgttggccgcgaatatgtacgtcgacaatctcctcatcgagtgtgaaacggaagaggaggccatcgacaagtcgtccatcgccaaacaaatcctcaaagacgccgacatgaacctccgggagttcctcagccactccccaaacgtcatgggacgaatccccgaggacgaccgactcgacaaaacgccggccaaagttctgggactgacctgggacacccccagcgactgcatcaccttcagtctcccaaaagacacagacatcactgctacacggcgttcagtcttgagcatcatcgccagcacgttcgaccctcttggactagtcgggccatgtcttctgcccgccaaacggctcttccaacgcctgtggggagaaggaaccgcctgggacacacccctccccgagaccgaggcggaaacttggaatcaaaccctttccctttggcaacaccaaacacttgtcgttccccggcactccattctcggcaagcacagtcgcctacaactccacgtcttttgcgacgcgtcggaacacacgtttgccgccgccgtctacatccgaagcgagacttccgatagctcccaagcgaacttgattttcgccaaaaatcgccttcggtcacgaattgcgagccagcgcttcaccatccctggtctcgagatctttagccgttgttg

SEQ ID NO: 52247 - DNA, 365 bp, Heterodera glycines
  Genomic contig location: Contig_ID=SeqID_21650; Location=1528..1892; Strand=-
  SCN-specific regions: Sequence locations=1-10,58-127,149-208,231 -258,283-365
attaatgtcgaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattcttttaaaatgatattgaaaaggcaaaaaggaaaagcttcatatctcggccagaagcttcatttagcaaaaataaaaaaaaatttataatacaaagggggggggggtaatctacctaccctgaaagtttcattcggaagtcccatggtcacttgggtacctctcctttgtaagg

SEQ ID NO: 52248 - DNA, 1908 bp, Heterodera glycines
  Genomic contig location: Contig_ID=SeqID_21651; Location=81..1988; Strand=-
  SCN-specific regions: Sequence locations=1-46,82-196,219-734,756 -1309,1333-1548,1575-1668,1698-1908
atgaagacgcggccgtttcccatcggcacgccacgtgtgtggaccggtgagcagctgtggcagcagcagccacaaacggcaggaggccacccccacactgattgtggtatgtataattatagttttatgatcatgactaatttctgccccctttttctacagctaaaccatcaccaccggctcttcgaccacccgcactgccatggtgccgaccggaggacaaccccttccgcggcttcctcttctgccgagtgctgccacccagcgcggacgagctgggcaaccgcgagccgctgctgccctatcgcacacaggcagacggacgactcacgttcggcctgtgcgcacgatgcgcggagctccgacagcagcgtacctgtcgtcacacggaacgcgagcgcgcgtggaccgccgcctacacgcatgtggaactgaacagggcgctgctcctcggctaccgtgtgctgcaggtgcacgaggtgtggcactacgagcagtgggcgtcgccggagagcggcaacgggctgttcaacgactacgtgaacacctttctgcggctgaaggcggaggcgagcggttggccggccggctgcgacgacgagccggcccgggcggagcacgtgcgtcagtttgcggagcaggagggcgtccacctacgccgcgacaacattgggcacaacccgggcctgcgacagctggccaaggatttgctcaactccctgtggggcaagatggcggagcggccggagcgcgacgaggtggtctacacggacagtgcgcgcgccttccacgagctgttgatggatgcgcggcaggaggtggtcagcttcacgcacatcaacgagcagctggaccgctgtgtggtgcgcaagcgggagccgtttgcacgggcgccggagcacaacaacctggctgtcgcctgctttgtgacatcacacgcacggctctacctgtacgaatggttggaggaggtccggcgggtgggcggccgagcgctgtactgcgacacggacagcgtgttgtatgtgaggcgacagggtgctgccggtgtgcgggagggcaatgcattgggggacatgaagcgggagctgcccggccgccgcatcatcgacttcttcgctgctgggcctaagaactacgggttccagcacgtggacgcgcgcacgggtcaggacctgagggcggagcgcaaggtgcgatcctttgagctcacctacgcagcagaccaacagctgcagtacggacggatgcgccagctggtcatcaaccattttgtcaggtaaaggcgccgaaatcggtacgacacttgcacaagcaccaccaccaccacactcattcgctgttttctttaggcccgagcagcgcgccaaccatggtggtgggggcggaggcgacattgcggaggcggccaccgagcagcggaccattgccgtgccctgtcaacgctttgtgcgcactcgacaggcggacatcttcacgcgtcgctccacccgcgtgtaccgccccgtctacaccaaggggcgtgtcctgcgaccaccaccaacagcgggaggcgaggcagccgcggcggaggaagaagctgaagcggtcacgccgacgcctctgtccatccgcacgcgaccgtttggctggtgttcggcagaggcgcagcaaatggagacagatgatgaggaggaggagggggaagaggaggcggacgcgaacagtgatgacgctggcggcgagagtgatgggctggagcagccggtgcgcaagcgggccagggccgagccggtgcaagaaatgcttgtggaggtggaggaggcagcgccggcgccggtggaccccgacctggaggaagagccagtggccggctgttcaacatggaatcagcagagaaggctcaatgagcacatttttcgaaattga

SEQ ID NO: 52249 - DNA, 127 bp, Heterodera glycines
  Genomic contig location: Contig_ID=SeqID_426; Location=818..944; Strand=-
  SCN-specific regions: Sequence locations=1-46,68-78,101-127
atggacttacaggacgccaacaaagagaacaaagagccaacgaaaaagcaagaggaggaggcggaggatcccagctggatcagcctcattgatgaggagatgaagcgcgagccactcgctccaattg

SEQ ID NO: 52250 - DNA, 4335 bp, Heterodera glycines
  Genomic contig location: Contig_ID=SeqID_426; Location=1054..5388; Strand=+
  SCN-specific regions: Sequence locations=1-44,68-630,652-1390,1418 -1720,1742-2708,2730-2763,2787-3067,3089-3488,3510-3950,3972-4335
atggacgctttccaacaatttaaaagggaggatggacaatttcgtcatccattcacaatgattgtgtctgggagcacaggcagtgggaagtcagagtggataatgcgtctgttgcgaaatgtggataaaatgatctctacccctgttgaacgcgttatttatagctatggggagctgaacagaaatgtgatgaatctgcagcgcgccggcaaaattggcaatgtgccagtcactgtccatagcggtgttccacgcgcagagcaagttcgggagtgcgccaaaaaagaaaaaaccttgctggtgctggatgatttggtggtgggtatgagtcaacaatatttggacgcactcttcacccgtggctcacacaattggggcgtcagcgtaattttggtgactcagcacctgttcagcaaagagttgcgtgtggcgcgcactaattctcactatttagttttaatgcgtaatcctgcgggggcgttgcagatacgcaccatcgccacccacctcttcccgtcaaggactgcccattttattgagacctatcgtgacgcatgcgcaaaaaattttggctaccttctcgtggacatgcacccagagagtccggaagagattcgccttagaacaaatatatatgaacaaaaacaaatagtttacctaccaaaatgaaagggtcacaattagtttcaagaaacgaatcctttttggagacattgtgtaatgccaaaaaggcgaatgcccttattcgagatgcatcagatgagcaacttttgtgcctcgtcgaaatctgcctaaacattctaaagtgccgagtccctttgcgtccccggcatttgaataagctaaaagctcatgcacaggtgcttcgccgtctcgcccgcacccgctgctcgcgctctgccaaaaaggttttgctacaacacggagatggccttcccgctattgtggggctcattgcgtcaattgctcttccgcttattgcggatgtcattgaaaaatataaatagtttccaaaaaattaaaaacaagaaaaaatgcagcatacaaagcgctatttgcttgtccccgaagaaatttatcagagtttggcagcaccgccaccggctgacggaacatcaattgggctggtacgtaacagaattaaacaaatcaaaaacgatgacggcataaatgaggcggaacgggcaatcaaatatgagcaggaacttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaaattgggcgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaagcagaatccgctcttgagtaggcatttatttcccgaaggccaatccggcaaaggaatttataaaaacaccacacttaagtttaagccatcattatggatttgaaaaagcttcgcttgctcgagtttttgtacaaggacctaagttcgcctgtcacattcacgagcgttgaaccgctgctgagagaggcgcggaaaagtcaaccaaaaatcaatcgaaacgatgtccaaaattatttgaccagccaacgtacatacacactgcatcgccagtcgaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcactaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcacttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgagcattggaatgcgcccagtagacgtgaactttaaaaacgcagaagcattgcgacaaaaattacatgatgcagctgaaaatgttgtacgacgcaagcaaaaataccgcgtgggagatcgcgtgcgcattgaaaagtacaagcacgtgttccaaaagggttacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacagcaaaaaatgtatgaaattgaaaagattttgaagaaaaagaggcagaacggtgtggattatgcgtatgtgaaatggaaagggtattgcactcgctttaatagttggattcccgtaaattcaattagcgagaaaaatatataaaaagcactatttgtcaaaatttaacaaaaatgccttcaaattctttttatgttgttcttccgtcaaacactaatattgaaggaaataggacaaattctttccgagtgcgtttaccgcgcaaattgcaattcaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatacaggctactgggtgagggaagtgatccgttggcaaaaaaggtacgatcaacacagaattctttcatgcttttgataaacaaggctcggcgatgggccagagaagaatacattaagcgaaagactaaagaaaaacggagcgtccgtgacgaagagctgctcctacaggccatgttgacagatactggaacattggttgatctcaacagcgtagcccaaggctttctgacacgtgaaaagagtgctgcaacgagtaatgtaccgttgagaatgccagctgatgataccaattcgtaccaagaaaaattgtatgagtacttttcaaaattaagtgacaaaaatttgaacatttttgatgaattgggcatgacaaaattgaacgccgaaatcaaaaatttaacagaagaggaacgcgtgatccttgaagccacaaaggaaatgggaacggaagcatggattcaggcgtaccgtgagatacgtcttgtttgccaatttaactatgacgtccatagaaatcgttttgtcctgaacatcgacccacggtacgttaaaaaggtcaaagtctcgcttcaactcgcttacattctcggtttcaacaacacggagtttattcaatctgaaaacgaggcaagattcatgccggacatgagcggtggtgtgtcatcattccacgtttacacgccggatcttattgaaccaatgatgattggagatgtcacggccccagtgttgcgcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaaatgatgaacacgttggaaattgacaaaacattgacaagaaacaacgtgactcgccactactatattggctgttttgcagcagatcaaatacccgccggtgcaattgtcaaatttccccactgtatggtggttaatcttgaccccagcacatcacatggttctcattgggtgggcatatattgcgcttctcctttgcatttggagtattatgactcattggggttgtggccaccgcccagtgttcacattgtga

SEQ ID NO: 52251 - DNA, 317 bp, Heterodera glycines
  Genomic contig location: Contig_ID=SeqID_426; Location=7863..8179; Strand=+
  SCN-specific regions: Sequence locations=1-56,78-317
atgtctccaaatgaatgttctgaccgtccctttcaacaacccgacaatgtacaacagccgcatcaacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggtcgagcccctgccatagaagccgcgcttcttcaacgcgccgaacgtgaggcagaaattttgcgccaatatgccgagaatcaacaacaatga

SEQ ID NO: 52252 - DNA, 1557 bp, Heterodera glycines
  Genomic contig location: Contig_ID=SeqID_426; Location=9259..10815; Strand=+
  SCN-specific regions: Sequence locations=1-428,466-1557
atgcgcgacaacggatggactcttcgccatgtggaaagccctggcggcgagtacaaacatggcaacttcctcttggacggcatgctcgagaggatcggcgaggacatgaatttggcgattgaagtgaacgggtaaagaaacacttgccaaacttatgctaatttttctcccttcaggtgttattggcacgcgtgcccgcactgtttccctgaagacgacgcaattgttggcggcggagagacggccggtgccattcgagcgagggatgagaagaggatccggcaaattgcgcgggacttcgaggtggagatcgtgtgggagtgccagctcggccgaatgctggaagtggacccaccgatgaaggcattctcgacaacacgcccgactccggcccgattgacttccatgacgcctttttcggaggtcatttcccccaattttggttaaaatatgcaaaatttgtttacaggtcggactggccccgagtggctcggagcatccatcatcccggacaaagaaggacaggctgggcggaccattaaagtgaaggacttcaacagtctgtacccgtccaggtagaaaataaattaaataatcacaaataatcaataattaaggaacatgttcaccaactaccccgtcggtcatccaaaggtcatccaaatggacaaggacgtcaactggactgcgaaggaacacattgtggacgacgacggcgtgaaaatggagggcatcatcaagtgcttcgttgtcccgcctcggcactgcctctacgacattccggtcatcccaatgcggcgtaacaacaggaccctcttcccactctgccggaaatgcgcggagatgtacccaaagggtctggtcgaccctgagtacaactgccctcactttgaggacgctgagaggggtaaccaatggctttattttccaatgattttatttttccttcgcaggattctcaacgaccatcccacacatcgagctcgaggcggcgctgcgatccggctacagagttacccatgtctaccgggcgtacgtttggccgctgtattgtgattggagcaacggcctcttccactcctacctcaacaaattcctgcgcataaaatttgagggtaattttatcagcaatcaaaactaaattaatcaataataatttagcgagtggattccctgctgattgtgccgttgatgacattgacgaggaggagagggaacgccgaaagcagcagtacattgacaacccatggaagggctgtacggtgcggctcgacgccaacaacatcaagccgaatcccggcatgcggtacctttcgaagctgtgcctcaactcgctgtggggccgctttgccttgcgcaatcggcttacgaagacggagatcatcgactgccacgctgatttggccaagcttctgaacgacgtcaaaatcgacatcagcagcatcgaccaactgacggagaaattctggatggtgtgctacaaggcgaaagatgagcacgtggtggagcacgacaccagcaacgtcgccattgccctatggactacggcagcggccc

SEQ ID NO: 52253 - DNA, 730 bp, Heterodera glycines
  Genomic contig location: Contig_ID=SeqID_427; Location=411..1140; Strand=-
  SCN-specific regions: Sequence locations=1-730
atgccaaagcttccggaaacactgtacacggaccgtgggctggagtttgtggccaagcccatgaaggagttcttcgctgagaatggcattaagaagtatgagaccagctcaaagaagaaggctgccgtcgcagagagagccatccgtacgctgaagactcggctgtacaaatatttctctgccaaaaacacctctgcgtgggtggatgtgttgcccaagtttttgtctgcgattaacaattctgtgtgccgcgcaacgggacttaggccaaacgaaatcagtgacgtcaatgcgagagaggtgtggaagagggtctatggcgaaggacttgtaccagcggagaagagaccaaagatcaaagcgggggagactgtcagaatccccgagcccaagcacatattcgagaagggtacagtgactcctccatttttttctgtatttttcttgtgcttaaggctatattcccaactattctgaccatgtgtacaccgttgatgcggcacgcgcaaccaaaccccagcactatttgctcaaggactattatggcacaaaaatgaatagaaagttttatttgccagagctaacaaaagtacaagtggacgaaaacacaatgtataggatcgagaaaaaatacaaagaacgaatgagggatggaaaaaaggaaatattggtgaaatttatcggatttccggaaaaatattgggtcacagatgaggattttgaaaaataa

SEQ ID NO: 52254 - DNA, 1827 bp, Heterodera glycines
  Genomic contig location: Contig_ID=SeqID_3877; Location=6..1832; Strand=-
  SCN-specific regions: Sequence locations=1-128,150-655,677-1190,1339 -1640,1662-1827
atgaacacaaatgcattgattgccagcagtagcgtagtgccattggttatcgaggaatttcaacggttggcacgtgcccgagtcgttcgatggcaaactttggaccaattaaggttgtaaatgttggcaattgaatattattttaaaaatcagtgccataattaaaactaattcccggcaagatggatggataccaaggaccaaaaatagtctgtttttagccaaaacttatgcgacgaatgtaaggcagcaacgaaatgcccagacaaccgtcgtcttttgcaatacggcgtctttctgctgcacgacagttttgcactcgtttctcggcctgaacgaaaggtttctcagtgaaattcgccaaattttggcatcgattgcgctcccatcgcacttttaagctttccaaaaacagttcagcttctcgtcgcgctgtgcgaattggtcgtgcggtcgatgcgcagcagtgccatgtccgtttcgttcgcttcgcttttcctctccactgaatttgtgcatgtggcgagtcggacaatttccgcactcctttcgcgcatttttgaccacatcggtcacaccgatgtacggcttgggaaccattttcttgatttgtcccaattgctcgctgctatttcagctgtccaaagtggtcgatgggcgtgcagttgcttcgttcatcgccgttttggacctgttcagcggttgttccaccgacaaatgggtgcttttgcgcgacaacgcaccggtggcctccattctggagacgctttgcgtcaaaatgagcactccgtgcgcaacccgagcacacattttgacacttcaagtgctgcctttgctttttctctgcctttttcaaattctgtcgaattcagaaagttctttttgccggtctgaagggcgtcagacagccgttgagcgaccaaagcattgacgaactgttccgagtcatcgtcaggtttagtgaagctccgcctttttgtcgcccccggaattccatggcttttcagatttatgcgcatagcgaactttgacgcgggcgaagcgtgcgcgactttcgtccaattgctcaaagccccgtccctaacaatggcattcagtgaaaatgtttggcactttttggatttgttaatagttcaattgctcatttttgggagcaccccaaaattccaccgccgaaatcatgccgctagaaatttaaattttttttaaacttagaattttttcaagtaaaaatcttagaaaaatttttttataagaaaattttaagaaaaaaaaatttgaaaaattttcagcgattttttaaaaattttatgaaattttcgtataaaaaaaatttttctagcggcgtgattttgtcccggcgttatttcggccggcgtgattttgtcatgttccccatttttttgttgccttttatccctcttaaaaatccaaaatataaaaatgattctttttttttctttcagtctttgcaattggtgaaggagttgaatttgttcgccgattgcatttcgtttctttcgtcggtcaaaagtcagtcggaactgctcgcattgggcaccttcgaaactttgcatttggtggcgaatttaatccatttgggaaatgcggacagagaagtgagtggcgcaccgacggaaatttggcacatttttacactgttttcaattgattccttaaaactcattttgcattttgttttcagacgaccactcagaaactgttggagtgggtccgcctcgtgaacattttgctccaaaaatgcatccaaaagggcggaagccatcggcccagcaattgttggcaccatcctttgttgggatggac

SEQ ID NO: 52255 - DNA, 178 bp, Heterodera glycines
  Genomic contig location: Contig_ID=SeqID_3878; Location=1613..1790; Strand=+
  SCN-specific regions: Sequence locations=1-178
ttcgttgtcaagtgcctcttgctcgaaattagttcctttatgagtttgggacttttcccttcttcaaccgctgtgtattcgtcgaacagtgacaacgaaaacgaccaaaacaacaaattccgtggtagtactgttttgcgtgcttcgtcagaaaactctgcgacatcgaacaactcta

SEQ ID NO: 52256 - DNA, 531 bp, Heterodera glycines
  Genomic contig location: Contig_ID=SeqID_3879; Location=750..1280; Strand=+
  SCN-specific regions: Sequence locations=1-35,57-265,288-531
atggatggaattgcacagtccaaccaaaaagaccattttttgcttaatttctttgttggcaaagtcaccgaaggggccgtagttgcggcacaaagtccgcaacgaaactctcaccatttgaatgaatttgagaagcaactgatgcgggaaaatgtgagtgtaacaaaaataacaaattccttggtatcgtaaaagtgagtagttctttgggtgaaatttgttgattcgatcaagatttttggacaaagacaattccaacggtaaatcccctttcagggtttcaaccacagtgttgctgtctgcaacaccaactttgacacggtcaatcgttcaacaattggccgccttgaggctttttatcttgcttttggagttgagggcgaaaaactgacgaaacgactttttggaggttttttttcttcatttttgggcttatctaatttttcttttcaggtcaagacaattcgcatttcgatcaagagacgcgacttgcccctcaaatcgaaccaacaacaacaaaaattttgctga

SEQ ID NO: 52257 - DNA, 1642 bp, Heterodera glycines
  misc_feature (3)..(3): n is a, c, g, or t
  misc_feature (5)..(6): n is a, c, g, or t
  misc_feature (9)..(9): n is a, c, g, or t
  misc_feature (11)..(11): n is a, c, g, or t
  misc_feature (18)..(21): n is a, c, g, or t
  misc_feature (24)..(24): n is a, c, g, or t
  misc_feature (28)..(29): n is a, c, g, or t
  misc_feature (39)..(39): n is a, c, g, or t
  misc_feature (47)..(49): n is a, c, g, or t
  misc_feature (51)..(51): n is a, c, g, or t
  misc_feature (56)..(56): n is a, c, g, or t
  misc_feature (59)..(59): n is a, c, g, or t
  misc_feature (62)..(62): n is a, c, g, or t
  misc_feature (64)..(66): n is a, c, g, or t
  misc_feature (68)..(68): n is a, c, g, or t
  misc_feature (71)..(73): n is a, c, g, or t
  misc_feature (78)..(78): n is a, c, g, or t
  misc_feature (80)..(80): n is a, c, g, or t
  misc_feature (86)..(88): n is a, c, g, or t
  misc_feature (91)..(95): n is a, c, g, or t
  misc_feature (104)..(106): n is a, c, g, or t
  misc_feature (113)..(116): n is a, c, g, or t
  misc_feature (123)..(126): n is a, c, g, or t
  misc_feature (130)..(131): n is a, c, g, or t
  misc_feature (135)..(135): n is a, c, g, or t
  misc_feature (140)..(140): n is a, c, g, or t
  misc_feature (145)..(146): n is a, c, g, or t
  misc_feature (209)..(209): n is a, c, g, or t
  Genomic contig location: Contig_ID=SeqID_21652; Location=1..1642; Strand=-
  SCN-specific regions: Sequence locations=1-202,257-258,280-558,645 -925,958-1576,1615-1642
ccncnngcnancacaaannnnaancgcnnaaaaaacccngccggacnnncncagcnagncgngnnngnccnnncccangncggccnnngcnnnnngggggccgnnnacgccgnnnngggcgcnnnnatgnnccgngccancgaanncccggccgaacaaaaatttccaggggcatatcgccaacgatacatggacggtggagaaaaatntaaaaaaatgaatttaaaatgaaaatttaaaaatgatttaaaaatatgacaatttttatctctccaaaaaggtggtgcaaaaattgtacgaatttatcgagaaaagtgaagtgatcagagaggacgaaattaaacgaggcgagaagcaaaaaaaaggggaaatccaaaattgaaaaataattaattgattgaaattcagaggcacacaaactttacaagcagtacgaacagtcgctggtgttcgccgtgaactacgaaggtggggggagggaatttgaaactgttcaaaaagtatgccaaggctatgacgaaaaatacgacgacagtcacccgacatttcaatggacggtaaaataaacaattttaactaataattattaaaaatgtttatttaaataattattattaatttgaaaaaataatttaaaaaatattcattgtttttttgttcagttttccggtgctcttctttattccatcacagtattcacgtaatttattctctattttattttttcaaaatgttcaattggcacttttctcccattttggcaccattggctatggccatatttgtcccaaaactgcgcttgcccggggcctgaccattgtgtacgccaccttcggcattccgctgatgcttttgtgtttagcaaacattgccgaaagtttggcacaggtcagagagagagagagagaagtgaaagagaaaagcgaatgtttttaaattttaattggaatttaattttgtcctcattttcaaggtgttcaccttcgtctactttaaagtatgctgtgcctattgccgttggcaggccaaaaagcggcaggaaaagcgcagtgccctcaaattgcgctaccacccaaatgcgccggtgaatgtgcgacgtggtaggccaaaatgggacaaaaatatgcaggataaaatgaaaaatatttggaatgaaaagcggggacaatttcccggcggggggggggggaaggatgggggggggtcgaaagtgccatcgatgccaaaatcggctgcaattagcctatttattcggaatttcccttaaaattgttcattcagttcactcagggcgttctgcgcaacgctacaacagtttgttgcgtcggcatgcgaggtaaaatggggaggaaagctattagtaatttgtaagcaaagttagtgccattttgagtttgtcagtgcgcggccgttgggccaccggcgacacgaaaagcatgcgatcactgcgctcgctggaggcgcagcagcgggcgcagaactacggcatggccaaatcaccaaattttcagcaggaggatgggccaatgaaaaagtgaaacaatttaaaatgaaaaaaaaatttgcatttaaatggaatattatataaaaactaatttaaaaacaataattaatcctgattcaagactctagaggtccccgg

SEQ ID NO: 52258 - DNA, 384 bp, Heterodera glycines
  Genomic contig location: Contig_ID=SeqID_21654; Location=84..467; Strand=-
  SCN-specific regions: Sequence locations=1-178,200-359
atgtcaacttctaccaatttgtcaagcagcagcattttcacaccagcagaaaggggtaagaaaagattaattggcaaagaaatgggtgaacaaaaataaatattgtaattagtgtgcggattaattagtagttataccaacctccgggatttttaacaattattattgtaagtgaacgaaaattttaaaatttttaagcttatagacgtgaatttctttttagtgttttaataaaaattttccaaaatttcagaggcgagttgttatgatggttcgcttattggtcaaaaattggacaacccaagatcattcagtgatcaacaacagattgaggtggacgaacgcaacagaaacaataaaaatggaaataaattttattattaa

SEQ ID NO: 52259 - DNA, 2062 bp, Heterodera glycines
  Genomic contig location: Contig_ID=SeqID_21656; Location=552..2613; Strand=-
  SCN-specific regions: Sequence locations=1-297,319-1090,1112-2062
atgacaccagcaaattccgaggactcagaaaatccattgccatgctccgtcaagccaagaatcatgatcggtgttagagatttttggcgttttatcttggattgggatgaaattcgacccggaatttacagaatcagaaccgtttttggtgtcatttttggaggggaagattgcggtgtccccgagaaaacctcaaatccgtcgttatgttgtccagtcctcaacacacctcatcccatcgaatccgatgttgccaaactttgggctttagaaacgatcggcgtttccgattctccaattttaaaagatgacgagatggcgcttgaaaaattcaacaaaaccattaaaaaggacaaggaaggacggtatgaagtgggccttccctggaagtcagagacggaatatccgcctgaaaattttcgaattgccttttcgcgattttccgctctggtgcataaacttcgcaattccccgcgtcttttacagggatgcaatgaaatcattgaggattatttagcaagaggaattattgaaaattcgtcccggacttgtgacccccagcattttttgccccaccataccgttatggggaaaaaattacgaattgtttttgacgcttcatcgcatgagaaaaatgtaccgtcacttaatgacacattatatgcaggtccaaatttgtaccccgatttagcgggcaaactcatccaatttcgggcgaccgcccacccaatttgggcagatatagaaaaggcatttctaatggtcagcctaagggaagcggatagagaattttccaaatttttgtgggtcaaagacgttaatgcaccactgtccggaaataatttgctggtgtatcgtttccggcggatcactttcgggattgtgtcgtgcccctttttactagcggccactttacaacatcatttggacacatcgccgagtgatttggccagagaaatccggcataagtcacttctatacgtggataatttgttgttgttggccgattgcccagccgaagccgaacaaaaggccatcgaagcgcaagaaattttttcagaggcaaaaatgcgcctccgagaatttgtcgcggccaaacctgaacttctgacgacaattccaaaagaggattgcctctctgaagacgagccatcagtgcttggtctgaaatggattttacagtcggacgatttgtccctgccatttcccgaagtaccaaacccagcggtacttactcggaggatagttttgaaaactatcgcatcgtttttcgaccccctagggttatgctccccctgtttagtgggggcaaaaatttattttcagagcttatgggaccagtcccgcggttgggaccagcccatagaaaattccgaaaaaagtgcatgggatttgatcagaagtcagtggagtgatcaaacaattttgatcccaagaaatacaccccgcacaaaaaatggagctattcaattacatgttttttcagatgcttcacccaatgtttttgcgacggcggtatatctgagagcggaaatagagggccatgtaattaactctctcatttacgcccgttctcgccttaaacccaaaaggatgggtgaaaatcagcccgacgggctcacaattccccgtttggaactcttaggggttctgatcgggaccagggcagccaaattcgtccaatcacatttattttatgacatagaaagtgtccatctctggacggattccaaaattgttttagcatggatttctagcacagaaaagcaaccagtttttgtgtcaaatcgcatacgtgaaatccgaacaaatcgttcagttaattttcactatgttcgttccgctgaaaaccctgccgacctggcaacccacccgaccagtccaaatgagctccgatccgccaacatatggtggaaaggacccgaatggttggaaaaaccagcaaacctttggccagacgaattgacggcaattctgccaccggaggaaagttcagcgcccgatcccgttgtggtcgccgttgtgaaaattgggccagacattttcgaattcgaccgattcg

SEQ ID NO: 52260 - DNA, 1582 bp, Heterodera glycines
  Genomic contig location: Contig_ID=SeqID_21657; Location=174..1755; Strand=+
  SCN-specific regions: Sequence locations=1-542,564-911,956-977,999 -1467,1494-1497,1520-1547,1569-1582
  Gene Ontology: Biological process=regulation of protein activity, epigenetic
atgggcaagctcggtcacggcgagttcaagcagtggaccgaaattctgtcgaaaaagaacctgaagagtcgcaacaacgcgctgaagggcaaagcgccgccggaggaaagcggtgccgtgtccgctccgtgccagtcgtgtgcccagtcgcacggctgggccgagacgcccgcgctgttgtccgcctgcctggtgtccaccgagccggagccacacttacgcgtgatggcctccacctcgccgggtgcgctcggcgacagcgccggaggcactggcaccacaaatgccgcaggcggtggtaccggtgccggcggaggaatgaagccgagcggcggtggaacatcgggcggtggcggcggtgccaacaccatttcgtccgcctccagcgcgacaagcagcaaaccggcgatgggcagtgccggcgcggggcgccaatcggcgctgggtgccaatgttggtgcgcagcaacagtggtggagccaaacggcagtcgcctgtccggacgaccgttccgtcacacacattatggtcttccaggtacattttgggttcgggttttttggtgccggattggacggcacatattttctccctccaccgagggattccctgttttttttgtgccaatgccttattgtgttaattttagaccattctgaatgtgtcgctgggccaccaccagggcgaggatatgcttcagagtgcgtttgacgatgatggcgacctcacaaatgtgttgggcggcttcaattttgttgaacagaaccaagaggaattggaccttgacaatttggagattgacaaaggtcggttttcacatccgttcatccctcaaaagattggaaatttctaaagggatttcgattacaaaaaaggcgtatatttcgggaattcgacaaaatttcgccgccaaaatttaaaaaaaaattttgaaaatttttctaataatttttttcattgcgcgaaggttgggcaaatgaaatgctttgccctgttaacatgctatcatcattatttatggactaaattttaaaaacaattttgcagacgaagaaacgcagatcaacaaccagccgatggccatcgggtacaccgtgtccacggccccactgcctccgggcatgccgtccagcttttggcaccggtgccctgccgcacgccgtcgtgccggcgcctcgggcattgcacatctcaaatcgtcactgcacatcaacacgtccaacctgaacgaggagtacgggggcggcgcggcacagcagcgggagcgcgactcgggcggcggaggaacaacggcttcatcagctgggggaggagcagcgaatgcaaaggcaaccggcgccgagcagcaacaactgccccatgcccaacaccctttggacgcagtggccaccgacgacgtgttaaggtggtatttaagattgaacgagaagatcaagccgtaccaggagtaataatgaagggtggtgaatctccaaaacaaaaatatttcatgaattgggacattgtgaaaatttccattcttttaaacaatttactcttaaaagccaataatattcatcattttatatggtctaaaaactta

SEQ ID NO: 52261 - DNA, 980 bp, Heterodera glycines
  Genomic contig location: Contig_ID=SeqID_21658; Location=356..1335; Strand=-
  SCN-specific regions: Sequence locations=1-23,50-91,117-559,581-980
atggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcagctctccggtagtcagtacctaattaaacttggcccgccagtaaccaatacctcacaaggctctgctctccgatagccaatacctaattaagcttggcccgccagtaaccaatacctcacatggctcggctctccggtagccaatacctaattaagcttggccctccggtcaccaatacctcgcaaggctctgacaccgaacactgaaaacttcattcttttgactatgaatttttatttttatgcaaattgttatcctcgtggtctaaaatttatatgagaataaaatatatctttcctattgatttggcaaaacgcataggatggaaaagggagtgggtaaactgagtttgcgatggtaaggagcaataatgaccgaatatgtgttggagaggaagggcagagctgaggaaaccaaataagtgaaggagaggggggtgaggtcactgcgtcatcttatcctgtaaatcgattcctctaaaaggaacaaatggaaagaggctaacgccaactgctttcttaacaaaatcctatatttagagattttggtttcgggtttatttgaattattttccttttctccgtaatacactttctctactcttctatatctgtttactttcactgttattccttattaatttcagacctacatattgtctaaataatcgtttccgttagctatttttcaatatcttttcttccaacactatgttttattctcgaaccgttatcttccaagtgttcgtattcttgttctttatcaaactattctcttccctatacattacctaatgtttgccttacaaactcacattaaa

SEQ ID NO: 52262 - DNA, 426 bp, Heterodera glycines
  Genomic contig location: Contig_ID=SeqID_21659; Location=298..723; Strand=+
  SCN-specific regions: Sequence locations=1-49,410-426
atgccattggctaatccaatcaaatcccatcaattgccaatgccattggccaatcccatcaaatcccattgctattggccaatcccatcaaatcccattgctattggccaatcccatcaaatgccattgccattggccaatcccatcaaatgccattgctattggccaatcccatcaaatgccattgctattggccaatcccatcaaatgccattgctattggccaatcccatcaaatcccatcaattgacaatgccattggctaatccaatcaaatcccatcaattgccaatgccattggccaatcccatcaaatcccattgctattggccaatcccatcaaatcccattgctattggccaatcccatcaaatgccaatgccattggccaatcccatcaaatctcatcaattgccaatggcttga

SEQ ID NO: 52263 - DNA, 1319 bp, Heterodera glycines
  Genomic contig location: Contig_ID=SeqID_21659; Location=738..2056; Strand=-
  SCN-specific regions: Sequence locations=1-149,199-406,429-758,781 -1085,1119-1263
atgctcagacatgagcccgtgttccgagacgaagtgaagcgactggtcgagtcgatggtggcaccgaatttgctgaagccaaaaatgctcaatgggcggccaatgaccgtccgaaaattcgtcgaatgcgtccgggtgagtggtcgcgctattttaatattaaatttctaattaattttgctttttattaatttttaaggaatacgcccgcattttcgacagtgccgtcgaaatgccggacccgcgtgccattctaaacgcgtgcggtgttttttggcccattaccacgtgctcaatttgtttgttttacagtaatttacaattggcttgcgtggattttgcgatggaggcaaaagtggcgtactgtagggcgatggatcgcgcgacacggtcaagtcgaatgatggcggagaagaagctgcaggaggcacacataaagcacggcatcaaggcgctgaacatttacgaccggtaacgtaccgtatttggtccctactcagtatgccgccgtatcaataatgagacaaaggtacagtaaaatagcgaaattaatgcaaatttaggtgtcctaaaatatattctggtgatgtgcgcaataacaacttggcccgactacaagaatccatcaatgtccggcgtttggattaaatgaattactataattgcaatttttgaataccgtacccaattgaatattgaaagggtactgtaaatggcatgggcactcactgttttgcagcgatatttcagcaatggtgccccatttctgcccaaaactttttcggcttttcagcatgaattagagcgttacaagcgcttgaatgaggagaagcgcgtaacgacgtgcgcttccgcgatgttggcgtgtggcgactcgccgctgttcggcgtcggcctcggcggcgccgcgtccggcgccgtcgccgctaccgtagtcacactgcaaatgggcgtagtcaggtggacactgtaaatttcgtaatccacaattatgaataaactgcttaattcacaatttagcgccggaattgttgcaattcccgtttcactgacggcacttttcggaatttgggtagattcaatcgttttaaattattaaattacaataattaatttttcaggtttacgtgacacttaagccaacagtcaaagcgtgccttggcatggaaaaggacaattgaaacataaattaaaaaacagctgtgttattattacccttgcacttttttatggcattgatcacttgggcattttttactgttcaatttttgttttttagataaaaaaacttttttttttgaaattttaaattaaataaa

SEQ ID NO: 52264 - DNA, 1323 bp, Heterodera glycines
  Genomic contig location: Contig_ID=SeqID_21660; Location=31..1353; Strand=+
  SCN-specific regions: Sequence locations=1-1237,1259-1323
  Gene Ontology: Mol. function=cell adhesion receptor activity; Cellular component=cell wall (sensu Fungi); Biological process =agglutination during conjugation with cellular fusion
atggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaattcggcctcggcatctgcttcaatgacatctgtgatgacgctgactcagttagcaatcaaataatttggcaaaattatcttttgggttttcaggaccaaaaccgcagcatctccagcatctgcatccaaggggtcaaacaacaagcccaagcagcaaaagaattcggcctcggcatctgcttcaatgacatctgtgatgacgctgactcagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagtccaagcagcaaaagaactcggcctcggcatctgctacaatgacatctacgatgactcttactgagttaacaatcacataa

SEQ ID NO: 52265 - DNA, 360 bp, Heterodera glycines
  Genomic contig location: Contig_ID=SeqID_21661; Location=47..406; Strand=-
  SCN-specific regions: Sequence locations=1-162,347-360
aaaagccgggtccgggtccaagtttttaaaccgggtacgggaggaccagaaagtggaagaggaacagaaagtggaagagaaagtggaagaggaacagaaagtggaagaggaacagaaagtggaagagaaagtggaagaggaacagaaagtggaacagaaattgaaacagaaagtggaagaggaacagaaagaggaacagaaattgaaacagaaagtggaagaggaacagaaagaggaacagaaattgaaacagaaaatgtaagaggaacagaaagtggaagaggaacagaaagaggaacagaaattgaaacagaaagtggaagaggaacagaaagaggaacagaaattgaaacagaaaat

SEQ ID NO: 52266 - DNA, 174 bp, Heterodera glycines
  Genomic contig location: Contig_ID=SeqID_21662; Location=299..472; Strand=-
  SCN-specific regions: Sequence locations=1-34,57-174
atgtccatcccagctctccccccccccttcgtcagtgttttggctcgtccgcttctcctcctcccccgactgatcacaacggttcgccgccgtcggatgagtccgtcgtttattcgtcctccaattcaaccgccgatgcaatggcaccaccgccggcaacagtcgacgaataca

SEQ ID NO: 52267 - DNA, 462 bp, Heterodera glycines
  misc_feature (94)..(94): n is a, c, g, or t
  misc_feature (116)..(116): n is a, c, g, or t
  Genomic contig location: Contig_ID=SeqID_21662; Location=1890..2351; Strand=-
  SCN-specific regions: Sequence locations=1-127,150-227,250-397,424-462
gatttccgcgcaccaaaatgtgccaattccaagccatgtgattgccaaccctggccaacagagttcggttggccatggaaagacagacgaaccngatggcatcggacttcgatttntgagggcacagaaaaagaaatatacatattaggaggaaaattcatagttaagaaaaccattttgttcgcctattctgaagaaaatttgttttggtaaaaaagactgtattcaaaatattttttaatatttattgattgggcgtgaaagcatagaacttccataattataattatataagaattcttcccttttaaaagcgacgaattacccctaccattgttttgtataatgactagtgctgtcaaaaaaatgtacaaaaagtatagtcaaaatatgtacataaatatgtaagaaaaatcccgaaatatgtacaaaaaacaaataggtaccgaatatgcaaataaa

SEQ ID NO: 52268 - DNA, 424 bp, Heterodera glycines
  Genomic contig location: Contig_ID=SeqID_3880; Location=250..673; Strand=-
  SCN-specific regions: Sequence locations=1-35,57-424
atacatcgatcacaatgtgatcgcttttctccgacgtttttgcccaattttcgccgcttttccaattaatttggccatcaaaacggacagtgatctgatttcggagttcattttgcgcaacatttggccaatgctcggacgaaatatttgtggcctgtttttgtttgcgaatgtttttcatcgtttgcgcaaatttgtgccgtcaattctcaacgattgtccatcgcttcgtgttgtcaatttatgtgacgccgatctcttcattgaatttccggccgatgacagtgccgcggcatcggatggacaagcggtggccaaatggcttttcactccgcttcaaaacaatgtgccaaaagtgttcatgtgttggtgggacaataatgatgatgggaatttggcatcggaacttgaagccttcaaagcg

SEQ ID NO: 52269 - DNA, 753 bp, Heterodera glycines
  Genomic contig location: Contig_ID=SeqID_3880; Location=1413..2165; Strand=-
  SCN-specific regions: Sequence locations=1-43,65-73,210-221,271 -501,524-656,679-753
atgtctgacaaccgaaaagaagcggaggaaaagatggcaaaagcaatgtaaaaataaaattaaaatgccaattttcaatttaatttaaatgccaattttcaatttaaatttaatttaaataccaattttcaatttaatttaaatgccaattttcaatttaaatttaatttaaataccaattttcaattttaattttcaatttaatttaaatgccaattttcaattttaatttaaatttaattaaaataccaattttcaattttaatttttgttttctttttttcagttttatctccgccgattgttggctcaaagtgttcgatttgctctctccgcgtcaacttggccttggaattgcaatgatcagccaccgtttcgacttttatgtggacgaacacttcaaaattcgcaaatggacattcggaactgttcaatttggagacaaaatgcatgaaaattgttcaaaattcaattaattcataactagggaacggatttctaagtttttgcttattttttctgcggctttaactcgacgagaaatgcacgaaaaacacattttttgttcgaaaattttgtgttttaacgcacttattcgaacttagaaatgcttattttggcgtttcgtgcttaaaatgcttattttagaggttcgcccttaaaataagtttttgtacttattttagcgttttatgcttattttcgttcttatttcgcgatttttgggaaatttattaacaaaaatgcaataaa

SEQ ID NO: 52270 - DNA, 2974 bp, Heterodera glycines
  Genomic contig location: Contig_ID=SeqID_3882; Location=257..3230; Strand=-
  SCN-specific regions: Sequence locations=1-62,86-414,437-774,801 -924,946-954,1014-1280,1303-1360,1382-1562,1584-1791,1837-2020,2042 -2487,2527-2629,2651-2651,2677-2880,2903-2974
atatttattagtaagaaaagctacctttgtttgtaaaataaccaaaaatattatttactataaatgttcttctataaaagagacggcatttgtcgtacgtaatccttttaccaatcatggcttgcgattgtccgtcacagttttccaccgtttgcgtcaattcgccccgtcaattctcaacgatttgccgttgttatgcattggcaaattccatgctcatgatgatgatgttgacgatctcttcgccgaatttccatgcaatgacagtgccgcggcatcagatggacaagcggtggccaaatggcttttcactccacttcaaagcaatgtgccaaaggtgttcaaatgcgggttggacatggattatgtgaagaattggtcgtcgaatattgaacaattcaaaacggtgcattcatttatctttcatttttctttatcaatttccccatattttaggcatttgccaatgcttcttcccccgtcaatttcatcgttttcatttgcattccgttgccttttgctgactccgttttggcctttgattttaccaacgaattgactcgggaacaattgacactgaaaagaactgactttcactactgttttctgttggtccgttgtccaattgcgcgagacgaaagcaaatggaccaaatgggagaaggaagcgattggctggcgaacagatgatccctggaacagaattatcattcatattagggttgcaaccccgaccccgccccgaccccgaaccccgacataacccggttgactgtttcctttttaatttatttttatgtgattaatagaattctcctaaaagtctttagaaaaagagcgccgcgaaaaaaaagatgattcgaaaaacaaaaaaaaaagaaaggtgatcagaaatttttgggcatttttttgaataaaatccctctatttttatttgggggcccggcgccggaggaaaaatttgataaaattattattatgaataataaaagatttttaagaaaaaataataaagttttttgactatatagcataaggcaaaaatcgaaaaaccccgaccccgaaccatttggtcaaccccgaccccgaccttgctgaccccgacaaccccgaaccccgacttttccaaccccgacggtcggggttgcaaccctaattcatattgatgatgagcgtgcaattggtgacgggtcagcgaatggcttattcaaaaattcaaatttatttttcgttttttatttttaggcttctcaactcagctcccggcccaagtgatcagcagaagaagtgaatgatgaattgctgataagtgattgaccaaattatgcaaatggaattgcaaattgacgtgctcataaaaaatgtgttttgttttttgttggactgatcaattttggatttttgtgtaagatttctcgttattatttttgttgtcctcctttttagaccactaaaattaggtcaaaatttttgcatcaaaattatgaacaatttcaaacggaagtgtccaccgcctgtgacgacccactgggttaattcaacaataattactgcctcaaggaataaatgtaattttctgtatgctaatatcccacccgcccccggcggatgtacaaaattagcgcgccttctccctgcgcttttcctccccccattattttgtgcaccgctcgcgcacacaatttcactttcatatgcttttgttgcatataagatcaattctccaagattgatcagttcacattcataactgttttggcttctttcctttccaaatgatcggaagggacacatttttatttttaatttaatttttttaaaatatttacataatttacctaaatgatcaaataaatcgaaattaatttacggaatccaaattttttatttcaaaaaatttcgacttgaaaattattattcttttttcttgttttaataaaaattaagctgtaagaaaaatttccttctgcggcgcccaacaccattataatactgtatatcaattttaataggatcgaaaactattatttttgaatatttaattaactcttaatttgtgccctccccgtaatggcacttccattatttgtcaaatgccgttcttcgcgtcgcgctctgtgcctgttcgtcgccttttttcttgttcattgctacccgggaccgccgtactttccgccaattcgtgctgatcaacattgggccacaattgggacgggatttggcacaaatcggtccaaaaatggcataaaaatcccccttataaatggccaaaatttgacagaattgtcgagactccgttctcgagactgccgaccgccattgaaaccgtgccaaaaatggcaaaaatgccattgaattggaaggcatcaagcaacagtcggaaggaagctgattttttgccgatgtcagctgaccggcgcatgattttggtcaataatatcagaaaagtttttatgccaaaatgaaaatatgggaaatttttgtccatttatcataatccacaaaaatataaatgcattaaatattgtacaaaattttaatctgtgggagggtgaaaaatttcaaagaaaaaaagaatttccataaaaatttacaaaatttcataaaaattcactaaaaaattgaaaaaccattccattgtaatttcacctgatttttaaatttttaataattatttcgctttcggatttaaaattcaaattttagttgtttttttttttgccctgaagcccttgaatttagctcagttttaatcaaacttttttctatatttataggctcttgcctcaccgctgtcattgagtaccactaattctgtgatgcgtacaatagggcagcaacacgatgtgccgtcaaatggtactgttacagtaaccttaattgtaacacaatcttcatcaacagaatctaaatggaagcaaatggcgccttccgatttgctcgcaaatgttacggtaacgccacatgcaatggtg

SEQ ID NO: 52271 - DNA, 959 bp, Heterodera glycines
  Genomic contig location: Contig_ID=SeqID_21664; Location=131..1089; Strand=-
  SCN-specific regions: Sequence locations=1-109,162-269,308-340,362 -406,428-630,652-894,916-959
atggatgagtacaaaaatgtggaggagggcatttccaatggcattcgcattcagctgaacaaggagcagggaaatgtgagaaaaagagagagaatggcatgccggtgccaaaatatttaattaatttaattattttaaaatttaattataattaattatttcagcgcgagttcatcttctcaacagttgcgggccatttcaaagtgttgcaaagggtcaaactgttctggcaaaactgtcttgaagctgaaaagcaaaaaaaggtggacatttctttaaaaattccttttttaagtttctattttaaaatgccaccgatttgaattcatgccaatcactctctctgcttgaatgtcctttaataccatatgtttcttgatttgttttccgtttttccctcatcttgtcaattaagcccctaattgccactcccctcccacttaattagtttgatcattaattggatttcctttttttgccctgcggctattcactcacctcacacgcaattcccaattaagcgcctaattaactattgccatccccctctctcccacttgatcagttggcactcgcccgacagtccgccagtgccaccgtccgtcgtctgaaccgcaagattgtgcgcgagccgctgtacgcgcactacccgcaccgatccgtgccgacgccgacggccaatacgacggtcggcacaaccctcgccggcactgcggacgccgacgcagttgggccggtgcagtcgcgcactgctcgccgctgggagaaactgttccacgactacggccacaactattccatgttccgcacgatcgaactgcaccgactgctgctggacggtgctgttgttgtacaacaaatagcaaaatgagagtagctttttccatcactgccaaccctgaccaaaattgatttacaaattcgaatggggatttttttgcaaaacaaattttaataaa

SEQ ID NO: 52272 - DNA, 1428 bp, Heterodera glycines
  Genomic contig location: Contig_ID=SeqID_21665; Location=1..1428; Strand=-
  SCN-specific regions: Sequence locations=1-308,330-684,706-719,760 -770,792-972,1015-1401,1423-1428
gagtccaccaatttatgggtggggaatgccaaatggaatagtccaatttcttaaaaaaataaaggaactctgcaatcgagagtttgagtatctgagcatcacgcgggacacgacagaggtcgacatcaaacaaaggcgcgaaatccgcgccggttcagcctattacactgatttggtaaatggagggggggggggcgatccaacgaaaaatcaaagccaaacatttttttttttcgtatttcctcattttggaagatttattctactgtttgattatctaggactttcgcaaacccaccaggcgcccgaaccagatttttcccacccagactgacaagggaaaactaggttaggcctgtagcgcttgtaagcgatttaaaaaaaagtttaccagacatatccggctcaagttttcaccgcctttcctcacatttcagtgcgctgtccgtgccgctctctgtggacgcattttatttatcgatggcgtggaaaaggccgaacggaacgtactgccaattttgaacaatttgctggagaatcgcgaaatgcaattggacgacggacgctttcttttgtccgctgaaaaattcgaccgtctccttcgggtgagtgaacaaattaaataggtttttataggagatgttttacagtgggcaatttccttacattgataatttacaggttcttaatttattttcaatatcatactgcttattgttagagaagcaaatttttaccccaaaattaacacggaaaaaatcaacattttatttcctaaaaattgatattttcaaatattggtctacccttaattcaggtaaatctgaaaattagaacacttgcgaaacctgaaaaccttgttgaccaatatggtcgcagaagaattcctagtgttttgtacacaattgcgttgtttcccccttttttctgaatttcgctttgtccccatttcttccccctttcagaagtattcccccccccccccccccccccgccttctcttcctcttttttcggttttcagtcaataattaatgcatttgagacgaaatttttctgcttttgtgagaaaatttgttgaacgtttgataataagaaaaagggagcggcaaggagtgaattgaatgaatttggagaaggggtgccattggtaggcgaaggaatgccatttccgaaaggaggagaacggataagtcgggagcgcatcttttgcatctctgtcgagagttaattaagcatccgagcgaagggaaagcataagcaaaaaggaacggacggatgggcggtggcccagagagtgctttttgtaaggacttcaattggatttccctcgtgggatgcgttgcgggagcctccgacgcccaacgccaccactctcgcccatcccccacccgcaatcttcctttctttttgcctcctcctctttctc

SEQ ID NO: 52273 - DNA, 721 bp, Heterodera glycines
  Genomic contig location: Contig_ID=SeqID_21667; Location=430..1150; Strand=+
  SCN-specific regions: Sequence locations=1-293,315-721
ccctccatatcatcctcagtcgaatggagtagcggaacgttacgttgactacttcaaacgccaactcaaaaaatgcagtggtgatcgaaattggcttagcaaatcacttctctcatatcgatcaacaccaattgctattttaggccaacgctcaccagctgaattgtttttaggccgaaaattgcgcacaaaattgtcactcatgaggcccgaaaccattccaaagcaacaacatcacgaacacacgtccaaaatgaaattgcaatttgacaaaaagcacagtgtaaagccggtacagtttaaaattggagagcaagtccaatttctcaattaacgaaatggtcaaacactttggcttttcgggcgcattgtttcaattaaagggctaattttcgaaatccgttcccctcagcttggcaaccgaatcatcacgcgtcatgccaatcaaatgcgaacaacaatggcacagagcggtgacgaaacatgttcggttcccgatgacatcattttcgcgagggaggagcatggaaccggaaatgaaacgacgaccggaaatgaaacaacggacgatcagcagacaaacacgcagccacaacaacaggcagcgcaacaagaggaacaaaggcaaaaccaacaaccaactttgcgtcgttccgaacgaacgaggaaaagtgttcgttttcttagtccgacgcacactggacagagttacgatcactga

SEQ ID NO: 52274 - DNA, 980 bp, Heterodera glycines
  Genomic contig location: Contig_ID=SeqID_21668; Location=458..1437; Strand=+
  SCN-specific regions: Sequence locations=1-84,120-207,274-285,308 -405,427-482,540-980
atgcaaatggtacacaaaaattacgggccgttgttagcatttgggggacaaagaacgaagaaaaagagggggacaaaagagcgaagaaacggagaggaaaagaaatggaagcaagagaaagagtggaggaggggtgagggcaaagcaccgccagttgtagataaggtaattgggatttaaaaattcaaatgtaaagagaaaatgaccaatttaaaatattagattaattacgaattacattttttattttaaaaaaacaataaaaaaatttaaggcaaaaccaacataatattttttttattaatttcgattttatttccataaacagtggggaaaattcattgttttgtttatagcagccgaaaatggggcaggagcatcacaaaaataatttatgtatgtttccaaaaatatcctttttaaaaaggcattccatctcatgtgcaattaattgattattggggggggggggggaatattcctattattttaaaagtgtaaaatgtatattaaaaataaaaataatgtataatataatacatattacgtaaaagaaagagtgcattcgaaatttgaaaaagatttgttgggattacaaattaaaacacagctaaaaaccaaaaaaaaaaatgctaaatcgtaacggaaaaagtttgaaaagtgttcgaatttggactgtcggaacaaactttggcaaaaactattagcatttgtataattaggtagatatgaaaattgtcgcgggaaagtgcacttcgcaaagcgacagagacaaagggaggaaaagcatttggagaaaaagcatttctgggaaagtcacggggacttcattcacttgcggttcgtttggttggttgatggtctcggcacggaggtggacaaagaaagcgaaggagcagaagcaaatttttaatttttgtctaggcaaccgaaaagtaaatttaattggcactcatttgtttggcattttgtaacataca

SEQ ID NO: 52275 - DNA, 260 bp, Heterodera glycines
  Genomic contig location: Contig_ID=SeqID_21668; Location=1535..1794; Strand=+
  SCN-specific regions: Sequence locations=1-51,73-225,247-260
atgacacctttttgcgcatttgttggactgacccaattggcggttactgtaattggaaaaggagtggaagtgcgcgtgagtgcagcagagaaaaataacaatggcagacaatcgtttcgaaatttttttttttaaagaaaccgtcaaaaaccacaaagagcgaggcttcttgaaaaacaaaaaaagaaaataaatataaaaccttagcaaaataagcgtccgctaattgagaaattagaaaagggataaaataagctgca

SEQ ID NO: 52276 - DNA, 154 bp, Heterodera glycines
  Genomic contig location: Contig_ID=SeqID_21670; Location=355..508; Strand=+
  SCN-specific regions: Sequence locations=1-154
atggacaacacaaataataaattcattttgttgaagaatggggcaaaattattctatgcttctgaagaatgcgtacgtcaggaagcgaaaaactttgtgggtggaattgtcggtttgaatgggccttcggatttggaggagggcatttatgagg

SEQ ID NO: 52277 - DNA, 79 bp, Heterodera glycines
  Genomic contig location: Contig_ID=SeqID_21671; Location=83..161; Strand=+
  SCN-specific regions: Sequence locations=1-79
tcttttggctgccaaatcgcattatttcggcgtcggcggaagtgttttggcattcgttgaattcgtccgctcgcgagga

SEQ ID NO: 52278 - DNA, 697 bp, Heterodera glycines
  Genomic contig location: Contig_ID=SeqID_21672; Location=264..960; Strand=+
  SCN-specific regions: Sequence locations=1-164,186-227,254-371,421 -447,491-497,522-673
atgtctctcattattaaattaaattacctgcaaaggaatggacagttccgttcgagtccagtgtgtgccgccgattggtgttcaaattgttcgatctccacgcaatttgccaagtgcgtctcacaacgcgaattcatccagtccacctgaaaaagtcggccaacttgagcagcgccagcacattttcctctgaaatgcgacaaaatgggaaactttacaaaaaaagcaatttaaaatatattttttaaaattagggccttaaccatagcggtacggtggagggcggatttcccccgggtgcactccgttcaccccccccccccccccgtttcccgcgcatcgtttcccttacgaaaaaatgttaaaaactgaaaatttttagttttctatttttttataagttaaatagaatttttttttcagttttatcattaaggtttttccttgaaaaaattaaaaagttagaaaaaaaattttttaaattttttttcgggggaaaatgtgctttgggggtgggggacggacgctccattataaaaatgaaaataaggaatttttagcaagaaacaaatgggtgcattctgaaaaataccgccaattttcttaataattcggaaaatttccaaaaattttccacgcggcggctaccgccatcgctggatttaaaaaattcccataatttttgaaatttataaaa

SEQ ID NO: 52279 - DNA, 2917 bp, Heterodera glycines
  Genomic contig location: Contig_ID=SeqID_3884; Location=103..3019; Strand=+
  SCN-specific regions: Sequence locations=1-1125,1147-1943,1972 -2526,2549-2598,2625-2837,2859-2917
atgccggatgacagcccattcatgtaccaaatcatccgcagcaaactgccgtcgactgttctgtccgaactcatcaaaatggaacgtgcggcaggcattccatggggtactcctcagctcagagctggacttgccgaagttctcggagtcagagaagaggtcgaacggtgtctgcgcgaaacaaatgccgacagacaaacacgatttcggcacgaagcaaggccaaatcgacctcagcgaccagaacggcatgaaaatgcgcgagttttttccgttgctcagtccgtcagaaattctgatgacaagcgagttccgtcctgcctgttctgccctggccagcattgggcctcggagtgcaacaaagtgacagatgcagagactcgaaaacgttgccttttgcagcagaaccggtgcctcaattgcctacggaagggtcaccaattgagggagtgccggtcaaagcaagtatgccgagtgtgcaaagaacggcatcattctgcaatctgccctagtgccaaagggacatcttctgcccgttcaaagcaacagaagccctcgcccaggaacaaacagagtttcggaaacgagcgcaactcaaggccattggtgtcatccgcggttgccaatgaggctgactcaatccctgagccgaaaactgttaacacaatcatggcaattgtctccccatccgttcctcatctcgtcatgctcatggccctccgagctcctgtgttctcagaatccgcaccgaacaagcgccgtgacgcactcttcttctttgaccctggtgcgcaagtcactatggtcaagacgccattgataaggcaactgagccttccgaaactacaagacgatcagctagaggtgaatcctttccacacgcggcaacccatcaagatgaaagcgccgcaacacgttttgtgcgtccaacgagaggacggcggatacgaaactctggttgcccatcggacggactggatagtgccatcagtgcgccgtgccacattcctccagggaatgttagtgcctgtggatgaagaaccggacattctcgttggaatggcagacttttggaagtttttcaacggtgtccaacgagtctctccgcaacttttcaaagtccaaacttcgatcggttccactgtctgcggacgcgatgaaattccgtcccgcccaactgccgaccatccactgtccgttatgcccgtcactgtccatgttcctgccaatgaagacgagatgcccaatacggctgtcagcggaattcagagaaacgaatccatctctgatcttgactcgctacgacaattctgggaccttcaaaacattggcatcagagatgatccactcgaaaacgatgacgagacggcacaacaaatcttcgaccagacgactacgcgcctggcaaacggaagatacagcgtaggatggccatggaagaattttccgccggacctgccctcaaattttgccatcactcgctcaaaaaccaaagcactggcctccgttctgtccattctgatgtgcctatttctgattggcgcttcccaaaccaacgccagtagcacgaccaagccaaagcgtgggaaaggacttccaattcgttgccgtggatgcgaactgacctgcacaaaaaccggcgttgacatttcaataccgaatgggattgtcaaattcttgctatgttgtgccggtggaactcagtgcatcactcaatcaggcgttcggaaatcctttcatcgtttgcccaaggaacatcttcttttcgactacgattgcgaagcaatgtactggacgaaacggggcaacaaaagaatcgggagcgtccaatgtccaggcagagatgcgtgcgagctcatcgattgttgggtgtgcctcgaacgactggcaaatcctgattgtcgtccagatgtgaccttcggactcattggtggagcgagcttcttcactttcctcttccttttctggattctgccactgatgtgccacgtcaccatgttttggatcctacagcatcttttcaccctgctcgttcgcttattgtgttgtttttggccaagccaaaatgcaccgcagagagaagaatcccctctccttgccttccaaagtctgcctactccgcgcaggcgccaaatgggtcgcagtcgttttcgtccttttccaaaacttcaaacgacgctcctgttattgaccatctgtgcctttacttcatgtgccagggcacaagttgtctcaatcactgcctctgctgagaaatgccaaaggtccgacttcggctcggtgtgccatctcgagagctcgacaacagttactcttctcccatcgggtctgccggtacgtctactccttcgacatcccgacgagagagtccttggcacgcttgaaatcagcatgcgctcactgactttgcattgcctgccaaaatctgagcaatggcttcggtcctatcacattgagacagtttcggtaaaacggtgcccgagtcgtggaaattgtacacgcgagttctgcgatgacgtcaacaacggaaggaagacagaagttcaggagctgagcgaatggaccaagcatcccggattcaacagatgctcagcatcttgctctttttggtggtgtggatgtttaaatgccggtgccagctgcatcttctaccgtccacatgccattgctaactcgccaattgtctatgagcaaatctcctgtcccacatgggaataccgcttgcgcacttcactcaaactgtcggtcaacgcaaacttcacgaaagagccgtccgtgtcgctcacacccggcattacattccgttggaaggatttgagcatcacacctattgcctcttctgttcctccggccccaatcatggcaaacaagtttctctcggatggcaataacgtggcaatcagtgatgaaatccaaa

SEQ ID NO: 52280 - DNA, 68 bp, Heterodera glycines
  Genomic contig location: Contig_ID=SeqID_3884; Location=1510..1577; Strand=-
  SCN-specific regions: Sequence locations=1-68
atggcaaaatttgagggcaggtccggcggaaaattcttccatggccatcctacgctgtatcttccgtt

SEQ ID NO: 52281 - DNA, 2529 bp, Heterodera glycines
  Genomic contig location: Contig_ID=SeqID_3885; Location=106..2634; Strand=+
  SCN-specific regions: Sequence locations=1-798,820-1222,1244 -1449,1471-1544,1566-1851,1875-2275,2337-2508
atgtccaagggtcttttcggatgctattcgtgccacactggagctcatctccatttgcaatgccacaccgactttggctccgcacttggctacgttcgtggttcggatggcacagaattcacagccctttgccacaaaacaccaaaagttttgaatgtcagcctgtcattcaaccgtgccgaggtcgacatcaattgtaccattgaatgcagtggaggacggaacccattcgtgattaatggtcatctccgctatgtgccaaaacacttccaagcacctaatgaaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcgtctatgtccttttgcgttgcaaccctgcccttcgatcttggagagccataagccgagtcgtccttttgttccttgctctttggcctacgactgattcttctgcagcgggagggctgagccatctactcagcattcaaaattcagcaccaaagctgcagtttgaaggccattcttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccatttccaatggccacactgctctctttcctcgccaacacgatgaacatcgatgtcgatcgcttcggtcttgccgtcactacatccatgagccgttggaacgaggcccaggcgatcgttgagggattgcacgctcgcggctacgaactcaagacacggcatctgtacccacgtgagcgaaatgtgcgacttcacgggtctgagctgagccgaagtggtgcgagtcgtctcggtgcctacaatggaagtgcccgtggcccaactgtctccgagctgtaccgctctcgacatggcatcactcttcggcacccctctgccccatgcttgatggagcccggcgggaatgaacaccatgattttttccccatcgaaatgattcgagtcgtggcccctgaccaagtttctacaccacggggcttgtccacacgccctcttccccgcccccgcccgtctcacttcgagctctgggacagaactgaccatccgccccggtcccgagaattggtgatcaacgttatgccccatggtgattcaacgagtcgaggtgccgcggaggaataccgcatcggtgttggccgcgaactcacgatctctggccccctcgttctacgaatctatgctggtgcccttcttcttgccctattctctgttgcccttgtcgatggccaatcatctattgctggtctctgccctgctcattcttttgccctttgctcttcacggctgcacaaattttcttgccactgtccgtcgctttttggtccttccgcattcgattttgtgcaaatcgtcaacaaatttgctccgctggcttattcaccgtcttccggcagcgaacacttcgttaaaagccatgtcaaatcagctgactcacccttctctccgctctttggccgagttcaccatttgccgctatttaagccgttggttgcaaaattggggcaccattcattgccctccgactcttcaatttccgtcgccctcgttgctatgccgtcaacgcactgctcgtcgactttggctcctgttgcttcccatgttcaatcgggtactgcgtcgctttttgatccttcgtctccgcgtgtctgtactgccgatttcgtcagggcgcccgaatcatgccctccaactattggcctctgcacgaccgaccgtatgccgactatcagtcctatcgctgataatcaaatggccactggtgtgacaagccggtggatgagcattcaacaacgcgaaaaatatgaacgacgattgcttcgactaaacggcttccgcccaacgcttgtcatttgtgagccaatgagttcagccattcggcgcgaacgactccgactgaagcgacttcacatggccactccccaggaaccgagaaaacctggagcagtgtcggaggaagaaggaacagcagttgccggaccatcttcggcggggagtgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcattttatattatatttattaa

SEQ ID NO: 52282 - DNA, 484 bp, Heterodera glycines
  Genomic contig location: Contig_ID=SeqID_3885; Location=3719..4202; Strand=-
  SCN-specific regions: Sequence locations=1-74,97-106,129-484
atgacgtccaaggacagagcacagcgaatgactgccaaaggggtggtcgactatttggagggaaaatgcaagccaaggcaaaacgggaaaagccccgaggcaaattgtgtgagaaaaagccccaagagaataaaactgtttggcacaatgctgaccgatgagactcccggacaatccgtcagtggacaatccgtcagtggacaatccgtcagtgtacaatccgtcggtgttaaaaatatttaagttcccttgagtttccggggtcgctgatcatgaatccggcatcaatttcggccgattccgcaccccggaacccgaatttgaacaaaactcaaaagtccaatttttcgaatttagctattatggttcaaaaacggcttagatgatctcttgttgcagtgttgatgggtttcagtttggttccatgtgtttaggcgcagacaagtttaaagattcataactttttttaattcgaccaaataaa

SEQ ID NO: 52283 - DNA, 719 bp, Heterodera glycines
  Genomic contig location: Contig_ID=SeqID_21674; Location=276..994; Strand=-
  SCN-specific regions: Sequence locations=1-179,201-552,574-719
atgaagcgaagcaacacaacaaaagacactcctcctcaaccaaaacgttcaatggcacccccactggacctggacccaaacactgtcgcactcgcagagcaagaacgtcaacgcacattggtcttcattggcatcccggaaagcaatgctgttcgcccatcggagcgtgttaaggaagacagggaagccaccaccaaaatcttggaccatcttgaagttgaggccgaaccaaccgccgtctttcgactcggccggttcgacccgcagcgaacaacacctcgcccgctcaaggtggtcatgccaacacccgcacatcaacacatggcacttggaggatggaagcgcgagcgtgctcgactccgttcgcaacaaaatttggcccgtctgttcgtccgcccagcgctcagcaaggaacaactcaaggaggaatacgaagcgcgtgtcagaaaacgtcaacaaaacactgctcccgtggcaccagcaatgcagccaccacagacaaatgttccggctcccgccaaagaaaatggtccaaaaccgaaggaggccagtgaagacacttcaaaatcttcacaggttgaaaaaacaatcacacaaaatcaaattccaaattcactcccaaaaattgacaattttctcctccaactgcaatcatttcaaaaacaattcccccagtgcttcgataaatagtttttcagacctccagcaaattcaataaa

SEQ ID NO: 52284 - DNA, 938 bp, Heterodera glycines
  Genomic contig location: Contig_ID=SeqID_21675; Location=536..1473; Strand=+
  SCN-specific regions: Sequence locations=1-52,172-192,357-551,588-938
atgtatgtgaaatatgtcaggtaaaccacacaaatgtttcccgagaacgtgtgagataaagagagagagagagagattgaggaggagagaagaggggaaatgagagagaagagaggaaaggatatagagagaggggagaaagtgatagaacgagagagagagaaaagagaggaagcgatagtgaggggggatagagagagagagggagaacaagtgagagagaaattggatagagagataaggagagagtgagaacgagtgatagagagaggaaagagagagagagattgaggagaagagaggaaacgagagagaaagaagagaggaagcgacagagagataggagaggagagagattgaggagaggagagaaggggggaaaggaaagaaagaaaaagattaagaggagattaaaatcgcaaaaactacttttcttatttttatttgcctgcattataaccgtttgtttaaaaaaaattttgaagtagaacggagcggttgggaaccaagcgctcgtaaataactattgaacaattctgcgcatttagctcaaatatattatttcatacttaaaaaattttatatttgttggcgattcatctcgaattcgagtttcattggttaaacattttgctgcaatacttttgcgccgccttaattgcctgaatttgtttctccaatttctttctaaaaagttaaataaatctgttcatttttgtatatttgttaggccactaaatggggattattttgacacaaaaaagtgaatttttttaaacatgcattttttaaggattaaatgttcgtaaaaatttttaaattgcgcaaaaaatcccatcggagaagctaaatagtagcaaaaggcagaataatgttgagattttgatagttctactgatgaatccaatcaacattataaaatatttgcatcatattta

SEQ ID NO: 52285 - DNA, 209 bp, Heterodera glycines
  Genomic contig location: Contig_ID=SeqID_21675; Location=1994..2202; Strand=+
  SCN-specific regions: Sequence locations=1-209
atgctaattgcggttatgaaaggccgtccgaaaattcaaatcagccaatattctgtgcaaaaatatgaggcacaccttggcattgtgtattttatgaaaaacaattggcaatgtgacaaaattgtggatgtatttgacgaatttgaacgggcagaatgccaaaaatatcgaaaatatttggacattttgtacgaatatttgttcagaga

SEQ ID NO: 52286 - DNA, 569 bp, Heterodera glycines
  Genomic contig location: Contig_ID=SeqID_21676; Location=456..1024; Strand=-
  SCN-specific regions: Sequence locations=1-4,26-65,88-521,543-569
tctcttaaaaaatcaataagatagtgccaagaaacaaaaaagttctttgctttcactaattacccatttatttattttaattaattactcgcttttattgccaatatggccactgcgtcgaaagcgtcgcgcgtttttagcattttggaaagggccaaattggtctgttggtttgaagagaccaattcgtacacccaaacagcacgaaggtgaagggctaatgaatgaccataaaatgcaaaaaatatccagatttcggaccgaatttggaatggacccgccgccgcgagaacaagtcaaaaaatggcacgacacttttctgaagacgggcacaattgggaagaaaaacggagagggcaacggcacgacggacggccaaatggcactttgaccggcggaagaatgggccgcgaaaggatgcacaatttgtcggcactttgcagtgatcgccccgcttggcattcaattttagttgtggcgttaatgggacaatcagtgaataattgaagtaacaaaaaacaaacatttgctcaccgaaccattggaatttttatcatgaatttattttg

SEQ ID NO: 52287 - DNA, 1089 bp, Heterodera glycines
  Genomic contig location: Contig_ID=SeqID_21677; Location=192..1280; Strand=-
  SCN-specific regions: Sequence locations=1-94,135-248,286-373,395 -687,710-710,732-798,820-1067
atgttttttttgccatttgcttttatgcttttctctcccacattcgccactctctctgtcggcaaccctggggttaagagaagaaaacaggtgcaaatttaattaaaaatttcataaataatttttttttttttgagcatccaatcagaacaagccgtgaagacgaattatttgatgaaacacgcggtgctgaaatgttatcaaagtgcaaagcttcaaacatggatttggtaagtttattcaaaatgaataatattaatatattttaaaataataaataaataactgcgctgaaaatgtaaatcctagccaccgaaaaagggacaaatcctcacatattaggaattcaatttttgttatccttaaaaattaatcgatttttcaaaagaaaaattgcgctaatttttatttagtttaaccatattccgaaaaagacttgtcattcatattgagtgaatttgttttccatattaaaaattagaataaaataaatcaagattattatattggacgcgtcaacctcgcgcgaaaacgttttcgagcaccagcgtgagcttgcactgtcattaattgaacggcttccgatcaaccgagaggatgcgcacatttccacggggatcattagcttcacaaacagtccagtgctacgacaaaaccttggcctgggccgggaccgtaaggttctggaaaaaaataattttaaaaatatgaaaaaagcatgggtctgggtttcgtgtttgacccggacctaggatttgctgcacaaaaatccaagttcagtgacaaagtccaggttgtccaaaaagagcctggaaatgtatcctggatctagaaaaaatccaggcctggactcatcatgtccagatcgattcactgtgattaattaacctgtaattgataatttgacaaaattcaaaaatttagactgtccgtaaggcaattgaagacatcaagtacagaggcggtagcacgttgacatccaaagctgttgagcttgcgttgcaggacatgaggcgcggaatgcgtttggacgcgcgacaggtgattatgagcccagtgaaaaagccaattaattaatttataaataaa

SEQ ID NO: 52288 - DNA, 937 bp, Heterodera glycines
  Genomic contig location: Contig_ID=SeqID_21678; Location=50..986; Strand=+
  SCN-specific regions: Sequence locations=1-937
atgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatggtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaaccgacggaaacaatgtccgtgttcatgctcccaaccgggaaattgatgcccaaggccgagccaaagtgctgaatattgtagctactaatatgctcaagttacaataaatagcttagtccagagcagttggtacatggtttttggagagatgccaaagcattccattcccatctgcactatgttgggtgcgaaaatggtgagaagcttggatccgggacatggaccggtcagccctctttag

SEQ ID NO: 52289 - DNA, 910 bp, Heterodera glycines
  Genomic contig location: Contig_ID=SeqID_21679; Location=801..1710; Strand=-
  SCN-specific regions: Sequence locations=1-11,33-104,262-387,409 -618,640-666,704-745,790-910
atgaaattctgtattttattatttttatttttgattgccctaattattccaattgaatcagaaaagaaaaaacttcagcagaaatcatttggcgaaatatttggagaaaaatgggaagaaaaagaagaagaaaaacgaaatgaactcaaaaaaagagaaataattgcaaaattttataaaataaaagagaaaataaagcaaaaaggaagaaaatattcaacaaaagaatggggaaaaatagaaataaaaatagcgaagaaattggggacaaatcgaatgaaaatttataaatggatcaaggaatttggtcttcaaaaatacaaatcaaaaagtgatgcagaaaaaatagaaattgtgcaggaatttattgaaatgacaaatgaatataagcaaaaaagtaaatattcacgaaaagaatggaaacaaaattatgatgaaatttgtaagaaaattggagttaacagagaaacacttagaaaatggaagaaacaatttggaattagcaagaaaagaataacggaggaagaaaaaatggaaaaaatgaaaatttattgggaaataaaaagtgaaaatccgaaaatgagtgataatgaaattgcaaaaatattgaaaatccaccaaaatagcattataagatggaagaaactgtttggagaagaaatgtttaagaaaagagcagaagaagaagagtgttgatttgttgggaatttaaatttgaagaattttttttattatgcttaaaattattattcaaaaattctttttcttgaattttattaaacatttcttcaactttgaatttaatctggaacttttttgtgacttgaagattttcaacattatattttgttcgattaatttcacagaaatatcttttaaatttgctcgactgatcacatatgcaaataaa

SEQ ID NO: 52290 - DNA, 1101 bp, Heterodera glycines
  Genomic contig location: Contig_ID=SeqID_21680; Location=1960..3060; Strand=-
  SCN-specific regions: Sequence locations=1-271,293-346,368-698,720 -773,797-828,850-865,887-945,967-1101
atgccatccaagctttcccaaaaatacgcaggacatttaccaaattcgctgacaacagtaatgagattattaccaaaaaaaattaagatgtatctgattttatattgtgaagctaggatttaataaaaatttggtttttttagtttttttgagtttttgtaatttttgggatattttttaagtttgtttaggcaaatattgaacacaccgtttcaatttttgcctcccagttccaaaaaagatttgcatgtgtggctcagttgtttttgtaagatagtgaagggacaaaggcgggggttcgagtccgttgtgcaacatgaatatttttatttaaaattcgtgcgttaaaaatgtttataatatttttctctatcgatttgcaaaatttattgtggatttaacaagtagaaaaaaaagttaaacaggatgaagtgaattcgggttttctctattaacagagacaaagaaatagtacgccaaaaatagagatgtttttttctctgaactctctctttattggttcatgtctcgttttttgaaacggtgtgtgaatatatacatatttttggatttttgagtgttacgattttctggcagtttttaggccatatttggcaatttttgagctgttattccatatttcggagctttttagcccatattctttacaaacctatctataagttaatctctaaaaaatttatacctattctgattttttgattattcggaatttcaaccggcgtgaaattctcgttcaatttacccaaatttccaaaaaattacttcaaattttcagttggcttcatttccaattaagaattcagaaaaaggaattattgccacaaatcaaatcaaaattgacattgttcaaattgttgatacttgtttggttgtacttttaacatacatttttttaaatgttatgaactcggcatagtttaaaagatttctaatagatcccactgaaaaacattaaaaattgcattgagcgattcgttatttgaaagaatttctcatgcaaaattgttcacttttaaatattagtgggggagggcaaaaattaaggcaaaataatgatctaaaagatgaaagaataaa

SEQ ID NO: 52291 - DNA, 79 bp, Heterodera glycines
  Genomic contig location: Contig_ID=SeqID_21680; Location=49..127; Strand=+
  SCN-specific regions: Sequence locations=1-79
aaaagagcgcaccccatctgatattcccatttttccgttccacaactggccaaaggcgactgtgctcattgacacgtag

SEQ ID NO: 52292 - DNA, 569 bp, Heterodera glycines
  Genomic contig location: Contig_ID=SeqID_21681; Location=421..989; Strand=+
  SCN-specific regions: Sequence locations=1-153,175-525,550-569
atggttactgttaggaccaaacgtataaaattgagtgaatctgagtttatggggaaacgaattttcgagaaatggacaagagagggaagtaagtaactagtatttggttaggtcataataaaagttaagactaaaaattcgaaataaatacagtttatttgtattgttttaattccaaggcgtgttaatttaacttggtgcattttgtacggttaatcggcacaacgaatcaaaagaaaaacaaaacaagagatgaactaaaaggaaagaaagagagagtgagcagagaaaaaaaaaaatttttgatttcgctgtttttgcgctaaattcaaaaattgattgaagtgctttttgtgttgtctgcttttttatcgccacatacagtatgggacaaaagtataataatagtaatcaaacagtatcacagatttttttttaatcgagataaggttattttaggggttacagggtcggagaatacgattcagatatccatttcgacccaattccgaacccctgacgaacaaaaatcgaaaattcaaattttcatattcgcatttttggtctaa

SEQ ID NO: 52293 - DNA, 133 bp, Heterodera glycines
  Genomic contig location: Contig_ID=SeqID_21681; Location=252..384; Strand=-
  SCN-specific regions: Sequence locations=1-133
atgtcaagctgtcttgacgtcttcaaactgacggacgatgacgcaatgaaatttttggtgtgcgaatcgcacatcggcaccaaaaagatggactaccaaatggagcattatgtgtggaagcgtcgatcagacg

SEQ ID NO: 52294 - DNA, 55 bp, Heterodera glycines
  Genomic contig location: Contig_ID=SeqID_21681; Location=1069..1123; Strand=+
  SCN-specific regions: Sequence locations=1-55
atgcgaaactctaaaaatttgaaatttcgactttttgttcgaaatctggtccatg

SEQ ID NO: 52295 - DNA, 407 bp, Heterodera glycines
  Genomic contig location: Contig_ID=SeqID_21682; Location=656..1062; Strand=-
  SCN-specific regions: Sequence locations=1-407
atgaaacggcaattcaacgacaaaaacggcgccaagcccatcactttccaaaatggagagccagttttcatttggaatttgaaaggcaataaggcaaattggttgccggcgacgattatcgagagagttggcaactctccgacttatcgagtcgacgttccgacgctccgttgcgcagtccaccgccttgtcaaccaaattcgccgccgtttcccagtagaaatggagacaccgcaacttggccaagaaaatggaaatgatttggctggggaccaaacgaatcagacccccattaaggagattgaaaaagccaaatctccaattggccgaagtcaaaatgcgccgcgaacatcagcacgcgccaagagggcacctcagcgattggacatggacccgtcgaagccgaa

SEQ ID NO: 52296 - DNA, 1530 bp, Heterodera glycines
  Genomic contig location: Contig_ID=SeqID_21683; Location=965..2494; Strand=-
  SCN-specific regions: Sequence locations=1-44,67-594,616-1530
atggacgactcagtttctcttgccggcagcgacgacgaaagtcaacaaccacgcccaaagaagaagttcaaaattccgaaacgacgctcagcactgttacgacccatcggtcagcagcaaagtccattacaaggacaacacaaacgccgcaagcaactacaagactcaggcttacgcaagttatttcaagccatctcggaccaacaaggaagcagcaaggccaccacaaaggccatcgaggaaagccgaaaagtgcagaaggcaccacgtcatgaaaagatcgagcatgaacaacgaatggtgaagaaaagtcaacaagaagcaaatcgacatcttcaacccgaaaagcggcagcaaaaagaaattcaagaagtgccacattcaacaacagaagagcaacaacgagaaaccaaacgccaacaaatcgaaagacaacaaaacgacgaacaacgtgccatcaatcaacaaacacgcagtaaggcttggcaagaattggcacgacaatttgactacgatcttatggatcagccggatccaacagagaaacaaccggaagaaacagatcagccaacgaaatcaaagcagcaatcaacaaaggacaaagaggacaaagagctggaacgacatcgcatcggcagaaaaaagacaatcgacatgcaagaaaaacggcaacggtcaagagacgaatggccagaggaaaacgaaacgctgctcagctacgttcaacgcatttacgggccggagaattggacgtcagcatggcaaagaggacgtgttctccgagaactccatgaactggaagatcaagggcgatggatgattcatcacaaatccgatcgcctacaactcagcgtctcgcgaatgtatggaggaaaacgaccatttgctgagttccgcttcgtggaaggcagatactactcacacatggtgccagaagatgtgatcttccttcaagcagtaccaaccgaagaacagccggagatcataacaatcgacgacacaacgacaccggcaacaaatacggaacaaacgaagcacccaacaaaaccgcaacgaccacaatcgccaaaactcgaagaataccgcatggccgactccaaaccaaacacgcacagccaattcaacctgtttcagccatgtgacaacacgcacacaacttgtgccaaaacagcgacttacggttccaccgcaggcaaccgatttcaaatggaagaattccaaaacttccgtgccaacaatttcttcgaggcactgctcttcaactggctgacacgcaacatgaacttgccagcggaagagatttgggcggcgcacgaaggctacattcaagccgacacaacagtggaagaagtcgcgcaaatgttctaccaacaacaagttgcggacagcggacgacaaatcgcacgagaccagcatttggccgaggtcatcaatgtctggcgcaactcatgcgaccgatttggcgaactatacaatcaaccggcacacaagcaagtgaagtttcggccaatcacaacagaaagcgaataa

SEQ ID NO: 52297 - DNA, 3733 bp, Heterodera glycines
  Genomic contig location: Contig_ID=SeqID_3887; Location=1138..4870; Strand=-
  SCN-specific regions: Sequence locations=1-464,486-1826,1850 -2071,2093-3305,3328-3444,3466-3733
atggccagttatcgggcagattggatagtcaaatctatccgtcgagccgaatggaagaccggaaacgtggaaataaccgatgaggaacccgatttactcattggtatggccgaattctggcgattcttccagcggcgcgaacagataaatcggaacttattccgcatttacacttcagtgggacctatcgtatgtggaaaagatatcccacaggagatcggagaaacgagacaaatttgcgcagtcatgtcagcaaaagctgattgtgaatttgcagaaacaggcatcgacactgcaaaaaacttttgggacctacaactgataggaataaaagacgacccaaaagaaaatgatgacgacacagcgatggaaatcttcgaaaagaaagccaagagactcgctgatggacgttatagttcgggatggccatggaaagagttcccgcccgatttgccatcgaattacaatatggcatataggagattggtcaacctccttgaaaaactgcgcaagactcccgagttattggacaaataccacgagtcaatctcgagagagttcaatctcggattctttgaacttggcgaaagaagggagggttttcctgaacacttcctgccacatcatggagtactaactcataaacttcgaattgtttttgatgcttcagcacacccacggggagagaaatctttgaacgagtgtatgttcagaggacccgtgatgattcccgatctcgtgggaatccttctaagattccgtctcccaataattgcattatgggcggacttagaaaaggccttcaatgccatatctttggacaatgaagacagggaatttgtgaaattcctttgggtgaaagaccctaagaagaaattgtcgacagacaatttacagatcttccgttgggctcggattcccttcggagtaatttcttcgccatttattttggctgcagttgtccagaagcatctgaaggagaaagcttcccccttggcgttggaattcgctgggaatgcctttgtagacaatctaatgacttcatgcaaagacgctggagaagtcttaaagaagtatcgagaagggaaagcattgtttgctgaagcacaaatgaacctgagggaatttatttgcaactcaatgaaagcaatggagcaaattcccgaagaggaccggcttaataaaccagggactaaagtacttggcatcccttgggacattcaaaaggacgaattgagcattggattcccaccgacgaatgaagccgggaagatttcaaaacgcattgttttgaaaacattagcaagcatatttgacccattgggaatggtcgcaccttgccttctccaagcaaaattgttcctacaacgattgtgggacagaacccttggatgggacgaaatcttaccagctgatgaaacagcagaatggtttgctgtcattagagaatggaagaccgaaccattcaaatttccgagacgatccgtgctgcaagatgaaatggtccaactccatgcatttgtggacgcgagcaaggacgcttatgcagcggcacttttcataaggtctcagaaaggagaagaaaccaatgtacagttactctatgcaaagagtagactcaagccccggaaagctgaagtaacaattccaagaatggaactcttggcaatgctaattggggcgaggatgctgaacatcaagaggatgcactccagaagagctgagatcccatcatctttggtggaatggaccaacatggctccgagaaccaatgaaaagttggccgatcgacttcgaggtcaccccaacaggagccatgaatgatggacaagaaagttcagaattggacaatgtagttgcagtgccagcaacaacgagtgaagacaatccatggattgacccttgtcgatttagcagttggactaaactacgccgcactgtggtttggtttctccgtgcaataaacaagatgaggaagactcgaatattcgagatttcagagggtgttcctatgagcagtgaagattaccagtacgccgagatcttacttgtaaaaatggcacaaaaatgttggccaatgtggaaaaagcaatcacaagaacttgtaaagacatcgaggaaagatggtcttgtccgactgtcaacacggctcgcaatgagcaatgcatctgaagatatggttaatcccattatccttcctgagaattgtccaataacccgactaattgcacagtcggtacatgagtcccttgcccattctggagttgaatccactttgacagaatttatgggaaaatattggacacccagagcgagactgcccataaagaaggtcattcgagcatgcggtcgttgtcgcaggatccaatgcccggcatataaattgccgacgatgtctcctcttcctgaggaccgcgtgaggcggacggcaccatttgaaagcattgggatcgattatcttggaccaacgaataccaaaattaatggtgagcttcagaaggcatggattgctttgttcacttgcctaagtacgagggctatttatttggaaccagtgcttgacttaagcgctgaggcattccttcaagtgttccgtcgattcactagtaggagaggaactccaaaaagaatcatcactgacaacggcacacaatttgtactggcagctaaagtagcggcagcattagaagctgggaagacacccacatgtccgctcgaagagcaccttgccaacgaaggaatcaaatggcgatttaatccatcactaagaccttggagtaatggatttctcgaacgccaagtcgctggagtaaaggcggccttcaaaagagtccttgggcgtcgaattttgccctacgaccaattgagaacgtttgtcgcagaagttgaagcgacaataaatcaaagaccgatcacctacgttgatgaaggaccaaatgctgtccagccattgagaccggtcgatttcataatgccaaaggccatattgagtttggatgtccggaggaacgaacaatcgtcggacacggagttcgaaaatgaacctaaaaatctccagaagcaattgcagatgcgctgggaaggtactctagccacattggatgaattctggaccagatggaaaaaagagtacctgttaatgctccggaacagattacaatgggagcataaaggaccaagaagttgcctggcggaccaaccaaaaatcggagaggtagtaattatcgaagaagaaaaaactccgaggaactgctggccgttgggcagaattgttgaactccaaggatcggacaatattgtacgaagtgccaaactcaaaataccaaaggcaaatggcgagcgaatttcatggcgttaaatttcgcgtccgataaaccgtctgtataggctcgaagtacttagactaaacttgtcacacattttagtccccggcactaatgtggccacgccctctttcggtgccaaagtgacttccggtgatcttcgtacggctttactgtcgaacaaagtcggtgaggaagatgcttcctccgtcgacccaattgatcgctcttacgcaaaacatttgataaatcaagcgaattccgggataacggtgatattttcaatttttctttttcgaaataaatatattttatgtttttagatcgaattaggccggccgttcattctcaataacatcaaacttcatctgatggaccgcgaccagcgaacctattcctattttgttgaa

SEQ ID NO: 52298 - DNA, 397 bp, Heterodera glycines
  Genomic contig location: Contig_ID=SeqID_3887; Location=6525..6921; Strand=+
  SCN-specific regions: Sequence locations=1-182,204-212,234-344,366-397
acaaccacttattgccaatctaatttcttgcagatttaaagccatccattgcctgccggttctcggcacagcaaagcactaatagggtgtttgactcacttcaaaaaataattccttacattctcggcacagcaaagcactaatagggtgtttgaagcacttcaaaaaataattccttacccaaaagttttttacaacaatttatttccaatctaatttcttgcagattgaaagccatcaattgcctgccggttctcggcacagcaaagcactaatagggtgtttgactcacttcaaaaaataattccatacccaaaagtttattacaacaatttattgccaatctaatttcttgcagattgaaagccatcaattgcctgccggttctggcacagca

SEQ ID NO: 52299 - DNA, 433 bp, Heterodera glycines
  Genomic contig location: Contig_ID=SeqID_21684; Location=378..810; Strand=+
  SCN-specific regions: Sequence locations=1-133,155-169,191-270,292-433
atgaacactgattttgtttctacacagcgtcccgaaaatgagcatctgtacaaaaaaaaaaatgtgtgggtaagtggatttgtaagataataaagagaaaagcggtggatgttcgactccgttcctcaacaccaatattttaattatttcttccagaaaatgggaaattgactttttacaaataataattttgtaaggtttttgccaacaaattggacaatttggtagcatttaaaaactctttatgagaaaaagctttttctaagcaaaatattcattatttctaaaaatctaagtttgatctcatattttcccagtgtcacattttcttaaaatgaaaggctttctatcgatgtcgcattttcagggagccttttagtcaactcctcaaagaatgaaatgctttcatcattttgttaaacattatttttca

SEQ ID NO: 52300 - DNA, 85 bp, Heterodera glycines
  Genomic contig location: Contig_ID=SeqID_21684; Location=1346..1430; Strand=+
  SCN-specific regions: Sequence locations=1-49,72-85
atggctaatttcttcaacattccccgtcgacaaacaattcaacttttactaattattattttatttaaaatgacgcttcaacaag

SEQ ID NO: 52301 - DNA, 729 bp, Heterodera glycines
  Genomic contig location: Contig_ID=SeqID_21688; Location=65..793; Strand=-
  SCN-specific regions: Sequence locations=1-729
atgtccaatggacaagcggagagatttgttgacacgtttaagcgtgccttcagaaaattaacaggggagggaatgtcatcagtgaaggaaataattgagacatttttggtcacacatcggacaacccccaacgattcattgccggacttgaaaagtccagccgaaatgctcctgggacggaagccaagaacaacattagacctactgaagccgcctccaattcagccgatcgaacgtgatcaggcaatggagaagaaattcaatcgccgatttggcacgcgtccacaaattttcgcatcaaaggacgcagtttgggcccgacatcgtctttcacaaagttggaaagccggaacgatctgcggatgtacgggtgtcatttacaatgtgaaatttgaagacggatccagcggtcgctatcatgcgaatcagctgaggttccgaaaggcgacccaaatcgtcgaggaccctttaaacattttgaatggagaattcaatttgccaattcaaatggcaccaatggtaaatggacaccaaaatgggcaggacatagagaataggcctgacccgatcaatgctcaaaacgaagtggaagaacagccaatcgaagaagagcagcaggacgtcattcaagccgctcaatcgccgacgcctgccgttcgatcgccgacgccacaacgacgctacccttatcgccgacggcaaccacctgcgcgatactcgccccgttag

SEQ ID NO: 52302 - DNA, 1791 bp, Heterodera glycines
  Genomic contig location: Contig_ID=SeqID_21690; Location=831..2621; Strand=+
  SCN-specific regions: Sequence locations=1-91,144-242,264-460,483 -780,947-1005,1029-1128,1206-1659,1681-1791
atgacgggtacatgtcaagaactgtctatttatattgttgcgatacccggtgccattactcttgctggtaaaatgctgacaaattcaatacatatttatatatatatataatttttataatagtttaaaaatattttattatacttaggtttacacctgaagcaatgggctcctgtccgtttaaatgtggaagtgaatggaatggtttcaaagttttgcttgataggtgagaaaataattctttttccttaattggatggtttgattttttgtaaaacttttcttatatattgaaaatattttaacaagaacaaaaagaaaaataaacccccaaaaagcgacatttggctatttataaaaatccacgttgaatttggttaaaattttctattttttagctttaaatctactttttggtagatttatcgatttttaagttattttttaagcaaattttgaatatatacacatttttaagaatttatgaggatttaaaagctttttttcatccatatttggccatttctgagctttttagtaaatgttttatgtctatattggaccattttttataagcataataataataataatgaagcataaataatttatttaattcataaaacagaaaagtttgttgcgttactgcaccattggaccctgtgtttattgatgaagagcgtaaaaaatgtaaactcaatggaaagcattttgaacctgtttttgcctcaatattaccggaaagcaataattttgataccttttcaggtaaaaatacgcaaataataaaacaaatatttaattacaattaaaaattatcctaaaatattgaaatatattttttaaaattagataataatactaatttctgattagagtaattaaatattattttcatttaaaataaacgcaaaaaattcttttataaatataataaagtattaatcgaatgcacccatttattaatttttgtaaaagtacatacatatttttcggcttaacaagcatttaataaaaaattgtaaaaagtataagcaatttaaatggaaagctttttcgttgttttggtacagtttttaaagtttatataattttttcttcaaaatttcaaaaaaatctcaactattcatttaattttattctaaattaattcttataggaatgttttttttaaatatattatttcataattattcttaaaaaatccgaatatttaagttgtattagtctgtcactctacaattcaaattccgaagagaattgtgatgccttgcgcgctctttatgtaaagactctgcgcgcaatgcttgaagatccggaaaaagccggcattaacatgacacatttcaaaacaaaggacaactttttgaaattttctacttggttttggttgtctacgatgacttttatgaagccttttgtttatatttcgagttttggttttaatgcctaggcacctatttttgtgcctatttcgccatttttggcacctatttttagggttttcgaaaaaatccatttcagagccgattatgctgtaacagaattagaagctcttctaacaattagattttgagcaaaatgaaagtcgagttgaacaatctcaattttgccatttttcatcaaatatttcgatttaaatatcttttaggaagaattttttaattatgcataaaattaaatccaaatttgaatggatgcgcgagtgggtcaaaagtgagcttcattgccgaaaatcttgacaaatttttgatttgcaattgcaaaaacaactgacaaaatttatgatga

SEQ ID NO: 52303 - DNA, 137 bp, Heterodera glycines
  Genomic contig location: Contig_ID=SeqID_21691; Location=1265..1401; Strand=-
  SCN-specific regions: Sequence locations=1-137
atgagcaacatccgaattcgcccttcactcagccaagaggaactcaaggcccgacgtgtgctgcaagaagagtgtagcaggaaaagaaaggaagatggcggcgagtgggtggtgtacgcggacaaagtgatgctgag

SEQ ID NO: 52304 - DNA, 1023 bp, Heterodera glycines
  Genomic contig location: Contig_ID=SeqID_21692; Location=1151..2173; Strand=+
  SCN-specific regions: Sequence locations=1-30,82-95,132-151,175 -230,268-439,462-604,633-716,738-771,813-832,855-1023
atgcagagaataattgggaagaaaagtgagaaatttattaaaataaatttaataaaaaaatcatttagaaattttttaaaacgaaagtttttgggtttaatttacaaaaaaaaaaaacattatttaaattagacgaaatattttaattgcgaatttaaaataaaaaaccaaatatttttgaaaaacttattttcataattttgtcgttccatataaactaaaaatagtggaattatttatttaaaatttaaaaatattattaaaaaacagaaaaagcgtatgatcgtgccgatgaaatgttggcaccgccagcgtcgccaacatctgccagtccgatagaacggccattgaacagcaacaatgccaatctgatggtgcgcggatgggcacgaatttcgggacggaaacggcaccgtcggaaagtgccaaatttggagagcaataacaacagcagcaacaattttggcgtgacaagacgtgaatcaggcacaatgccgtacaacatacaggtggaataaaaaataattgttaatttactggcgccacttgcaaagtccttttgcattttgttatttgacaaatccaacctcttcagatagatgccaaattttgaatttaatattattaaatatcaattcaatcttattttaggctggcactatgtgtggtccaatccgatttagctttttatcttaatccatcagcccctatctgacaaataaataataaaataaatagtctactgtaaccgtacccccagatcaaaaacacattattttttatgtttttttttttaaattttaattttaaaagccaaaaaatctgtgtttaattatcttaaaaaatttttaattgggaaattaaaccaaggacgaattgaaaacaaattcagaatggacgtcgtgaaagtgggttctctgtcgaaagcacttggccaatgattagagccaattcgaatttgtcacgagtggcgcatttgtcggaaaacaccggcagaacggaggatgaaacagaaaggaaacg

SEQ ID NO: 52305 - DNA, 1192 bp, Heterodera glycines
  Genomic contig location: Contig_ID=SeqID_21694; Location=913..2104; Strand=+
  SCN-specific regions: Sequence locations=1-751,773-1192
atgccagcgccgcacgacaaaacgaccctccgttcatttttgggagcgctcaattattacggacgttttgttaaaccaatgcgagaaaccagggcgccattggaccaactcctcagaaaggatgaatcctggagttgggagatgaccaacagtccgcgttcgagaaagcgaaggcaattatggtttcagaacttctgctgacccactacgaccccacacttccgatcgtcgtagcggcagacgcgtcaaaagatggcatcggcgccacaatcagccacattttccagacaaaaaggaaaaagtcatcgagcacgcctcaacagttctgaccaacgcgcagcagaactacagccaaattgagaaagaagctttggcgcttgtgttcgcagttcaaaaattccaccggatgcttttcgggcggaaatttacactgttcacggaccataagccattgctggccatcttcggctccaagaaaggcatccccatttatgccgccagccgactccaaagatgggccctaatcatggccaattacgattttgagatacggtacatcaacaccgcatcatttggccaggctgacgttctctcacgcctcatcgcaaattatccccgaccagaggaggatattttgatcgccaacatctgcaccgaaactgagtgctacataagcaccattctgcaaaccaaaacggaacaacttccagttacagcagacgaaatcgcagaggtgacaccgaaagatgagattttaaagaaaattttggcattcacccaatcgaattggccaaagaaatgcagcgacccggacatcgcaccgtattttccaaaaagggaaaacattttggaaatcgagggctgtttgctctaccaaaatcgcgttgttgttccccaatcgctccgcaaccgaatgctgaagtccctgcacatggcacaccccggaattgtgcgcatgaaggcactcgcccgccaacacgtctattggccgggcatggactcggaaattgaacggattgtccgtcaatgtgaagaatgccaaaaggctcaaaaagcaccgataaaggcaccgcttgccccttggactccaaccgacaaggtgttccaacgggtacacatcgattttgcgggaccatgccaagacggtcacgtctatttcattttggtggactcattctccaaatggccggag

SEQ ID NO: 52306 - DNA, 2305 bp, Heterodera glycines
  Genomic contig location: Contig_ID=SeqID_3889; Location=462..2766; Strand=-
  SCN-specific regions: Sequence locations=1-575,597-1173,1198 -1256,1278-1396,1419-1498,1522-1940,1977-2305
atggtcaatcccttagagaatttgccttacgaagatatcgtcgcgattgaccgtcgcctcttctcaggtagaaacccatccgtccaagcaaaagttagtgacctcgaaaatgtattaagtcaagtttctggctttgaggatgcctcaaacagaaaccttcgctatcttaatcgtcggattaatgcaacaaatgaggcaatctttaaactttctgaggaacttaatactgggctggcaaccatggcaacccggattgattcccttactgacccgaacccatttcacttcccttttcctatccccaagcagaacaagcagaacagaagcaaatctcaaactccatcccgtcaattccctctcaatgtagatttgaatgctcagtcttcaaattccatcactcctaatcttgcccaaaattctgacatccgaaatcgtggactcactgacagttcaacccctccccctctcaatcaagtcatagttgaagaagaacagcaggatgattcccatgtctgggctgatgaatcttctgacagaattaatggattaacatttgagaatcaatcatcgggtgggctcaattccttcactggggaatcttcccagacttttgagtcttggtccagaaaattcatggactacatcgaagccacgggtaggcgcatggaggaaggtgacaaaattggtcgccttaaaatgatgttagaagggaccccgcgcgacatttttgaggacctcccagctgaccgtaaggcaaccctccaagccgccatccatgccctcaaaacagtcctcgatactccctttaagtcccaattagctaagcagtcattggcctcatgtagacaaaaagagggagaaatggttgaaacctttgttgagcgcctcatccccctagttaatgccgcttatcaagaattagaccccaaattccgcaaagatatgcttaagtccgcttttctcgaaaaacttcgggatgaaatttccttccatgtccgacttggtagtagtgcctcccaaacctttgaagagacccgaattaaggccttagaagttgaaaatttattggccactcgcaaaccccgagttgaccccgattggattaatgtcatgtcctcctcttcttcggcccgatcccctccaaatttactccaaggaaatttcacaacctggcaacccccacccccacaacaaaaacgggtttccttcggtccatcacaatccgctaacccaaacccaaacaattatactaatcaattccggccccctagtccccctcgatttcaaaatagaaactggcagcaaactcccaaccagacccccacatgttattattgtaaaaagcctggtcatgtaatcagtgaatgtcggatcctcgcctataaaaatcaaaacagaaattcgcaaaattggacgtctcagcctcctatgttcacccatagcaaccccaacagtattccaatctcccgaccccctccctataacagtggtagaggaaatcaacctcatcaaagaggcacatggcggaaccaacagtcttttcatcatgatcaaaggggtgcatggagaaatcagcaacccttccatcatgacaatcggaattggaatcgctacccaaatcccaaccagccttatggccgaggacgacaaattaattcccttaacacctatgattcccttcccccagactcattccaaaatctttcaatgtctgataatggtccccacccttcatttaacactcttacattctctgaccaagtccaacaacccgttactgcctcaccatctcaaatcaaagaacagctcgtgtgctctggctctgctgataagcaaccaaatctcacggatgctttaaaatccgaaccaaagcctgtttcccccactcctattgtcacaaattgggaatcacacccgcgcagctcaaatttttcaatagctccctttctaactcgttttaattttatcctttgtatcattactctttctctaagtgcttctttggtctcatcctctcatagtcaatcatccttaaaagtcctccctatggtttgtcagacacacgttgagggcacaatttggtctcttcccatttggctaccatgtccaaaattaaagcatactccttctgacacccctatcaaacaacctattcgccttttccaaccgaacccattcgaacaaaaatccaaggcatgggtgtgcaggaaggtaaagaaatccctgattgagtacaccaatccatggaatgatttaatcattaagcaactcccgtccgaaaatctcccagtattattagatgaat

SEQ ID NO: 52307 - DNA, 1111 bp, Heterodera glycines
  Genomic contig location: Contig_ID=SeqID_21695; Location=17..1127; Strand=-
  SCN-specific regions: Sequence locations=1-1111
aggcctgccacatgtccattttgcgctcatccttgattgggacagagtacggagtggaggaatcatcatgacgcccgaagactacatggtccagtacatttcggccgaaattccggaaaatccgtctgggcgatcgccagaagtcatattacggcggcagttgtacaacacaattacaacaaagaatatccacacatgttcaattcggcgttgcattgttgacgggaaatgtacaaaacgttttccggttagatagaaatgtgcattaaatttttcaaccttactaattaaagaagcccttttcctatgacgatgtctactccgaaactgcgtaccctcggtacaagcgtcggccgccagcgttaaccgaaaaggaagcgtcaaaaaatccagacaactatggccggttcatccagtataaggacaaaagtgggaagattgtccgcgtcgacaaccgacaagttgtccccttcaacgcattcctttctgccaaatacaaatctcagttagtgagatttcaatagttgcacaataagttaacaaattaagcatcaacaccgagtttgtggcaggagaaggttgcactaagtatttgtgcaaatacgtgatgaagggagcggacatggcctttattgaagtgaagggcgggccggaaaagcaacagaaggtggattacgatgagttccatcaaattcgccttgctcgctacataacttcaatggaagcctatctctcgctaactggagcgaagcttgtgcgacgttcacacgaagtagctatattagaacaattaaaatgcaatattaattatgataaggtcgatgagctggacgtgcatggtccaagtggacaccggattgctgtggaatttggccttaaagatgaggaggaagacttgaatgcagtttgtgaagcagcacaagccgaagaagaccggagggcaagaggcgaagagcgcgtgactcagcttacagcgtactttgccttcaacaaagacaatgcaccgcttggcctgacatatgcgaagtgcaacaaaaagttgtggtacgacatcgcaaagaagcagtggaaaccatatgtgggccgagttttccgaagttctgccgactga

SEQ ID NO: 52308 - DNA, 1139 bp, Heterodera glycines
  Genomic contig location: Contig_ID=SeqID_21696; Location=16..1154; Strand=-
  SCN-specific regions: Sequence locations=1-638,661-791,814-1139
atgataagctatgtgttgtgggactacaatccgcccgaagggaatatgccgcaccttcacggccagctcttcacaattccgccggctgaagcaagaactcgaattacagacatttctacagagaattctctcgatgtaagcataggaaggtcctagcaaaaatttagttttttttttgaggactcggtcatggatgcgcttcacagaattctgcgtgagcatcacttgcttgctgtagtctacgagtctgctgctgaaacatatcggcaactaccagctgaagaacgtgtgcaattacggatgcttctcgtagacaccgacaaaacgggtgcagaacgaacggttgaaagtgatgtcgcgcaagcacctgcaaatttgcatgcagacgacagagcaaacgtgaagcaaattcatcctgggcgacttggcactgaaactgccgctgggagccgtcttgtcgcacaagtaggaatcaaaagccaatcaaattattcttaaggtagaaattttgataaatatttagttttacctggacactggtgcgaatgttattccagtcagcgaatacgacatcattttgatgggccgagacgagactaaagtgcgctcaatgaagtggtggaataggaacatcgatcctgctcttttccctcttctatttccgttcgggcaatttggctatggtgaaaaatggtttccttttcagtttttctatttccatgtttttagagtacggaattaaacttgtgctgttgaagaatgaacgttttgactcaacatacagacagatcagggacaaggacaatatgcttttggacgctgatgaagaccttggcgaggaggaagagttccttggggctgaacaagaacaacaattccatcgccgtgatcaagtgtcgagatctcaatggtttcgctacatggcgcacataagagggctcaactacaactggcgagatggtcattggctttgggattggcggacacttgcccagttgtacaccatcagctacaacaatcgaatggaagcgcaaaaagttcaattcatgaagcagcatcaagaacgccgacgtctaattctgccgagctccattatcaattggcttaaggctctccgcgataagaaaggcaaaaaataa

SEQ ID NO: 52309 - DNA, 736 bp, Heterodera glycines
  Genomic contig location: Contig_ID=SeqID_21697; Location=297..1032; Strand=-
  SCN-specific regions: Sequence locations=1-216,238-699,721-736
atgcctctctctaatcaaaatcgcaacacaatcatcaaacatgtggccatttggtgcaagggaaagcaagatcaacgtcttgaggttgagcaaaggcgtcagcagctggaaggagaagtagctgcactggtaaaagcttgtggacgcctcaaaaggaatgcgcaaaagaaggacatcgcgttcaagttgaaaagccttgaaatggtgaaatggcctcctgcaaaagccttcgacaatccttacatcaaacaaggtatataagcaactttacaagctctaaattagtgttctattgatatgtcgcaagttttcctattatgtaaggattccttacatgtgaattgattttgccctatgtgtaacaaatagttacactacgcttgaaacttagtaagttggaagaatttttacatatgagcatgcgtacacacaggctaatcaataaatttcatgtaaagcctacggccgaggcaccgatcaccaattccaaaaagcagcaaccatcgctggccgcttccgcgcaaacttcttgggatcgtcgaccgcacggttggcgtcagccgcgtggtacgccacccgtggagtattcgtcaattcgtttttgaaacatttttcaaatcagcattctagcttttgattttcaggaattcagattcattgacgaatcttcactgtttgagacaaattttataaaagctaatttatttttatattgtatcattttgcacgcattaaa

SEQ ID NO: 52310 - DNA, 76 bp, Heterodera glycines
  Genomic contig location: Contig_ID=SeqID_21698; Location=1037..1112; Strand=-
  SCN-specific regions: Sequence locations=1-76
tagagaaaaaaagatattgtttttctctggcactctctatttattggtacacatctcgttttttgaaacagtgtgt

SEQ ID NO: 52311 - DNA, 75 bp, Heterodera glycines
  Genomic contig location: Contig_ID=SeqID_21700; Location=18..92; Strand=+
  SCN-specific regions: Sequence locations=1-75
caattcatctacaaagggcagggcggcaacacaaacaatttcccatcaaagaagctttgtgatcaagtgtgcaag

SEQ ID NO: 52312 - DNA, 738 bp, Heterodera glycines
  Genomic contig location: Contig_ID=SeqID_21701; Location=138..875; Strand=+
  SCN-specific regions: Sequence locations=1-738
atgaacatgacaatcgatgaattgaaacacaaactcacccagttcctctatcgtccaatcaatcgtcttcaaaattgtaagtttgatgtagatacatatatggatggatggcagtgacggcagggaactccgattttcgaaaaattattgggccttggaaatccggtttccaaaaaaattttgagcattggattccgattcgaaaatttttgaacctcgaatttctcaaaaagtttgggcttcggaattccgaatgtttgggttctcggaatgccattcctgataattccaattcaattttttcagccgtgaatttcttctgcaagattttcgcaaatgaagtgatccatcaaaaagtgcttgcgtcactgcgaccaaaggatgttggacgaatggaatcagtcagcgtctccttgaaaaatattttgctctccggatcagtggacaatgctttttggaaagtgcattatgaacgactttttggcaagggtatatatttttttttgtttattgttgatttatgggtttttgaatgacaaaaaatactttttcgagggtttagtaggggtcaataaagaaatatttattggtttcgtttccattttagttcaagatgaccgacaaattccatatcgtgagcgttttggtgaaaaaatgagatggcaagcgaatgctgcacgcatgcttatggcgattcctcttcgagagccaaaaaccgttgatgttcctgacgagtaa

SEQ ID NO: 52313 - DNA, 132 bp, Heterodera glycines
  Genomic contig location: Contig_ID=SeqID_21702; Location=682..813; Strand=+
  SCN-specific regions: Sequence locations=1-132
atggaagagtttgaggaaatggtcgctgttcttcagcttgatggcgtccttgactttgacgcggtgcgaagagcagtcagttctggtgcaatccgagtgcgcgaatgtgacgcggaaacgcccatggttcag

SEQ ID NO: 52314 - DNA, 239 bp, Heterodera glycines
  Genomic contig location: Contig_ID=SeqID_21705; Location=929..1167; Strand=-
  SCN-specific regions: Sequence locations=1-239
gcatcggttcggggggactgcgccgaaaacaaaagaatcgattttttcaagtgtccgtttggggtactcaaacaggtcatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 52315 - DNA, 410 bp, Heterodera glycines
  Genomic contig location: Contig_ID=SeqID_21706; Location=1..410; Strand=-
  SCN-specific regions: Sequence locations=1-38,60-104,134-141,165 -317,341-410
cacaattacctaatttctcatttccccggtttctttctcttagtaattccctttgatacgccgccttttctccgtccgatggatgtttccctcttccgtttgccttctcttccccattttttcccttctcttccgctgtgtcccttccttctcctttttcttttgtccaatcctccgattttcgcctccgattcggctgcttttccgacgtcttcatgccgtaacatccaacaagcttgtgccgctcaacttttcttcttccctccgttgccttccgtacaggagacggtgccggacgtgccgttggcacagcgactggaggaggaggaggaggaggaggggtccggtgaaggcgcgggtgctgtagacgccggcggatggcattttgtgccaatgtccgggcctttgtc

SEQ ID NO: 52316 - DNA, 373 bp, Heterodera glycines
  Genomic contig location: Contig_ID=SeqID_3892; Location=863..1235; Strand=+
  SCN-specific regions: Sequence locations=1-130,160-257,279-373
atgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcagagggaagagcatgatgagttcgatcaaacggaagaagaaactgacgaaatttcgcttatcaatgtcattgattgatggtgatttagcaagaagaaattggtggtcgacgggagacggacgaagaaaacaatggagaaaacaattcgattttgaatagacacagttcgataaaggtttttattcgtttttacaggaa

SEQ ID NO: 52317 - DNA, 2415 bp, Heterodera glycines
  Genomic contig location: Contig_ID=SeqID_3893; Location=1919..4333; Strand=-
  SCN-specific regions: Sequence locations=1-1119,1141-1262,1284 -1597,1637-1766,1788-2415
atggaaatgccaacgaatcgggaactggcacaaagaaaaagacgcgccgaagaggcggaatttttacatagcattgacgagggcgaacagttggatgaattgacgccgggccgaatttgcctacacgaggtgggccatctgaagttcctctgggacgacgtggattgtgttgacgagtttcgcaaggttattttttttaaataaaaagcaaacaaccgggaaagaaaaattgtaacagggcccattggacttggcccatttcactaattttttcaacaacacaaaaaaacacattcaccctccagagttaccctatcaaatcattcgatagctctaagtgtcttattttgtataaatggagatcaaaaaaaaaatgttaagcgtgaaaaaagggtaaaaaatcccaaaatttgttgggttcagatcacggcagccgctgacccgagagatggcagtgcaggcgcggtccatttccaaccgccggcccagcacaaatacacccgggcgcaattgaaggcgaagcttcaattgtcgctaggtggccgtgcggcggaagaggtctacttcacgcgttgcgtcggagatggctttgacagcttggaatggccggagctggcaccaaggttttttggaaatgaacgaatcgggcccgcccagcgaaaaaaagacacaatcccgactcgtttagtgaaaaaaagcaaagagtcgggccagcccagcgaaaaaagacacaatcccaactcgtttagtgaaaaaaaaagcaaagagtcgggcctagaccaccggaaaaaaagacacaatcccgactcgtttagtgaaaaaaaagcaacgagtcgggcctagaccaccggaaaaaaatgagtcaagcccctaattttaacttatcatgccagtcagaccccgtctgtcggaaaaaacttaaattttaagaaggggtaggtgcatcgtatctccgacaagcagggattagcaggctcaattatgcaaagcttagggggaggggggtggtttctgcaggcgtcgcctaaggcggactcattctggttcacaaaactaatagaattttaccagattgccgaaacgagtgaccagtggagagcgctgccactcgtaagacgcacgaggggccgcaagaagaagcttaaaagggtaactactttttttgtgtgccaaacagacatgcaacaaggggtgcgcgacgcacccgggtgcaccatttcccccacccctgggtcgtttctcataaaaaagaagatgaaattcaaacctagaaatttcaaaaaatctagaaacaaggaaattttacggagaaaaaaacttaataatccatcacaaatttttattaaatcgcatgcggtaaaaagtgagagattttgtcgacgaaggggaaatttttgaaaaatttggctacaatagaaagtcaaaaaatttcccaagtggcgccacaccgccggcctccttgttccccaaaaaagcgccgcaaaaaagtggtgtaaaaatcaaaaaaaaaaaaagtttgtcgcccagagcggtggtactccccccccccccaagccaaaatcctcggaccgtccctggtatacggggaactgttcacaaataaataaataaaattttaaaaataaaaaaattaaaagtgtaaaaaatggagcttttagattgatgggacaccctgaagcgagcaagcagtttgcggcggaagcgagggcgaatgctgcgaacgcgatggagtgggaccaaatgagcaactcaaacgcaagcgggatggaggaggacgaagaagaagcaacgtatgaaatgatcaccccggggcttattcgttgaaaaagggtttttatttttgccaattcttttttgcccatttccttttggccatttccttttgcccatttcaatttctttttggaccatttccttttggctcatttccatttggcccatttcaatttttgctcattcttttttgtccatttcgatttttacccaattcggttgtaatattttgttcaattcgcgcaaacaaaaaaaaaacaatttcttaaccggtggatatacaaaagtgaaaatgtaaaaaaattttgatatagaaaaactgactaattttctccccttattccgtttacaatgggcgtgttcagtgccagaaacgcgatcagagggaatcaagcaaagggtgcggcacgtggggatggggaaagagtggaagagaagggatgtgggatgaagtgaaaaaaactaattttgcaacacggcggccagggttgccatgccaaaaactgcatttaccacatgtgcctgcccgttctggcctcctcccctgcccacctcacactcacaatcaattggacatcgcagtttgccccgttcgtcggttgggagctgttttcttgaaaaaaagcaaattttgaaaataaa

SEQ ID NO: 52318 - DNA, 70 bp, Heterodera glycines
  Genomic contig location: Contig_ID=SeqID_3894; Location=778..847; Strand=+
  SCN-specific regions: Sequence locations=1-70
aaaacgcagccaagaattcgtccgctgctgttccttggtgcgcgttcggttgaactgagcatttttggag

SEQ ID NO: 52319 - DNA, 1037 bp, Heterodera glycines
  Genomic contig location: Contig_ID=SeqID_21707; Location=371..1407; Strand=+
  SCN-specific regions: Sequence locations=1-200,249-250,272-524,546 -547,572-580,602-843,868-1037
atgcctggacctggacctggacctggattccatgttggacctggacctggatttcctggacaaaaatccaggaaaatccaggtccaggaaaaatccaggctcctcgagacctggatccaggcctggacctggattttttgaaatttattttaaaaaccaaaaaaatgtttgaaaaaattaattatttgcgtagaagcatctaaaaatatctaataaataataataatgtgtttttaaatttatttaatctgttttttaaaacttgaaaaaacatcggtctgcacgagcgtctggaagagcaattttgccctatagcggcgcccaaccgctcgttccataaatcccgatctctggcacttttatcgatcattttttgacattttgtttaatttaattcgaaaattatttttgtctaattagatagtttaatagttccaaacaaagggggggggatgagggcatctaatttattaccaaaaacaagttttataatttaaaaatgagcaacagtcatcagcagaaacgtgaagaatttcaaaaatattgcaaaaaaaaaaaaatttttttttttgattggttcaccatgtttctttttaatgagtggattttttctcattaattttgtccaccataccctaaaaaaacggtattgttaataggtttgtcgcaattaacagtgtgcacaatgtttttaacatttactgagttttttttgttcaaattgatcacatcatttgggccaagaatttgatttcaaaggaattttgcgctatatgttaaattttgaagcagtaaattcattttgatattcttactttaatgtggaaatgagttaaagaaataaatgctaattttattttacattttacaaaccttttttgtatgacgttcttcgaatatacataaaatattttgtttaaattttcttaatttaaccgattttcattttattttaagttcggaatcagcaatcaaagcctatgaaaatttccggaatcattgtaatcaatcaattatgagcatctttttattttcaa

SEQ ID NO: 52320 - DNA, 345 bp, Heterodera glycines
  Genomic contig location: Contig_ID=SeqID_21710; Location=149..493; Strand=+
  SCN-specific regions: Sequence locations=1-156,179-197,240-345
atggcattaatcatccgcgggtctgctgactgcttccttccgcccccggggcgatgctgggaaagtgagtagggaagaagtaaaagtgacggaggactttcaaaatgaattttggaaattgctaaaatgtttaattggattgatcgatcaatggcaaaagaaacaaaaacatttcaaccggcaaattggtacagagaaaattgttaaataatttatttgaattcagaaaagggaaccaaaatgtgatcaaattgcaatgagaaaagccgttcttctcggatatttttgaaattagtttgttaaggatctcaaatttgttaattaatgacgcattggtctttaaaa

SEQ ID NO: 52321 - DNA, 1265 bp, Heterodera glycines
  Genomic contig location: Contig_ID=SeqID_21710; Location=912..2176; Strand=-
  SCN-specific regions: Sequence locations=1-47,69-400,422-442,464 -919,950-1040,1063-1244
atggaatgccatctcagagccaatgcaaagagtggttggtgggcacgacacacggcacacacaccccatggggcgaaaagatagagatcggcattttgaaaaaagcctggacctgtatttcctggacaaaaaaccagaaaaatccaggcccctcgaggcctagacccaggcgcaggtcgatctcaaaaaaacataggatttccaattttcccaaggatttcaaacagtgcagcaaaaacctacagaaaatggataaattgacaaagaataaatttattttcccctcgccttaaaaaggtgaaaaatttgttggaaattcgacgcgcgcatttcccaacggcgcaaattgtgcgcagagattgtgtggagccgcgcgagttggacgaattgccccggcaaatttgcagggggttcagccattgtcaggtgggagaggagggcatcaaaaaatttatttttatttcgaaagtcgaaatgccccccccccctccaagacgcttattctcactgatcacggctcgggttccgctttcacaatgcgcggctgtgccgaacgcttcggcgccgtggacgcggaagtgttggcacggcgtggagacaatgtgtgcaaaaggtgccaaaaatgaacgaacagtcggtgaaattcgcctcttctgatcacaactgtttgacatttttgacctaaaaaacaaaaaaagggtagaagtattgcatggctttagcaattttaggaaccatatgacgttatgccaaaatggggcagaaacgggaaacttttaaatagtctcatccttaccaagtcccttaccgtatccaaatattaaaagaccgtgaacatttcttctattttcattttgaagattgcacgaaaaggtggacattcaggagtgcatttgtgaggtatgccttttacaaattgattttaaataaaatttttaattgaattttagcgccgaaagtattgccacgcgggctccgaccggtcgtcctccgtccgcttcacgccaatgtccgaatggcaccgccgccgggcagtgccgtcctccgccgcctcgtcgggccaaccacaaaaatccgttgggccatccgccgaagcattgcaacggagcaaaagcaacggggaaaggggcacgaagaagcagacaatgcttctaacgctgattgggatgatgacagcgattagtgcgatgattaggacaataattggcacgggcattggccacagcggagcaattaacacccattaatatttttggcaaaataaa

SEQ ID NO: 52322 - DNA, 1201 bp, Heterodera glycines
  Genomic contig location: Contig_ID=SeqID_21714; Location=793..1993; Strand=-
  SCN-specific regions: Sequence locations=1-1080,1102-1201
acaaggatgttcttgaatttgtggaccgccttcctctttaggtgcgccggataagctcaaggaaattccatttgcctggaaggtatcacagttgacatttgcttttgagtttttgagctaacaatttaaggtcgtactcattggaggggactggaagcagttgacccctgtcattcccggagggaccgaccggcatcaactcgaggcttcagtcaagaattcgtcattgttcgtcaactttacaactgtgcgactgcgtgccaaccaccgcttactgcccggccaacatcattatcgagcatttttgaagcgcgttggcactggtaccatcaacgacagtcaaggccgtgtcaagttgccgtctttgatggttcagccatcccgggatgagctcatcaacgagatttttccggcggacctgctaacaaatccaaccaacaactggaaacagcttgcggaacgagcaattctgtgccctctgaaccgcgacacgctgacattgaatgaaataataatggtagaaaaagtcgatagattagttgtaagctttttccgataaaggaacgactcaacacggccgagcgtgtctaccatgcagtgacccttccgttggtggatgagacgggggagaacgaattggagaatgttgccgccgatgcggaccacgaaaatctgagccggatgactcctccggggattccggaacatattcttcgcgttcgcgtcggtgcagtgatgatgatcatccgcaacatctccttggaagaagggctctgcaatggaacgcgggtgcaagtcactgaacttttcgacaacatcatcagatgccgtattctcacgggaacacatgtcggcaatgaacacgatctacatgcggcacgcttcacttttggtggtgatccgaaggcacctcatgaaggtccattcaagtgcgagcgcatccaatttcctctgcgtcctggaagcgtgatgacaatcaacaaatcgcagggttaatatattgatttttaaaatttatggttgaaaataatttgaaggacaaacattggcaagagttggtgtgctgctcgattccgcccagtgtttctcccatgggcagctttatgtggcattgtcgcgggtgcgagacgctaacagcatccgagtctgcaccacccgcaatgatcggcgcgtcaaaaacgtcgtcatgcgggaattgctc

SEQ ID NO: 52323 - DNA, 132 bp, Heterodera glycines
  Genomic contig location: Contig_ID=SeqID_21716; Location=203..334; Strand=-
  SCN-specific regions: Sequence locations=1-132
atggcacattgtgcgagtcttgtgcagatggatgaggatgtgtatgaagagatgaaattgtggatgaagggattggtggcgatgtggcgggacgaaaaaggagaggacggcatggactgtgtatttgttgag

SEQ ID NO: 52324 - DNA, 8108 bp, Heterodera glycines
  Genomic contig location: Contig_ID=SeqID_3895; Location=479..8586; Strand=-
  SCN-specific regions: Sequence locations=1-6,28-128,167-168,191 -621,643-699,721-934,955-973,998-1186,1208-1429,1452-1604,1641 -1768,1790-2071,2121-2324,2346-2421,2443-2512,2534-3028,3050 -3360,3386-3399,3435-3473,...
  SCN-specific regions: Sequence locations=...3514-3609,3631-3639,3662 -3664,3687-3796,3818-3908,3930-4253,4275-4693,4715-4727,4749 -5406,5445-6037,6059-6164,6187-6436,6458-6870,6892-7122,7144 -7322,7346-7422,7444-7705,...
  SCN-specific regions: Sequence locations=...7727-7783,7805-7964,8000 -8108
actataaaaacattcattgatagaaatggattaattagaatggacacaagaattaagaaatgtgaaatggaattctcttttaaatttcctattgtattcccaaaaagagcaccaattatagaattattaatttggagagctcataaaaaagcaaaacatggaaaagttgacagtactttaaatgaatttttatcagaattttgggcaccaaatgttagagcaactgttaaaaagattataaaaatgtgcagttcatgcaaaaaattgaatggtccatcatttgcattaccaataatgccacaacacccagaagaaagagtaaaaatttcaaatccattcgaatcaatagcacttgattatttaggcccatctttagtaaaaaatgatgggaaaacagtaaaattttggattgtattaattacgtgtctaattacgagagccgtttatctcgaaccagtacttgatttatcaacttattcatttttacaagtcttaagacgatttgcaagcagaagaggaacaccaaaacgaattatttctgataacgcacagacatttcgactggccgcaaaggtagccggagcatatgaagcaagaggtggaaaaacaagagacgaattagaaaattatttggttaaaaataaaataatatggcgatttataccagctttagcaccgtgggcaaattctttagccgaaagattggtaaaaatttgcaaagatgcttttaaagcatcccttggtaaaatggtcttacagttggatgaattacgtacattcacaactgaggttgaatggacaatgaataatagaccaattactcatgtttcaattgaaccagaaggagaaagagcccttcgtccaattgattttataaatcccggattgaatttgggattaacaatgccaaatacagaaaaagaggaggaaaacaatgatgatgatgatgatgattataatccagaacccgaaaaattagcagatcatttaaaaagacaatggcaaaaaacaaacaaagttttgcagtggttttgggaaagatggcataaggaatatttattagttctaagagacagaacacaatggttccataaaggaccaaactcacaggaaaaacgagaaccaaaaatagatgaaattgtattaattgaggacgaatttcatcccagaaatacctggaaaatgggaaaaataattaaattaaatggagaaaaaggtgctattcgaagtgtacaaattaaaatgacaacaaaaggcaaagaaatgactggaagaataatagaaagaccaataaacaaaatatactcccttgaagtgaataattccttagaaccaaaaagttatgatgaaaataaaaaagaagaaaatataaaagaaaaggaaatttgcgaagttcaaaagaaaaatacacaacaaatgacaacaagatcaaaaacaagaaattatttattaagaggaggcataggattacttatgacaatattattaatgagttcaaatttatttggatttacaaacgcaaaagaaaataacaaaacgaaaagcatagtcaaattaaaatgcaaagattgtgaaattaaatgcggatcaaaaggaatagaattaaatacacccacaaaaataaataaatttgaaatttgttgtatgggtcattgccgatcaccgacttttagaaataattatctatttgaattaagcaaagaaatattgattacagaacactattgtaccgtaaattactggacaaagaaaggaaaatcttatagaaataaaattatttgcccaccaatagaaatatgcaaattaattaaatgtttattttgcctagaaaaattggcaaatcctgaatgtatgttgaccgaaacgctcatactaataggaatcggcctaacttgtattatttcttttattatttgcatagcaagttttatcataaagtttatcataaaaatatggtggattattaaaatttgtttttatgggccatatttggcgttaaaatgggtcttgaacccaaaattagacaaaaaatttaacgatgagatacagaaaagtttattaaatgaatttgaaaaaagagaaaaaaaattcaaaaaagaaaaaacagaaaaaacagaagactatatagacttggaagcattgtaatattactatttttatgtttgacaatgcctgatttagtgcacagtggtgccgaagtaatatcaattcagtcaacttccgaagactgtgaaagacaattaaatggttctgtatgtagagtcagtggaacaaccgaattaacaatattactcgctggacaaaaagtttcattagcattaaaagatgataaaggaaaaataatgggttcattagaattaattttacaatttttacgattacactgtaaccaacaaactttaaaatggttacgatcatataaaataaatgttatttcaaaaagacgctgtccaacaatgggctcatgtacaaaaagtaaatgtaaaaacattaaaatggatgaaaaaattccagaaatggaagattatgaaaattttccaggaaacaatttctgtaaaaaaggagacgcaatttggggtcataaatgcgcactcccatcatcggaatgtttcttttatagaacttacgcagaaccaacatcaaacacaatttgggaattaattagatgtaccggatgggattatgaattaaaaatgagtttaacattaacaatcggaaacgaaacaaaatctaaagatttgaccatgtttcctggtcttacagttaaatggagtaaattttcatttacaccggaaggattaacacctccaatttcaccaattttcaaaattaccattcacaaccgcaaaattaaatattcgaaaagaaggtaaaaaaatattaagcgagactgaatattctccagttaagttagcaataagatttaatggtataaaaattgtaatagtcacagatggaacaaaatgcaacataaaaccaactaattttagcggctgttacaattgcggcacgggtggaaccctaaattatgtgtgccaaacagaatttggtcaagcagaagcagaaataaaatgccaaaatgggccaatatttttagcaaaatgttcagaaaatggacatgaacaaaaggatattttaccctttgaaatggccgacataaacatgaattgcattgtcgaatgcccagggggccaaacaaactttaaacttaaaggcacacttcgttacgtaccagtaaatgaaaagaaatttcgaaaaataaacacagaaaaaattaatgaagacgaatccgattggaattttgaaaacattaaaataattgattggaaatatttgctcaaattcgcacttaattggaacaatttattaataattttaattttttcaacattagcactgtttattttattaataataatttttatatttataaagttttcaccattttacaatgcataccgtattattagcagaaatttaattaacaatattatttttattttattatttaatcatgcaaattcaaaaacatttgcgttcggagggtcacatgaatgtgacaattcaaaattaaacattatgaatgaaataaagaacaaaattttgtggagtgaaaatgaatcagcatttttcataaagagaaaaattttatggactgaaaatgaatcagaaatgattaaattaaataaaaaggtgaacattaagaataagagtgatttaacaaatttacaaaaagaacaaaaagcaattggtaatagaaatgctagtacattaaaatttaaaggcaaagattgccataaaatttatattaaatatagtgattcatttgtcaacatttttaaagcattgtcaaatttaaacaaagacaaaaaaccaaaaattgaagataaattaaatggatataaaaggaataagaaaaagcctattttttaccttaattatttttctccaatccattttaacccaaataaaatattcacaataatgaacaaaatttccttgctaaaattagcgtccgaaatattcggaataaaatccgaacaagtggccaagacaattaaagacgattggaaaaaattccagcaactcgaaaatgaggtaaaaatcctggaggaacgaggtgcgcgaatatacagcaccaagaatggaaagcggaaaccgcatataaataataaaaattgggttttgtcaatggacaaaccagacgatgttatttttggaggaacaaaatcaattaaagtattgaatagccaaattttaaaaattgaaaaattaccgtggtcccaagctggaccaggaatagtagttgatgggaaattttacccgttaatgagcttagaaattgggggcatcatcgaccaatttgacatatttaatgaattttggaaaggcatcgaaagggccaacaaaccaccaaaaaatccagaaaatttggaccaaaattccgaagaggaaaaaataaatatttctgaaaattcagtaaaaaaatctgtagaaaattcataaacaatccaatttgaaattattggagaaacaaatgaaattgaatttgaaactatgtgccaaatttttaaggaagagcgaaatgtccatggtaaggacatcgtcaaaagaggcgacgggcttttgaatttgaaggtaaaagggtcacaaccccaagttagaaaaatgtcccttaagggaattattaaatggacaattttggcaattttcatcctttttggccatgtcaaaggcatggacaacaccaaaaaattggatgagagcatcatcgacgaattaagcgatgatggtgccattgaagaaaaggacgaaaaatcacagatacacatgagcatcctcaattgcccgccttcaaccagcaatgcgcctcaaattcaagccgaaatcggcacactcatacaaacccaaataagcgcaatggccgaaaattggctgcgatcggcttttcagcaagggccaatgaattaagcaacaaataaaaaaggaaatggcggacaaaaaatgggaaaaaaagggcatttcctttttcccaatcaacggcagaatcaggcgaaagttggaggaaagttggaaaaactggcgcatcacaatggcagcgaacccatgagctgacaaccgtcgcagcagatgccgtcgaggctttggccgaacatcttcgcgactacaatgttgccgtgtccattctcctggtcacaattgccgccggacttgccgagatgaacaatcactacaagggcaacttcaaagggaacagaaagtgaattgtcggccgccggagtgtcgctaatttcatccttagcgacgaaaatttaaaattttctgtcagcccgcctatgtaaaattgccgtatttaaaccattgtaaaatcaccataattcttattgactatctgaaaagagagtcaataaaaataatcaaaattaaaataaaaaatattttttcttcaaaacataaaattgctaacattttatccgaggcatagaacatgtttttgtattaaaggtggactgaatgagctgttcggaacgattacaaaattttgcgctctgcacctgctgctcccggtattccacgttccccgagaattttctcatcaaaggggtcggggctgaaccttatttatttgtggggcaaaaattttataaatattaactcgcattaaaaatttgaccaataaatgaaaacaggaattataatagaacatttgagaagcaattgatgaaatagaaataattttagtaaatgaagcagatgatggttcggacacattatcagttgaattaggtgcgcaaggcaaccaacaaaaaataaatcaaaatgaaaatgagcaaagaattggaaatagagaaagagttgagactcctccagtatattatccgaaacttccatggccaaatttttatggagacacaatgtcttggccagttttttggcaagcatttcaagccaatatgggcgataaaccgattcccgaagcacaaaaatgtacttatttattgttaagcctaaaaggcaaagcagcccgagcaatgagagggtatcaaccaacagcagaaaattataatttagtaataaatgcgctaaagcgactttacggtaatgaaaaagtcataaaagaagcactacagaatgaattattgaatttaccgcaggccaatgaagctgctatttcactaagaatttgtttagaagatgttgaaagagttgtgcgtcaattaaataatttgggattcgctggagataaagattatgtgatgatgacaataaaaaacaaatttccgagaaatataattttagaagcactaaaagctgaaaaagacagcggaagagaatggaatgttgaagacttgataaaaggtctagaggaaataataagcatgagagaagaagctgcaagatgcacaaggatgaataaaacagcaggaacacaaagagaaaattggaataataatcaaaagcaatttagacagtttggtaatcaaaataataaatggcaaaataaccagccgagaaataaccgaaacgatgaaagaaacccacaaagagtcttttttacgcaagattcaaataataaacaaaactcacgtccacctataattaatccaaaatgttttttatgtggcggagcgcattggccatcaaaatgtagacaaataattggtcaagaaaaccgattgaaaataataaacgaacaaagcaggtgtcatcgatgtctcaaaaaaggacatgaaaaaataaattgcacaggaaaaatgtgttttaactgcaatggagaccacaataaattaatatgcatgagagaatttcaaggaacaggtgcaaaccgaacagaaatccgattgccctttaatagaactaatcagaagcaaaatccaaggtcaaatttagcagctactgcaataaaaaatacattggaagaaaaagaagttttactgatgtctaaaagaataaatagttatgatggattagaccgtaagaaaaaatcagttctagtcttttttgacaatggaagtcaaatagctatggctacagacgaattaatcgataaattgaaaccaccaaagataagcgaaggagaattagaattattgtcagttcgaaaaagtaaaccaacacatttgaattctccaaaatatttaataaaactcgaaacaacagaaggaggtatggaagaaataattgtcaaccgagtcgatctgataacaacaaagattaaaagagcgaatataatttctggcaaaattgaattaattgaagaaaagccagacattttaattggaatgagagaattttggagattctttaaaaaagttgaaccatttaaagaagatttatttaaagtacatacagttttcggcccaataatatgtggtgaaattaatggaaatgacaaattatgtgctctcacttcaatgggattagaatgcattgaaaatgaatccgaaaaaatttgggatttagaaacaattggtataaaagataacccaatggaaaaagatgatgaagtagcattaaaaatgtttaaagacacaatttacagaaaagacgggcgatacgtagtaagttggccatggaaaggtccaaaagaggaattacctacaaattttaccttagcttatcgtaggatgataagcataattgaaaaattaaagaaatccgaagaacacctcaaacaatacgacgaaatttttaaagaacaattaaaagaagggattgttgaagaaagcgaaattaaaggatatgatgaacattttttgccgcaccattgtgtattggtagccggaaagaagccaagagtagtctatgatgcttcgtcaaaaatacggggcaaaaaatgcctcaatgatttattatttagaggccctatttatatgcctgagttaccaggactgttaatgagatcaagactttctaaaattgcactttggggagatatccaaagagctttttggacattagaattacaagaaaatgacagagataccgtaaaatatttgtggttgaaagatgttaataaaccaataacaaaagctaatctttgcgcatttcggttcaaaagagtgcctttcggtgtaatatcatctccatttttattaggtgcaaca

SEQ ID NO: 52325 - DNA, 1015 bp, Heterodera glycines
  Genomic contig location: Contig_ID=SeqID_21718; Location=932..1946; Strand=-
  SCN-specific regions: Sequence locations=1-493,515-771,794-937,981 -1015
ttacatcgaccaaaatgtcatcacatttctcggcggttttcgccgtcttttccccgtcagttcgatcaatttggacattgtcactgaaaatcttcgaattttggaatttgtgctgttcacaatttggccaatgctcggcaattcgatttgtctcctgaaattaaacaaaatcgttcttcacggcttgcgtcagttggccccgtccattctctgcgattctccggcacttctctacacaactgtagaccgtgttatgccgttcgtttttccgctcggtgacaatgctaatgcgtcggatgaccaagcgctgaccaaatggctgttgacgcctcgtccggacggtgtgccaaaattgcttgattgtaatgtcaattctgttggagaaaactggtttgcggcgatggatgaactccaaaatgtgagtgttccttttaattggtttttctgatttttgtgtttcaatgattttttgtcccattttaggcatttcgcattgcttcttctcctgtttcttttcgcgtgtttcttgggtttccaaagaggcaaattgacatcgctgtgccatttgagttgaacaatgaagtcaccggagaagaactgactcttcgacaaatcgttccgcgtcattttgtgctcacccgttgtccaattggatgggatcatcgaaattggcaaattgtgagcgctctaatcaatgctcgaccgaacccaattgacattgtgatcaaagatggcgaattcgacgaacggtgaacaatttaaaaaaaatatccattttgtttatgaatccaatcaacaaatgcttagacttagtgctttcaactgataccaaaactgtatggtttattttaaaatggacagaaggactatggtgccaaaaactaaggcagttgattggactcataaactaaatgcactaataaaatgccaatgagttataatttgcaatacaattccttttttcagtcttctcaacacagcttctcccgcgccgggtggtcagcaacaacagtag

SEQ ID NO: 52326 - DNA, 270 bp, Heterodera glycines
  Genomic contig location: Contig_ID=SeqID_21720; Location=364..633; Strand=-
  SCN-specific regions: Sequence locations=1-64,104-270
ttgaagaacccaattgcattcacagcaagtgctcgtcccatttgtttaatggaatatggttgccaaataattttaaatacttttttaaaattaaaaatattttgcttatattttcaggcaccaatgatcagtcaacctttgttgttgctggttggggccgtacttcaccatattgttcgaatgacagtaagccaggcccaagcaaacaattgatgtacggtaaaatgaaaatcagtgcaccagagaattgtcaaagtgcatcaatcaaat

SEQ ID NO: 52327 - DNA, 105 bp, Heterodera glycines
  misc_feature (72)..(72): n is a, c, g, or t
  Genomic contig location: Contig_ID=SeqID_21725; Location=1149..1253; Strand=+
  SCN-specific regions: Sequence locations=1-105
ccgggactcaaatgtcccgctcaggccaaaaattttttctatttccgggaaaaaatcgaaatttttccgaanaaataccagtcgatagagctcgaaaaactatgt

SEQ ID NO: 52328 - DNA, 1405 bp, Heterodera glycines
  Genomic contig location: Contig_ID=SeqID_21726; Location=487..1891; Strand=+
  SCN-specific regions: Sequence locations=1-636,665-1214,1253 -1357,1381-1405
  Gene Ontology: Mol. function=transporter activity; Cellular component= membrane; Biological process=transport
cagcagaaggtcacgctgggcgttgaacgctttgcactgcccgaactgctgattcggcctggcgatgttgaagtccagcaaatgggcatcccagaagcattgtgtgctgtcattgaacggctgccaaagggtgcggcggggggcaggggtttaaccgaaggcttttacttaaaaaaagatgtgataccaccgtgtgtgtgctgtacccaatcccgcattttttgggaattgcgggatttgctggattaatcccgcgggaccccgtctcacgcaatgccgcagcgggatctgcaaatttaaaatttcaggctctaatattcactcgccgtagggggcggagcaggtcacccccgcctcgaaattttttaaaaattgttagaattttttttttgaaaaaaactgagtttttaaaaatttttagggctgggggaaatgaagtgcacctcgtagcggaggagaagaaggagtacttttgcttattgctttcagaaatgcagctgttgatagcgcggaacattgtgctgaccggagggaacgccctcttcccgggctatcgcaaaagaatgtaaaaattttgaaaaaaacaaagactcacattttaccaagaaatagtgtaatactgttgtttgtcccccctttttaaataaaaaattttcaataaaaacaaatttcctatggtttccgagggactaggtcgtttcggcgccgccatttcggcgctagcccatgttttttgtgtataccttttttctttgtaagcaaaatcaaacaatcttggtatcattcgaaagtccttcacatgctctactagccttacaaaaaaaaaccaacaaaattctagcctttaaaaaattattaagaaaaaacttcaaaaattttgacttttttgaaattttcatgtatatccgaggttcaccaattcaactgattccgatcaaattcattcaaattgttgaatttcgaaatttctttttttattgcagaattgttggttttcagtaaaccgatttagaactcaaaaactcgaaaattgaactttcgacttagtgttcgaattcggacccggagtttggaagcggtcaaaatggacgccggtttcgtgatcagcgacctctaaaaaccacaggaaacttgtttttatgaaattaaaatttttgaacgttttcaaaaaagggcggggacaaactcaataatcaaaaattgtttcttagccctttatttcaatttttattttttatcatatttattttttgctaattggcagtgagcaggaattgcgttccatgatgcccgaacagttcactcttggtgttcagcaaccgtccgacccgatttgccacgcgtgggaatgtgcacgcgacgcaatccaacaacaacagcacgatggtgcggaaatgcacaaaaa

SEQ ID NO: 52329 - DNA, 734 bp, Heterodera glycines
  Genomic contig location: Contig_ID=SeqID_21727; Location=182..915; Strand=+
  SCN-specific regions: Sequence locations=1-399,427-734
atgaggcaaattgtgctaattgcctcaaaaaagaacaaaatgtaaagcaattataattttaattgttccaaattcatttaatttatttaccaaaaatagtttccacattttcagttggttttgtactgattttttgatggacattttccccttttttgaccatgccgaactcggcctcaaattggcactgatttcgccccatttcgatgttttagtggacaaacatttcgatggcaaatcagaattgacactttggagatcaatcacaattcgtaaggacattgtcgcaaaagtgccaaagttgtgtgtgtttcttagtgccaattctgttgaatttccattgcccgaccattcgctgcctaacaaaattcgctttaagaacctacggattgagtaattcaaatataaaaagaaagaaaatcacttcttttcaccattttcagatacattgatcattccgtcatcgcttttctccgttccaatcaccaaatttgggacaaaagaggcatcaatttgcgaaagttacggtactccctgcgggtgcatatcaaggctggccgtgatcacggatcacggaaatcacggggtttctgagatgccgtgatctcggatcacgggtcacggattttttcaatttttccgtgattttgatccgtgattggcattttatgtactgaatttttattgaaacgaaaataggaaattattgtgaaaagagaaattgtttgagaaaa

SEQ ID NO: 52330 - DNA, 1932 bp, Heterodera glycines
  Genomic contig location: Contig_ID=SeqID_3896; Location=567..2498; Strand=+
  SCN-specific regions: Sequence locations=1-178,204-272,295-473,496 -527,549-554,576-1431,1490-1533,1596-1748,1920-1932
atggagactggtatattatttttcaacctcctcagaagggggtatataattggaggccggcagattaatggagactggcatataaaaagagtatatacggtattttgcttaataaaatttatttgctttgcttgattgctgtggctttgtgtgtatacggtttagggccgaaacacacataataattaatttaaattatttaacccaaagagacaccgtactgatgaggcccggtctctttcggttaaatttgcacgtttcgcgaagtgcccacttttattgatttttatttttgcactgtcgcgaaatgcgctgcccgtcaaaatgtccctgcgtcataatgtcccagcgtcataatgtccctgcgtcataatgtcccagcgtcgaaatgtcccagcgtcataatgtccctgcgtcataatgtcccccaagccaaaatgagtcaaaatgtccccctctaaaaattagtgaaaaaactgaaaattatataattatatgccttcatacgatctgcttttaaaatttatgctttagcatcaatatagaccgtaacaaaattgaaattctccaaaaaagtcgtaagcgtaagtttttggacaacaacgacaatgagaacgaaacgacttctgagcatcatgaaccaaacgacgaaaacaatgaccgcgacgacgattttgaagaacacgccatcgtgaacttcgaactcgggaaaactcattccatattggaacgtgcactcacatgcggcttctgccctcgcgagaaccaataatggcctcgaagcaacgcacctccatttcgctgtattttttcacttatgaaacctcccccaaaaacttcaattttagaagggtctttgtcaccacccggccctttccgactttatttatgaagtcagcagaagtatcgacaaacaagtggacgcagcgagatcagctcggaacttcatacacaaacgacacaaacgctacgtgctgcaaaacgcagtcatcattcgaattttagcggacgccacatacgacaatgatgccgaaattcacgatgttatgacggctcttggtctgcaggtcaaaggatatgcaggaaaattgaaggactatgaaaattttgatgattcgaccacgcatgtcccttaaaattgttcatttcgtttttattattccttcaattaattagaaaatcccattgttgattgatttttttgttgtttacttgattttgatcaatttttaatgaacatagtatttgcgaaatcaaaaattatataattttcagttttttcactaatttttagagggggacattttgactcattttggcttgggggacatttcgacgctgggacattatgacgctgggacatttcgacgcagggacattttgacagcgcgcccgcgaaatgacatagcaccatgaaaataactgaataagaatttaaaaaaatattcattttttagaatattctctaatttcttaaatattttaaaaagaaaattcttatgtaagttctttgttgagtgttgccttaatgtgtaatatttattaatattgttgatgaaatatttaattaaattatatcagaaaataatatatatgaaagatttatatgtttaaactttcattctttaagcattctaagccaaaattactattttcaataactcgatataatttaagtgcgagtacattaaatttgatataattctcaatataattcacctctaatatattttcattttttagggtagaaaattaaaattatttttggatataattaatcaatattgtgtatttgttaaactttaatttatttatttgaaatgaaatacaattttttattgtgggttttatttattttaactattaaaaattgattatagatagttaaaagaattgaaatattaaattacatttttaatctaaattgagcaa

SEQ ID NO: 52331 - DNA, 269 bp, Heterodera glycines
  Genomic contig location: Contig_ID=SeqID_3896; Location=877..1145; Strand=-
  SCN-specific regions: Sequence locations=1-4,26-31,53-84,107-269
cgacttttttggagaatttcaattttgttacggtctatattgatgctaaagcataaattttaaaagcagatcgtatgaaggcatataattatataattttcagttttttcactaatttttagagggggacattttgactcattttggcttgggggacattatgacgcagggacattatgacgctgggacatttcgacgctgggacattatgacgcagggacattatgacgctgggacattatgacgcagggacattttgacgggcagcg

SEQ ID NO: 52332 - DNA, 817 bp, Heterodera glycines
  Genomic contig location: Contig_ID=SeqID_21730; Location=18..834; Strand=-
  SCN-specific regions: Sequence locations=1-43,83-98,120-299,353 -569,627-781,803-817
atggcacatattaaaagggtggaactgttgttgagaagagcgatttgtgggggaggaaggaaaagtgaaaagggaaaagccaaagggaaaggacgggggacggaggaggagaggaagaacccattcataagccaacggagcagcggggacaatgcgaagcagagaatgccaaagggagggggcggcaacggcaatttgtcagaagaatcaattagcaaagaggtgggcaccgatgacggaaaagcgaaccacccgaaaacagcgaccgaaatttgcacccctttcaatttttcgcatcgcttttcgttttttgcgctttttccctttccttttctgtttcttttccttttttagctgacttcttctgattgtgagactcattcggcggctctttcgcggcttttcgaccttttcagttcggacattctcagtttgctgggaaaggaggacatcggaagaatgaagagaatattagccgaaattgaaatacaaatgccaaaagagagaggcgaaagtgagcaaacgcagaaaaaattgaggtgcgtaatcgaaaggttggaaatggcgacggaggagaaggaggaagaggaggagcaggaggagaagaaggaggaggaaggagaggaatgagagaagctgaaagagattgatggtggatgactcatcggaaaaatgtgaactaaatgtaaaaaaaggaaaaccgtttaatctcatttgccttttaaaattttttttagtttttcgagttaaattatgtagctcgtgtacgatatttaaagctcttaaaaagaaatagtttttatgattcgacattaaa

SEQ ID NO: 52333 - DNA, 1744 bp, Heterodera glycines
  Genomic contig location: Contig_ID=SeqID_21731; Location=177..1920; Strand=-
  SCN-specific regions: Sequence locations=1-1744
tgtgcttctgccaattcgattccacgagaagtgaatcggagggccgttgacggagtgaacgaagtgatcaaagcacttttgcaattggaatggccaagtgatcagccgcgtatgacagtcttcggatggaattcgtttcttttctccgccttctctcaaattgccggttcggactcactttgcgtgtccgaaacatttctgcaagtcggtcaagtccttctcagcttcgtgggccaaaatagcgaaatgatctgttccgcgtgggaccctttgtttggcacaattcaggcaatgaattcttagcttttttgtacgattcgctgttctatttcagcagcttatacgaagaaatgtaaaggaaagtccaaattgtccattggtggcactgattttggacatttttgagaaattcttggctatttcgaagccattcgttctactgatcgcattttctggttttgtcgacgctttgtccctttttctgtctttgtcaattgacgacaattcatcaatttttgagcaattggtctctcttttggaacgttctgaatgtgttctgatcgacttcctatttactgctccaattgaacttcctttggctttcattgaaatgatcaaccgaaaatgggaggacaaacggaaaataacaatggctaatgggcagagaaatacggaggaagcggatgcagatggttatgtcaatcagttgacggatttgcgaacgcttttgagtgatcagcgggagggaatggccgagggatgtccgataatgtcaaaatggttggacgaaggtgaaggcggcgccaaggttggaagcggacaacggaaaagcgaaggtgggccaaaagcaaatggaccaatcattgaaagaaaaatgacggcactttcagactccacttggccctccaatttgcccatttgccatctcagtccgacttccccttgtaaagttgttgccctgcactccttcaatcttctgcagcaattgctgaaggccatgctgaacaacagaaatgacagcttcaacgtgaccaatcagtcgcggctaacgcttaattttggcaatttccttggggagctttcgactaagttcggtccgtccgttccccccccccttttcccttttttgatcgctgtttatctccttaaggcactcctttcgcctctttttgtttttgtgccgttctgtcgtccgatgttggcaattcgctggcccttccgctgagtgcatccggcgtccgttgccttaagcttctgctcgtctccctcctcgcccatcgttcggttgttcttctgctctccccctcccctctcccctctctttggcgcttcttcctccttcggcttctccttcggctgtccgtccattgcgtttccaaagggggcgtaagctttgctttcggttgtcactctttgttttccctctcagaacctttctttggtcggttgcgcgttgcttcgcaatttttgcgccctctccactgattgtccctttttcgcctctctttgtgccgatgccatttggagttccatgtccgttcttcatttgcctttttttctttcaaaatgcttttccttcagtcattacactcttttccccgtccgtttgctcatctcccaattcttcgtccattccaccgatttctcctctgaccttggcaaaatgcgcgtttcttatcggttgggattaaacccagcagaagtggaggaatgcgttgacaaagtgaacaaattggctaatcag

SEQ ID NO: 52334 - DNA, 245 bp, Heterodera glycines
  Genomic contig location: Contig_ID=SeqID_21732; Location=270..514; Strand=-
  SCN-specific regions: Sequence locations=1-245
ggtcccttggtatttccacggccaaaccagcaatgtcagacattacaacagttaccgcccgccctccttcactccgcgtctgtccacctattggaaaagttatttctgaccagcgaccgttcagaatggcatttcgttgtccttttgaattccttgccttttcattttccctttgctttagtccctccattatcattctgtgcatagaaaatgagcgtaaagtgtcaataaatgtgcacaaaagc

SEQ ID NO: 52335 - DNA, 997 bp, Heterodera glycines
  Genomic contig location: Contig_ID=SeqID_21734; Location=340..1336; Strand=-
  SCN-specific regions: Sequence locations=1-141,164-241,265-776,800-997
  Gene Ontology: Cellular component=extracellular space
agaaaaagttaaaagaaaatttttctctttttcccgtcgggacaccaattccgaaggattaccgaattgagaagccactgatccgttggagttcacccaacctttcacaacgcccacgctcctaggcatacttttaacaatgttttgtctattttgaatttttccttcagtgattttgctgagtcaatgcattcggttgcccgccttccgtttcaggtttctttttcagtagaataattttatttcacaaattttcaattatagaccaaactgagttcggctggtctcatttacgcccattacggaaaatcgttgatcgctaacattttgaatttggcggaggatgacgcggacatggacagactatacgagcacgtgtatcgtaaatttgttgagggagtcgacgcaattgacaacggaattaaacagtacgacggaacgccgaggtaaaagagcggagacattcacttgggcaaaacattcaatttttggggttttaattgaaaatggttcattcaaatcccatcgtagaaacgacggttttgaatttgtcaggtaccaaatgtcgagcactttggactcgcgagtgcggaattgcaacccggcatggaatgaccaaaagccggacccggaaaagggctttcacaatgccatggcaattgtcggcgcggaattcgaggagcgcattcgttacctccacagtgcgtggatcccggccagaaacattgtcatagaagctatcgaaaggcgaaatgaggcaaaaaaaggggtgggacaaactgaaaaataaatttaattaggcccatccaagcggaaggataattttgttccccaaaagcggtgtggttccgccatggaaggaacattttttccaattggaaaatgaattgggcctggagaatgtcggcatttgcttggtggtgttcgccgacaattctaacaacacttggcgggtgcaggccatccccgtttcggacgtgagctcttttgacaacag

SEQ ID NO: 52336 - DNA, 270 bp, Heterodera glycines
  Genomic contig location: Contig_ID=SeqID_21736; Location=1887..2156; Strand=+
  SCN-specific regions: Sequence locations=1-201,224-270
atggaccaccgctataaggccattattataggcaaatccgaccagcatctgtccgacatgtgtctgaaactgtggctcatcggcgagtggaaatgcgtggacatcaaattcggccgatatggcgggtacaatctgctggacccggtcgatgtcggcgactttgtcgagctgtacgacggtggtggaccaattcgaaggcttcctccgggaccggcactgcccaaaacgcgaatcctcgacggaagcaatggcactcgcagctgcttgaag

SEQ ID NO: 52337 - DNA, 393 bp, Heterodera glycines
  Genomic contig location: Contig_ID=SeqID_21737; Location=1069..1461; Strand=-
  SCN-specific regions: Sequence locations=1-206,228-393
atggggcggacattcattttttggttggggaaagcgacgaaaaagaagcgagtggttaaacatttaatactaatttgaattttaattgaaaataaggaacatggtctaatttgtttaataacttgtctattttttagctaattcccgcccataaaacaattctggcctcggcctccgacgtgttcgaagcaatgttccgttttgacgccggaaatactggtcgaaaaagtgtgcataaacaaacaattacataaagccttaaaacaatgcggctcgcttgctgcacgaccgaaaattttgggcaccagaaaaaaaaaatgccgcgggttttctataaaaaattaccaatcatttgttaatttgtgggtttttttggctgttttaaaaaataaa

SEQ ID NO: 52338 - DNA, 1479 bp, Heterodera glycines
  Genomic contig location: Contig_ID=SeqID_21738; Location=655..2133; Strand=-
  SCN-specific regions: Sequence locations=1-21,43-110,144-300,323 -394,417-789,812-922,944-1006,1041-1479
atgggcggcaaggattcatcaaagaaagtgtgttttttatttgtgaaagtatttgctgcagcagcgaacaaattaattctgttgtgagaaggaaagaaaggattgggcaaaacgaatgacgaacgaacgaaagaatgaacgaatgggtgggcggctgatggaatgaatccatttttaaattgaatttcattctaatccaagttctcatcatcaccgatggtggaacgaacaaataacggtaaaatatagtggggacaaggggaaaaacgaccggcgaaatgggcgccatgggaaagtgaggtgaatagaacaaatgtaaatgtacagtgtgaatatggacaaatccttgaacaatatgcgtatatgccatatttatttgttctaaaaccaccctcttgggggtgggaccaagaaagtttggcccaaaagtaaattgacattttggccgttctggcgttcacaatttttgacaaaaaattattcagctaaaaagtaacataatttttaattattgatatcattcaatggccatttattttctattagccttcaaaatttcaaaaatttctgtttgactttaaaaaaagagttatggccagaagaacctaaaaacaagatttttggacattattgctcataaatagggcagggaatatatggatataaaatcgcaaaatatggccataaaatatggaccaaaaatcgcgaaaataaaattgcaaaaatatggacataaattttccgaattgaagggtaaattttccaaaaatttcttcaaattaattaaattttactaaaatacatataaaagggctaatattgtattaaaaatcattctaaaagaaaaaaacatgataaagctaaaatttactaatttttactgaaaaatcaacccgaaaagcgaaattttcgctttttttagtttatttttgatacaaatttatcaatttttcagaaaattgaaacttattcaatattctcgtgaaaatttgctaaaaaaagattttttggaaaatttccggtttttggggtccaaaaggccaatttggctgatgggggccgttctaatagaggtttttttggaaaaatctcaaaatatggacaaaaatgcgaaaatatggaaaaatatggaaatatggatatggaactccatcctagaagcttcaaaccaagctaaaaacatgtttttcgtgcatttcaggcctcccacagtccaggaaaaaaatatggatttccatataattacaaaccctactcataaattatttaaaacttaacgaaattttttgaaatttggcaagataatagatattagagaacatttaggttttcagatacttaataacaccataatgaacaacagacgtaggacatgttgaagaatagtggagacatagcagaaaatataacgaaggtaatgaacaaaaaattgaggagaaaccacgttttaaagaatactctgtgttaatttaaaataaa

SEQ ID NO: 52339 - DNA, 285 bp, Heterodera glycines
  Genomic contig location: Contig_ID=SeqID_21739; Location=515..799; Strand=-
  SCN-specific regions: Sequence locations=1-65,87-285
atgacggccaacatcaacccgactacggctatgaacagaaaagtgcgcattgtgcaccaatactacttactaaggaagaaataaaattggggaatgtgcaacaattagtgagagagagtagtttgaaaatgaagtgtcattggctgagtttggcaccgcttttatattggcactttcagcgaaaagactgcacggcatgcaaatgcgaagcaatatcgcatggaagacggtcaaacaaaaaatcagatagcacatgccaatgaagagagtgggcagagaaataaa

SEQ ID NO: 52340 - DNA, 731 bp, Heterodera glycines
  Genomic contig location: Contig_ID=SeqID_21739; Location=665..1395; Strand=+
  SCN-specific regions: Sequence locations=1-49,71-147,203-245,307 -537,566-624,646-731
acttcattttcaaactactctctctcactaattgttgcacattccccaattttatttcttccttagtaagtagtattggtgcacaatgcgcacttttctgttcatagccgtagtcgggttgatgttggccgtcatcttggagaatggtattaaaaatttaaaaaagattttaatttgtcataaatttatttatattattttagtaaatgcgactgggaaaaattcgccgtcaaagggtgatgacgataaattattatttactataattaatgtaaatttaaaagcaaattatatacaaaaatttttgcgaatcttaattcttagtgtcggtgggaggatgcaattttttgaaaaattgaatatctgaaacaataataatttttattattagatagtagtccgagaaaatcgcccttctaaattattatcattagggctgctaattttatttaaaaaatttgcgaattatgtaaataaaatatgtataaaaaatgctaaaatatgtatgaaatatgtacaaaaacccccaaattgtactaaaatatgtaaataaaaatttttaaatggtcatttttttggataaaattcttcgtaaaaagtgaactaatcacaaaatgccttgaattttcaaaaaacaataaaaattggttgttagatagtaaacatatttttcacgattttaggaaaacagtcgctagacagtccaaaccataaaaaagaccctaaaaatg

SEQ ID NO: 52341 - DNA, 1312 bp, Heterodera glycines
  Genomic contig location: Contig_ID=SeqID_21742; Location=57..1368; Strand=-
  SCN-specific regions: Sequence locations=1-134,156-173,195-273,295 -412,434-667,689-944,966-1199,1221-1312
atgcctggtggggaaaacaatatttcacattcactccatacctttgtgagttcggcacggatcgagaccgggataagaccatggaaagagcagctcgagctctacaagaaggtatggaaagaaaaaatagttatttctgggactttttcagaaatcagaattaattctccaatgtgggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgatttggtttcttgatatcgaagctgttttctacgctatttctaaaacggttgtaccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatagagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagtatgaagtcttggatttgtcaaataaa

SEQ ID NO: 52342 - DNA, 94 bp, Heterodera glycines
  Genomic contig location: Contig_ID=SeqID_3898; Location=48..141; Strand=-
  SCN-specific regions: Sequence locations=1-94
atgactttcccctttttgttgctgcccgttcatcttctgttgatgctcgtcagcgctgttgtgttcatcatcttcagccaatgctgcggttgct

SEQ ID NO: 52343 - DNA, 1106 bp, Heterodera glycines
  Genomic contig location: Contig_ID=SeqID_3898; Location=1773..2878; Strand=-
  SCN-specific regions: Sequence locations=1-28,52-59,190-197,350 -368,407-733,755-812,834-1106
  Gene Ontology: Mol. function=transcription factor activity; Cellular component=nucleus; Biological process=cell proliferation
atgtcggacgagccaccgccaccagcaacgccggagacgcccaaggagccgccaacgcaagcgtcagaagtgccgtcaccagcagcgccggagacgaccaaggaaccgccaacgccagcgtcagaagtgccgtcaccagcagcgccggagacgaccaaggaaccgccaacgccagcgtcagaagtgccgccaccagcagcgccggagacgaccatggaaccgccaacgcaagcgtcagaagtgccgtcaccagcagcgccggagacgaccatggaaccgccaacgcaagcgtcagaagtgccgtcaccagcagcgccggagacgaccatggaaccgccaacgcaagcgtcggaagtgccaccgccagcagcgccggagacgaccatggaaccgccaacgcaagcgtcggaagtgccacccgccagcgccgacacgtcttcagccacgctcagcgcccatcagcagcttcaaggatgtgcgcccggtgctgcgggagatgctcgaccagttgcaccatccgatcatcgacactgtggagcgacagaccgggatggaccgcgagcaggtaaagaaagggaaggcattccccgctctaattttacaatgccattcagctgttcttcgccgtggtcgccctgttgacgttctacctgctgtttggctcttacaacatcttcgtgagcaatgtgctcggtgggtttttggctttttttttttgtcttcactgcctccactaatttttgtcattttcagtcaaatgttacccggtctaccagagcgtgatgaccatccgatcgcaaagcaaaagtgagtttaaaatttttccaatttttgattttaattaatatcccaatcccattttcagcggacgacacccaatggctcgcctactggtgcgcgttcgccctcttctcgctggtcgaccacttcatcgcgccgttcgggctgtatctgctgctgaagacggccgtgctcgtctacatgctcctcccgcagacgtacggtgcgcacaactgcttcgtcaactatgtgcagccgatgatggagcgatttgcggagcgccgtgtccgacgccatgctcattgatgcgcccgcccgcaagctaa

SEQ ID NO: 52344 - DNA, 48 bp, Heterodera glycines
  Genomic contig location: Contig_ID=SeqID_3898; Location=3248..3295; Strand=+
  SCN-specific regions: Sequence locations=1-48
atggcacgccgacgaagaaagaaggagccgcgaaaggtgtcgtacaag

SEQ ID NO: 52345 - DNA, 1008 bp, Heterodera glycines
  Genomic contig location: Contig_ID=SeqID_3899; Location=19..1026; Strand=+
  SCN-specific regions: Sequence locations=1-208,231-866,889-935,957 -1008
  Gene Ontology: Mol. function=DNA binding; Cellular component =nucleosome; Biological process=nucleosome assembly
atgcgtgcgttgaacatcatgaactcgtgagttgcggctgttgctgaaagctcaacaacaagtaacatccgttttccccatttttttcagcttcgtcatcgatgccttggatcgcattgcaacggaggcgacgcgcatggcccactacgaccggcgcaagaccgtcacgcttcgcgacatggagttttcgtgccgactgtgcctgcccgacaccatggccaaacatgcgaaccaaaaggctcagaagacggtgaccaagttctacgctgcaaaagtgcgggaccggatgagaaggacggagatgcgacgtggcgaatttgcgatgatgcagatgggagcgctgtgagcacactcaacttttggacgaccgccggatgataccgcctatatattgttgatgattgttcctatatcccccgcatgtgtatgtattatgcaatgtatcccccccccagtattgtatgtgtatgtattattcaatatgtgctttgtatgtgtatatccggtatataaaatatggcatagtaagccatcgataaaatctgacggatagactttgattttgtgtgaatttaaattttgaaacttctatagaataagagaaaaaaatcagagaagggtagaaaaccaactcaactgcgtctgagagacaactctaagaagaaaattggggacgaaacgatcattttggagtgtatgggtgtataaattgcaatacaatagtgaataagtatattaaaatttatatattcaagcatctttcgactttttcacgaatttttagcttggcggttgtctcagacgttggcggttccgaaaaccaaaggatggacacttgctttggaaaaaatgtaggacgttcctgattttaaattttttgaaaaattcggttgggggcaaatttacgattagcccgatttgtaaagcacatttggactaataattattttttgatcatgaaacacggttgtcctgacaaagacctaccccacaagtaaaatctctcga

SEQ ID NO: 52346 - DNA, 1784 bp, Heterodera glycines
  Genomic contig location: Contig_ID=SeqID_21747; Location=167..1950; Strand=-
  SCN-specific regions: Sequence locations=1-96,118-118,140-249,271 -548,570-1241,1264-1643,1666-1755,1777-1784
ttctgagtcaaatcaagacacaatttcaactaaaaatggagaaactgtgactgttacaactcaaaaaccgacaaaaaacggtgttgggaggccacggaagagaaagagggtggaagatgaaaagaggaagaaggaagtttcattggaaaaaaagaaaaaagaggaggagccattggaaagcgaagaatcggccaaaaaatgtctgtcggacactcaacaaaaagctaaacggacaccattttacaaacataatgtaagcaattcaaccaaagaggcagaaagcgtgatcaactcttcactgtcacatgtaatttttgtcataaatttaatcaaaaaagtttctaaattcagcccatttatcactcaaacaaatcattttcaaaatccttaccattgtcgtcggcagattacccgacttcttcctcccaacttcaacactgtcataatttgcctattgggccaaataacgaagcgaaatgtgactttatcaaagaagaacaagcatcgaatttcgatcatggtcttttttttttttttttttcaaggccttgaaatttaaaacaaaaatatcggacaattaaaaggcaaaatgtagcaatttcgagcagtattaaccataagaatccaatgagaactttcgacttatatatcggctattactttgttttgctccccccccccctatttttcgaaaaaaaacccgaacaaaaagtcggaaatttattttcaccaatgacccaagagatatagaaccttctttatgtgatctatttaaacattatttagggcttaaaagtgacgagacacggaggcgagagaatgacgagacgacttttgtttgtgcgcgggtgcgtccatttcatagggcagttcagccgaatacacgcgggactgacaaaaggtagccatttttcgtttttttttttttttttgaatttctgcatgttttcttggtttaggctaaaaatcagttcgcatcttcaaaattctcacaatcagaaatgttattctcatttccgccaaaacactaaatattgtggccaaactcccattcacatggccaaaaacgaaaacaattttggaaagaacttacactgtggtaagtgttggatgatcaaaaaaagagtcaaactcgtttctcattagacgaggtttcaaaatggtgcaaaaatcactttgaagaacgacgcaaattaaatgacgccccacaaacacctcacggttcaaaagaaaggtgtgccatgtgcttaaaaaatattacatacgcttttcagtgtcctctcaacaaaaccttcgcctttggtttctgcgcattatgtcgcccattcgtcacgtcaaattcttagggcatcaaacgaaatagttgaagcggaccatgcttatgagaaggcttcttcatcattaccaattgaaaacaacgtcaccaatgccaatgtttcgtcagccgtaccagcggtcattggaaattgcgctgctccgatcactgttcaggcggaaaacggattggttgtgagcaatggaacatgtgacaatggaacgccttccaatcatttgtacttttaaggaataatatccagggatgttgctaccaaaataaatgagagaacgagaaaggcgagaaatgagacgcaacatccctgatatattccatttatcttttaattgaaaaggcttacatttcaaattttacagaacaacacttacaactcttgacctactgaggaccaaagaatttattgcgaatcagtcaatttctatggatgaaggtcaaattttaaatgaaa

SEQ ID NO: 52347 - DNA, 1281 bp, Heterodera glycines
  Genomic contig location: Contig_ID=SeqID_21749; Location=76..1356; Strand=-
  SCN-specific regions: Sequence locations=1-74,97-1247
atggttttttcaagggcacaacaaatcagcgacaactacaaaaatttggaaaatttttctgtaagaatttaagtaatttaaatcatattgtcagtttttaggcaagtagtcatggatggttggagaaatttatgagccgccacaacttttcgttgcgcaaaccaacaacacttgcacaaaaaccacccgatgattacgccgaagcaattgtcaattttattgtctatgttcaaaaattatggcatgaaaaaaagtaatgattagcggaaaagttttcacgcatattctaattttagttacactgctgtctttgcgtgcgatgagacagctgtttggcttgatccaactggcggaaattgcgtttctgagacgggtgccaagtccgttacggtgctaacaacaggccatgaaaaggcaagggtgacggtgatgttgacggcaagatctgacgggacgaagctgcgaccatttgttttactgcctaagaagagacctgtgccagacattatcaaacgttttaagaacgatttagtgttgtgctggtgttgccgtacatggataaacaacgaactaacgacaaagtttttagaggaagtgcgaatgcttatttgtctttaaagaaattatgtaattaaggtgcttggcggttttgcattcgggacccggcttctcgtttgggacagctttcgttgtcacatcagtgacgataccaagcagacactccggcgtttatccatcgaatctgctgttattcccggtggtacaaatacattcaagtagtagacaattcaatttaaacccaaaaaaacattttagccaccagacgtgtgttggaacgcaccgtttaagaacaaaatcaggcaaatttacgatgaatggatggtgaaaggagagaaagaaacaacgtcgtccggaaatatgaaggctccgccaatggagacgtatctgcaatggattgtcaccgcctggaacttactctcgaaggaactgattgccaaatcttttttgtcatgtggaattacggatgaaattgatggaagaaacgatgagatgatcaatgtttttaaggtcgcctatttggagtattttgtgtatttttcaagtgttttaaggcggacggagccataccaaatgggcttcatcttctgaatcaacgtcgaaatgaagaaaatgttgtgaaagcacttgagcaagatgatttgggacaagacgaaagcgatgtctctgtcgacgttgctaatgaataatattttgatcaaatttattttcttttttaataaa

SEQ ID NO: 52348 - DNA, 428 bp, Heterodera glycines
  Genomic contig location: Contig_ID=SeqID_21750; Location=1125..1552; Strand=-
  SCN-specific regions: Sequence locations=1-71,114-322,344-347,369 -372,394-428
ctcccatcaaagccacggcattattatgggaatccggccctttgatatgtctggggacgaaaagtctgatagactgtgacaatgctattaaaaaatttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcattacagcgttaattttctggaccggtaaagtcgtaattacgggaactaaaaacaattctgaaattgaggaaatgtatcatcatattctcccctatttgaaaatggctcaaaagaagttagggagacgataaaaaaatttcatttattgg

SEQ ID NO: 52349 - DNA, 1858 bp, Heterodera glycines
  Genomic contig location: Contig_ID=SeqID_3900; Location=2097..3954; Strand=-
  SCN-specific regions: Sequence locations=1-4,66-312,342-622,666 -734,756-971,993-1045,1074-1201,1225-1339,1398-1515,1537-1557,1581 -1698,1730-1770,1799-1858
atgcaaaaaaataattttatgaagatttttttaataataattttattaactattttatttattatcattaccgaaggaattgatgaagatttatggaaggacttgaaatcttcgacttcgagaaacttaaaaaaacaaaaaatcaccaaaaatttttcaataaacgaagaaattgctgttaaaaatgaaatttatcaacaacaaaatgccaacaaaattattattaaatctgaaaattgcgatgaacatgaaacggaaaacataaagccaaaagtatcgcaaaaaatcaaaacggaatcattggatggatacaataataaattgaaaataaaaataaaattgccaaaaattgaatccgaccaatggaacggagaagcattagaaaatgaaaatgatgagcaacaacaagctggtctttgcaattgttctgctgatcagagtaattcttctgctgatcagagtaattcttctgttaatcacagtaattgttcaaaggaacaagaggaattagattacaccgaaacggtaacaacagcagggcatactgtaatacgatataagggattgatcttttacgtgttgttttgtagtgaacttttttttctgaatttgaattagagcgaatttttaaataaaattaatttccaaaattggaatggatcaaaaatttgctcaaattgcaattaaaaattcctcacaaatttttcttttatttataaaatccgtaatttctcagcctgaaaacaacttgaaaattacgggaaccaaccgaactatcactcggaaaaggtatattagtttggtattattgaatagagcaaggtcgatttctcttgagatttttaattttacacgcccataggaaaaaaaaatcaaaaagagagggcctcaaaaaccgaagttttcgtgtctgagatccattcactatcttgttcactttatattaattcccgaacctttgcagtttactaaattttcattaaagaaaattatcaaagatttttttgtaaaataaaaatggtttttaaattgtttagttttcttatacattattaagatttatttattttaatgttcgaaataaaacagggacatccaaaaatgcgaattcaaccaactgaacaaaattttgaacattttctcacttgaccaccatcgctgaagcgaaaaccgagtcaatatttcggttttttgaggcctcataaattttttatttatttttatgggggcgtaaaaaataaataaaagtcgaccctgctctatcaaatgataccaaatttatctatgtttaccgagttagagttcagaatttaaatttttaatccatacaaacgatgacttaattacaatataaattcttaaaaatatattacaaaaaaaaagaaattaattatatacttaagaatgtaaaaagaagaaatggattggaaaaaaatgccaaaaaattgggcaaaaaccacaacaaaatttgtaacttaaagcaaaaaatgggccaaattaagaagaaaaagcgggaaactgcagaaacaaaaatggaactgatcagaacatttgatcaaatgagaaaagaaaaaatttatgggtttaaatatgaagcgaagaaaaagtttcaaattgaaagagaaattgcgggaagtttgggagttaagcgtgacgaaatttaccaactgaagaatgaatttggtaaaatttcttaacaaaaaaaaaatatatatctattttaaattttcgatagttccatgtgtacgctagggggttttgggattttacaaaaaattttcttaaatttaaaaaatttcaaacattaaaaaggctatttttgacaatttttgcgaaatatgaaaatattttgaataaa

SEQ ID NO: 52350 - DNA, 1248 bp, Heterodera glycines
  Genomic contig location: Contig_ID=SeqID_3901; Location=681..1928; Strand=+
  SCN-specific regions: Sequence locations=1-107,129-399,457-523,545 -621,643-663,722-1248
atgaagctcatccttcagctcaatgtcttgtttgcgtgcttttggagcggtaattatacaataataatgattgatgatcaattttaatgacttttaaatgttcgtaatttaatttttacaaaactgttttagcaaaattgctcatttgccgtgtgggactgtttggctccgttgataaaccctttgttcgtaaagagctcaattattctacgattgattgccctgcaaaagctaaattttgtgtgaaagaagtctgcttccaagatggcaaaggtagaaaatataataaacaacacacgagaaatacaatacaaattcattgaaaaagagaagtcaaattaaaagttttgaattttagtggaaaaagtatcaaaaataattacctatataataattgggaaaatttcaaaaataattataataacatggaaaatttgaaaaataattaattaataactgggaaaatttgaaaaaaattatttaaaaactgatttcaaaaatgattatttttaaagggaagatttcaaaataataaatcaataactggaaaaatttcaaaagaaaattccatttatttatcgaacaaagtacagagtttttttttaaaaaaactctccgctcttaataaattctcatttgaatggcaaaaaacccgcatttaacaaaaaataaaaataactttcatttttaattattaaatattacaaataaaacaatttttgtttgtttttttaagccgaaaactatgtgaacatttacgcatgcaccgatgttataaaagattgcaacactgatggtactagcttaatggcatacagggagtgcagactaaaaaataaaggaatcaaaaacgcgtgtaaaaatgagaaagaaaagaatgaggccgcttttgtcaaaaaatatggcagcaattaccggtgcgaacagtgccaatatggcaacgaaaatgaagacaaaggcaacgagaatttcgcgccgtacaggccagacggtatgtagaataaaaattggatgtttttttttaactaatcttttggggaataatgagaaaaattgttttcttatagcattaaaatttaatttgttgtctttaaacattttttcaacggacaaaattggtgaaaattttgtgaaatcaattttaaatataatttacaaatgtaaaaatttgaaattttgttagtgtctcttttttaattttagccgatttaattataatttagattaatgaacttttcaaaaacatta

SEQ ID NO: 52351 - DNA, 330 bp, Heterodera glycines
  Genomic contig location: Contig_ID=SeqID_21754; Location=713..1042; Strand=-
  SCN-specific regions: Sequence locations=1-262,285-330
ccgggactcaaatgtcccgctcaggccaaaatttttttcaatttccgggaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgggcttttaaagctctacaataagtctgctggccaccctgcgctcagctcaaagcctaatgagttattcgcctggtactgaagtgggaaaaaa

SEQ ID NO: 52352 - DNA, 153 bp, Heterodera glycines
  Genomic contig location: Contig_ID=SeqID_21755; Location=1512..1664; Strand=+
  SCN-specific regions: Sequence locations=1-153
atggtcaacaccaaaaatggtcatggtatctctcatatggtagtgttcttctgtttggtgctcaccattggttgttggccttcaaatggtggatggacaccatttggatttgtacatttgggtggtcttgggctcaaaaatgcggacctgctg

SEQ ID NO: 52353 - DNA, 966 bp, Heterodera glycines
  Genomic contig location: Contig_ID=SeqID_21756; Location=370..1335; Strand=-
  SCN-specific regions: Sequence locations=1-111,146-671,694-760,782-966
atggaagggcaaattcggaatgacaagcgagcacgggacgagagtcagtcaaaggagcccgtgcggtcccagcgacgactcaaagccagagatccgttggacgaacagttgaaaagaaggaaaaaagggcaacaagctgaagagaaccctggcagaataaagctggcaccagcaagtcccggctaccgacgtaccatcaattattcgctgtttacgcgatgtgagcctggtgtaaaaagacatgaaggttgtcaaaggaattgcaccatgggaagtctgtcccacggccggctaaccaaaatcccgcaagccgaatcaaaggcggtctgcctggcccaagccttcgcatttgattggctaggacgtatgcacgccaagaaattcaatgaaaattggtgcgccttgctgggaagcggaagcgagattgaggattcattgaagaattggtggacgaaagtgctccaaaacaatgagaaaacgataccacagaagcaactcgagtgtgtgctgacggcatgggacaattcgtgccaagtttttggacaagagtggaaaggaaaaatctatggaccagttggtctagaggatgtgccaatgaaaacgaatgtgataagtgcagaggagcaatttgagaattggctcaggaatctcacggagagattcggccagaccttgaccaaactgagagccaaggagtactggaaggactgtcatctccaaagcaagagggtattggttgtgagtaaccaagaagccgctgagctggtggccaaggaatttgtggaagaaggctcgagctggttcgtccattttggtgacaaaccgttgcgtgaaaagatgttcccggccaattggaatatcaaaattattttcaacagggatgataatgctgatcatgttattgatcacactgttgcaaccaacggtgatcaacggacaagtcattcggccggaacgaaacgatag

SEQ ID NO: 52354 - DNA, 350 bp, Heterodera glycines
  Genomic contig location: Contig_ID=SeqID_21757; Location=1446..1795; Strand=+
  SCN-specific regions: Sequence locations=1-350
tagagaccggaaatttcaaatttgcggatcctgttgcaggattggaattcaaaattttttacaggacaggatccggcaggattaatcctgcaaatcctgcaatcctgcaaatcctgcatttaaaatctgcaggatcctgcgcaggattgcggattttaggaaatttcaaaaaattctgtattaataaaaaatctttcaaagtataaaaaagtattcaaatatatttttaaaccaaaaaatgatgaagatgaaaaattaataacgtttttttgcttacactccaagcaatcgactgaatcttctttaatgcgtttaaaaagaccgatttgccaaattgggtggctcataat

SEQ ID NO: 52355 - DNA, 878 bp, Heterodera glycines
  Genomic contig location: Contig_ID=SeqID_21758; Location=990..1867; Strand=+
  SCN-specific regions: Sequence locations=1-104,145-417,439-458,489 -508,530-855,877-878
atggccataaaatatggacaacaaatcgcgaaatatggacataaaatagcaaaaatctcaaaatatggacataaatttttccaaattgatggtataatttgtcaatatttcttcaaatttgttaaatatatatgtagtaaaatcttcaaaatggttaaatatggtattaaaatcattttagatgaaaaaaacatgataaagctaaaaattaatcatttttagcgaaaaatcaacccaaaaagcgaaatttagttttttctgcttatttttgagaccaaaaataacaatttttaagaaaatttaaatttttccaatattctctggaaaaattttgtaaaactgattttttgaaaaattttccgttttttgaggtcaaaaaggcaaatttatctgttgggggccgttctgttagaggttttttggaaaaatgccaaaatatgggcataaaatatggacataaatgccaaaatatggaaaaatatggaaatatggacataaattgccaaatatggagaaatatggaaaatatggatatagaaatacgtcctagaggcttcaaactaagctaaaaacatgtttttcgtgcgtttcaggcctcccatagtccaggaaaaaaatatggatttccatataattacaggccctacttattatgataaggttgagaaaatttaactacccctttacaccaatggccataatgaattaatgtttagtgaaataacattaaacttggccagtttgtcaaattcaatatgttctttaagattaagcaaaaagagaaatttttaaaccaaaatcgtgagatttcagggcagacccttatggctaaatttcaggtgtccttggccaaacttaaattcacggaaaatttcaaa

SEQ ID NO: 52356 - DNA, 1599 bp, Heterodera glycines
  Genomic contig location: Contig_ID=SeqID_21760; Location=503..2101; Strand=-
  SCN-specific regions: Sequence locations=1-283,305-408,430-704,786 -802,828-861,925-1088,1139-1220,1268-1358,1380-1396,1495-1560,1589 -1599
atggattatttccccacagaagtggtggatttatgttattttgagggggagactgaaattccccaacaaataaaccgtccattacgacaggacgatacggatcctggaggggaccggaacctccgggaattctcagagccaccagtggctcgaggacagactcagttaaccactgaccagaattggaccgaacaacgggaaacaccaaatagtcaaaactcggattttggtctgagtcaaaacgaaggatcgggaagcctgagcagcattccgactatttacattattttttcaatatttctcgtgcaaaatgtaatggcaattgcggacagtttggaatgtccgtttactcattcaaaaaaggagaagggagaaatcacttcccgcgtattcaataaaattactaagtcgtcctcttcctccactgagggagaattgtccgacgcatcattttcgcaaatgacaagattctcctttgtcaaaggggagtcaaaggaaatccgctggatctggtggacgcggtacgggcggtaagcaatagcacccggagaaaggggaaggatcttcggattctgatagactccgaagcgaaggaggtggcacaaaagccgcctacctgctccgactgcgggagggaaggccaccgaaggggcgataaaaagtgcccctatccgaaggaggatcgggcggaatcccgatccgtcaaaattttagatttaattaaaatttatttacgatttatttgagcttttacttaattattaataatataataattatataaacgatacaaatattttgcagaatttttcattgtttttgataaacttacaatattttttttctttgatttttgtcgtgaaaattttttttatttattaataattatattagtatatttttctattttagtttaataatttacttaaagagttgttcgcggaaaatttggtagagtatcggaatatatgacaatttaaacacaatatatttacataatgaaaacaacggatttataaagtgagtataccgggtaaataacgaaaagtcagatctatacatactcggataattttcactgattattgttttattttttattgacaaattaatttaaattttacattgtatatttatactaatcttctattgagaccttagcttaaatttttagatatcatagctattatatttctttgttgctacttcaggaagtggagaaaaatattattagaattattttaaatattaaaaattatttttatttgttcttttcatagaatatgcgtgtttgatttaggttgcctgtttttttgcaatcacgaatttttggatttatttatttgtaaattgctctctaaaaactgaattaaaacaatgctgaattatacataccttaaaaatatttcaatatttttaaagataattttatccattaaacattttttatttttttaattcaaattagcaatttaataattagaaattatttttcttcacttttcagcgaccttgaaaacccctaaaaacatgttttccttgtaatttgtgaatctcggttttttgttcgaattcgggttcggaatttcggaaaataaa

SEQ ID NO: 52357 - DNA, 1743 bp, Heterodera glycines
  Genomic contig location: Contig_ID=SeqID_21763; Location=8..1750; Strand=-
  SCN-specific regions: Sequence locations=1-14,37-123,145-361,407 -691,713-751,773-900,923-976,998-1048,1070-1147,1171-1290,1329-1743
  Gene Ontology: Biological process=regulation of protein activity, epigenetic
atgaggactttccaaggagagcaacaacagcagcagaaacagaagttggagcagggcaacagcaggactttccaaggagagcaacaacaaaaactggagcaagacagcatgaggactttccaaggagagcaacaacaaaaaatggagcaggacagcatgaggactttccaaggagagcaacaacaccagcagaaggagcaacacgaaatccaacagtttgagcagcaggaaaacaagcaacaggagcccagccttgcgctggagcgtgctcgtcttgaagagctgcgcattaaggagcgtgcacgtgttgccaaactcgaggcggagagacaagcgcgtttagtcgaaatccaggtaagggaatttttaaatttggaaaatttaaaagggaattaaaaagaatttttactccgtaaagcctggatgctgatcgctgatcactgatcagattaactgtcctatccaaaacaaaaaattcacaggcacgcgagcgccaggcaaagttagaagcggagatgcgagtgcgcaacgtggagaaccgtgtccgccaagccaaactggaggcagaagcgcgtgccaaccaagcaatcctggaggccaaggtgcgccaggccgagcgtcgcgcacgtcttggccacggcggcggattcgcagatgcatcagaggagttgcagaaagacgagcaacaagcacagcaacgtcagcagcaacaactgcttgaacagccggtagacgtcgtgtgaagaattgtaaattttaacaaaatttttaacactcaacatcatcagcagatcaacactccgcaacaactgcgtgaaaatgtcgcgcagcccattgttgccgcccctgttatcgccgtcgctggtgttcactaaagaacggagcggagacaatgaatgaagaaggatcaaatgagcaaaattattgggtggtacatattttgtggttgatcaatgatcatttctgaatatgcctcagggaaaatcacattttgtcatttattaacggctcagggattaatttaatgcatttgttttttttgaaatttttcattcataaaaatttcaacggcagacaataccaattaaaattgatgacataataactcgaaaaattggtagcttaatagtcataaaaatcgatacactaaaaataataatattattattaccgaacatcattgaattggtatctgtttttcgcaaaaattacaatttttgactattttggggtggaattttcttaaaatattgaaaatggggtccggcggtgccgacaaacgccaccaggaaaaatttgtaaaaattattaaatttttaaaaaatttagcaattatttcttgaaaaattaatcacgtaaagaattttatcataagaacaataatgagaaaatttgtttataatattccttattgcacgtatgcagaaaatgtacagtatccaatgcctaatcaacgcccagaactactgtaattgttcattcattttgccaaatgtttgcccaatcatgtcttttttgagcacaatggtgaaaccgatgccaagcttgtcgtccgcttctcgccaatccgccactgtccagttataatgtcggcacagctcccagcacatcttccgttacccacaccgagtggtgctcatgtgcagtgtcattgcccgcattggggtgctggtgccgttcaagcagttcggccaatgttgtcctgttcggatggggtcgaaagtcttcgatagagaaaataaa

SEQ ID NO: 52358 - DNA, 324 bp, Heterodera glycines
  Genomic contig location: Contig_ID=SeqID_428; Location=214..537; Strand=+
  SCN-specific regions: Sequence locations=1-193,251-275,307-324
atgcctgacgcggagcagcgagtgcccgtcccctgcacccgcttcgtgcgtacgaagcgtgccgaggtgttcacgcgccgcggcaccaagctgtaccagcccgtgtacaccaaagggctggtcgttgcgcttgacgagagggaggctggcggcggcgccggaaatgcctacttcaccagaccgtttggctggtacgacgacgacgacgacgctgaccgtgacgatgctgaggaggaggaagccgaagatggggaactcttggacgaaagcgacactgatgatgatgatgatgatgatgatgttgattttttggtacttggatga

SEQ ID NO: 52359 - DNA, 1236 bp, Heterodera glycines
  Genomic contig location: Contig_ID=SeqID_428; Location=1405..2640; Strand=-
  SCN-specific regions: Sequence locations=1-254,282-1236
atggattcattcggaaatgtcgcctggattctgcgaccaacggctcagacgacaggcactgctgtgggctcaatggagtacgaagaggaggaaaacgggacagcaaagttggtccacagtgacacagctactgtcaccacacctaccaccgccgagtttagactggaaaaagaagccccctcctccgagaaggacggtgctgaagagggcagcggcggccacggcgcactgctgttcatcgaatccgatgatggggaggaggaggaggaggaggatgaggacattgaagacacccccgtcgccacagactccccctcggccgcgacggcaaccgttgtggatgactcctccgacactgttaaaggggtggagcagcgctccagtgagcacagcgacatgacgaacggtacgggcggtggcggtggaagcgaaggcgcaaaactgctcggcgggggagaggaagaggaggtaggtggaggccagctaattttctaccccccccccccccaccactgtttgtagcctgttcgaatgccgctgctcaactacctgtgcgcgttcaacgactgttcaatgaaggagcttcaactcctcttccacagtgtccacgcgcgacagcgtatggtgtcgcacctgcaacaacactgccgacttcataccgcgtatctgaaaccggcggagcgtaacattgcgctccactgtcacgacctcagcgtgcaaaacgcgaaccggacgttcgcctgcggtggctatctggagcttaccgtaagtcggtgagtgtgtagaagcagtcatggtgcggccttctgtccaggttcgacaatacttcttcgccaaacacgggctaaagctgaagcacccgtacatgccgtgcatgatcgagttcgggggcggcacgcacgcctcctactacccgtaagcgggggggggggggtacgcaaaaatgggggaagtgagcgttaacgccttcagcctggagctcgtccatgtcgtgctggagcgtacgaagcgcgctaaacaggaggagacggtgaagcaagaagagccataccgtcgtgaatccggcgacatggctccgacaaagtcgatggcaatgccggaacgacattgttgccgctgttgctgtcgatgcgctaacaactagctttttgagagacatggtcattgtagatttgcgcgcgtgatcacgtgacttattgtgctgttatagtgtttgtgcactttttttaaaataaa

SEQ ID NO: 52360 - DNA, 1240 bp, Heterodera glycines
  Genomic contig location: Contig_ID=SeqID_428; Location=2771..4010; Strand=+
  SCN-specific regions: Sequence locations=1-942,976-1100,1124-1240
atgttcaagcacccgttcaccatgtgcgtcgccggatgcaccggtagcgggaaatcgcagtgggtggaccgccttctttctcacattgacctgatggtcagtgaaggccctatcactggcgtgctctactgttatggggaagtgaacgacaatgtgctccggctacaacgtatggagaacaccgccaccacttcaagtgacagcaacaccacggagggaaaacattcgatcagaatgtgccatggagcgcccgaggagagggatgtggagcgggaagcacgcgctacgggcggacggctcctgttggtgttggacgacctgatgtccggcggtctacgctgcagctttctggacacggtgttcacccgtggctcccacaactggggcgtcagcgtggtgctcatcacgcagcatctgttcactcgtgagcttcggatagcgcgcaacaactgtcactatatggttttgatgcggaacccggccggcgcacttcagatccgcaacctcggcgcacaactgtttccgggcggggcgctacgctacttcttggaagcgtacgaggacgcaacggccgaaccgtttggctacctgttggtcgacatgcacccaaccacggagcaacagttgcgcctgaaaacgcatatatacccgggggaaatgtgcgtggtgtacatgccacgagcgcgcgcgaattttaatgcaaacgcttagcgcaattagcaaacagcagtcgacaccgaaaaaaattgaaaggggcggagccaacaacaacaacacattgaagaagaggacagaagggtctggcgaggaaagacgacccagcagccgcaagctcgccccgtctcgccccccagtgctgagcgaacacgtgaggcgccacattgatttcttccgacaactaaaggcagcacgcagctctcctacccgctgccaagcgctggtcgccggagccagcagcgagcagcttctctgccttgtggagagcgcactgaacatcttacgagcacgtgtgcccatccaacggcgtcatctggaccgcctcaggcagcgtgcgagcgacgtccgcacactgagcagggtgcgtagcacacgctccgcccgtcgccttctgctcaacgcccacgcaccgtcaacagcgcaaactggtcgtggcataccgcctctggtcgggttgctcgccagcgtgctggtgcccgtgctcgtccaacgcgtattcgagacaaccagcagtagtagctga

SEQ ID NO: 52361 - DNA, 2297 bp, Heterodera glycines
  Genomic contig location: Contig_ID=SeqID_429; Location=493..2789; Strand=+
  SCN-specific regions: Sequence locations=1-700,722-842,864-1827,1849 -2089,2117-2297
atgacgttgaagcacactgtacgcatgctactcatccccgaggatgtttatcgacgtctgatggacaaccccagtgcagcggcggcgacgtcttctaccacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagatgaggcggaacgaccgctcaacgtacagctatcgcaacggacaacaaacgcactgcgtgacactgtgctgcagaaggcttcgccggcaacagcgacgccgccgccagctcgcccccaacggaccacacctctgtccagacgacggggcttacagcatcaaaaccaagcgccgagcgcgtcttcctcttcttcgacaaggccagcaaaaagtagcagcagtaacgagcaacaacaaccgctcccccagcagactgctgctccacaaaaaattggcgatctgcctaagcaagctgagccgcgtatacatgccgcgatggcgtacgcgcaacagaacccaggcttgcttggcgtcggcggtgaagacggtcagcaaattttgcaccttgcccagggcgcttatcgccccatccggggcagcaaccttgacacgctgctccgctaccactttgtgggtcgtcatcagcagcagcagccgcggtcctccactaccacccccaccgccagtgtcgctaaggcaccaccgggctacaaaaccttcgtcaacaatgcgcgtgacgatcttcaaatgtggcgtctgctgtttccggatgaaagggcggcggcggcgggcagtgattcagcgtcaacagtgggcggacaacctcggcgccaccaacctctgcgcggacagaagaaaactggcgcgggccgcttttccctgagccgcctactacagcctaatcatcatcatgcacataaatctgttcaaaaaagtgcgacgagcaagaggaagcccaacactgtggagcattccactgccaaacgttttaagcctcaattatggtgattggaagcaacgccgtccgctcactgacggtggaaagtcttttggacccgatttacaaggacgaacggtcgccagcatgcttcaccagcgtagagcccctgctgcgggaggcgaagcgccggcacccggacgcccgtcttacgcgcgctgagatcagccgctacttggcgagccaacgtgtctacactcttcaccgacaagtgcgacgacgcttccgccgtctgccgactctggcctccggtctacacaccgactggcaggccgacctggccgatttccaacgtctccgcgcgcaaaaccgtgggtacgcctacctgttggtgtgcatagacacgctgagcaggcaagtgtatgtgaagccggtcaagagcaagcgctcggacgacatgatcgcagcgctcaagcgcacctttgcccgctgtggctacacgccgtggcgtctgttgacggacaagggccgtgagttcaccgcctccgctgtccaacgctacttgcgcgacgaggcggaggtgcgtcaccactgcatggaaacatcgccactgtggcacgctgggatggcggagcgtgcaaaccgcagcatcaaagagcgcctgtaccgttacttcacgcaccgtggcacccaatgctggacgcgggtgatccaacgcattgtcagctccctgaacgcgtcgccgaacagcagcatctttggcatgcgccctaatgaagtgtgcttcgacaatgcggagtcgctgcgccagcggatcgccgaccgtgcggaggcggagcgcggtggacgtgcctctcaacatgcgcggttccgccccggtgaccatgtgcgtattgagcgtgcgaggggcgcctttcgcaaaggctacctgcctcggttcactgacgaggtgttcaccgtggatcgggtgtgcacaggcagacgacccatcacctacaagctacgggacatggacggtgaacccatcaccggcttgttctacgccaacgacatgtgtctggtactggttccaccctcgctggacgacagcagcatcagaagcagaggcagcattgataagcgtaaaacgcggaagcgtctacctggtggcatcgacaacaacaacaaggtgtacgccattgaacgcattctggagcgacggtaccggaaggacggcaccgagtgctgcctcgtcaagtggaagggctacagcacgcgtcacaacagctggattccggcccacacaatcatataa

SEQ ID NO: 52362 - DNA, 533 bp, Heterodera glycines
  Genomic contig location: Contig_ID=SeqID_3902; Location=252..784; Strand=-
  SCN-specific regions: Sequence locations=1-134,165-237,259-289,321 -389,411-533
  Gene Ontology: Mol. function=GABA:sodium symporter activity; Cellular component=integral to membrane; Biological process=transport
atggtcgtgtgtgttatcaatggaatgacttcaattttggccggttttgccatcttttccgttcttggccatttgtccgagtctgcaaaaaaaccaatcgctgaaattgtgaagcccggttggctttacttggcatttattattattattgtttttaattttaaggtgttggacttgcctttttggcatatcctgaggttgccagtaacttgccgttcaagcagatttgggcatttctgttttttctgatgatcacaattctcgggctggacagccaggcatttaaaaatcatttttgcaatttatttttcagaaatttacaggtttgcatggtggaaggacttttcactgctcttgaggacacttttccaacacttttactaaaacacaaaaaagtaaaagtatttaaagtatttttttatgttttcattaagctttctcttcttgttgcttgcataatcttcttcattattggcattccgatggtcacttatgccggggcacattggcttacgctggtgaattataattaa

SEQ ID NO: 52363 - DNA, 4983 bp, Heterodera glycines
  misc_feature (1555)..(1555): n is a, c, g, or t
  Genomic contig location: Contig_ID=SeqID_3903; Location=1..4983; Strand=-
  SCN-specific regions: Sequence locations=1-128,158-158,180-236,268 -796,819-1269,1294-1392,1414-1609,1654-1900,1923-1970,1992-2048,2082 -2224,2248-2293,2315-2788,2810-3011,3033-3215,3238-3246,3285 -3417,3457-3627,3667-3692,...
  SCN-specific regions: Sequence locations=...3714-3751,3779-4077,4114 -4197,4220-4313,4335-4628,4667-4787,4809-4836,4860-4983
  Gene Ontology: Mol. function=GABA:sodium symporter activity; Cellular component=integral to membrane; Biological process=transport
tagtgaagaaatagtggcaaaaagtcaaaaatagtgacataattttcagccaaaaaataagccaaaataatttttattcaatgagtaggactgggatttttaagaccaaaaaagccaaaatagttacctaaaaaaatttttaaaattaaaaatttttgccaagaaagtaaatttttgagaacattttttttcatttcataggagtatattttgaaaaattttaggtcgattcttaggggtgtattttttggttttattgcatttttgttagtaattttccaaaaaatgtcgaaatagtgacaaaacgccaaaatagtgatttttaactattttagtgacaaaacgccaaaatagtgatttctagtgacgaaaagtgacgtccaaatgaaaaaagtttaacgcagaaatgcgttttttgagctcctttcttcaaaacaattgagcaaaaaaaaaagttttttcactaaaagttgctgccctactgatcatatatggttgcctcactcaaaaaagtgcagcatttgatcaagttcatcaaaatttcgaaaaatctaagattttcaaaatcatgataaaatcaatgatttttgcagctctgatatcatattcgtgatcggaagccccgtaaaccccagggttggacttttcctagcagaaaaataatttttttgggtggagcccagattctccagtattaccattttttgaaagcttaaatttgagaatgttttctaatcgaatgcttataaatttaaagcttgttcttcttttgtttatgtaatactcttttggtttgcaaaatttgtttatcttaaaaacagttaaaatttgctaatagaggttttcaggattatgatcaggattctgacatcaatttcaaccaattctaaatccttcccaaatattaaagttgtgggcacccgaaaagccaaataggataggtcgaaccctagttaggtgaattttaggtctccagatcactatgaaggagtgatctgatcgagttggtgtaatttacatggatccttctcctttttaaaatttgaattttctgctcgatgttttgttattttttgtttttgacttggcgacaaaacgtcggcgccaaaacgaacagactcacttttctcaattacatttcttttctctctaaccaccggcggagtgtataaatagtgaccgtgcccttcacattttgctctcccttcattcattcctacaatttgttcattcgtgatttgcttctctctctttcattcatttctcctcagatttattatttatttatttgtcgatagatatttgtgttcattattcctttggacacaacatgcatggcgccgaatcagttgaccgaggccaatggacgggtaaactctgataatttgaactttacattttaaattaaaattatgtaaatactaaatcattgacccctattaactgaatggataattgtcactaaaaactggaaaattaaagcaacaataagcattacaaattaaggtgaaaatatttttggatgggtaatttgttcttttaccttaaattttanaaaggttgcgtgccttgttttagactatttggaattttgactggaaaagaaagcataaaaaataaatttaaaaaatgcaatttaaatgtattaattttcttacacaccgattttattaacctacacagaagttttggctctactgagtttacgcgtctaatcagtgaccatccttattttcttagtccacaacttttttctaacttacaattagtcaaatcttacattcttggtatcaaacaaaagcttgaaatttcgggaatctataacaagaaaagagaaaataaagacattaagaaagaattacaatgagaatatccgaaattcagtttttttcaacaatattttggaaaattttttgtttatagtcttgagcacaataattagttataaaaaacataggctttaagctttcaattgataccaagtaagaaataagttatggcctatgtggtcattgatttgacgcgtaaactgcagtagagccgaagttttattcatttaaaatatttgtggcttctgctggaccattagttacacacagcgtccgggaaatgagctcctgtgccagaaaagatttgcatgcgtggctcagtggtttttataagatagtaaagggacaacgggtggtggttcgagtccgttgtgcaacatgaatattttcatttatttttgtccaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctttaaaattttgtttttcttataacttttgaaatagagcattaacaaaaataaattcagcattaatcgatgcagaatttttttctctaacgatatgcaaaatttcctgttgatctaacatatagaaaagaagctaacatagcgaagtaaatgttgtttttcctaataataaaaatattagatagtacgccaaaaggagacaaaaaattagagaaaaaaagataatgtttttctctggcactctctatttattggtacacatctcgttttttcggacggtgtgtacagacaacttgacatttctttggacagacaacccagctgttgaaaagttaatatttaaaaatcaaaatgaacaaggaaaatacactacattttagaaaaattttcaatgaaaacctaaatttttattagaagataaatttaatctgtttaattttcatcattttttataggacggtttgattttctgatgagtatgattgcgtacgctgttggcctcggttaattaattaattgattttgattttttttcggtaaaaaatattatgttaaggaaatgtttggcgctttccgtacctttgttacaaaaatggcggaggttaattaatggatttaattcgaaaaatattttaatcaacttttaaattgctcataggttcctttctcgttgtttatgcgcttttcttcacttttggcgctgtaccaattttcatcatggaagttacgatcggtcagtacctacagaaaggtaggttacagtatgcctttaaagcattttttgttaaattattttcaggagcaatggaaatgtggaaaatgtgtccaattttcaaaggtaaataaatttttgcattgaattttaaaataaaatttataattttttttaaataatacttttttgcctttccaggtgttggcattggtaatgtggtcatttcgttcatgtgcattgcctatttttgtgtgattgtttcttgggccgttttttacatgatcagctccttcaattcaccatttccatgttcgttttaattttttttaaataataaataaataattatttttgcgtgttttaaaggggaaacgtgcaacaattggtggaacaatggccaatgtgtgtcggggaaagaaaatgagacggacatacagcaactttcgtcaaatttgtccgtgtacggactgaccattgagtcatccgttgaacaattttgggagtaagcggttaaaggaaaaagcaaaaatataaataaataaataaaagtagtttttaaataacagacttattttttattggcattcaaaaaaggcttttggattttaaatcaccaaaaattaattagagcattctggaggaaagcacaaaaaagtttcattttaaaaattatttggagaaacatttagactttctttggaatttctctaaaaagtgtcaattttctccaataaatcccaataattgtttttttcaggcgtcgtgtgctaaagcaaactgcgtcaattgacgacattggcggcatccaatgggaattgctcggactgatgtttttggcatgggttgtcgtatatttcgctttgtggaagggcatcacccaggcgagaaaggtgccgtttcatttcacatgccattgatttgtgaccgaatacaaaaaatgcggcaaaggtgcagaattgtggtcccgatgggaaaaattactaaaattttaaaaagccttttttctggggtagaaaaatacgctgatcacgaatctgaactcagattttgaaaatcattgattttgtctatgactttttatcaagtgctagattttttccaaaaattttaagaaaattaatgggcgtaaaaaactcatacacagatgttgtagagcttaaaaagcgctttccaatgagctattgaatctattgaaaagtcaagtatttaattttctatgattttttgaaatttaattattaatccctatgggtcttatgagacgaggactgcggttcgagtccgcttggctgcgatttattatttttatgattgctgttgaaaaatcacggagaaaacgaagattcttgcaaaatcaaagcccatattcgtgattagcatatttttttatcccaaattcattgaaaagaaaatttttacagaagattaaaaattaaaaaaaaatcaagtacttgataaaaagtcatagacaaaatcaatgattttcaaaatctgagttcagattcgtgatcagcgtatttttctaccccagaaaaaaggctttttaaaattttagcattttccccatcgggaccacaattctgcacctttgccaaaaatgccaaaaagtttttgtttgaattattttagtaaattttttgatagtcacggggactgaattgggcacaaaataaaatgcaaatttctttttattaaaataaaatctcttgttttttcactttaaagtttgtatacttctgtgctctgttcccatattttctgatccttgttttgctcatccgtggcttaactttggagggtgcagggaaaggcattatattttatctgaaaccaaatatcacaaaagtgaccgacacgacaggtccatattaataattaat

SEQ ID NO: 52364 - DNA, 1898 bp, Heterodera glycines
  Genomic contig location: Contig_ID=SeqID_3903; Location=3770..5667; Strand=+
  SCN-specific regions: Sequence locations=1-396,419-947,979-1035,1057 -1057,1087-1233,1256-1327,1369-1374,1397-1511,1533-1644,1666-1898
atgaatgaagggagagcaaaatgtgaagggcacggtcactatttatacactccgccggtggttagagagaaaagaaatgtaattgagaaaagtgagtctgttcgttttggcgccgacgttttgtcgccaagtcaaaaacaaaaaataacaaaacatcgagcagaaaattcaaattttaaaaaggagaaggatccatgtaaattacaccaactcgatcagatcactccttcatagtgatctggagacctaaaattcacctaactagggttcgacctatcctatttggcttttcgggtgcccacaactttaatatttgggaaggatttagaattggttgaaattgatgtcagaatcctgatcataatcctgaaaacctctattagcaaattttaactgtttttaagataaacaaattttgcaaaccaaaagagtattacataaacaaaagaagaacaagctttaaatttataagcattcgattagaaaacattctcaaatttaagctttcaaaaaatggtaatactggagaatctgggctccacccaaaaaaattatttttctgctaggaaaagtccaaccctggggtttacggggcttccgatcacgaatatgatatcagagctgcaaaaatcattgattttatcatgattttgaaaatcttagatttttcgaaattttgatgaacttgatcaaatgctgcacttttttgagtgaggcaaccatatatgatcagtagggcagcaacttttagtgaaaaaacttttttttttgctcaattgttttgaagaaaggagctcaaaaaacgcatttctgcgttaaacttttttcatttggacgtcacttttcgtcactagaaatcactattttggcgttttgtcactaaaatagttaaaaatcactattttggcgttttgtcactatttcgacattttttggaaaattactaacaaaaatgcaataaaaccaaaaaatacacccctaagaatcgacctaaaatttttcaaaatatactcctatgaaatgaaaaaaaatgttctcaaaaatttactttcttggcaaaaatttttaattttaaaaatttttttaggtaactattttggcttttttggtcttaaaaatcccagtcctactcattgaataaaaattattttggcttattttttggctgaaaattatgtcactatttttgactttttgccactatttcttcactattttgggatttttactcactattttagttaactatttcgggatttttcgtcactaaaagttgctgccctaatgatcagcactatttattaaccaatgagatggtcatagaacaattgcataaaaacataaacaatcaatatttaaatttcaaagatctattatttttaaaatcaatgttaaagtcaattatttttgcaaattatgatatcatattcgtgatcagaagcactaaaaacgccgggttcatttcttcacaaaaaaaaaattttggtggagccagattcctcccagtatttacccccaaaatataaaaattatatttcgataagtattacaacggacactcttcacattaacattatcactcattggcagtttaaattttctttattttataacaaattggtgaggaaattgaagagggttttatggaattgatttggatgtgataaatggcacaaatgttttccttcgggaatttcaaccaatcgactgttgggcaaattcttgagtttgttcgcagaatttatgcctaaacggaagaactactaatagtttatcatcaaaaacttggataaccaattgatgtgtcgaaagcgcctcggatgatcagacagggactaaatttggtttctgttcaaaattttttttggtacttttacagttctgtggctatgtataca

SEQ ID NO: 52365 - DNA, 140 bp, Heterodera glycines
  Genomic contig location: Contig_ID=SeqID_3904; Location=158..297; Strand=-
  SCN-specific regions: Sequence locations=1-140
atgtccggcatttacctcattccgttcctttctcgtggaattaagaaaaaggacattcatttccacgttaaagcattcattgcaattggcgtgtcggacactcaccgactaaaagtggaagaattggtcaataacccaat

SEQ ID NO: 52366 - DNA, 1389 bp, Heterodera glycines
  misc_feature (1343)..(1343): n is a, c, g, or t
  Genomic contig location: Contig_ID=SeqID_3905; Location=1..1389; Strand=-
  SCN-specific regions: Sequence locations=1-217,244-612,636-905,928 -957,980-987,1009-1166,1188-1389
atttttccttttttcaggtcaaacatctcgagccatgggagcgtggcacacgccgaacgacggggatgacgggaatgtgtggcgggtgagcggaagcaataggttacattcaatgggccccttttggccctatcctttaaagagatgttcattgtctgattttacatcagaattcaagcaaaaccaggcaacaaaattattatttagtttctatagcaaaatacatttttgaaaagatttattaactgtattcattaatccattatttagaagggatagtttctaaatttcatgagtaattttaaccatttattccgaactgaatcattatggacggttcgtgtgacatttagataataattcactaatgccaactccattatgccctcccccaaaatttagggtccgtggtgtcggagcgggaggcgtaatctctacagcgttttgtctgctgtacaaactcttcactttacgagtcactcggaaacaattggtggccatgataaacagtcgtcagtcgatttacttgcgaggaattggctttatgtacatccgatacacgcaaaaacctgccgatctttgggcttggatggaaccttatttggtctgctattagcatttgtttgtttaaatgtgcactttttgcaggacgacgacgcagagattgacccacgttcgggaggaggtgacacaatgcaaatgggacagcttgtcaggatgatgctcaccaaggtcaacaggaaaagtttcgaaggcaaatgcacagaaattctcaaaataaataaaatttagagcgttttattcttcaaaattcctactaagttttagaccaattggtgccggggagcaactcgtcctctcacatttttaccatggacagaaaatttagttttcgaaattaaaacagatttgtttattatattttttatcagcaaaaatagggaaaattgagctccacttttaaattttaaaggatattgcgttaacattgttgttttttagtatgttttaaaaataataatgtcttcgaattgtttggcgaaaaaatcaatgaatggcgactaattattcctaaaatataacttacttttttttatcaaaacgtatgtttttagctggatttctatggcacgctttttcctcgaattcctgtgccaatccaaaaggacattgaaagcaaatttggcgaacgtgcaaaattgtatggctatgaggacgaacgatacggtggagggacgagacgaaggtcgcggagtcgcgaaagaaggcggtcgaggagcaaagagaaggaaagggagcagcgacggtcgcgcagcagagaaaagaggggaaagagtcgaagncgagacagaaacagacgaagccgagaccggaacaggtgggcgaacg

SEQ ID NO: 52367 - DNA, 699 bp, Heterodera glycines
  Genomic contig location: Contig_ID=SeqID_21764; Location=846..1544; Strand=+
  SCN-specific regions: Sequence locations=1-3,25-502,524-699
atgaaatttgcaaagaaaatgttaataattcccgaggccgaatatttggctctgcggagtgcgatgaatagtggtgattatctccaaaatgaaaaagcgagtttagacgcaaaaatttctcagaatttacaagatcctggcataagcgaggacctcaaggcgaagagacacgattggctctataaagaaagacgtacggtaaaggggatacttgaaaatagaccacagaaggtagtgattgagaatcatgtacctggtccgaacgttgcaccatatctgggcctcaataaccaatccaaaccacaggagaccgatgaaccccggaaaataattattcctaggaaaagacttaaagagcaaactcctgatcttgaatcagataatgatacacttgaggagttaagtccggaaccccaaacaacatccacattaaaaacacccattccgatcaaaactattatacacccgacccttttaaacggtctttttaggtatgtaaaagaaaacaaagatttatttaaaattacggcggctggaaaggtacagtcgaacatgaatttgccgattgaaaacagtaattatagagatgttttgttgtatctcgcggggaagaaagatgaaacaccccggggtgcaaaatttcttaaagatcggttactgaaggatccaacagtaaaagacatggttgataaatcaaag

SEQ ID NO: 52368 - DNA, 841 bp, Heterodera glycines
  Genomic contig location: Contig_ID=SeqID_21765; Location=1360..2200; Strand=+
  SCN-specific regions: Sequence locations=1-10,32-189,212-300,327 -452,474-484,507-841
atggatccgtccgccgtttcttcttcgtccagcaccgatcagcaacaaaatgcggaagaggcgcaaaagggcgatttgacattggcacagcaaattgcggaggacaaacagaaaatgtttgaacgctcccagcagtaccaacaggaaattgaggacgaagtaaaaaattgggaggagaaaaacgaattgggaagcttttatgggttttttctggacagaaagaaacttagtcagcaaatttaaatcactttccttttcctttcagattcgcaagactcagccgttggtttcgtccaagcaaaacgtcagttttatccttaaaatttcactcgtttgtttaggggtgtattttatacgaatatttcgatttcaccactaaatggcaatgtttgttgtcctttcattttctttgctttttctccctccgccctttcccgtggcttctccaattaactgttttcattaatattcagattgtccatttggttggcgaatttgatgagaagacgagctctcagtacttcaaaaaggcgacggtatcacaaaaaagccaacatttttcttattattctctgttttcttttaggagcttgccggcgtttactcggacattcggcgaatccgtggcgatggcaattgcttttaccgcgctgtactcaccgcccaactcgagcgctgttttgaggacgccgaggagctgaaaaggttggaaatggcagacaacagcagcagaacatcactggttctgttcaaaaagcacttattctgatagaaaatcttaggcattgggccggagaatggcgaaaaagccattttttgatagttttttaaaagtaaatga

SEQ ID NO: 52369 - DNA, 505 bp, Heterodera glycines
  Genomic contig location: Contig_ID=SeqID_21765; Location=658..1162; Strand=-
  SCN-specific regions: Sequence locations=1-505
  Gene Ontology: Biological process=establishment of synaptic specificity at neuromuscular junction
atggattttgctgttctcgttgtgagtgattcgtctgacaaggaccacaaaatggacaaaagtggtcctttgttggtcgaacttctgcagaattcgcttttaatcagaagagggcaaaaagtgaccgttgcaaattacacaatagtgccggacgagaaaagcaaaatcgttgaatatctacgtgaatattccaccaaagttgactgcattttgaccagcggtggaacagggtacaataactaattaattaattgaatggactaattggattagttttagccggattaaatttagcaacaattaattaaggttctcaaaaagggatgtgacgcccgaagcgaccaaagaagtcattgagagggaatgcccagggtaaagtgttaaaagcaatgccgggggcaaccaaagtttatgcatgtagaatcgctgtggcacttctgaagaaagggcttgacattacgccattcgctgctctcacccgtctcaccgcgggtggactcaaatt

SEQ ID NO: 52370 - DNA, 61 bp, Heterodera glycines
  Genomic contig location: Contig_ID=SeqID_21765; Location=1..61; Strand=-
  SCN-specific regions: Sequence locations=1-61
ggattatttttcaaaacacctcttagactgggggataattggagactgcgggattaataga

SEQ ID NO: 52371 - DNA, 1437 bp, Heterodera glycines
  Genomic contig location: Contig_ID=SeqID_21766; Location=154..1590; Strand=-
  SCN-specific regions: Sequence locations=1-9,32-183,278-286,559 -1146,1180-1268,1310-1355,1427-1437
atggtttcattgacaataattaatttgaaaaatacattttgtagtaaatttggtgccttttggacccgaaaatggcgaccttgaagtgtcaccagggttcctgacgtccggtcagaccattgaccttcatctgttcttcccattttacgggggcctttacaactacacaacagtaagaataagattattattatataatttatttttgtaattacctaatttcatgtttatttttaagcaaatattaattttattttttgcatttttttatattaatgctctaaacatttaattttgaaatttatttttcaaaagttcaaatatgtttatttataaaaatttcttttaacataatcgtaaatttttattttagttcgtaattcaaataaataattttttctaatttttatattttaagcaaagatattataattttattttctttatttaaataaatatttatttataagaaaaaaatcagtaaaaatttaaattattttagtgtaaaatatattttttaattttttaaaattattaaaatataaagatataaataatgctcagatttctgtgaatggatatttgggctttgccactgtgttggaccaaggcccaaccatcaatgttggcccggacagcacggattggccacgggtacaagacccagcaatgattgctccatatttatgcaaacagcaggtcacaaattagggcaataattaattaagtattgaacctaatgctttaaattagagccattatcagggtaattaggcaccaatcaagaggcttcccttaatgatgagtcaagcaacattaaaacactattgaattttttagaaagcaaaaagtggttcggttgacaaaataaatcaaaaaaccgaaaaacttgaattttctcgatcgttttttgtcgattaaaatttgaataaaaccaaaaaatcgagtgctggtatctaaattgtatccttttttggcccccgttcagatcactcaggacgcaattcctggccttcgtgccggcgttttctttcgtctgatgatgcgccaaagtttgtttggccgtggtgttggcacaaatttgaacgcggatggcacaattatgcaatccgctttctttggacaaccggcaaatcaggcaaaaccatttaatttttgttattttttaaaaaaattttacaggcttgtccaagcacagcaggctcttatgtacgatgtgatgcgaacagtgactattttttggacgaaatgatgcgatggcttcagggtaattaaatgttttttttatttttgaaatttttttattttagagggtgtcgctggtgcttcggcatttcgtgcagatgccgctatggtatttattttttgtatttttttttattgttttcattgaaaaatttttagaattacttattcaaattatttagggggattaaa

SEQ ID NO: 52372 - DNA, 289 bp, Heterodera glycines
  misc_feature (176)..(176): n is a, c, g, or t
  misc_feature (191)..(192): n is a, c, g, or t
  misc_feature (195)..(196): n is a, c, g, or t
  misc_feature (209)..(210): n is a, c, g, or t
  misc_feature (222)..(222): n is a, c, g, or t
  Genomic contig location: Contig_ID=SeqID_21766; Location=1672..1960; Strand=+
  SCN-specific regions: Sequence locations=1-52,75-289
atgtcaataatatttctatctaatagaaaatacttagagctacgaaagatatcaagtattaaaaatttggttattcttaagaaaaatagaataatttttcgtcaaaaatttcctttttggtgttttttcagtaacgactaggcaccaataatcagccattttcagaataaattcancaaattaactaagannaannttgatatgataanntacagtaaattntttacttttattttagatatttcctgaatatttttttcacagtcaatttttcatttattattgaaaa

SEQ ID NO: 52373 - DNA, 1335 bp, Heterodera glycines
  Genomic contig location: Contig_ID=SeqID_21767; Location=397..1731; Strand=+
  SCN-specific regions: Sequence locations=1-178,217-319,351-1067,1089 -1162,1184-1335
atgaatttggctttgaaccctgaaaatggcgatgaacctgcttacgggcagattttcatcgttgatgctgaacaagcgatgagatcaatgaggcaaggcaatgtcgatgttgaccctcaattgctgataacagtgtatgaagtgatcagaaatatgaatgtttttgctgaagcatatatgatgatgaaagatgaggaagaagaagaagctgagagagcaagaaatgagatgcgagagccgaccgagatcaaacttttgtttgataccggaagacaattggacagacgtttggggtacaatgtacccagagcgaatgaagttgcagctgtttatgttcctggggcagatggtgaagtacctaatgccaagattgtgattagggaacgtggaaaggaattgaagattttgaagagtacagattcaatggtgactccaatgacttacccgttgttttatccgcgtggtacgcttggttggaaccctgaaatgaagcatagaaatagtaacagaagagtaacgaggttgcagtatgtatgctatacattagcaattagagaaagagagtttaacccgattttatacggtggaaagctctttcaacagtattgtgttgacgaatatgttaagattgaaggagatcgaatgaattggataaagtgtaatcagaaaaagattttggctgatgcatataagaatgttgataatatgttaatgagaagagcacaagaaagaggtttgccactgggaaggaaggtcattcttcctccaagtatgacaaatagtccgagatatgttgagaagcattttcaagatgcgatggccgttgttagacggtttggtaaaccagatatgtttttgactatgacatgtaatccgcaatgggaagagatttcagagaatttgtttcatgaacaaaagtcaagtgatagaccagatttggttgtaagagtttttaacttaaaagttaaagctattatgaatgagatagtcaagaaaaaggtttttggcgaagtgattgcatggatgtatccggtagagaaccaaggacggggactaccgcacatccatttgcttttgacattggcggagcaagacaaattgattaatggtgaagatgttgaaaagaagggaattagtgcgagaataccggataaagaacatgaatatggtttgtttgatttggtgaaaaggtttatgatccatggcccatgtggtaatttgaacccaaattgcccatgcatggaagagtttgttgacaagaatggtattaaaggaaggaaatgctctaagggatatcctaaagcatttcaagaagagacagttgttctgaaaatg

SEQ ID NO: 52374 - DNA, 840 bp, Heterodera glycines
  Genomic contig location: Contig_ID=SeqID_21769; Location=528..1367; Strand=+
  SCN-specific regions: Sequence locations=1-134,156-504,529-840
atgttcttcagacgcttcttccgactcgataaatacgcgaatggccgaccattcgttggtttatccatgcaaataacttttcttatttctcttttcgtgcatttagtatttgattggggcaataaatgcaagttttgatgaacaatgatattttcgactttttgttcgaatttggagttcggggttcggaattggcgagaaagggtgtcatattcgtgatcaatagggagtccaattatatggaaatccgtatttttttcctggactgtgggaggcctgaaacatacaaaaaacatgtttttagcttggtttgaagcttctaggaaggatttataaatccatatttttccgtatttcgcgatttatgtcaatatttccatatttgtcctttccaaaaaacctctaataaaacggtctccatcagctaaatttggattttgacccttaaagacagggaaattttccaaaaagtcattttttaacgaaattttgtcgagaatattgattaaatttatttattttttaattggtaagtttatgtcaaaaataagcaaaaaagccaaaatttcgctttttgggttgatttttcgctaaaaaagagtaaattttagttgtatcatgttttttttcttctaaaatggttttaataccacatttagccattttttgtaagttttacaatattttagcaaattttgaaaaatttatttccatattttgcgattttggtccatattttatggccatatttcgcgattttatatccatatttttggactccctaattgatgacatggaaaatgtactcattcatataaatgtatttattccgcaatgata

SEQ ID NO: 52375 - DNA, 118 bp, Heterodera glycines
  Genomic contig location: Contig_ID=SeqID_21770; Location=351..468; Strand=+
  SCN-specific regions: Sequence locations=1-118
ttgcgtgtgacccgggcggagccactcgttttggaagcggagatcgaacttggctctaaacaccttaacgaaggcggcacaatgcatggcggattcgtcgccacactcgtggacatcg

SEQ ID NO: 52376 - DNA, 127 bp, Heterodera glycines
  Genomic contig location: Contig_ID=SeqID_21771; Location=1159..1285; Strand=+
  SCN-specific regions: Sequence locations=1-28,51-127
aaattgtacaaaacttgctagttttttgaaaaaaaaaattaaaaaaatttccgacttttcatcaaaaatttcggaagtcggaattccgaccccaaaaatgtgaaaccggaagtctttccgtgccata

SEQ ID NO: 52377 - DNA, 801 bp, Heterodera glycines
  Genomic contig location: Contig_ID=SeqID_21774; Location=267..1067; Strand=-
  SCN-specific regions: Sequence locations=1-49,71-299,321-699,788-801
atgctaaggcatcatttggtggtgccatcggtgccgactgattgggcacgggacggagaagaagcagaagcggaagagcatttgaaatcctcgccgactgatcaagaagggctgagatgggcaaagcgcggcagttacccctacaaaagtaagggtttggctatcgtgcttttcagtacctatttagccacgaatactgtaggtggcactgatttagcaagtatatatgctttagcactgaaatttctggcaccgtattttttgaattagagcccccccccctcacctgaattagaactgcatcggcaatttctggcatttgcatatgccttggcactaacatttcttggcatttatatatgccttggcactgaaatctcaggcgcttatctggccattaaactttatttggcgttgcgtttattagtataatttgtggttaattttttgcaattttacatatttttcagtttttggcaccaccaaaaagagtggaattgcaacggagtgctgctcgaaaaggtgacacaaatttaaaaagataatttatttatatgtgtgattttattcgctttactcacaaatttaattatttaaaaggtatatatgtatatctaattaggccatggacaagagttcgtgggtgtcacttttttgctcttccgtacaaagaatatgactcaaatttcaattgttttgaatttaataaaaatattttttttaatgaaaagattaaattattatttttttttaaaattttataatgaaaattaataattaattttttcaggtgcacattaa

SEQ ID NO: 52378 - DNA, 1331 bp, Heterodera glycines
  Genomic contig location: Contig_ID=SeqID_3907; Location=1..1331; Strand=+
  SCN-specific regions: Sequence locations=1-469,536-603,626-691,719 -738,812-1331
cgtaattttggccccgtccgtcctcagcccgtgggttctgtccccggccgcgcccgtgccgtacattctgtccccctatgttttcggccctttcattctttcgccgatggcaatggcaccatttatcgtaaaagttaatccaatgttgttttaaatagcaatgttttcagcttactccttatgtgttgtcgccaaatgtgctcaatcctttcgctttgtcccctttaattttgagcccaacggttaccaatattaattaattaattgcgtttgctttctatcgccaattaacccaattaattaactgtctgtcattgttttaaggtgctcagtcccgacattctgtccccacagattttgggcggtggcattttgtcgcccaccgtcggctcaccggcggtgctcacagaatcggctctgatggcctccgttctttcgccaagcgttctgtcgaaaaaataaaaataacatttctattttatatattttttaaattatttttatttttttcattatttttttaatatttctctttgaattggcaaaatatttctttggttttgttattattttcgtttaccaaaatataaaattccgtcgtaaagtttaaaatgagagaaatgcgatgaaaaggagcggggaaatttttcttctgagcaaatcattttctgttttatgtttacgatgtttttgagtaataataataatgaataagaaataacataaatgaatcaaaggaataatatttaaaattataatattgtaacaataattttattttatatttaaatttaaatttgttttaataattgatcaattgagattcagaaaactttttaaatgatcttttacactttaatttatttaatacctaatcattttttgtctctttgagtgaaacaaagagataaatgaaattcgcgagaaaagaaacgcgacagattcggtaagagagaaaaactcacaaataaaaaaggaaaaaaataataaatctaattagcctattttttattaatatgaaagtaaaacgcacagaatattttgattttgcatccgaaaatgtaaattttgctcaagaaaaatgttgtgcaaattccaacgaattgtaaaacggaatgcgaaactcaatccgatggacgcactcaaaaatgcacaacgaaatgccaaatttcaatgccatttcgaatgcttagccaacagcaaattcaaattgtaaagatttccattaaattatggcaatttgcttaccaaatttatacctttttcagccaaacacgcaaataatcagcagaatgagtgaaactcgcgaatttttgcagatggacgaatgt

SEQ ID NO: 52379 - DNA, 2146 bp, Heterodera glycines
  misc_feature (1562)..(1562): n is a, c, g, or t
  misc_feature (1564)..(1564): n is a, c, g, or t
  misc_feature (1573)..(1574): n is a, c, g, or t
  misc_feature (1607)..(1607): n is a, c, g, or t
  misc_feature (1658)..(1658): n is a, c, g, or t
  misc_feature (1688)..(1688): n is a, c, g, or t
  misc_feature (1715)..(1715): n is a, c, g, or t
  misc_feature (1753)..(1753): n is a, c, g, or t
  misc_feature (1776)..(1776): n is a, c, g, or t
  misc_feature (1871)..(1871): n is a, c, g, or t
  misc_feature (1873)..(1873): n is a, c, g, or t
  misc_feature (1878)..(1878): n is a, c, g, or t
  misc_feature (1887)..(1888): n is a, c, g, or t
  misc_feature (1896)..(1896): n is a, c, g, or t
  misc_feature (1969)..(1969): n is a, c, g, or t
  misc_feature (2008)..(2008): n is a, c, g, or t
  misc_feature (2019)..(2019): n is a, c, g, or t
  misc_feature (2047)..(2047): n is a, c, g, or t
  misc_feature (2056)..(2057): n is a, c, g, or t
  misc_feature (2059)..(2059): n is a, c, g, or t
  misc_feature (2084)..(2084): n is a, c, g, or t
  misc_feature (2086)..(2086): n is a, c, g, or t
  misc_feature (2088)..(2089): n is a, c, g, or t
  misc_feature (2096)..(2097): n is a, c, g, or t
  Genomic contig location: Contig_ID=SeqID_3908; Location=566..2711; Strand=+
  SCN-specific regions: Sequence locations=1-533,556-1171,1193 -1725,1748-1785,1808-1900,1922-2146
  Gene Ontology: Mol. function=structural molecule activity; Cellular component=cilium; Biological process=cilium biogenesis
atgcggcttcgtcttcggctttccccgtggtcctttcgcggtgccgtccccggagtcgtttgggtcggtgccgacgaggttttctccgtgtccgatgaccacagtctctgccgctggaccgtctccaaaacggaggccaattttctgtctaatgcgttgaaagagtgcgttttgccgcctttcctcccaaaatcactcttttttcatttccggtgccattttcagctccattttccccacttctctcagtgccgcgtttcccttcgccgccgggcgttctccattttccggaggactgtcaattcgctcgggcaaaaagcaacagcgtacttccgccattcactcgtctcagtcagcagggaatgagctcattctgatgactgcctctgatggtccatcctctcattgatcagataattaattttgacttcgattatctcaggcaaaatccatctgatcactccggcggggaaaattgaacgaacaatcgaagcccaccaaggggcggccattttggcccggtggagcacttccgagcccggaggggcgggcggatttgtgagctgtgagtgaacgatgggtgggaagcgcaaacggaaaagcaaaatgttggcacaggcggagaggacggactgttgaagatgtggtcgcgaaacggaatgttacggtcgatgttggcacaacttgggaagccaatttatgcgatggattggaatgggaacggcacaaaattggtgtacagtgcgggcgaagagtgtttcatcaaacagatgaaggcacaggtaaacgcagaaagtcattaattgatcgaagagatctttttagaaaaactgccctttatcaaatagattcaattaaaatgcaatcagaatgcacccaccaaatggcgtgcccacaccggactcgtcctctgcttgagttggagtgcggtcaccgatctgatcgccagtggaggcgaggactgtcgttaccgactttgggatgggcaaggtctgattggcaaattgccaatattgagggtataacactcccgcctcttttgctgcagggcgccctctgtggtcctccgcttcccatggccatccgttgtgcagcgtcagttggagtccaagcggagagactttcgcgatcggctcctacaatttgctcagactttgcgacaaatcgggggtaaagagcgattaaccattattaataatacgaaaattttggctttatttttttttctgtcaaaattgttcaaaggcatctccgatttttctatgccaattaaatttgatcattctgtttcttgactacagtatcactgccttttccgctcattgtgccaatgcctttcagtggtcccattcccttgagcggcctgccagtggcacaatttactctttgaattggtccgccgacggtgttcaactgattggcggatgcgccaatggacaaatccttcacgcgcacgtcgttgagaggtcgtcgttgggggggcgctgtggtttttgccgtccttgtctgcctgcgttcgggcgggttgtgtgggcgcccttggcggccgtccaggcccgccncntggtcgttnnccttcggggtttgagctcggtggtcgcgcgtgntcgtctggttccgcgggtcggcgtggtgcgtttcgtcttcggcttttcctntttggtggttgcggccctctcgctttgctncgtcttcgggtctttgccggcgtttcntggctcgtttttgttttcgtttgtgcctttgtttgggntgcgccgccgcttgtcgtcctgncggtggtctcggggcccgtgtcgctggtccgtctctgcgctctgtgtgccgttttggcgtggttttctgctgcctttcttttcggggtggctttntntcccnccgttcccnnttctcggnggtgttttctgctggtgggtggctctgccgtccgtgtgttctgcttcgtgggccggtttctcggctctcttcnttttcctccctccgccgcgggcgggcccttcgctgtctnttcggtggccntttcctccgctttgctcgttcttcgggncccttcccnncnttccctaaaggatcttttcgccccncngnncggtcgnncggccccttaaggaaagaaacacacaatgttagcgggggggcgggggcg

SEQ ID NO: 52380 - DNA, 1213 bp, Heterodera glycines
  Genomic contig location: Contig_ID=SeqID_3909; Location=407..1619; Strand=+
  SCN-specific regions: Sequence locations=1-324,349-366,390-446,491 -640,663-1144,1166-1213
  Gene Ontology: Mol. function=structural molecule activity; Cellular component=cilium; Biological process=cilium biogenesis
atgtgtggcacttttgccgagcgtcgagtggcttttgtggaccaaaagggcgactgtttcttggcattagtcagctgttatgggtcagcccaaaggactgcgaagatcggatcgctgatctcctgcctgagtgccaacaatttgaccaatatgttggccgcactgcaggaaaatcagcgcctgctcgtttggacccttccgacggtggcatttttagacagggatttgcttccctccacccaaatggaactcggcaatagtgccgaattgggcaaatcggcgacgattatcgggtgggttggacaatataacatgtgtgaaaacaacaaattaacaaatggtttggtggaatattcagattcatcgggaacaccgtaactgtgcgaagatcggacagatgtttaatcgcccattatgtgccccctttcgtcgcgggactgtacgagattaaaattcaaaatatattttaaataattaacttattttatttgaaaggattcgttgtgttcagcttgcccaatgggaacaagctgttcgaatttgccgaacaacaaatgtgagaattttagggcataaaaaattgaaaaccatcgctaatcaaggaggaattcttgtgggcaactttggccggattggcatgcattgaaaagaattaccaaattgccgaaatgtgttatggacaattggaggaggtgactttcagggagcgggggggagggggaggggggtaaagaaaataaagagcatggattgattgttatcattaaatgaatctctctcaagagtccaatttcagatggagaaggttctgtttttgagtgagcttcggtcgcaaaatgtgccgcaattgcgcgacgcaaaagtggcacaattcagcggacaaaggcgcgaagcggacatgcttttggtaaacgcgggaaggaccttcgaggcactgatgctcaatctcggcacttttcgatttgataggtttggagaaagaggaattaagtgattaaaatgattaagggcgttggaattggcgacaaaaatgggcaggcatttggacacggtgctcggctatcgccagcgatatttggagctaacaggacggaaggagacagatcagcgatatttgaagcatctttcggaggtggaaattgactggacacacatttttgagaagatccaagaggacgaggcaaaggccaaccaacagaacaaatcgccgtga

SEQ ID NO: 52381 - DNA, 1895 bp, Heterodera glycines
  Genomic contig location: Contig_ID=SeqID_3909; Location=1516..3410; Strand=-
  SCN-specific regions: Sequence locations=1-144,166-577,746-862,884 -1275,1299-1680,1709-1839,1861-1895
  Gene Ontology: Mol. function=transporter activity; Cellular component= integral to plasma membrane; Biological process=transport
accgtgaatggattactgtaggtttttcctatatcaacttacgcgtaaaaattataatcattccactatatatgtacaatatctcgtttcaaagtaatactttgccactgacgcattttccgatcacacacatccggtcggtactaaatggatgtgttgccctcaccgttttccaattctgtgccaatttcccccgtccaaaggtggccatttgaacccggccgtgtctctcgccttcgttagccttggcaaattgccatttgcgcactttttgctgtattccctcgtccaaactgtcggcgcctttttcggctccgccctttgcttccacgtctacagaggtgtgggttgacttgctatttttcgaaaattttgaaaattattatttttttgccagaatcattcgagaaattcgacgcgggcattcgaacggtgggagggcccagcggaacgggcgcaattttctgttcctttccggacgaacacatcggacattacacaggtaagcgaagcaaatgctaatgtaatggccacactcatctcattcatgcttttccttcaggattttctatttttttctccctttctcctttcctctcgctctcgcctctctctcctttgtctcacatttccctctctctttccacttactctccaccctctttttctttctctctctactcctccttctctttatcgtctctctttattttcttttattttaacaattattttaattaattttgcagcgtttgtggatgaaattgtcggcactgcgctgctcctctttttcgtcaatgcgctgatcgatccgcgaaaccaagtgccaaaatgggtgcatccgatcggctttgggctggccatctttctgatcacttcctcttttggcatggtacgtttgtctttggcatgatcactccctccctcgtctattggtaatttctgcttgacagaatgtcggctctccgatcaatccggcacgtgactttggtccccggctctttcttctgtttgccggctacggatgggaagcgattgcgtcagtttttgtcaacagttcaacagcaacgttcaatggcgcagaaacgttgcgcaacacaaccgccgtcagtggaggaagtggggacaagcgaaagtggaagcgagtcggcctcggactccagctattcgttttcttccagtggtgagtttgagtgcggggcagggttgttccgggtcgagaaaaatatcgggtttcgggtcgagaaaaaggccgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataatgaacaaaaacgaatacaaaattttcgattccattgaacacaatcgtttcaaaaaaaattctcaattcccttatcctcagaattttcacccagaccccattcttatcagtgcgtatttcgacccgaaaccggacccaaaatcatcgggtcgggtttcgggtcgagaaaaaggccgggtttcgggtatcgggtttcgggtaacccggaacaaccctgatgtgtgtttgtcctcctccgccggtcttcctcttccctttccccttcattttcccatttatttcgtttttaaattgtttattatttccgaatctttttgcgcatgttcaattttaaatgccatttctcgtcattttcacggcgatttgttctgttggttggcctttgcctcgtcctcttggatcttctcaaaaatgtgtgtccagtcaatttccacctccgaaagatgcttcaaatatc

SEQ ID NO: 52382 - DNA, 768 bp, Heterodera glycines
  Genomic contig location: Contig_ID=SeqID_21775; Location=894..1661; Strand=+
  SCN-specific regions: Sequence locations=1-285,314-427,449-660,683-768
atggatcgagaaccggacccggcctgggagatagcccatgaaaaactgaacaaaaaattgttcttaaccgggccggtccgggttccggatcaggcacttttggtgccccgaaagtggtgcgatcggcttccggaaaatgaccaatcaatcactgagttttttttcgcatcgtctcagcacgaaaagcaacagcaatcgttgagttcatttgtgacagacagcatctattggaagcaaaaaagcatcgtttaaggaaaatctgagaagattttttggaaaattctattgggaatttatttatttatttgtcgactatttcagttggatttgtactgatatttggctggacactctcccctttacaccaactacaactcccacaaccacaacaacaagcgtaaagcaatatttgttcggcattgacattggatgtaagaaagaaatatttaatgggttgaaaatgattgaagaacatagcggagaggggagaaaattgaaaattttaaataaaattttggggaaaaaaatttttaacaaaatgtggaactatggaaataattaggacaaaaaaacaaataattcaattcattcagccaaaaaatttgagaagccatgtgaaaagaactgctttttggcatcagaattaatgtatgtttattgtttacaatttataatttgaataataacttaatttagcaattttagagcaaaagtggtggaagcgattgactctgaagaaaagaaataatggcgaaaatggcatttaaa

SEQ ID NO: 52383 - DNA, 453 bp, Heterodera glycines
  Genomic contig location: Contig_ID=SeqID_21777; Location=3..455; Strand=-
  SCN-specific regions: Sequence locations=1-178,200-327,349-362,384-453
atgtgcaaaaatgaagtacataacaagtacaattcgggaaagttttcaagtgctaagacgcaattcaagaagaaaacggccaatgtggtcactgaaaattgcaaagttgtcagcgttgcacaagctgattgcaatttagtgtcagttccgcctcaaatgatcgcgttgcaggtccataaaaagactgcaaatttcgaactggacacaggcgctgatgttactcttttgagttatgaagattgggaaaacattggacacccaaaactggacaattacaaatgcccgacagttcttatggcatttggtgggattccaatcaaaggagtgattggatcattcaaagtctgtgtggcctacaaaaagcaaaagatggaggccaccatttacgtcttcaaaggcactagacgaaatttatgtggccgtgatctgataaaaggacttcagattgattga

SEQ ID NO: 52384 - DNA, 540 bp, Heterodera glycines
  Genomic contig location: Contig_ID=SeqID_21777; Location=657..1196; Strand=-
  SCN-specific regions: Sequence locations=1-78,101-540
tttttaactgactggcacaaatggctcaacaatgccacaagcggtgggaaaagtcggaaaaggccctggtgcctattccccagagatgagatgtcttggtacacctgggaggaacggttcgagtttttcattaaactccgaggaatcacggatgaaagcactaaaaagctgctactcttcacggagattggagcgatttatgaggagttgcgaatgatggcacaacccgatgatgtccgaactttgcctttcagtgaaattgtgaagctaatgaaagagcgttttggtgaatcaaaaacgctcgctgctaaaaggcatgagcttttttcggccacacagtcctcaggtatgtcaattcgtgattttgcaatccaattacggagcttaatcgctaaggccgagtgggacagaaacagcattgaaatgtgcttatgcgcgttatttattaacggcattagcagtgatatggtccgcactgaactgatcaaagggaaggcaatggcattcaaggacgcagtagagacagcagtcttactgtaa

SEQ ID NO: 52385 - DNA, 513 bp, Heterodera glycines
  Genomic contig location: Contig_ID=SeqID_21778; Location=334..846; Strand=-
  SCN-specific regions: Sequence locations=1-513
atgaccggaagttcagctagagtggtccctgctgataaattaaaagctgatccaatttctgtgccaatcgaaagaatgattcgtgttccccctgggatcccaaacaattcaattttgccaaaaggaaaagccaaatttaagaatttaattggcttaatttgtgtctcggaagaaatcaaaaatggcgagattaattttgaaaatgagactgataaggaagtggtttattcattagggacaatgaatttttcaggggcggacggaaaagaagcggccaagtgcgacgagtactgtcttggcgacggaacttgtttttggaccacaatttgctctggggaaggccatgagcactgcacgcagttggtcgttgccgattttgatgccgtcctaaatcgcaaaatcggaattggcgctaaagaggtgacaacgccgcttcaagcactgttctgtgcatttctgctcaaaaaatttggttcgacaacggcatctcgtcgtttggtggaccggccatga

SEQ ID NO: 52386 - DNA, 1173 bp, Heterodera glycines
  misc_feature (1134)..(1134): n is a, c, g, or t
  Genomic contig location: Contig_ID=SeqID_21779; Location=168..1340; Strand=-
  SCN-specific regions: Sequence locations=1-255,278-641,664-878,900 -1173
  Gene Ontology: Mol. function=protein binding; Cellular component =cytoplasm; Biological process=N signaling pathway
atgaccatcttttcatcacaacattcatttgtaaattggacttttaagacggatgatgggagcgatgcgatggatagcgacgacgaggaccaatccgacgaagatgccaaccgaagagcagacgcacttaccagggaacaggagaaacagttttggtccattgtcccagtcgaacaactgaaaaccgaggacggaaactcccaatcgtcggacaaaccatcgacttcttacgccgcttctcaggccgggcttcctccgtctcaaaagaaaaaccaagcgtcgagttcatctatgcgccatcccaacgtttgtctggacgactcctcaatgccgtgctccatttgtttgagtgacatgcgcgaggagtgcgacgacgatgttgttgtgcagctgtctctctgctctcacttattccacaaggaatgcataaaggtatttccgaggcgtctatttttgtaactaaaagcacatcaaatcgggagaagttggggacgtacctcccccctttcgaaattcgcccacttttacttctcttccctatttttattgaaattatctcacaatcagttgattcatgtgcaaaagtcacactttaattagtttcttttttcttcagtccgcctttgctgtgaagcgacagtgtcctctgtgcatgctttggtatggcgaatgtgtcggttaccagcccgccaatggtgattttggttttaatttaattaaaaagcatttgatgatttaagctactatgacggtgaagcaaatcccggggtatgtcgccggacacagagacgcaaagggattccatgaaatcacttaccatattcctgctggaattcagattgtatgtcttttcccgacccgtatttgttccgtcgcttatttctaaatgttaaggatggacacattcgccccgggcagccgtacagttcgaccactcgcatcgcctatctgccgaataacgcggaaggaactcttgtgctcaaaatgctccaattggctttcactcgccggctgatcttcacaattggcgattcagtgactacgggtcgcaaaaatgtgccggtgtggaacaacatccatcacaagacgaacaagaagggcggcccgcaaaagtgtgcctttgttatttgaaangggcaaaggtgtagaattgcggtcccgacagaaaataaa

SEQ ID NO: 52387 - DNA, 788 bp, Heterodera glycines
  Genomic contig location: Contig_ID=SeqID_21780; Location=609..1396; Strand=-
  SCN-specific regions: Sequence locations=1-72,95-327,349-788
atggaagcgttaaaagcaaaaatttctttaaaagaaattttggaagaacaaagaaaagtaaaagaattatcaaaaatatttaacatactgaaaacggggaaatttcctgagggggagccaaaatggagaaaaataattgaaaattatggcttaataaatgacgcaatttactacaaaaaaggaaaaacaaattctgaaaatcctaaactgataattccttacccactaagggaacgaattttccgaatttttcacaacgaaggacattttggctttgaaaaaacatggcccgaaataaaaaatcgattttactgggatggaattaaagaagacataaaactgctaaatgaaacctgtgaattttgccaaaaaagaaaaatttttcctggtcaagttaaagcagcaccaagtgttccaattaaatccacggaaggaccctttcaaagaattcattgtgatttgatgggcccattgaaaaaaccgaaaaaggaaatcagtacattttcctagccatagacagtttttcaaaatgggtaatggcaaaggcaatttccgaccaacgtgcggaaacggtggccgagacattcatagaaattgtaattcaccaacattctacaccagaaacagtggtcacagaccagggaaggcaatttatttcacaaattttcggaaatttgaaaaaatttatggatttgaacatattatgtccactgcttatcatcagcagtcaaatggaatggccgaaggttcaatgagaatattggcaaatatatttccacgacaataaa

SEQ ID NO: 52388 - DNA, 1367 bp, Heterodera glycines
  Genomic contig location: Contig_ID=SeqID_21781; Location=55..1421; Strand=+
  SCN-specific regions: Sequence locations=1-15,37-54,76-543,565 -733,755-978,1000-1367
atggatttatatttggattttgatgatgtgtatgacaacaacggcattgtccagtcaatttggagtgtttttgcacgcgaattttggcccatttttgcgccaaacattcgccatttgactgttcccattggccatcaactggacgatttgcgtcatcacatttcaccgagaattttcaccgattgcaatcaattggattcaatcgattccgattctcggttgctcgatgcaattggtgatgatgggccaaatgcaactgttggccaagcattgtccaaatggttgcgcattccgacaacaaatgggcagccgaaacaatttcgtgatgatgaatcgtcagaaaccaatgaatgggtcaacaatttcaagaaggtatggtgccaatattttcgtaaaaaagattgttaaaaacttggactggcggcgcctaatttcgatcaattgcgaatcccggacccgaattcgaacaagaagccgaaagtccaaattttaaattcgcatttttgcttcaaaatcggtttaaacaaatggaaataaactgaaagccattattctttcaataaaagataggtaatttaataataagccgtttttagacaaaaaaaaaatgcgaaattcgaaaatttgaactttctattttttgttcgaattcgggtcaggggttcggaattggtctaaatggaagccatattcgtgattagcgattccaaaacccccatggttacatttttattgtcttttaacatcaacaaaaaatccatgtggcctaaactgtataattaccgactcattttggattgattgccatttgggttttaatttaccattttttaggaatttctccgtgccaacacttcttcggccagctacataattcaattcaaaacatacaccacctcagttgcgcagtttgaattggtgaacgaacggactaatgaaatgctgacattgaaggcagaagacgatgttgtatacacacatattaattgtgagttgaagcgatgccaaattgggcagacaattcaatgggaggacaaaaagacggacaatttgaacaatgtcgacatttcgcttcatggaaattgcattgggtgaggaggagtggcaacagcttttgcttttatttgtctcgtcacatttaaatttgcacttcgtttaggccattgtttccgccaaagacgggccaaattaacgcaaaaaatctcctgcaaatgaatcccgggcccagctgagaaatgattgatcattaggaatggaaactgattggataattgctcctcacatttgatacttctttcgtttgaatacattttatttgactgggtttttggcttttacatcagaaatgtatttgtttaccaaatcca

SEQ ID NO: 52389 - DNA, 1391 bp, Heterodera glycines
  Genomic contig location: Contig_ID=SeqID_21783; Location=338..1728; Strand=-
  SCN-specific regions: Sequence locations=1-247,269-487,511-793,815 -895,920-969,1009-1391
  Gene Ontology: Mol. function=structural constituent of muscle; Cellular component=cytoskeleton; Biological process=regulation of striated muscle contraction
tgcgtgccggcgaaaccatcactttcacgctgccgtacagctcgggagggctgaagccgaatgtggacgtgctgaacaacggcaagacaatttttgaggacgaccgcaccaccattgaagtggaggacgacaaaattgtgttcaccacccgtgactcaaaacgcaacgatgccggaccgtacaaagtggtggcacagaatcggcacggcaaagacagtgccaagctgaacgtgaacgtgctggacgtgcccggcaagccgagcgggcccattctgttctccgagcttgccgcagacgcgtgcacactgcactggagtccgcccaaggatgacggcggttcgccgctgaccaattatgtggtggagcgcaagtcggcacgtggtggtgactgggagcgcgtcggtgcaccggctggcctgtcgctgcgtgtgcgcggactgaccagcggagaacgctacgagttccgcgtttgtgccgagaaccagttcggcgtgggcgagccgctggacgcggaggatccgctgctggccaaggcgccattcgatgtgcccggaccgccaggcgcaccagagccactgcacaccgcctacgactcaatcacgctccaatgggcacgcccgttgcgggatggcggtgcgccgatcactggctatgtcctggagaagcgtgagcatggcaccaacgcgccgtgggagaaggccgcgtttggcaatgtgccggacacgcgttgcaaggtgggggaaacgggtgcctttcattcaacgcgtagtttcctcccgcctcgcattccccgaattttttgtttaaattttcaacttagaaaatttctaaaaaggttttaggaaatttttcataagaaacttaaaaaaatttttttgaaaaattttcagtgatgtttttaaaaattaaaaaaaaaatagtaggtcatcatcaaaaaaaattttttcttgaaattttcttatgaataaatttcctaagattttttgaaaaatttcaagaacatttttttcaagaaattttcgggatggggggggacgacctgctccgtggaaaattgttgaaatttgtccaaaaaaaaacactaaaattgccatcactgaaggtgaccggcgtcaaaccgcagcacacctacgagttccgcgtggccgccgtgaacgcggcgggccaaggcgagtggagcgaaaactccgtgccaattgtggccgcaccgtccgcctgcaagccgttgatcaccatgggaatgttggcacgcgacatgactgtgctggtgggtgagccggccaagctgctggtgccctacgcggccagtccacgcccggaaatcacttggagcaagaatggcgtgccggtggaagttcgtgccgacccacgcgctgaggtggaaagcagcg

SEQ ID NO: 52390 - DNA, 186 bp, Heterodera glycines
  Genomic contig location: Contig_ID=SeqID_21784; Location=688..873; Strand=-
  SCN-specific regions: Sequence locations=1-186
atggaaaaccctgacgcgaattcgtcgacgattcatcagctgaatggggttgggctcggtggacagaatggaagacatcggtcgagtgattggcgatacaaaattcgaaatcaaatggcggaaagggagggaagggacggagtcaattcgtcggttggattctctgctgctcggcgtcacatcaga

SEQ ID NO: 52391 - DNA, 966 bp, Heterodera glycines
  Genomic contig location: Contig_ID=SeqID_3910; Location=377..1342; Strand=+
  SCN-specific regions: Sequence locations=1-702,724-744,766-966
atgactttccccaattcttataaaatcggaccatccgctagtaagggacaacgactgttttaagagatattgacatatttagaaactttttctaagctacatattgcttggtgattaaaccattaccaaaaaggttagaaacgaaaattgaaaaaactcgaaattttttatactttttcttaataactttttacattttggaaaagcttgacaaagtgcttacaatgaattacacttaattttatagaactgagaagtatttcaaattggcgttttgttgtttgtattttccagcattaacaaattaccgaaaatttccgtatcttttttcggcaagcgtcaaattcggaaagagcttgaagcgggactggatcccgcacgaaatccatccgaaatcccgcatttttaatttcgggattgcccgctggataccgaccgtcccgccaggcgcgtaaccagaaaaaaaaatttcgggaggggcaaccgtttttatgctcttcgggccagctaatttttctcaagagaaaattttcagcgccggagaaaaaaaacagggtaatagtgtactttgtaccagagatgtgccgagccagacaaaatccgattccgattaaatcgccgattccgattatggccaaaaatccgatacggttttaaaaccgattacgattatggcccaaaacccgattaattgcgattccgatttttttaaaataattttttcccaaaaattttattcataatcaaaatcataaatttaaagattgtgatgcaaaaataaaagtttgtccacattctcaggcaataaacgttttcagatctgtcacaatcaacccagcggtggagaatattcccagatatttgccatttttgctaaataacaaaaaacttgattatatcggggagaattaatccggcactgctttgtgagaaaaatttaatttcagtcattatgttaaaataaga

SEQ ID NO: 52392 - DNA, 133 bp, Heterodera glycines
  Genomic contig location: Contig_ID=SeqID_3910; Location=949..1081; Strand=-
  SCN-specific regions: Sequence locations=1-133
aatcggaatcgcaattaatcgggttttgggccataatcgtaatcggttttaaaaccgtatcggatttttggccataatcggaatcggcgatttaatcggaatcggattttgtctggctcggcacatctctggt

SEQ ID NO: 52393 - DNA, 155 bp, Heterodera glycines
  Genomic contig location: Contig_ID=SeqID_3910; Location=1910..2064; Strand=+
  SCN-specific regions: Sequence locations=1-155
atgattgcacgtaattgccgaaaaaattcgagaccaatttccgaatgttgaccgactaattgcaaaacgaaagccgtctttgtcaaagcgccttaccgagtcaaaaaatttggaaatatatctcatatgcaatttaaaccaataaatttgaagaa

SEQ ID NO: 52394 - DNA, 709 bp, Heterodera glycines
  Genomic contig location: Contig_ID=SeqID_3910; Location=5017..5725; Strand=+
  SCN-specific regions: Sequence locations=1-9,36-79,101-108,130 -250,307-384,407-501,523-539,569-620,642-686,708-709
atgaatccaacttttgtttttatatgtatttgtattagagatcgacattttgaaaaaagcctggacctggacctggattccatgttggacttggacctggatttcctggacaaaaatccaggaaaatccaggtccaggaaaaatccaggctcctcgagacctggatccaggcctggacctggatttttttaaactcattttaaaaatcaaaaaagtgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttgacctggacctggatttcctggacaaaaatccaggaaaaatccaggttgccgaaaaatgacctggacctggatccaggaaaaatccaggcctggatccaggtccaggccgatctctagtatttatattaaaaaatcaaaaaaaaattcttggctttttaatgcgatttttccataaagaaggtttactctatagcataaaaatttttgaaaagatttttacttgtttgtagatgtaacagatgcaaaagctcacggacaaattccactgaaaataatttaaaatatta

SEQ ID NO: 52395 - DNA, 343 bp, Heterodera glycines
  Genomic contig location: Contig_ID=SeqID_3911; Location=302..644; Strand=+
  SCN-specific regions: Sequence locations=1-9,36-56,83-83,105-112,134 -254,311-343
atgaatccaacttttgtttttatatgtatttgtattagagatcgacattttgaaaagcctggacctggacctggacctggattccatgttggacctggacctggatttcctggacaaaaatccaggaaaatccaggtccaggaaaaatccaggctcctcgagacctggatccaggcctggacctggatttttttaaactcattttaaaaatcaaaaaagtgtttgaaaaattcaattaattgcttgggaacatctaaaaatatctaatttacaataataatttgtttttaaatatatttaatcattttttgaaaacttgaaaaaatatcggtcacttgaaata

SEQ ID NO: 52396 - DNA, 1568 bp, Heterodera glycines
  Genomic contig location: Contig_ID=SeqID_3911; Location=779..2346; Strand=+
  SCN-specific regions: Sequence locations=1-24,46-93,115-124,146 -154,188-287,309-614,638-891,920-960,982-1204,1226-1389,1421-1568
atgacctggacctggatccaggaaaaatccaggcctggatccaggtccaggtcgaactctaatttgtatagtttacactccgccgatggacaattaaatcctccccatttttgctcactgatcaattgctgctgcagatcaattagcgaaaagcaataaatattaaattatatttattaatttaattcaacttcttccgctgattaatgtccaagcactttcacattcattaattatgtgcaaaaaagaaacattgcaaattaagcacatttcaagcgtttccgtggtaaagcagaaaaataaataaatttttcgagaggatcgcaaaaggataaataaaactacgaacaaaaaaaataaaattgtcattttagccaaaaagggtgtgaataagttacaaacgaaaataatcatcaattacttaattaatcagatcttttttcataatagcctaaacgttgagattttatatattttagcttcgttagactcgctgacccacaaaatgtccaggccacgaaatgtccaagtctcgaatttgagttttttattattcggatgggcctaaggttaggcaacgggtaatataaaggttatattcgtattcagcgaccccgaaaaccctaaaaatcctaaattagactcattttgtttttataaattttgaaaaattttggacatttcgtgggtttttactcttttggacatttcgtggcttggacactttgtgggggcgccgttagactttgtgctttcgaatgctaccaaaaagataggggttgttcaaacatgaacaaagttattgtataaagtcaattgattggactcataagtgcactagagccgaaattttaatcatatgaactcgtggtttttgataattttcttcactttttaaaattttgtttatatatatattcagcgaaaaacatgttttctttttcttttaaagatttttcgaaaatttttaaatttaaatttgctgctcgtgtgtttttcgggtccactgcgtttcggcgctggcgtttcggcgccagcatgtttttggctataacttttttctatctaatccaaatccaacattgttgatataattcgaaagcttaacatgtttagaagctttttctaagcgattgcttcgcgattagacaattaccaaaaaagttatacatgaaaatttcgaaaagtcgaaatttttgaagttttttcttaataaaattttttacaggcttgaaaatctatccgctttttgtaaggctaatagagcatgataagagctttcgaatgataccaagattgttggatttggatcagatagaaaaaagttatagccaaaaacgagctggcgccgaaacgccagcgccgaaacgcgtgggtccccctatccattctctctctctctcatttctctccctctctcacttcatgtctcagtcaaattagtgatatataccttatgctaattatggttatatttaattacacttaattgaacctcacattttggtgttcatttatttgcgctccatttgtgccaaaataatataaaattgatgaaaacaaaagga

SEQ ID NO: 52397 - DNA, 157 bp, Heterodera glycines
  Genomic contig location: Contig_ID=SeqID_3911; Location=2835..2991; Strand=+
  SCN-specific regions: Sequence locations=1-157
atgattgcacgtaattgccgaaaaaattcgagaccaatttccgaatgttgaccgactaattgcaaaacgaaagccgtctttgtcaaagcgccttaccgagtcaaaaaattttggaaatgtatctcatatgcaatttcaaccaataaatttgaaagaa

SEQ ID NO: 52398 - DNA, 1545 bp, Heterodera glycines
  Genomic contig location: Contig_ID=SeqID_21785; Location=782..2326; Strand=-
  SCN-specific regions: Sequence locations=1-284,308-550,572-619,641 -804,840-992,1014-1204,1316-1337,1359-1473,1495-1545
atggattttgtgaaaacactacaaaacattgtgtctgttgatcaaagattgaagcttcaagagtttgaacaacgccaaaattcattttggaaagaaaaaaatatagcattttcggaattgcttttctcattggcaatccgtttgtgtgtacaaattgaacaacaaaatgaccaaattattggtaattatttaaaggcatttacatttgcttacagaactggttttaaaatccataggtaaaaaaaactacaaaaatagtactgtaggatcagaaatttcctttgatatattcaaaaagaacaaaaaatactgtagaataaaaaaatttccaataatcctgtgtaccaggaatggaattccgaggcaccaaaaaatttcggaagtcgaaattccgaccccaaaaatgttggaagtcggaactcggaattccgtgccatccctgctgtgtactggacactcaaaattgcatttaggtaattaaaactacttacagaagttaacaaattcaaaattggaatttctatttccaaaattaatttctaaatatgtttaacccttggaataagatttggtaaattattggcgttggaacatccccgggggtgtttctgattaccgcaaattttaaattattattttaggtcttttaacatgaaaatcaacatttcaaatgatttggtcgaaatcaatatgccaacttggaaattgccatataatgtgtacttggaaaataaaaatgagctgcaaattgaaaatgccaggggtaaatgtgtccttataagcaaggacaattgtttaaaagccttaatttgtttaattaattaaaatatttattttttcaccaggaaattatgagtttttgctaattttgacgaagccggcttattcgcccacagtttatgaagtgataaaaatggtgcaaattcttgaccaaatggacagtgatggagaatatattttggaagaacttgattacttaaaaatttttaaccatgttttgaattttcttttaacaaacgaacgaatttcgaaaagcccaaatcaaattcgaaataaatttgcatttttggcatattttgttgaagatttattgcaagaaattgagacaactaattatttactaaataacgaagcgattaaaatgctaattaaacgttttcgtgaaaagcaacggcaattgtgcgccaaatcaacgtaagattcgaattatataatagtttttaaaatttctaatttatattttataagtattttttattttacgtaaaataattaaaaattttaataaaattaattagtttatttgtaaatttttcaggttttattgctcattaaacccaaactttgttttaatttatgaaaacaaaaaagatgcatacatgaaatattttggtgagaattacgtgaattttgtcaaagcaatcaaaatcgattttaattcggacaaaggttgttgaattaatttaatgatgttgaaattaaaacattaatatacatgcaattttaaatacattaaaacttgaacatcaaagaattttgaataaa

SEQ ID NO: 52399 - DNA, 743 bp, Heterodera glycines
  Genomic contig location: Contig_ID=SeqID_21788; Location=52..794; Strand=-
  SCN-specific regions: Sequence locations=1-8,126-159,181-227,251 -341,364-380,402-478,501-743
attttgagccatcacttccaccaccaacagcacaacaacaacaaccatcagtgttcaccgccgccactgcagcaacagcaaaaactgaccaccaccaccaccagcagcaacaacagcttcaacacttggacatactcttgcagcagcagcatattgggacggcacgcggtggcggtgggacgccggcaatgcgcggcggtgtcggcggagcagtacaaccatcaccaccccaccagcaacagcagcagtacatgcagcaacaacagttgttgctgatgcgagcagcggctgcggaacagcaggcggtgggtgattgttttggcgatgatattggggttttgaaaaatttaaaaaaaaatatttctttttggaacagcttattttcccgccgtcccccctcccatccagaagatttttttttgggtgtataaatcgaaatttttgtgtttgccgtcattaaggggtaaaaaaaattaccaaaaaaaaatatatttatttttcggtttgcgagtcgtcaaattgtagggggggggaaacgggtggggaccttgaggtgtttggtttttggtcatcaaatgggttaaaattgtgtgcacagatgctgcaacaacaacaacaacagcggaaacacgagcaacaaaaaatggcaccgcctctgacgactgtttcggctgccgcggtggcactaacgccggcggcgctggccattgacgacttccgactgattgcggtgcttggccgag

SEQ ID NO: 52400 - DNA, 752 bp, Heterodera glycines
  Genomic contig location: Contig_ID=SeqID_21789; Location=37..788; Strand=-
  SCN-specific regions: Sequence locations=1-242,276-361,385-431,453 -465,487-622,644-723,747-752
atggcttcgagcttctcaatttctgtgtttatttccatgattgggctttgctgtttatttaatgaaagcattggaggagatgaatatgagtattataatgggctaagcgaaattcataacgtgcaaccgtattcggactactatcctacaagttatggtaataaacagaccagctattccagattcctagctttttcgaaccggaattttggattacatttttttatataaaaatatccgagttttcattcattaaaaaatttgccaaattttaagtaattgaagcttaaaatatgtttttttgagaatagaaaacttaaaaattcagggttttggactcgaaccccccagataaagtcagtaaatttatattattttaattaagtgtaatagtatcagctaagataaaaggatgactgtggaataacaggaaatataaattaaaatattatggttacatcttcatttttgttttgctctttcagatcacaggaattgggatcattcgagtgagatagcttatggtcaattgccgcctgctgctcttggtcaatcaaacggtatgacatgtttttgtttagaatattaacaattttataccctgactaattaaataacgaacttttttatatttaataggtttcattaaatatgaaggaaacaggaaattggaaaataagatgattacttagcattagtacactttagtattcttgaattttcaattaattgttttaatttttagcattaaa

SEQ ID NO: 52401 - DNA, 318 bp, Heterodera glycines
  Genomic contig location: Contig_ID=SeqID_21789; Location=1045..1362; Strand=+
  SCN-specific regions: Sequence locations=1-85,107-152,175-318
atgaataataatataatagcagttgctttcgtcatgaatgtaaattaattttgtaaataatcgatttttatttatacgtcaaattatttttatttctgctttatttacgtcatagctaccccattgttaacgcttataatattataaaaaataggaaataaattttggaattttgcaggctaatagagaaaacttttggttagcgaatgataccaagattgttaaattggctgacaaaggaaaaggttatatatagtccaaaaagttgattggacccaaagttcggggctcaactgaagaaaaccgatttcggctaaa

SEQ ID NO: 52402 - DNA, 360 bp, Heterodera glycines
  Genomic contig location: Contig_ID=SeqID_21790; Location=230..589; Strand=+
  SCN-specific regions: Sequence locations=1-1,58-360
atgttgctgctgctctgccggttgctggtgctgttgctctgctggttgctgctgctggtggtggtgttggtggtgacgaagaccaaaatgcaaccgcccggtgttggatatttcatgaagaacagcgctatcggagagtccttcctcctcaccaccactttcaactggctgtaaatattgatttaattaatatagttttgttttgaaatttcattattttcagttcaaactcacaattccctccaagttcatgtcggagtggtcttcagacattgaattggccaaaatttggttgagatcgatctgcaaggcggccatcgaaatcggaaagcaaatttgaattgagtaaatgctgtaaaa

SEQ ID NO: 52403 - DNA, 159 bp, Heterodera glycines
  Genomic contig location: Contig_ID=SeqID_21791; Location=884..1042; Strand=-
  SCN-specific regions: Sequence locations=1-24,46-113,136-159
atgaaaggaccatttgattggtacattgtatcaaaaatgcaaaaaccgataatcgtcaatataattgctctcgctaatctcggtaccggaattaaactaaactctctgacgatcaccgaatgcgaatttaagtataaccctagaaaattcaatgccgcg

SEQ ID NO: 52404 - DNA, 252 bp, Heterodera glycines
  Genomic contig location: Contig_ID=SeqID_21792; Location=708..959; Strand=-
  SCN-specific regions: Sequence locations=1-252
atgtcctcctccacaattgctcccatttcttccgccgatggcaccgctgggagtgccgccgccgtcgccagcgctgggccctcctccgtcgagccgatgccgccggtggagcagctgatggagggcattgaggagaagtgcccgccctcgttggaccagcgactgaacgccatggacgaggtggacatgcgcatcgacgacctgctcaccgtggtggccgaagtgatggccggtctggacaaggacaagccg

SEQ ID NO: 52405 - DNA, 430 bp, Heterodera glycines
  misc_feature (143)..(143): n is a, c, g, or t
  Genomic contig location: Contig_ID=SeqID_21792; Location=1536..1965; Strand=-
  SCN-specific regions: Sequence locations=1-368,394-430
gaggtggcactgatggacgagtattggtcatggacccggagcgggacgaacgcaacgatatgatgtgagaaggtcgggggggggggggcggcacaaaagccaattccaatttgctctctctgttgttcatccttttcttgtgngctgatcacccatttgggtgttattttttctgatcacttctcccaattcctccgcacagtttgacacgtccaaagcgtcgctactacgaccgggtggaggacttgccgcagaatgttgttgcccggtggcgcaaggagcgcgaacagttccaaccaccgaccgacccatatgctggaaaagaggacgaagaatgagcacggagcggataggatgatgattaatgatcatgaagatggtgttgaacaacatataattaatgaatgcaaatgataaaaataaatatgcc

SEQ ID NO: 52406 - DNA, 854 bp, Heterodera glycines
  Genomic contig location: Contig_ID=SeqID_21793; Location=367..1220; Strand=-
  SCN-specific regions: Sequence locations=1-404,426-498,520-763,814-854
atgagtgctcactcacatgttaaggagcgcctctttcccgcggctgcccagccggcacccgccattgtacagccggctgccgccgccgttgtccctccggcacccgttgttgttctaccggctgccgccgaagccccaccggcagacgtggagattgagctggacattgacggcgaacaattgacaaacttcccggcacaacaacacccgcaacaattgttcccggcacaacaacacccgcaacaattgttcccggcacaacaacaacaaccgcagcaattgttcccggcacaacatcaacaacaactgctgctgccgcctcggccgatgatttcgcagattgtcgacaatgccgttagcgtactccagatgcattttcacaacatgtctcctctgcggcccgcttttccaccatttttcatcaactcgccgtttcctcggcttcagggcgccttggaactcccttctcttcaattcggccagcagcacgcatttgcgccccctccggcaccggcactccaaattgtcccgctcgatgatgccccggcgcctcaaccgttgtgcgatgttttgcaaacggtagcctaaacccacttttacctataaatgtaaacccccccccaataagacgccaacgtgttcacgttgcattcctagagaatgtgtacgcgccgcgtacaaactgctttcaccacaacaaattcatgcagcggaggcagttctgtttggagacagcaggccgggaaccgcgttcagctcggtgtcctcctgctcttccgcttcttcatccaccacttcctcttccgcgtcctctgttccgaagcacaccgaacgagacaaaagaaagcgcctaa

SEQ ID NO: 52407 - DNA, 375 bp, Heterodera glycines
  Genomic contig location: Contig_ID=SeqID_21793; Location=1390..1764; Strand=-
  SCN-specific regions: Sequence locations=1-375
atggctacctcatttttaatgagcttaatattttgtttattagtgccggcaccgtcaccgagacatggacttcgcgacatcgctgaagaggatgacggcagcgaggaattcgagatatcagccatcatgctgtacgaccactgcgcgtgtatgctctgtggacgtatcagattcttttatctgatcgactacgctacgccacacgtcgttacgaagtggggcgggtcctacttgaaggacgaaaatgtcctaacgcatgtaaaattcctgataaaatcataaattaataatacgcataatttctaggccggcttctgtctcggcagactgctcacctttgtgaacacctcgccacatggatggcagccggcttaa

SEQ ID NO: 52408 - DNA, 807 bp, Heterodera glycines
  Genomic contig location: Contig_ID=SeqID_21793; Location=2209..3015; Strand=+
  SCN-specific regions: Sequence locations=1-147,169-180,203-592,631 -774,797-807
atgcagtggattaaattcaactgcacgctttgtccaattggacttcagtgtttctatccgcgcaagtacgcaaagcctgtgctttgtgcgcatcccagcgtccgtaacatcacggactttttgagcaccgggcagcttggcgaagctgcaacgacaacaacaacaacatttccgacaactgcggaaacggcggcggcgacagaatgcgcacctccgcccgcgcatttgaccgcgtggatcgcggtgtgcacagcgctggtggcgcttttggtgattgcggaggtctgttaattttgggaatttatccgctaaacccctattcctcaattaagcttgtgcgtgcaggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcaccgactccgctgattttgccggctatgttggccggcgtttctctgcgcccgacgggcgtcaatttgactgtggaccgggtgtgcaattttaattaaattaaaatctttatatattttaatttctcactcatcaaaattacaatttaaatttaaaggcagcggggcagcgccgcgcggatggtgcaattgaggagggcgaagagcccgtgtacgatgaggtgccgcttgacagcgacatcgtggtcgagatgcgcgacgaagaaaatggggaggaggaggacgaagacagtgatttttaa

SEQ ID NO: 52409 - DNA, 345 bp, Heterodera glycines
  Genomic contig location: Contig_ID=SeqID_21794; Location=143..487; Strand=-
  SCN-specific regions: Sequence locations=59-112,159-218
  Gene Ontology: Mol. function=casein kinase activity; Cellular component=nucleus; Biological process=signal transduction
ttggccaggatccaatacattcacagcaaggatttcatccatcgcgacataaagccaggttttctttttttttcatgttacattattcggccttgtaaaaaagcactcttttagacaattttctgatgggtctcggcaagcggggcaatcttgtctacgtaagactactgttggcacttttagacgtaaaaaacgtaaatattggtccatttttgcagattattgactttggactggccaaacggtatcgtgaccagcggaccaagcagcacattccatacagggaccacaaaaatttgacgggtacagcgcgttatgcgtccatcaacacacatttgggtgttg

SEQ ID NO: 52410 - DNA, 1343 bp, Heterodera glycines
  Genomic contig location: Contig_ID=SeqID_3914; Location=2..1344; Strand=-
  SCN-specific regions: Sequence locations=1-198,224-314,336-375,418 -460,568-694,716-1135,1160-1237,1259-1343
atgatgttttggaggaatgaattgtgtgctgtaaatccgcatatttattggcgtctcataaatgaatggccaagcgacgccatcctccgcccatcatcgccgggggggaagaagactaagaagaagaagggaagagatgactgtgagaagatgtgtgaattgcaacagatcttccgattaacaaaggaaaacagcgccggggggaagagaggaggagagaaaatgcattgctaacgttaagcgagcaatgttctcagcagatgggccaaagcgatagtgctgactgcgagcgtactttgttcatcaacatatccggcaaaattccccctttttttgagtactgtagtcccccttttttttgtatactgtatatggtttaaaattaattttctatgtatttttttttctttaatatatcttttatcaatcatctctttgtcttcccgaaggacctactgtatttttttttatatttgtatttcattttttttttgcttttatttcacatttaatctctttttttttgactgactaattttgatttttttcgatttttctctttttcttcccgaagggtatctctcgtttttcatccaaaagggcattcctaattcataatttatttttctacttatttatcttcctactgggcattttcaaattttcagattttcaacctaatgggcatcctgaattttctttttcatgtatttgtcttcccgaagggtatccaaaattttcacttattttcatcctaatgggcatttaatcatccaaaagggcatcccggggcattcttctattattttttcatcccgaagggcattcaaaatttcacattttcatcctaatgggcatttactcatccaaaagggcatcccgaagggcattccgaaagtcatttttttctatttatcatcccgaagggcatcccggagggtattcatagactgtcggggcattctctttttttttttactctttttattttctcctttttaccgcctccggaggactttctttttattgccgaagcactcactaatggccatcatttttccatgcttttcccttactaacttttcctatgggttgtccctcagccgcccaggccaaatgccaaaccatccggtgctaccagtaacacacatgccagtggaacgcgctgaattaggccttgggactcccaacccttacaaatccaaccatttttatgagggggtcctggggtgatcaatcccacttccctccccatctcataccaattcaaattccaatctgtaatggctttatttcaggaagagtatgcaaaactattacaaatagaaatcgcaacaaataaa

SEQ ID NO: 52411 - DNA, 562 bp, Heterodera glycines
  Genomic contig location: Contig_ID=SeqID_3914; Location=2224..2785; Strand=+
  SCN-specific regions: Sequence locations=1-510,533-562
atggtaaatacagtaccttttcttcgattaaatcaaatctgtgacaatcaaactaaaaattttttttctctctcttttctgtctgattaattaactgatcaaaaagtcattttgtatcaatgacatgataattttttttcatatcggtttatattgttgtttttatatttttggcgtatttctaataataatttaaagtttgttggcatgaccttaaatactgttttcttccaattttttttaatgggatcattgatcattggcatttattacttaaaaattaattgcttaaacacttaaaattgtaattcattcagacaaccggatcggttatactgtattacaattaacattgtaactcattcaggttttggcattgtgttttgctttggaatttgtcgtcgtcaaggacttgagcagcgtttggattttggatttggagtttgacgcaacagcctttgaacactttgatcttctgtggccaagggttggtcaaatcactgattattgacttaattattcaaattattcaaaataataatacaagacaagactaaacaaa

SEQ ID NO: 52412 - DNA, 1632 bp, Heterodera glycines
  Genomic contig location: Contig_ID=SeqID_3914; Location=2859..4490; Strand=+
  SCN-specific regions: Sequence locations=1-662,684-780,802-1128,1150 -1173,1196-1196,1218-1632
atggattataatgatttaaatgtttgcgacaagaaactcatggatgggaagatcctcacgaaccaagcaaaattaagtgatgtagggaaagtccatgatgaagtaatacttttagaagatggggtgaaccgaaatttgagaacgattaaccgaaaagtaacaaatgtttcaaatcgagtagttgagattgctagtgatgtaaatgtaggttttaatacagtagcgaaacgggtcgacactttaggggaaatagtcacagaattagacgggaaatttagtacatggaaaaatgagatagatacgagagaacaattagagtttgatgagatgaacaaaacccaagaagcccatgggactgtacctttcccttttagaagacctccagggtctcctagactgaacattccagcaactcctcctgctaatttggcactgattcttcaaatccaagcaccaaataggggtaatgtgaatgcactcactgaagtaggcacttcgggaccacaaccagggctatttaatggtgaaattgcctcggcatttgatgaatgggaaattaaatttagggattatattgatgtttttggtacaaattggaatgaatcagagaaattgaatcgtcttaagctacatttgggaacccaaacacgaaacatttttgaaaatttgcttcaaaatgaaaggaataccctcgccaatgcattgaaaaatatcagagcaaaattggacagtcctcattttcgggaattagcctacagaaaattagcggcatgttatcaaaaggagggagagtcagtaagtgacttcattaagcgcttagttcctcttgtcaacacaacttcagctcaaattccacctgaagcgagagaagagatgatgtgtagatgtctcatagaaaaagtaagacccgaatttcagcgttctttacagcttgtaggaccacttattgggagaaaggactttcagaaactgactgcatacattcaagagttagaagtctcaattgaaagagatgtgagaaatgagagcttcggcattcacgcacttaatacaaatcctagtcaagttccacaaggcaaatttaacacatggggaccttcgaaccctaacaatattcaacttgggcacaaaacatttagaaatgaaaatcgtgatcagtcagataggagacccaatcagttttcacagaataatagatacaatcagcaaagaagggattggggcccacaaaatgatagaagatggaataacagacccgtctgtcattactgtaagaggaccggacacgtacaatacaattgcaggattagacagaatgactttaatgggcaatcggacaatcgtaatcagacacgttggcaacatcggccacaaaattcaaatagggacaattggtccacaaatgagtcaaaacaattaaaagatatggtagaagacttagcagttcaggtgcatgaaatgaaaatgaacaacaattacgcttcggcgagacaacagaacattaaagcattacaaatgattcatacaaatgaagaaatacagaaaattgaaccaagaaaaattttgaacccaaaagtatttcaagttgggagaataagcaagggaaatccaaaacattttcaagcattttaa

SEQ ID NO: 52413 - DNA, 1786 bp, Heterodera glycines
  misc_feature (1710)..(1710): n is a, c, g, or t
  Genomic contig location: Contig_ID=SeqID_3914; Location=4771..6556; Strand=+
  SCN-specific regions: Sequence locations=1-110,133-307,329-363,392 -700,722-866,892-1220,1242-1534,1556-1786
atggaagagaagtcagaaccagagaattttgatgtgtctttggatgaatgcagacaaatgatcaagcacaaaagttgcagcttcggcaatttaaaagggatcacaaatttttggcaaactgaaaataaaatagatttaactcccaggttttggctgttagggtcatttggatggaagaatgtctcaagtgaaaactgttttcttttagaaacacgaattgactcgcactttggggctaattcaattgtgactccattgagattgagcgaaactcatgactgtccatacagtaaaggttactgtattttgtctgacaaaacagttttaatttggcaaatagacactgaaaggaagtgtaattttattccaattggaaataaaaatggaaaaatgatggacaaaatttggttatctgatgatggtgagctgggtctatctttcgggaatcaaacgaatttaattgatgtgggcaattcttctcagttagcttctcaattgacttatttggctcaatcattaactcaaccatgagttttgcattttctcaatcacttagacattttgtgagttcattgaggagaatagaagatgggttgaagcctcattcttttcaaatccaacggatttggctagatttactttctctaatccattcatttatgctaaaagagcagcccaaacacttttaaaaatttggccatgcgttcctttggaccaaaaagattatgaatttagaccaaccaaacttcaaaatcaatgtttcgaattcataccaattaatttgaagacgcagggtagggaacattttgctttcattgacccaaagtcaatgataatctctccatcatcaagaaaaggttcctgtgaggaatttagaaaaattataattcaaattgaaggccaaattttagaaattgaccaaatagaaggaaaaattacttcggtaagcccaaataaactgattcatcatgaaataaaatttgggctaaacaatttgcttcctcaaatagaagcacatgcttttcacaaattggttctactaaatctgacagacataaaagatcatgcttttgtgagcaatatggtaaaattgagtcaaatgacttatcagattcatgaaaaggacaccaaaatcacagctacaatttctcaagaatgggaagaggttgaaagccaaatgatcaaagcagtgattggtgattacagaaaaatgtggttaataattatgtctctaattattaccattctgtcaattgacttagcgataagattgacaattggtttaagtgaaatttatgcagggaatgggcgcttaggcaatttattatttggtacaacaattcagaaagctgggaaaagagtaagaaaattgagggaaactaaaattcaagaagaaagagaaatctatgaagaaccaattaatcaaattagttggcctccaagaattagaagagcgggaaattcacttagaaaatctttcaccagaccttttaaaagaaataggcatggaccaaatccaacacaaatgagcactcattttgaattaaattctttgatgggacagcttgggtcgttaaataataatacaatgacagggaccacttttgtctctcttaataatttccaaatgaaatgcttagtggacacaggctcaagcacctcagttgcaccaaaagcgttagctgattacttaggtattaaaacatttanatcagaagcacatttaatgagtgcttccggtcatccagtacatgtcaaagaagctgctcgtgtgactttaaaatag

SEQ ID NO: 52414 - DNA, 2216 bp, Heterodera glycines
  Genomic contig location: Contig_ID=SeqID_3915; Location=9..2224; Strand=+
  SCN-specific regions: Sequence locations=1-339,365-454,476-1007,1029 -1251,1275-1382,1404-1712,1735-2216
atgagttttgcattctctcaatcacttaggacatttgtgagttcattgaggagaatagaagatgggttgaagcctcattcttttcaaatccaacggatttggctaggtttactttttctaatccattcatttatgctaaaagagcagcccaaacgctcttgaaaatttggccatgcgttcctttggaccaaaatgattatgaatttaggccaaccaaacttcaaaatcaatgttttgaattcataccaattaatttgaagacactgaatagggaacattttgcttttattgacccaacgtcaatgatagtctctccctcgtcaagaaaaggtacctgtgaggaatttagaaaaattataattcaaattgaaggccaaattttagaaattgaccaaatagaaggaaaaattacttcggtaagcccaaataaattaaatcatcacgaagtaaaatttgggttcaacaatttgcttcctcaaatagaagcacatgcttttcacaaattagttgtattaaatctaacagacataaaagatcatgcttttgtgagcaacatggtcaaattgagtcaaatgacttatcagattcatgaaaaggacacaaaaatcacaacttcaatttctcaggaatgggaagaggttgaaagccaaatggtcaaagcagttattggtgattacagaaaaatatggttaataattatgtctctaattctcaccattttgtcaattgacttggcgataagattgacaattggtttaagtgaaatttatgcagggaatgggcgcttaggcaatttattatttggtacaacaattcagaaagctgggaaaagagtaagaaaattgagggaaactaaaattcagcaagaaggagaaatctatgaagaaccaattaatcaaattagttggcctccaagaattagaagagcgggaaattcacttagaaaatctttcaccagaccttttaaaagaaataggcatggaccaaatccaacacaaatgagcactcattttgaattaaattctttgatgggacagcttgggtctttaaataataatacaatgacagggaccactctcgtctctcttaataatttccaaatgaaatgcttagtggacacaggctcaagcacctcagttgcaccaaaagcgttagctgattacttaggtattagaacatttaaatctgaggcacatttaatgagtgcttccggtcatccagtgcatgtcaaagaagctgctcgtgttaccttaaaaataggaaatgaatatgtggacataattattcgtctttttgatgatgaactttcatggacaatgaaagattataattttattttgggatgtgatgctcttgcttcactgccgcctattacttttgactttcaaaataaatgtgtaattattacaaatcccacctcaactgtaaaaagaatttttaaaggaacatgcctcggcaattcaaatgaagtcttaaaaacggaaaatagcactatttttactgaaattgagaaagaggacagtgagtatgaattcaatgcattgatagaaaaagaaataaaaattgccattgtgacagcagcaaatttgccacttgcaaaattagtccaagaattgaatgatgtatttggttctgatgagatggaagaatcaggttcagttgcattcttctcgggttatgccaaagaaaagtacaaagaaatgttagaaaagttgaaaaggcatttgttgatttccaaaatttcgaacgaagaaataataagcaagtttgagacacaagacgatgtgaaggaaattgagacttattgtaagaatttcgaagttcgaccacgcttaacaaaagaacgaaaagtagcgaatttgtactcagaagttgcggatttgcggattgtcttcaccacagtgtcgatggcagaaaatctgattcacacagctttagacggcacaacagtcttaatctttgatgaagctactcaggggtcatgggtctgcttagcacatttagtagccagaatgccaaaattggagaaagtcttggtaactggtgaccaattgcagcttggtgttcatctgcagaaactcccgcctttgctacaatccggttttggtcttgaatcaatggttgatcagttgatcctgtctccgacagttgttcaaactcgtctaacgacttgttacagaatgcatccgacactggtgaaagcagttgcttcggca

SEQ ID NO: 52415 - DNA, 420 bp, Heterodera glycines
  Genomic contig location: Contig_ID=SeqID_21796; Location=148..567; Strand=-
  SCN-specific regions: Sequence locations=1-420
atgccaaaatcctcccaaaaaagatgtcgaatgtccccagttttggaagacaatgatgatatcggtattcggcttaatcgtcttgaaaagcttgtttcctccctcaacccgtcgatcaacgccacaattgttgagcggctggatcgcctagagctacttgtgcagaaattggttaatgacaacacaaaggagcgatccgccggggactcaatgtccttctccaactcctcacccagtgttctttggggtcaaccgccgcctcacatcggaatggtcacccaactggtcaacaatgccgtgttggactcggaggagattatcgcaaaatcgaagagagcagtgttggagaaagtaccagaacaaatcgatgccgttaaacttgtgcgtaaggtcgctaccgaatgtggactgatggacgag

SEQ ID NO: 52416 - DNA, 239 bp, Heterodera glycines
  Genomic contig location: Contig_ID=SeqID_21796; Location=660..898; Strand=+
  SCN-specific regions: Sequence locations=1-239
atggaaataaatgaccccaaaaaattccgagaaattgcaaaagaaataattaagcaataatgcatattttccccattgagaggtgtgatttgtttcatttatgtctattgtttttaatttgacacctattctgtgatttgacacttatttttgtgatttttgactgccatttatgttttatttttattctcactttttttctttttacaccactgttagagtgcatagcaccttgtggt

SEQ ID NO: 52417 - DNA, 253 bp, Heterodera glycines
  Genomic contig location: Contig_ID=SeqID_21797; Location=378..630; Strand=-
  SCN-specific regions: Sequence locations=1-253
cttatctccattgcatttgattgccacacaccatcacattttattccggtactttgtcgatggatctgcacccattttttggagggggacaactttgcgtcaccactgaattacatttgttggaatccaaattaaaaagtcataaagacatgtttcctgggtgacgagggtggacatacttttgggcaagaaaaagtccgacttgcatcttaaaaattgtttacggccacaatttgccgcaatggcacacatt

SEQ ID NO: 52418 - DNA, 168 bp, Heterodera glycines
  Genomic contig location: Contig_ID=SeqID_21798; Location=203..370; Strand=-
  SCN-specific regions: Sequence locations=1-44,113-142,165-168
atggtgctggaggggacggcggacgaagcgggcggaaacgccgcggaagaggaagaacagcgggaggacggagaagagatggacgaggaagaggaggaagcggaagagaaagtcatcatcccaacaaatggaagagatgaggaaagaaaaagagtgacagaaaagaaa

SEQ ID NO: 52419 - DNA, 367 bp, Heterodera glycines
  Genomic contig location: Contig_ID=SeqID_21798; Location=1045..1411; Strand=-
  SCN-specific regions: Sequence locations=1-139,162-191,214-308,337-344
gagggacagacacataaactgatcaatgggactcatttggccaaatgaagtttaatgagaaaccgactgatcagctggtgaatgctgtgccgggtgatcgttttcccactgtcttttgcgtctttcgctttcataaaatgccaattccctctccccttcccatttctcacatttctgtgctttctttgctgttctttctcatttcacttttttcgctcattcgtttccaatcattccttttttgactcaatgattgatcaaatgtcctttaaatcaatcgaaacattccttccaattttaaatttaaattgttccaattacaaatgaataatatccatctgaattttaaataaatacttaatattta

SEQ ID NO: 52420 - DNA, 1209 bp, Heterodera glycines
  Genomic contig location: Contig_ID=SeqID_21798; Location=518..1726; Strand=+
  SCN-specific regions: Sequence locations=1-26,121-135,157-203,229 -425,447-522,554-558,587-681,704-733,756-1101,1123-1209
atggccaaaaaaagaagcggacgaatgaaaaggaagagaaagaagggaaaaaaggagcaaaatcagagggaagagaaagggggcggtaagaggagggcgagagggggaaaagggaagggacattcggcaaaattaattaatcagcactgataaaagggcgatctgaaaaggcaaaggcattgaaaaacgcaatgaaattggaatgaaaatgattttgattgttccaaattttggcattttttggtgcaagactcttggattggatgtgctttcaatcgccgcacaaattttacttttcttttccgcaatgcatgtgcttcgtcagtgtttatcagtgctgatcggtcagtcacctttcatcctccccccccccctctggtcatatccggatcactttcaccgtcattttcctttttcctctcgccgctccctttgttttccaatggaatgactcccggcattcccccccccctcgcgccggaatttaccacccaaaagggcgacccctcaagaataaactcgtaaaataaatattaagtatttatttaaaattcagatggatattattcatttgtaattggaacaatttaaatttaaaattggaaggaatgtttcgattgatttaaaggacatttgatcaatcattgagtcaaaaaaggaatgattggaaacgaatgagcgaaaaaagtgaaatgagaaagaacagcaaagaaagcacagaaatgtgagaaatgggaaggggagagggaattggcattttatgaaagcgaaagacgcaaaagacagtgggaaaacgatcacccggcacagcattcaccagctgatcagtcggtttctcattaaacttcatttggccaaatgagtcccattgatcagtttatgtgtctgtccctcctttcctttgatctttccccccccccctttttttggtttgtcgtctcttccaaacagtgaattcaaatgaagaaaaaaaataatggcaaggtattttgttcattttatagtccgtttcttccttcaaccaggtgcgtaatatagggtgtacaaagggttaggagaagtgtggaagttgtagtaggcacctttcgggtattttccgtattttgtaaccattgcatgaatagtaatgggatagggagagctcagttatcgccccaggacgactagattggattaagtttaagataagttatgctttattatttgcaa

SEQ ID NO: 52421 - DNA, 59 bp, Heterodera glycines
  Genomic contig location: Contig_ID=SeqID_21799; Location=206..264; Strand=-
  SCN-specific regions: Sequence locations=1-59
aacatttgccttctctagtctggctctaccaaacactcacacgatatttgaaatgctaa

SEQ ID NO: 52422 - DNA, 59 bp, Heterodera glycines
  Genomic contig location: Contig_ID=SeqID_21799; Location=336..394; Strand=-
  SCN-specific regions: Sequence locations=1-59
aacattttccttctctagtctggctctaccaaacactcacacgatatttgaaatgctaa

SEQ ID NO: 52423 - DNA, 59 bp, Heterodera glycines; identical to SEQ ID NO: 52421
  Genomic contig location: Contig_ID=SeqID_21799; Location=466..524; Strand=-
  SCN-specific regions: Sequence locations=1-59

SEQ ID NO: 52424 - DNA, 59 bp, Heterodera glycines; identical to SEQ ID NO: 52422
  Genomic contig location: Contig_ID=SeqID_21799; Location=596..654; Strand=-
  SCN-specific regions: Sequence locations=1-59

SEQ ID NO: 52425 - DNA, 59 bp, Heterodera glycines; identical to SEQ ID NO: 52421
  Genomic contig location: Contig_ID=SeqID_21799; Location=726..784; Strand=-
  SCN-specific regions: Sequence locations=1-59

SEQ ID NO: 52426 - DNA, 59 bp, Heterodera glycines; identical to SEQ ID NO: 52421
  Genomic contig location: Contig_ID=SeqID_21799; Location=856..914; Strand=-
  SCN-specific regions: Sequence locations=1-59

SEQ ID NO: 52427 - DNA, 522 bp, Heterodera glycines
  Genomic contig location: Contig_ID=SeqID_21800; Location=59..580; Strand=+
  SCN-specific regions: Sequence locations=1-5,33-60,146-522
cagagagtggccaaagaattggaagaattagcagggatttgtgagacaattgcagagacaaaagggaaaagggaaagtgcaaagacagaaaaggaagagaagaaaagggatgaaaagtcaacgaaagcgagaaaagtggaagaaacgcagtcaaatttgaaaatggtaaagcggacgacatttgaatggcaggaagtgaaaataattaagcccatttggatgcgaaggcattcggaactagagaaaagtgacgactccttcaccaataagatgccgccgaccgctggcgcattccaaattcaaaatttggcattttcatcagggacgatgaaaaatttgagggaggggaagaaaattggcagcagtgagactggcaagaaaaatggcctaatgagaatttggcgatttgataagtacagtgtgaaagtcgccggacaaatcatagtggaaagtgcgaaatggctcaaaacgtggattttcattaaaattccggataaaattcttttggattatcacatttaa

SEQ ID NO: 52428 - DNA, 349 bp, Heterodera glycines
  Genomic contig location: Contig_ID=SeqID_21800; Location=1381..1729; Strand=+
  SCN-specific regions: Sequence locations=1-17,60-349
atgaaccgacggtaaggaatttaaaaaaaaaaatttaaaaaattacaattttaatttttcccaatttttctcatatttcagttggatttgtactgatgtttggatggacattttcccatctttcgaccgtcctaaacttggtctccaaatggcattgctttctttccgttttgatgttttggtggacaaacattttggtggaaaaagcgaattgacaatttggcgaccaatcgtaattaacaagggcattggaccaaaagcaatgctattagtcgattggaagcctgtggcacttccggaccgtccactgcccaacaaaatccgctttaaagaactttggattctgtaa

SEQ ID NO: 52429 - DNA, 1464 bp, Heterodera glycines
  Genomic contig location: Contig_ID=SeqID_21801; Location=723..2186; Strand=-
  SCN-specific regions: Sequence locations=1-36,62-531,560-565,588 -634,656-877,900-1335,1369-1464
atggcagcacctccgatcgccaacaccgccaagacggatcagcaacagcagcagcagacaacacacaccccacagcacttttatcatcaaaattatttcggaagacagatttctgcgcaagtgggtgacaacagcgtgacctcccaagcgccagcccttttcattccgatgactaagccaaacagcagcagtagcacgacgacagctccccaagttcaagctgtacagcaacagacgacgacgaagcaacctgaatttgttgtatttgagctgtttggacagcagaaacagcagctgaacagcagccacaggcaattgttcaatgttcatcaacagcagcaacaacagaaatttgccaccaaatggacgcccttctcgccattgatgtccctcaattcgcgcgaagcgccgtcgctgtccaacaacatcaagacagaaacgaatgtcgaagaatcatccgcagttgcaccaacttcatcaaatggcatttgctttgccactgtccatctttggcccaaccatccgtcactgggtaacaacaacagcagcagcagtaacattaacattgtcagcagacacagcaagacaccgcagcaacaacggacgaatcgtctgttgttcgataatccgatgttccgtcgtctgccgaattggcacttttttggcgatgatcgtcgacttgtgccaatccctcccctaattccgctgcttccggtgatgcctattgagcgaacattgctttacattgcgccaaatgagagcagttcacgtcagctgctgctgctagccatgttggacatgaagcgaaagaaggaaattgcgggaggaatgcccgccattggggacggtgaagcggactccgaaagtgcagaaacagcagctgtggctgaactgcttcaacaggatgacgaactgttgccggtggaacaggagtgcccgagcagtacatccggcgtggagtcgatgtcctcggcggaagaaagtggtagcgcgttgacagagcgtagctcgcgctccaccacgccgaccaacaaaggcggacggagcacgcccggggaacagcagacagagccgaaatatcagcagaacaatgctcatgcatatgagggtgatgaacggcaggatggcaacgaaatggaagagtatgacgaggaagacgagatgttgaggctgggtcagcagcacaaccacctcctccgccgtcagtcaccgatctcctccgccaccgaatcctgcacgtcaagtacgccgaactcgccgccaacatttgaccggcgcattgttcgcatgagtcgtggcacgagggatgcggtgcgacgactttcgagacgttttgaagaggacagagaggaggaggaagcggaagaagagagtggcaattgtgcagcggaggacgaaagtgatgagcatgaatttggtaaagcaaatgggaggaaggatgaagaaagtgtgtgtgcaaactga

SEQ ID NO: 52430 - DNA, 516 bp, Heterodera glycines
  Genomic contig location: Contig_ID=SeqID_21803; Location=46..561; Strand=+
  SCN-specific regions: Sequence locations=1-516
ggtatttgctgaacccattgaacggggctttgcaactgaacagagcgatccgctggtaatttggatagcgagaaagtcgcaggacaaaggcaatgaaagcggagaaaattcggagaatgggtaggttggcggacttctgttgtttgatgcatggtctttgttttgtgccggttttcagcgcgatttccatggctgatgagcttcttccgccgtacaatttcaccgccaacattctcagtcccggcaaagtgcgtctcgagtggagaacgcctccgctgccctcgccttcgtccgtccctttttacattgtgaatgtccgtcagctaagtgccaatacaggcgatcgcttccctccccaacaggtggacatttacttggcatttccttggcgtttgccgcatttccttggcatttcgtctaatcttcgttttttccttttcgcttcgcgtcgatggcactcattttttgctcggcaatttggtcgctggagaaaactttgagttcacaattcggacc

SEQ ID NO: 52431 - DNA, 893 bp, Heterodera glycines
  Genomic contig location: Contig_ID=SeqID_21804; Location=393..1285; Strand=-
  SCN-specific regions: Sequence locations=1-241,281-284,552-554,576 -844,866-866,888-893
atggtgattagaagaggtacaactgtgattagaagagggacaactgtgatcagaagaggtacaacggtgattaggagaggtacaacagtgattaggagaggtacaactgtgattagaagaggtacaacagtgattagaagaggtgcaaaattgttaaaagaggtaaaaaagtgattagatgaggtacaaccactgtcgaaaaggtacaataattgttggaatggtacaataatggttaaaaagggtacaatcatggttttaaaattaaataattaaggaaatcgtttattaaaaagtaagattaaatattgaatgtaattaataaattttaaaaaataaaataaattattccttttattaattaaaaagaaagtttgaaatgtacaaggattgaatattaattaaattgaaattaattttacaaattctaatttaaaaaatacaggagttctttaataaaagtaaataaattattattttaatttaaaacatttttcacaaaaaaacaatttaatttaaattaaaaaattttatttttattaagaaaaaaacactcttttaaatgaattaaaacattaaaaataacccaaaaatacatagaaaataatatacaccgcgcggattcgaacttcgcccccccccccaaaaaaaatgatgcctcagaatccccaatcacacagggattctaaggtcttaacgatgtcagaagtaaaatctgatcacgcattcgtgatcagcaacccaaataacgcctaaagacatcttttttgaaggtttttgatgaaaaaattttttcactcaaaaatcctggtcacccccttgtggtcccgaacaccaaaatcacttttatttttgtatctatttttaaaaatgtgataaaaaagtgaaataaa

SEQ ID NO: 52432 - DNA, 162 bp, Heterodera glycines
  Genomic contig location: Contig_ID=SeqID_21806; Location=80..241; Strand=+
  SCN-specific regions: Sequence locations=1-162
gaaggaaattcgaacgtgcacgcggtcgccgaaagtctcgcggttacaagaactgaggaattcctgtttcgctttgttgagtatattcccttgtcatgttacctttttgttatggaaatgaaatctttcttatccataatcaaagaaaaaaattgttgattt

SEQ ID NO: 52433 - DNA, 154 bp, Heterodera glycines
  Genomic contig location: Contig_ID=SeqID_3916; Location=509..662; Strand=-
  SCN-specific regions: Sequence locations=1-83,146-154
atgaatattgttgtggtcattaaaactgaaggaaatggtattataaagtctaattttcattaataaatcaattttagaaaagcattattataattttatttattataaaaatatattatttaaggtagcccataaatatattaatatcaataaa

SEQ ID NO: 52434 - DNA, 564 bp, Heterodera glycines
  Genomic contig location: Contig_ID=SeqID_3916; Location=3495..4058; Strand=-
  SCN-specific regions: Sequence locations=1-102,160-300,323-392,436 -510,536-564
atgatagtatcttttttgacccagctaaaaacatacctgaggaaacatacaataagtgagtttattgagcaaaagttaaaaaaagtaattaaaacctaaagcaataaaatattaaatataaaaaataaaatattcagaaatctttattttttaaaaatagaaccaaggatgaaggcttggatatgaaacaaggtggatcaattggacggaattaactttccttaatcatacatttaaaaaatgattgactataatttttgggtattataattcctattttaaaactaataactattcgaatttttgtaaaaattctttctctaaagaaataatttgtaaattttatgtagctaagaattttttgatcaaataccgataaaaatgacaacctgaataatttttctttaatatattcctttttcatatatttttatttctttagtatccgtataccattgcaatgagccccactagtttgtgtccgcccattgtgttatttcttacaatttgtagaatttattacttatattaattattaacttaagttttaaccaaaaaaataaa

SEQ ID NO: 52435 - DNA, 1185 bp, Heterodera glycines
  Genomic contig location: Contig_ID=SeqID_21807; Location=1309..2493; Strand=-
  SCN-specific regions: Sequence locations=1-174,218-219,332-419,448 -463,485-1185
atgatggaacgcctccgaggcggtgtgccggaggcaacgacggcaaaatttgtgccaccgtcggcaccggcggcactacaacaacaacaacaacattttgctgacaacaacacccataataacaacggcacggtggtgttggcccagcaacagcaggtaacaaatgattttcggttatttaaatttttctttatctaattttactaaaaattaaattggattttgattttaatttatacattatttttaatttatattttgcagaaattaattttgcattttgcattttgaatttaaattttatttattttttaattcattttaatatttaaaatttttggaagtgcaaattgatgtgtaatttattttataattcaaatttttcaggtgcccctcaattttggaagtctttcaaatttgtcctcttcctcctcatcttcttcttccgctcctccatcatcatcagctccaccacaacaacaaattaagactgaattgatcaaaaaatcatcttccgaaaatgccacagccgacgaatgtgagggtgggtaaaatgccaagcattgattggcaagcctttgaaattttataaaaattttgataggcctacctaatattttgtaattcaaaaaaatcaacttttctgattccgctgcgggattggaattcaaaatttagcagatgggatctcccgcaaggactaattccaaaaaatccctattttcaaaaaaatgcgggattggggattgagatcccgcaaatcccgcgcggggtcccgtcccacatcgggctctaaatcaatcactaaatttagggaattttaaacaaaatattttagttgaaatacaataataatcatcagagatttacagtaattggaacgatgcgaaatttttccaattttttagcacaacaaacacaatttgtgccaacaccatcaacaacagctgatgagctgatcggccacgcgttggcacatctcgtggaacaaatggacaccgacggcaccgatgcgacggatgacggccacttccaggaaggtgagaattgccaaaaacagtgcgagggcgattcctcaatttccccagcagaaccctcctaattagtgtctaattaacggataaatcggaattgctaatgccgaagccttaaaattgccagattcattaatttgcagccacctaa

SEQ ID NO: 52436 - DNA, 297 bp, Heterodera glycines
  Genomic contig location: Contig_ID=SeqID_21808; Location=143..439; Strand=-
  SCN-specific regions: Sequence locations=1-103,128-297
atgcataaatcacttattctgactactgttcagaataaaagtatcgtagatgaagtgagaaaagaagtggacgaaatcacaggattagcaagataaaaatgcgaataaaataaaatcaggtttaaagtaaaactgcggtagacggcataaaataaaaatattttcacgtaattcatattttagaaaataggggtgggtgtattatttctcccgaaatccaggacaatttatcagaagctgaagctcaaaaaactcgatgtttccgaagctcgaagccgaagtttcgtccatccctga

SEQ ID NO: 52437 - DNA, 1151 bp, Heterodera glycines
  Genomic contig location: Contig_ID=SeqID_21809; Location=17..1167; Strand=+
  SCN-specific regions: Sequence locations=1-488,510-551,581-930,955 -1151
atgggtatttgtctaagccttcaactatatattgtccatgaacaacagtgagtgaacattattattttttcatttgttaagcatatcgataatgatgataaatgcgggaattcaaaaaaatgcgactgtttttgatttataatactgaaaaaagggcgtgaatgaccttagtatttattagtaaaatttagcgaaaaaccaaaatttttaattttataggccatttttataaactcttttaaatctgatccttttttgatgggaagcttaaaataaaccgtctttatagcgcgtgcaatttaaaactgtccaaaggcacattagtgttcttacatggtgcgaaaaagacaaaaaaaagggaagcgaacaattaaaaatatagaagaataccgtaataaatagaccaaagtttataattctatttaagtctagttttttttcttttcgaacattgatttgaaatatttttttgttctaaatgattaaaaaattacaacacaaagcctcaaagatcaaacattatgagaggggtgtcaaaagccaattgcttataatctcatttattaaattttaatttgtactttcaatttatgaataaaagggtcatgtgtttgtttcaaaaatatacgattaatataaattcccattacagcaaattcatgggcattggtacggcaccatggattgcattcctccaaaattgagttgaacccgaacacagattaaaaatgcgacactgagaaaatatgacacaaattttgtttttttaataatagattgatttttgtttctatacagcgtcaggaaattggccaatccttagcaaaaaaaaaattttgtattgtgcctaacaaaggagaggtacccaagtgacgctggaacttccgaatgaaacttacagggtaggtagattaccccccccccactttgtattataaaattttttttatttttgctaaatgaagcttctggccgagatatgaagctttttctttttgatatattaatacctttacaaagaatgaagagccaatgtgagcgtcggtggcctagtggttatgccttccattctttttttcttcttctgaagttcaattcccccaccctgcaaataattgttttggttcttttccctatccaaaatattttta

SEQ ID NO: 52438 - DNA, 214 bp, Heterodera glycines
  Genomic contig location: Contig_ID=SeqID_21810; Location=436..649; Strand=+
  SCN-specific regions: Sequence locations=1-214
gtttgactaacttccgttcgttccgttggaatgtttaaattcgtccactttttctgctcattggccacttttcccctgctgatctctgccatttgtaagtcctttcgccccctttgccctttaaagtccaattttcccctaattagcttccaattgcttttacttgccacacattgtgctgaacggcggcacttatgacgagttcaatgcttct

SEQ ID NO: 52439 - DNA, 1348 bp, Heterodera glycines
  Genomic contig location: Contig_ID=SeqID_21811; Location=218..1565; Strand=+
  SCN-specific regions: Sequence locations=1-687,773-1348
atggtacaatacgaccctataaataaaccagtgaagaatattattacagaaaagttcaacattttttttaatttattaaggttttttggtaacaaaaccagggttgcctactgaaaattgagtgcaatttgtaaaaggttttcatccaatttttttttttcaaaaatgagcataaatcagcaaagtttctcaaaaaacagctataacggctgatcgaaaatagctgtgcgagctgaagcaaaaggggctaaaatgaaggaaagattgccccaaaacaacattcatccctcccgagtggtggatgtggtctagtggctaagacaacggatccacacgtaaggggccccgatcaaatccggccttccaccccaattttataatagcagcaaagcagaatttggagccctgattatgatgatgaacatggaaaggatttataaaactccaactgaaatcatttgaccaaatatttggataaaaatgggaagaaaaggaagaagaacatttgaatgaaaaaaagaaaatgattaaaaaatattgtaatataaaagagaaaattctgcaaaaacaagaaaatacggagcaaaaaatggagaaaaattgaaagaaaaattggaagaaaactggggtcaaagcaccattatatttataagtggattaaaaaatggaattaaatcaaaacgccaaaaagatacaaataaaaaattgaaattatacaaaaaaagataaaaataaaaaggcataaaattaaaaattattaagaaaaattaaattttaggggtaaatattgatgattttttggcgttgtctgccccccctttcattgacggcatttctttcgcatgtccaactttttgtcgaccgttccaaagttgtggagatggcgtcgctgcactcgcatttcgtccaatctttggctgtcgtggactttgcgcgacgactcaagtgaatttgctgccgatgggcattaactgttagcaattgaattgggttcattgacagctctgaacagcgttgttcggtccgtgatcagctgatgttctgtttggtgccaattgtgcctcaaatggttgaaattgccggtcctttttttgcatttatttttgttaatttgcttctccaattcctttcagactgttctcgtcgtcaaattggcatgctgatgtgcgaagttctgttctcccttttcgatttcccttctccgcctcaatttgactacgccgagaccgacccaatgctaagagagtttcgagcggcgcttcaaaatcatccatatcaaaatagcacagaatctaatgatgaagatgtgctcctagagaataccttctgtaacgtattgaccatttaa

SEQ ID NO: 52440 - DNA, 857 bp, Heterodera glycines
  Genomic contig location: Contig_ID=SeqID_21812; Location=101..957; Strand=+
  SCN-specific regions: Sequence locations=1-210,232-506,529-560,613 -661,704-857
atgacatttaacaaagcaattgccctgactgtttacaaccttttgccaccggtatggagttttagggcccttttatagaagtttgtgccattctttgaggcgaggtactccctcactggctactcgatccatgttgagcctccagaaatgcagaggaagaaaaaatgaaaaatacgactagcccgtataattgaatttatatttctgattattatttttaacgcctccttccctttttgaaggcaaaaccaaaattgacgtaaaaatcaaacttaaaaaatttctgttgggaaaaaaccaatttttcatttctttgttttttttaaagtttccgaatcgtcattttttgctcttgtttcgtttttaatgaaagttttccaaaatgaaaatttaaattttaaaacttgaaaacgaaaaagaaacaaaaattttttcttggacgaaaaagaaacacaaaaacaaaaagataccgttttcatacgaaaaaaacgaaaaacacgaaaatttcgcacaatttatcatttatttaatgtctttgttttgtaaatcatttctttaagtattttttgaattataatgttatttaaaatttttttaaatgaataaaaaattgcttcagcaaagctatttaaatcatggtttatacggcttgcttaaggccttaatattaaacataaatttaaaaagaattatttaaaaattagccattttttgttttaaatttttgcacaaatatattttttcatttatgggcagaaagtgcaaaaaaagggcatgatttccagcattctatctccgatcaaaaaaaaatcatacccatacgaaaatttcaatacaggtcttttttgcagtcaata

SEQ ID NO: 52441 - DNA, 554 bp, Heterodera glycines
  Genomic contig location: Contig_ID=SeqID_21812; Location=1573..2126; Strand=-
  SCN-specific regions: Sequence locations=1-133,158-554
gagaagggtcgtccgacatgataatggaagaaatacccttaggcaattgcctctgtttttggacctccaaaccggtgcacttatacggaaaacggacggaaaagtatttgcgtgtgaaatggcaaaagaacgtgaaaaggcaaaaaccacagagcaagatccgaacttggaattatgtttacaaaaacataaagatgttttttccacccatgattatgacctcggggaatgtttaattaaatgccctcccattttgacaaattcaaatgtgccagagcgggtcaaaccatatcccgtaccggaaaaatacgagaaagagctgaaattgcacattgggaaaatgctcgaagccggcgtaattaaagagagttgtacgccatgggcccacaacgttgtgttagttaaaaaatcgaatggccaattgcgcccatgcgtggattttagaccattaaataaaataacaattccggatccgtatcccattccacgaatggacaaaacaattttaagagtttccggacaaaaatattactcgacattggatttgttgtcgg

SEQ ID NO: 52442 - DNA, 1213 bp, Heterodera glycines
  Genomic contig location: Contig_ID=SeqID_21814; Location=322..1534; Strand=-
  SCN-specific regions: Sequence locations=1-65,87-187,211-219,241 -331,354-407,429-493,526-689,712-923,945-956,1010-1042,1071-1213
atgaatataattttgcatttgttaattttaaactctgccgttgatttgctcaattcgaataatttagaacaaacgaaaattttaattggtaagtaaataatgagcaactttcagttttttttaattattagtcaattaatttttagaactgatcaacacaggcaaatgcaccgaaaaaaccgagttcaaaaaaaatataataaaaaatttcatcgattcgaatttataaatatattcaggcaaattgaagaatttgttcttgaaaagggatgcgaaatattcaaaaatgaccaacaaaccgactacccaagcgaactcggccaaattaatgcaaattttgaaaaattatgcattcttaaaaatgaacgtaatgccaagaatgaaaatcttctcaaaattaaatccgtattcattgaaagctttgaattgaattttcagcaatttttggccaaattgaagaaagaagagggacaaattcaaaatttcttgtcagagaaaaatgacaataaaagaaaaattttaaaagcaattgtcaatttttttgatgaaatttcaaaaatattgacggaattttcatcaaagaatggtaaatttgctgaaaaagattatcgaatgctaagccaactaattgaaacgcttctcgacaaattatcaaccattaacaaaaatggttggaataatgtagagaaaaatagcaaaaatttatttaaacaattcgaaactccaaaaatttttgcaaaagcacatcaaaaaagacgcgttcgtcgtcgtgacaacgaaggcataatgccaattggtgtgattgaagtgttcttattgttgacaacgtattgtgcaatcactgtactgccactgatcacagcaattctgttgctgatcagactcttttttatgtttcggaatgaaaagatgaattaatgaagagaaaaattgaaattcgatttacactcatcaattgatatttatttgttagtgataatttgcaacaataattaaaaaatacatataatttttcaaaatgcgaacaatgacaaaaatcatctttacaatttatttatttaaatgcttaagtaattaaaatgatctccaattcattttgcaaaaaatggaatttgtcgtggtactcttacccaggaataatttttagagaatttaaacccattaatactttcataggataattttattattacatgcacgacttcttaataaa

SEQ ID NO: 52443 - DNA, 1308 bp, Heterodera glycines
  misc_feature (1232)..(1232): n is a, c, g, or t
  Genomic contig location: Contig_ID=SeqID_21816; Location=102..1409; Strand=+
  SCN-specific regions: Sequence locations=1-71,95-794,830-1308
atggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactcaattgccaaaaatactgacgcggcaattgaagagtttttctttggcgatgatgatttgaatttgcctccagggcaaccaaatcttcgtccacagccaaaagcccctccgccacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaagtcatatgcgggaatacttgtccacggataagccccttgacgaccgcccactggacatcgatgagatcgagtccgaagtggctgcgttgaaccngcgcacagactcgggcatgccccacacagtctccggcttaagtcggatgcgtcgtcgtcctcttatcataaagtga

SEQ ID NO: 52444 - DNA, 1232 bp, Heterodera glycines
  Genomic contig location: Contig_ID=SeqID_3918; Location=212..1443; Strand=+
  SCN-specific regions: Sequence locations=1-26,70-519,555-798,820 -1045,1068-1232
atggttagtgctctatttcaaaggggatatattttttattaatgattatagattatttatttattttttctccttccatgctgtacggacgggcatttagcagaaattttactaattaaccacaaaatttattgtttattttttcggaattagagaatggcattaaacccaaatttgattacacgcggacttaagcattcttaaaagtctataatttaagccaagcggtccgccacttttgaattatgtgtgtaagtcaaatgggaacagtgaaagaaggcacatttcgtttcttaaccaatttgatttgcaaattgtgccgacaattccaaaagatgacgacagcatttattacgtggagacacaatgccataataagggaaatgaacatcaaacattcaaatcggtgacaagtggcagcattaaaattgttttgcacaaatttgcttgtaaatcgtacgacattatggcacgaaaagtgccgaaaaattggacccagcaaattgaattggtaatgtgatttatataaaattaaaaatttataaaaaaaaatagaggcaatcgcaagatttcttaattgcatttatatttttcgaaatttaattgactgatttttataattatgctaatttaataatttgttcttttgctttaaagtataaatatgcaattcgtcaaataaaagatgccaccgaattaaatgtcaatattgataatggatatgtgtacatttttgattatgaaacactggtccggacaaaccgcagatggagaaacgctgggccttcatcggtaatctttaatgtttattttaataaaatttcgttctgctatccattaacgaaagcggttttaataactcttaattgttctaatttggtaaccttgaaaagttggtatttgcgttaatttttctttatgatttttttttcgtttttgtaaaattttgcctattttaagaatgtcaatctttttgatttgaacgtggaagattatgttgcatcagattatgataaaatggaagaggaagacagaaaagaaacggaattaaataaagcaagaatggatgaaacggatgatgattgtttttactatttcaattaaatttgtatctttttcatgccttttctaaatgaataattttaggataaaatggtaaaaaaaatttaatctttggttaatatttttttttactaaaagcattggtcacattcacaaaaaaaaattgacaa

SEQ ID NO: 52445 - DNA, 83 bp, Heterodera glycines
  Genomic contig location: Contig_ID=SeqID_3918; Location=1..83; Strand=-
  SCN-specific regions: Sequence locations=1-83
agagcattttctgaaaaaatatttatgaaataaaaaaatcgatagtttcaagtgtccgtttggggtactcaaactaattatgg

SEQ ID NO: 52446 - DNA, 413 bp, Heterodera glycines
  Genomic contig location: Contig_ID=SeqID_3918; Location=1797..2209; Strand=+
  SCN-specific regions: Sequence locations=1-18,42-413
atggaaaactccaatcaggaaataaagacaaagcgaaacaagcagaagctggaacatgagggtgcactttatgttcttcaccaactcagtgacgatggacttcggaagtactggcgatgcgagtttttcgggcctaacgataaatgcaaaggtgtatgcaaaaataaaataaagactatttttcaaatttagggcgccttcacactgatattcatggtaatgtcctcaaaataattggaagccacacatgcgacatgagcgccgcacaagtggagtgtcagcgacgtgtgacccagctcaagcgacgtgcagttgagacgtgcgaagcgccggctactattcgtgcgcaagtattgcataacacagcaacccccgtgttggcagcttttccgaccaaagctgcgacaaaaaag

SEQ ID NO: 52447 - DNA, 4133 bp, Heterodera glycines
  Genomic contig location: Contig_ID=SeqID_3919; Location=560..4692; Strand=+
  SCN-specific regions: Sequence locations=1-1271,1294-1422,1444 -2039,2062-2600,2623-2836,2858-3149,3171-3265,3289-4133
atggccaaccaaaacgcgacaattcaacaattgattgacacattgacgcaacagcaacaattggttcagcaattgctgacacatcaaacgcagaatttggctggacaagcaattgcgcccacaacaattccggcacttcccgacatcatggcttttgagcagaatgatgataaaagccgagtatcggaatggatctcgcgcttcaaatttgcacttgactgtgccgcgccgaatgccgccgacggaatcaaggttaaggcgctcatgaacaagcttagtgaagcagcgttcagtgagtacagccgttcggtgctgccgtcagcagtgactgattttaattttgatgcgacagtgcaaagaatggaaaagttatttgcgcgtccgcaatcggtcttcattgatcgatatgagtgcttgaaagcggtgagaagtgaaggcgaagattttcgcagcttcatcaaccgacaccgaaaattgctcgccgatttcaagttcagtgaactgaacaaagagcaattcaattgcctaatgctattaactgcattaaaatcgcacagcgattcggctcttcgtcaaaggattttggcgaagctgtcagcggacggaacaaacatcacttacgacggagttgtggaagacctgattaatttccaggcaacaattgtggaggcaaaagcaattgaagcaccgacaaattggaggaatgtgaatgccgtaaatcggccggtgaagcaaaacaacgcgccgaaaatgcaagttgccaaagtgccagagaatcggcaggcgaataagaattgctggcgttgtggagctaccgatcattggggcagcgagtgccgattcattggagcgaaatgccgaaagtgcaaattcacaggtcacattgaaaggcaatgtgaaagtgtgcagcaatggcgtttgaagaacaaaggcaagaggtttggcaacaaaagaattggccaattacaaatcggtatggtaaatccgaaaaatgacaccgattcgctgaagacgaaaattcggttcaacaaaaagccgattcaatttgcactagacactggatcggatgtgaacgtcattgatgttgactcacatgtggaggctgggagcccaccgatcgaaaagtgcactgaaattggaagagctttcgatggaacgccgattcgattcatcggaaaaggctttggcacatttgaatttggaggaattttgatcgagaatgaaccattttatgtggcaaagcgtggatcgcttaatttgttgagccgccaaacaatgggaaaatttggatttttggatggtattaagcagcggatcagcgaacatgggatcaattcatgcagagccaccaaccaatttgagaagcacatttcggaattgaggaaagaattcccgactgttttcgaagatgcacttggacattacatcaaagaaaaagcgcacctcgaattgaaaggaggagccgcgccaatttacagaaaggccagaccggtgccacatcactcaaaagacgtcatcgaacgtgaattggaccggctggagggcctcggaatcattcgaaaagtcgaacatttggattgggccgcaccaattttggtagtgaaaaaggcggatggaagtgcccgcctctgcatcgattattcaacggggttgaatgatgcattaatcgactaccagcacccgctcccaattccggaggacattttcgcgacgttaaatggaggacaattcttttcgcagattgacctcaaagacgcgtacttccaggtggaattggatgaggactcgaagaaattgtgcggactttcaacacacaaaggcaatttcgccatggaacgtttaccgttcggcgtaaaatcggcgccaagcatttttcagtctattatggacaaaatgctcgcaggcttaaattttgccacggcttatttggacgatattatcgtcgccagccgatcattctccgatcacatccagcatttgaaagatgtgttcaaccggctgcagtcatacggattccgtgtcaaaatgacgaagtgctcatttttccaggaggaaattaagtaccttggattcgtcatcgacaaaaacggacgcaggccggacgcatcaaagattaaggcaattactgaaatgcctgcgccaacgaatctttctacattgcggtcctttctgggaatggtaaaccattaccagcaatttgtgcaaaacatgcggttcgtcagaaaaccgctcgacgatttgctaaagaaggacgcagaatggatttgggccgaaaattgtcgtaaagcatttgataaattgaaggagattttgacttcaaatttgctgctgactcattacgacccgaatttggagatcatcgtttcggccgatgcatcagaacacgggatcggagcagttattgcacatcgttttcctgatggagcgatcaaggccatcgcacatgcatccaaatccctcaatgctgctgagaaaaattatgcccagattgagaaggaaggattggcattaatttttgcggtgcaaaaatttcataaaatgatttatggccgtaaatttgtccttcaaacggaccataaaccactcctggccatttttggaaacaaaaaggggatcaggcagtgcagcgccaatcgattaattcgttggtcgctgatactattggcctatgattttgaaatcgaatatttgaataccaaagattttggccacgcggatgccctttcaagattgatcgcgaaaggatccgacgacgaagatgagcgagtgatcgcttccgtcacagaagagtcggaaatggaagaccttctaaaattggccactaaaaatttgccgattaaatttcatgatttggttttggcaaccaaaaacgatgctttgctgaaaaaggtcgttcaatttgtgcaaaaaggctggccaaacgacaaagatttgagcaaagaagaggaaattgtccgattatttcaccgacggatggctgatttgtcaatcctcaaggattgtttgatgtatggcgaaagagtggtgatcccgaagattttccaaagcaaaattcttcacctctttcacaaaggccatccaggaatgaagagaatgaagcaattggcgcgtcagtatgtattttggccaaagatggaccaaaacatcgaacaatttgtgcaaaattgcgagccttgccaagctgcggcaaaggcgccggtcaaatcgaaccttcattcgtggccaaagtcaacagaaccctggcaaagaattcacatcgactacgccgggccattttatggaaaaatgttcctaattgtggtggattcgttctcaaagtatccagaagtatttgagatgaccacgtcttcggccacggcaacaattgacaaattgagatatttgttcacgcgccacggcattcctgaaacaattgtttcagacaatggaactcaattttcgagttcagaatttgccaaatttacagcagccaacggcatcacccatctcttttctgccccgtataatccgatgtcaaacggacaggcagaaagatttgtggacacatttaagcgggctttccgaaaattgaaaggggaaggaatgccgaatcaggagatcatcgaaacttttctgatcacctacaggacaactccgaacgattcgcttccaaattcggtgtccccagctgaaatgctgcttggacgaaagcccaggactacatttgatttgttgaagccgccgccatttcgaccactgatcagggatttggcgatggaagagagattcaacaaacgatttggcaccaaatcacggaaatttgaaattggtgataagatctttgcgaggcatcgatcttctgaagattggagacccggagtcatcaagggatgctctggcgtcatatttgaagtgaaattcatggacggatcaaagtcgcgattccatgcgaatcagctgcgaaaccgacaaaatatgaacaatggcgatgaagcattggcgatcttgaatgatgcctttgcattgccattgccacctgcacaggctaatgaggtgccagcagcagacccgccggcagatgaccacgaaggcaatggactcgaagaccaaggcattgtgcgatcgccactgatcgcggaccgaaatcagcgccg

SEQ ID NO: 52448 - DNA, 100 bp, Heterodera glycines
  Genomic contig location: Contig_ID=SeqID_3919; Location=172..271; Strand=+
  SCN-specific regions: Sequence locations=1-22,44-100
ttgtctcctccgccgtcctccgacatatttatttgttattttaatttgtcttcaataaatatttatttgttcgtccattcgacatttcggggaccgaaca

SEQ ID NO: 52449 - DNA, 63 bp, Heterodera glycines
  Genomic contig location: Contig_ID=SeqID_21817; Location=732..794; Strand=+
  SCN-specific regions: Sequence locations=1-40,62-63
tttgggccccggggtcatttgggccccaacccaaaaattgaaaaatgtgcttttttaaaaatt

SEQ ID NO: 52450 - DNA, 1961 bp, Heterodera glycines
  Genomic contig location: Contig_ID=SeqID_21818; Location=305..2265; Strand=-
  SCN-specific regions: Sequence locations=1-130,152-299,334-410,448 -521,551-646,668-717,757-1360,1555-1577,1615-1634,1656-1661,1774-1961
  Gene Ontology: Mol. function=structural constituent of muscle; Cellular component=striated muscle thick filament; Biological process=striated muscle contraction
acttatccaagaactgcaagcgaccaaatctcgtttgcaaactgaagcaagtgaccaagaaaggcagagtgaggtgaaaacatttctaatgtacaataatgatcaatacaaaaaagattaattaccataaatttaaaaaatgtttccattttaggaattggaaagccaattaaatcaaatgggcaaacgtaaggcgcaggcattggcacagcttgaagacgcgaagagaattctggaggaggagcaccaagaacgaatggaggtccgtccggtgtaaaaacataatatgcaccgttgggaaaaatttttaaaattttaattaatatttttttaggttttaacaatgttttcaatatttatttagatttttaatttccaactggagcattttgggtccacataattggatatttttggtcaaatatgttaaaaatttctccaaatttttaaatttttgccctaattttgcttctaaacgcctgtggcatttttggaaaattcttgtttaaaaattcccgaacatttttataaattaaaataatcattttttctttataggtcagtgccaatgtgaaagcgttggagcatgacattgagcaaatccgtgaagcaattgacgaggaagtgcagggcaaagaggaactgctcaagcagctcagcaaagccaaggcggaggcggcacaatggcgaggcaaattcgaaggtgccgaccgaaactattaattaactaattaataatatttatgattaattaatctgttccatgtgtcaaacttaattttgacctcccgccccacgctttaagcaatttataattttcgtaagcaaattttaattaaaattgaagcattttcccctctcggcgccagtccggtacgcctgactacaaaattccctggaatttttcataatttgacctaaaagtggttaacttctggcgaaaaactgctaaaaatattactttcggaatcctaaaaaatatttaggggtagtggagcaaaaaaaaaaagtctttggcttccagcaatcctaaattttctctgcctttcggcgccgccggttcaattctcgaattaattaactaattaaaacccattgaattttcaaaatttgacccttcaaaatttctcaaattaatcattttttgcgcgaaattacaaaatgaaaaaaaacattttttataagaagcttaggtatgtgaaaaattacatattcctctaggagaaggccttgttgctgttgatgaattggaagaagaacgccgtcgtcggatgaaccgaaagttggaaatcagtgaccaccttgctgaactgaactccaaaattgcagctgtcgagaaaacaaattcaaaagtgaattcattaaaaaataaaataaattatttagataataaatctttatattaattcattgttgtaataatcaattaaaattttttattaatcaattacatgctaattaaacaaatgcattttgtaaattcgtttattataaaatgaaaaattttttaaatatttaaattatttatttaaatactttgtaataatataattacggtttttattaactaattactttctgcttaaaacaatgcattttgtgaattcattaattcagtcatatgaattaaggacaaattataatttgtgttttttcatgggttatttaaaatatatttttttaaatattatttataaattaatttttaattaattgtatttaaaaataattatttccttcttaaatcaatttttttatcttaattttaaatttgattaaagttgttggccgacgcggaagaggcgcgtgcggaagcggagcgtgcgcaaacccaaatcttgcagtggcagaagaagcaggagacgcacgagcgcgtgctggacgactggcggcgccaatgcgacgatttgagcgcgcaaattgagcgcacgcaggaggactgccgccgcagtaccgctgat

SEQ ID NO: 52451 - DNA, 358 bp, Heterodera glycines
  Genomic contig location: Contig_ID=SeqID_21820; Location=1229..1586; Strand=-
  SCN-specific regions: Sequence locations=1-113,135-358
atgactataaaaacagaaaaacaatcgaattcaattcaaaaagcaaaaagaatatgcccaggcagtgattggatgagctcaaaacaaggaaagtatgaaatcctaaaataattcaaaaaatggtggaaaaagaaaggcattatgattattattattattagggatatttttttaggcaaatgcctaaaatttctgcgcacttgatactcacagataagcacgggaaacgcattttccgcttggtttcggatgtctacgatgacttttataatgcctatttttgcctatttcgaggtttttgtgcataatgtgcctatttgcaggattttcgaaaaatccttaacaaaaaagcaataaa

SEQ ID NO: 52452 - DNA, 116 bp, Heterodera glycines
  Genomic contig location: Contig_ID=SeqID_21820; Location=1582..1697; Strand=-
  SCN-specific regions: Sequence locations=1-116
aaaaggccgtgcgcggaattaccaccacccattcgttatttgtgcttcgtatctcatcatttattttgctttgattattcgctttgctctcttaattttatttaaatggccatgac

SEQ ID NO: 52453 - DNA, 402 bp, Heterodera glycines
  Genomic contig location: Contig_ID=SeqID_21821; Location=1784..2185; Strand=-
  SCN-specific regions: Sequence locations=1-68,90-120,151-224,246-402
atgcaaatggtgccatttgaatttcttaacgaatggacaaaggaaaagctgacaatgaccaaagcaaatgaaaatgaattggacaacagttggataatgaaacgatgcaaaattattggggagaaaaaggagaagcagcagcaaaagaaagatgataattgggacaacaattgtaacaatgtgtccatttggttttttaatgccaatgattgcattgggtgagcaattaaaaaaggcatttaattttgtttaaataattcaaatttcgcttaattaaggccattgtctccgccaccattcgcagaagaatccggacaaagcatcacaaaagggccgtcttctgctgacaaaatgagtgatgtgcaaaacaacaaaatcaatgatcagatgcagaagaaatga

SEQ ID NO: 52454 - DNA, 723 bp, Heterodera glycines
  Genomic contig location: Contig_ID=SeqID_21825; Location=512..1234; Strand=+
  SCN-specific regions: Sequence locations=1-432,455-476,499-593,616-723
atgatagtggacaaaaagagttttaaaagtaacatattatgccgaatactgcttttggaagtgacagttcagaatgttcccttgtaagtggtcaaacgatgatgcactcgctctagaccgtgtgtccaaaaccctaaacctaacagggctgggcgtaactggattttaattatggaaaatcgtaacccgtaattacgtagttttttaaataacggaaatacaatactcgttattatgggaggaggggggtcgaaaagtgccgtaattagggaatctcggaccatcaaaaccaaagacatttcccactctcgattcgcgtatcaccacaaatacacctaaataggaaaacagttcgatttacctcattttgattaaccagtgcttcgacctccttcctgttgtggtagcaaccagaaaaatcatacaaatatcgttgaacttttttggtgccattggcatatacagacagtaacaccaaactttcggcaattaatctcagcctcacaataatccgggaagaacggcacagttttaacgcatttgctctaaatttggaaagaatttgcaaaagtgagtgtcatcgttttaggttccaaaacctaaagcccaaaaaatgaaccgtattttgtattttgtttggtgccaaaacataaaaaaatgcctaaaaagcgaaccgttttttttgcaaattatcaatcaaacaattttaatatttttagataa

SEQ ID NO: 52455 - DNA, 211 bp, Heterodera glycines
  Genomic contig location: Contig_ID=SeqID_3921; Location=1..211; Strand=-
  SCN-specific regions: Sequence locations=1-63,85-211
tttgtgcgaccaaatcgacgcattggcacgggaagcggaggaattgaggcagaaattggagcaggaaaggcacaaactgaacgacatcccaagtgaacgaccattaggcaaggcaaaagcagacggaaaacttccttttagtacaacaagcagcagaacggttggaacttctgtcccaatagccatcaaacagcggagagtgctaaagggc

SEQ ID NO: 52456 - DNA, 1861 bp, Heterodera glycines
  misc_feature (863)..(863): n is a, c, g, or t
  Genomic contig location: Contig_ID=SeqID_3921; Location=1259..3119; Strand=-
  SCN-specific regions: Sequence locations=1-195,218-564,593-594,616 -921,943-1436,1587-1645,1724-1830,1852-1861
cctctagagtcattgccgccacagatatgtacgaagtctgttttaagtttctggttttgatgatggtgaataccacttactgcatccggcacctcccggtccgtttgtttgaatgctcggcggaacgcttgggggtgaagcgccgcctgggggaatgccaggggcatttccactgggaccagtgccagaaacagcttaaataacaaagaaactatttggaagtgcaaagattcgttcttacgcgccgagggtgcaacaccgacgggcgcattcgctttgggtgcgctttctgcgcccgcgtagccggcgtcacggcgggcgcggacgcgcaacttcttgcccaacttcatcatgtccacccaaaggtcgtcagtttcggcacggaacccagcgatttgttggtccaactcttgccaaatttgttgaacatcgctgtaaatgttggcgatcagtacaagagaggcgagcagggaaatgcccgagacggaggaggcgaggaaagtggcggtgtacactttcattacgccgagggaattctctttgtcctaagtcaaaattattgtttttaattggccaattaaaaaactggaacaaaatttgttgaaatgaaattaatgctggcagaaggaaaagtcaattgcgatttatgcataataaaaattgcgaacattcgcaacaacggagtcccttttgtgggagatcagtcaaatgcttctgcttttaacgagtcaaagaaagccgaccgatcaaagagcgaccgatcagtcggtcgccaatacccccccccccccctctaacggattaaggatggcgtctgcgattttgggggggaggaaaccaaaactaattaatggtcgtgcttntgatgggtgaacgcttttgggtacgtggaaggacggggggaagagtgaacaaactggttggggagaggggcgggtaattggcgaacggaccgaccgattcgctgcattgcgcgccttttggcctgcccctccccccccccccgggggcaattcgaacattcttcgcaaaagtcgtttttcaccgccgtaacccttttcccaattcagcgccctctttcgcttcgcgctgttcaggcgctgaagcggctttacagcactaagtaccaagtgggctccggagcggaccttctctgtgagtgattatgtcttcttacaatttgccagcattttctcttcagacgaggcttccggcgcttctcatgactttgccaagggctctctgaacattccgtactcatttctcatcgaacttcgacctcagaacactttgcacagcacgggatttttactacccgaggccgaaattatggacacggcagaagagacgtgggaagcggtgaaagtggtggcggacgaagtcctgcagagatttggccaatttggagaagaacggaaggcatggaatggtcggtcaaaagagggcgggggtaagaggaagaggaggaaaaagggaggaaaaaagggggttaattgggaagaaaagaaaaggatgaaaagagaagaaaacgatgaaaagagaagaaaacgatgaaaagagaagaaaacgatgaaaagagaagaaaacgatgaaaagagtgccattttcagtgtccaccgcaaaaccaacacaaacggtgagcagcacaacaacaacaacaactgaagcaacaacaacggaaacgacaacgacaaaagcaacgacaataacaacgacaacaacagaagaagcgaccaaagggacgacaaaacgaaagacgacgaaaatcagaggaaaagggggagaaaaaaaggggaaaaagtcactggcgcacaaacacacgttcaaaccgaacacaaccaacaacagaacaacggcagca

SEQ ID NO: 52457 - DNA, 441 bp, Heterodera glycines
  Genomic contig location: Contig_ID=SeqID_3921; Location=2599..3039; Strand=+
  SCN-specific regions: Sequence locations=1-304,327-441
  Gene Ontology: Biological process=embryogenesis and morphogenesis
atgaaagtgtacaccgccactttcctcgcctcctccgtctcgggcatttccctgctcgcctctcttgtactgatcgccaacatttacagcgatgttcaacaaatttggcaagagttggaccaacaaatcgctgggttccgtgccgaaactgacgacctttgggtggacatgatgaagttgggcaagaagttgcgcgtccgcgcccgccgtgacgccggctacgcgggcgcagaaagcgcacccaaagcgaatgcgcccgtcggtgttgcaccctcggcgcgtaagaacgaatctttgcacttccaaatagtttctttgttatttaagctgtttctggcactggtcccagtggaaatgcccctggcattcccccaggcggcgcttcacccccaagcgttccgccgagcattcaaacaaacggaccgggaggtgccggatgca

SEQ ID NO: 52458 - DNA, 1152 bp, Heterodera glycines
  Genomic contig location: Contig_ID=SeqID_3922; Location=1..1152; Strand=-
  SCN-specific regions: Sequence locations=1-143,167-328,351-396,418 -620,642-1152
  Gene Ontology: Mol. function=carboxypeptidase A activity; Cellular component=extracellular space; Biological process=histone acetylation
tggccttccatctccccccccctcctttaagaaccgaatgtggcgcaagaacagacgacccgcattttgtaggcagcaatatttcaaccgaatttgctgctcgggagtggacctcaaccgtaacttcgactggttttggtccagtgagtcttttcctttccattccgtggcactttctctccgttcagccaccggttcgagtgccgacccgtgccatgagacataccacggcccctcagcattcagtgagcccgaagcaaggtcattaagagaaactgttcgattttacaacaaaatacggatttgttcgtcggaccattaagcgccactttaaaatgttttcatttatttgtagcacaatccaatctctcaaaagcctagccctgcacggtctgtttagtgacttattccccaaattaggtccgtccgcgactttctcgaggatcattcggtgaaggcctttttcacgctccattcgtactcccaactttggctgattccctacgggcacaaacgacgcaattacccggaggattacacaaaaattcaggtgggaaatttggtaaaggaagtgatttatttgtcggtttttatttgatgttggttggcacatgatctgatcgttcgttcgtccgttcgttttcctttctctcccatttctctcagcccgatcgctgtgggcacgggcaatactctgcgtctggccccggccgtcccgtcggtccttcctcgccgggccttccttgtgctccctgcactcccggcactccttgcgtccccgcctcccccgcgggtccgggcagtcccggcggggcgtttagcccggactctccggctattccttctgcgccttgcaacccgcgcggaccacgaggtccttggcgcccgatttgctgctctgtgtcacgccctttctctccgggcagtccgggaggtcccacttggccagcaggcccaggggcacccgattcgccgggtggcccagggttcccgtcccgtcctccgtgtccgggctgtccctttgctcccgggtgtccctttgggcccgtccgtccgattgggcccggttgtccttgcgggccagccgggcaattgaagctatgatgatagaggatcagcatctttttcgctctggtgcgcccacccaccatc

SEQ ID NO: 52459 - DNA, 540 bp, Heterodera glycines
  Genomic contig location: Contig_ID=SeqID_3923; Location=1161..1700; Strand=-
  SCN-specific regions: Sequence locations=1-368,425-487,510-540
atggacactttccttggcatggcatttcccaccatccggagtgaattgacaccaattgactgtacactaattaattggttgttggctacccattgtgcccatcttcagggtgtccgtcaactcagctgcctccaccgggtcgggtcctcaatcggtgcagaactttttatggggcgccaaaaggacgacaaacgcaaaaccaacgaacggagaaatgggaaaaacggtgggagaagaaaaacggaattgggaaagtacatttggtctgatcagagcacaaagtcgcattgccatgttcattttgacctgaacaaatcgggtcaaaaggaagaagcgatcggcggaggcaaagcattggcaatgatcgcagaggaagagacggaaatgggaaggactgaaatgggaaggacagaaaagggaaggacggacattccaacgccaaagtcatcgttgggatcagcgagcagtacgagcagttcggcggcagagggaaaggaaaaggacaaaacgaacgatggggtcaaaagacgaaaagaatga

SEQ ID NO: 52460 - DNA, 490 bp, Heterodera glycines
  Genomic contig location: Contig_ID=SeqID_3924; Location=657..1146; Strand=+
  SCN-specific regions: Sequence locations=1-364,388-416,478-490
atggacttccaaatggagcccttccaacggagcaaaagacggaaaaagccgagaaaagtggaggaagagacggacaaagagtaagtgatggtcattagcagagggatgggagaaaccaagtcgagacaggcgagacagcgaagaatgttcgatcgaagccgggatttccgaagcgttgccgaaactgacacgggactgatcgatcagagtgctgcgaaagaatgtggcttccgtttgccaattttgccttccggtcgaccgattgatcactgatcatctctctgttcttgccgttttctgtctgttgcgcttttctcactgtttgccctgtcgatggattgtcaaagcacttcaatttgagattaattgagcataatcagaaagaaaggaccagcgaatggatgataagtgcttcaaaaaagaacggagagaaggcgaaacataagcaaatggaagaagaagaagaagaaagaagaaacattatttgaca

SEQ ID NO: 52461 - DNA, 751 bp, Heterodera glycines
  Genomic contig location: Contig_ID=SeqID_3924; Location=1..751; Strand=-
  SCN-specific regions: Sequence locations=1-78,100-751
  Gene Ontology: Cellular component=integral to membrane
atgaccatcacttactctttgtccgtctcttcctccacttttctcggctttttccgtcttttgctccgttggaagggctccatttggaagtccatttggcctgagtttgtctgttggctatgcacttactacgccctttccttctcgtacagaaaactgatgaggaaaaaccagcaaatgttcgttttttcgattgacttcgctacggccaattcagtcccatggcttccctttttccctcgctcattctttttctgttttctcatttcattgtgcttttcctcttcagactcttcgaggacatttgcatgtttttccacgcttattccgattacattgtgcgttgttaattagcatgcttttcattttaattacttagttccaaatgtttgtttggcttttccccttagccaatcacttttatgctcggcttttatgtctcggcagtttttaaccgatggaatgaaatgttcacaaatttgggttggatcgattcgtaagttggcaactaattaactaatctcaactctttattgcaaaaatgtaggttttcctttactaattccccaacccattaagccctgctttgctaatcgccacgattttgcgtggcaaatcggaggaggcgcggataatccgacggaacattgtgcgatatttggtgctcgtccaagcgatggtttacagggacatcagtgcaccggtgaaaaagagatttccgacgatggtaagcaaaggaatcctaaaatac

SEQ ID NO: 52462 - DNA, 467 bp, Heterodera glycines
  Genomic contig location: Contig_ID=SeqID_21827; Location=121..587; Strand=-
  SCN-specific regions: Sequence locations=1-153,175-186,209-296,361-467
atgataaaagcaaacagaaaaaagtgccgatggaaatttgacaaagttcggagacaaaaggaagggcggacaaaagagggacggtcagtgagaaagacaaaaggctggccaacagaacgcaaatgaattcacgggagaatctgaacgaaaagtcataattaccattttaagaaattagttttattcattaaaataaaacaatttgtgatgctagtcagcttaggatttaccaaaaattaaagaagatatttggaaaaaatggtttcttcttaatcttaaaaaacttactaactaagaaatttttaaagaaaaaatcttacaattaatttgtttattagaaaattttaaagaataatttttcagcgattttttgtccgggcggaaccagcggggagagcggaaacgtagtgcaccccaataagacactgggaaaattattgttttttatcaattgcaaaaaaaataaa

SEQ ID NO: 52463 - DNA, 384 bp, Heterodera glycines
  misc_feature (341)..(341): n is a, c, g, or t
  Genomic contig location: Contig_ID=SeqID_21827; Location=830..1213; Strand=+
  SCN-specific regions: Sequence locations=1-33,55-299,321-384
atggtcagaatttgtgcaaatttcgcaattctttgtttgactttcattgtttgcccggcggaagaatcgaagattccgaaagtggttttgaatggtatgccatctgtgggactccatttcaaaaccggaccgaattttcagttgttttaaggtaaccaaatttaactatgcgcttttgagtcaataatgatttatttgcctttagcgtgttttgctttttggcttctctgctcctttaccaagcggccgctgcctcgggaaaaacgccacacttttaccgagtggtttatggccgttcagaaaagaagaaaaagaccaaatgattcatcaaatcatgcacnatatttttgatctcgttaaccaattggatatcattttctccaa

SEQ ID NO: 52464 - DNA, 1078 bp, Heterodera glycines
  Genomic contig location: Contig_ID=SeqID_21829; Location=6..1083; Strand=+
  SCN-specific regions: Sequence locations=1-135,158-1078
  Gene Ontology: Mol. function=dopamine receptor activity; Cellular component=plasma membrane; Biological process=synaptic transmission
attccaccaattacttcctcttctctttggcccttgccgatctgctagtttgtgccgtggtgatgcctttctccattttggttgagcttggcaatggtttggctgcgcttttgcacaaatgtctcaaatttcgaattgcttttcccccaggggttttgccgtggacattccgctgggacttcttctcttgtctcgtgtacacttatgccgatgtgttcctctgctcttgctccatcgtccacatgactgtgatctctttcgacagatatttgggtaaattctcaaaattatatttttttaaatgttggcatttgccgtctttcaaaagttccaataaattttcaggcgtttctcaacccctcaaacggcacaacaaacgcaagcgaattgttttgatgaagatttttgttgcttgggttctgtccaccataatctcttcaccgttggccattctctcttttgtggaacagcagaatattttgatggtccgtttaattcccaaattcatacggtatccatccaattgtatacggtactttccctgttcaggaaaatcgttgcggtattcgttctcgctttttcatgctctatggttctggtggggtcgttttttgctttaaatttttgaattcgctcccaattttgcacttttctcagtgttttcctttctcatccctttggccattatggcaattaccaccagccgaacggcccatttactgcagcgtcaggctcttctgttgagctccggcaattccttcggcggattgcgccgaattatggcaccgcagcgcaaaatgggcggacaggcgccgatgatgttcatcgccaacttcagcggggggtttgccaacagcagcacggggaggagcagcaatactacgacgacgacgaacagcaggtggccaaatgggacagaaggacaagccgaacaaagaatggcacgggagaggggggggggagggctaatgacccctcatttgtcagtgattagcgagcggagagtcttttaattgaaacaatttccaattttcagtggcagcagaagccggccactcccaaagccgatgaattgtaa

SEQ ID NO: 52465 - DNA, 179 bp, Heterodera glycines
  Genomic contig location: Contig_ID=SeqID_21830; Location=246..424; Strand=-
  SCN-specific regions: Sequence locations=1-179
atgtccttctatactgtacatcgtgatcagctgccattgcgtgcattgttcaatcaacatggactaagctttcaacagcgttggcattcacctcactacaaatacagtgaggtgctcggcggcacttaccatatcccgcacagccgttacccaccccatgacgtgtacaaaacaccgtg

SEQ ID NO: 52466 - DNA, 352 bp, Heterodera glycines
  Genomic contig location: Contig_ID=SeqID_21833; Location=738..1089; Strand=+
  SCN-specific regions: Sequence locations=1-175,203-292,315-352
atgcggccacgttccaaatccctttcaaatataaattttgaaattactcaaacaccaatctgccgtttttatctacgctttatggatgcgttatatggtagaaggcgtttatcaactcctcatagaaattttttcccaacaaaaatgaacataggtctttctcagcacttttttcattttaaaatatatttttaaaattttagaagcaaaacatgatcggatttttttgaagcgaaaaaagaacaatcgttgggtgaagattcgacgggtatatccagtattcatcttggcgttaatattatttaaataatttagtcgtcacgtctgctggataaaagaaataatattgata

SEQ ID NO: 52467 - DNA, 599 bp, Heterodera glycines
  Genomic contig location: Contig_ID=SeqID_21834; Location=486..1084; Strand=-
  SCN-specific regions: Sequence locations=1-273,299-320,342-517,539-599
atgaagaaaacgatggatgaaactaacggacaattatgcaattcaactttcatcaattctgacgcactgacggtattcttgaacctctatgcaaaagtgacttctttcgtgaaagtagggatttgtgcgagtctttattagttaattcattttgatgtcaaaatattagattatcttagcatacataatagtattcagtttacaacaatagtggatcagtttagtaattagtcctagaatggatgtcatatccgttttcagcgacctcaaaaacccctaaaaatatattttccctgtaatttacgaatttcgatttttttcgaattcgggttcggaattttgaaaaataaacgtcatattcgtgatcatcggcacaaattaccctagaaatgactttttatttgaaaatttcaggggggggggtcacaaaacagaaaagtaccgggctacgaatgatatcaagaattacggtaatttttttgttaaaaattttaatttgatgtgtttctttataacgccctttttatggcttttataacgactcagcactagtggagttgacccatattgaatctctttaaaggtgtaaacgtaataaa

SEQ ID NO: 52468 - DNA, 1373 bp, Heterodera glycines
  Genomic contig location: Contig_ID=SeqID_21837; Location=42..1414; Strand=-
  SCN-specific regions: Sequence locations=1-116,142-1048,1072-1373
atgatcaagaatatcggcactcgagtcgattttcggtgcggcatcgagtaattcagaaaaactttacggcactgtcggaataaaaatttacttcggcaaattataatttagtgaaaaaagatttttggattttttcaaattgaatattcattttttaagtgaaacattaacaacggtttactcattactggaaattgaatctcaactggtcaaagtcgatgagaaatccgcaaagactatccaaagactcaacactgatcttatgacgaacttcagcaatggaaaaataagcgaaaatgaaggcttaaaggaattggacaatgaattggataaaacatttaaaacgatgaaaaataaagaggatacggcggcgaaagttggaattggcgggatggacggtttggcacaaatatttccaaaggcaaatgagcaaggaaagtctgtaaggttacaaatatatgggcaagcgatggaagtgctaaagctaattcacgagagaattgagcaaagtacggaaaaagaagcaattggaaaagtaaccggcaagagtacggtggcaaacaacggtagtactgtaatgccaagtcaattagtgggcttaatgatggggctttggacacattttttgcaaagagttcgcaaatcagaccaagacaaagctactcaaactaatccagaggtaattctaatgagtgaggatgtgtggggacggggggggaaggattttcatccccgttccccgtttttcctatcccaggaaacggggatccccgcaccccattcctaccgtggacgggcatgaaacatactaaaaatgggctcaacaacaataatgaagaaactttttgacgaaatttaagcaaataaaaaaatgggaggaaaattcgtttcaaaatttttcctccggccttatcggcatcccagaaccactaattcctttcgatattcaaaaatgagcgaaaaacttgcatttttcctaaaaatctgttaaatcaactcaggaaaagcaatcttcacctaagctacggacgaaacttaacacaccgatggcacaaaaaacaaaggctccaacgaaggcagctaaaaatcaagcaattccaaaaaaccaaaagcacacggcttcgtcagatagacaaaaaaaagtgacagaaaagaaagcggtttctcttggcaatgataaattcagccgtcgacgacgtgccataacgccaattgactcttcgacaattcacgctttattaatcgctcttgctattctttgtatcactgtactagccttcagcagtgaccttaacccatgggcgattgttgcaattgtctttcttacacttaattctcaacaagcaaataatcggcccaatcaaattgccaaa

SEQ ID NO: 52469 - DNA, 1166 bp, Heterodera glycines
  misc_feature (1099)..(1099): n is a, c, g, or t
  misc_feature (1140)..(1140): n is a, c, g, or t
  misc_feature (1144)..(1145): n is a, c, g, or t
  Genomic contig location: Contig_ID=SeqID_3925; Location=51..1216; Strand=-
  SCN-specific regions: Sequence locations=1-9,32-145,167-275,297 -304,326-455,477-499,521-561,647-673,696-940,962-1166
atggggcaaatcagtaaaaataatggtaataagtaacacttcgctaccgtttaaattttataaaatcagtaaaaatttctaaatagaatttctgtaaaatttaatatttctttagacatatcacatttggaagagtcgtttaaagaaatgttaaaattcaaaaatagtcaatcacctagaaaatgggagacgcccaattcgacgccatccagcccagcgccgtccaattcggcaccgtgcagcagagagccgtcaagttttactccgtctagttcatcaccacaggtaataattttcttatctttgagaataaaattttataaagtcggtgtcactcaaaagcgtttgggccaacctctgttagttttccaaaatgaaaaaatttagatacttaaaaattggcggcgccgaatcggcgagcgcccaagtaacaccgaccagacaaaatatgtgagaggaaatcactcaaaatcaaacaacttggaagagtcgtttaaagaaatgttaaaattcaaaaatagtcaagcatcgagaaaattggagacgcccaattcgacaccatccagcccagcgccgtccaattcggctcagtccagttgggcaccgtacagtttggagttgtccagtcttgcaccgtctagtccagcatcacgggtaataattttctttattcgagaacaaaattttataaaaatcggtgtcactcgaaaacgctagggccaacctctgttaatttgcaaaattcaaaaattaaggcatttgagaattggcggcgccgaatcggcgggcgcccaagtaacaccgaccaaacaaaatatgagagaggaaatcactcaaaatcacacaacattgaaagcaattttgacgaggaaaaaggtaatttaatatgtgtcattttctgcaattttcttgcggatgattgttgttcgatattttttttaaaacattttttaatgaaaattgcctagaaaattctaaaactaaatttttcaatcttagaaaattaccgagaaatgtttgtctaaactaaacataattttttgactcttagaattaattcaagtcaaaaatgccccaattaccaagaaaaacatatttnggcagaagtcggagtacaagtgtaattggacgattttctanagannaatgtaagttgtcgcaataaa

SEQ ID NO: 52470 - DNA, 1110 bp, Heterodera glycines
  Genomic contig location: Contig_ID=SeqID_3925; Location=2291..3400; Strand=+
  SCN-specific regions: Sequence locations=1-117,139-973,1108-1110
atggacggcttcaacacgggcatgaaccaaatgacaaacgttcttgatgctagtcaaccgtgggtggaattaatgtcgctcgatgataaagaatttgatgccgggtgcgttgagtcttgagaaacagggaaagaacccgagaacccaacttagaaggagaaagcgcaaggagagaccccccaaggccaaccggtacataacggcattccgttgagcatgagcattccgtctaaaaagtctctaagcgcggtgcgaggtgccggccatgggcgcgtcttcatccgaggacgcgggggacaaagctgtggagctgtaacgggaacctagtttcacatgtgcgaaggcaatcgagcgcacaatcagcaccacaaccaccgtcactcggtcccggggccgccaggacattgccgataccgtaactgtcagctgccgaaccatcattttggcattaatttctgtccatatgctccgcgttgacaggctgccgcagaatttcaaagaggtaagaaatggactgttcgttaatctgtattttaacccaatctacttttttcctttgtgttcgctcccgactccccacacgcttgactcagccaatttgttatgtaatttatgtaatttccccgcttaatgtacattcttcctcactccctttaattctgcgtctgataagaattggttttggcattctctcgttccatccttgcctacaaaaacattgtcaccacttactctcggctcttctctctcctatcctaacctactattcctgctttcaactttcattcccaacctttacctaactttctaaataaacctcccattaggaaaaaatttgcaaatcgtacatttcaagtgtgtaattgggatataaaatcaaatttttaatacatttttttgtgcgcattttttaaaaaaagggggtggatccggcggcgccgatcattcaatagttctaggttttctctatcagaataaattttaaatttttttataaaattataaaaaagtatggccaaaaaaatctaaccattatttttttttaatttttaagataataaatagctttctttatacttaagtaaaaaaattttaaaaaataatattcta

SEQ ID NO: 52471 - DNA, 1575 bp, Heterodera glycines
  Genomic contig location: Contig_ID=SeqID_3926; Location=734..2308; Strand=+
  SCN-specific regions: Sequence locations=1-303,327-658,681-1245,1268 -1398,1443-1508,1530-1575
  Gene Ontology: Cellular component=nuclear pore; Biological process =protein-nucleus import
atgcgctatcagaatattttcttccaaccgatggtcactgctttggccgacaaatatcccgaggtgaaacgaatgccaataatttatcattttttagtttttgtctttttaggttaggcaggcggccgcttacggctgcggaattatgggactgaaggggggacaggtgagtaccaacgaaaaacggcaaataaacaaacatttgatcacggatttcagaattacgcgaaacattgcgcccaaatgcttcagccattaatcaatgccattgagaagaacgggtcgagaagcaccgaaggtaggcaaaggaaaagaaaaaggaacaattaaacggctagattttaaaagataagaaacatttgttcagaggacacgcgggcgacggaaaatgcgataagtgcggtggcaaaaatactcaaatacaacgcgacagaagtgaatttcaacgaggtgagcaaaaaaagggtggagaactggtggattgatggttcgtatcatcggcataatgccaatggttaaggttgtgccgcgtttcgttggttggttgcccatttggaatgacgaggaggaggtgccgtacgtgttcgacttcttctgcgatttggtcgagtctcagcacgacgcagtgcgagaggacccgtctcgtgttttccacgtaatttttcattatttgttaattacactcattaaaaagcgtctcgcttttggttttgttggcgtccctttggagtgtcgttcattcaaatggcaaaatgccttccttcccttccttcagattattctaaacgctttttcgcacggtgcttttgaggacgactcggcggaagagatgcgattggtcaaaagtcggatggtccgtttccaattgaaataaaatcgaacaaaacaaatttaaaaaatggatttagaagggaataatggcacacattcgtgccaatgaacagttgttcacgcaaattgtacaatcgctacaattgaacactcaccagcgaactgtgctggagcaaattttagcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgtttacgatcctttgcgctttgttatcgttttgaattgtgttagttgtttaactaagaattgttacaaatgtgccaatttgttatgaaaaataagttttgggggcccgacggtaccgataggcgccgccggaggaaaaatagaaattttgagtttttaacagattttcactgaaattttggggcattttacacacacgaaaatgaatcaaaatgtacttttttcaaattaaaattttttcaaatattcgcttcaaaaaaatgatatgtagggctgcaacttttagtgacgaaaaatctcaaaatagttacctaactaaaatagtgagtaaaaattccaaaatagtgacaaaatagtggcaaaaagtgcgaaatagtgacga

SEQ ID NO: 52472 - DNA, 2560 bp, Heterodera glycines
  misc_feature (2062)..(2062): n is a, c, g, or t
  Genomic contig location: Contig_ID=SeqID_3926; Location=2987..5546; Strand=-
  SCN-specific regions: Sequence locations=1-510,532-1610,1632 -1674,1705-1786,1808-2117,2140-2310,2360-2560
atgataaaattggaagttgccgaatcggaaaccgttgacaaagtgaagatgcttatccaccaaaccgaaggcattccacccgaccagcaaatgctgttcattcagcttgaggacggtcgaaggctaagcgactacaacgtgcagagttcgtctacgattgggatggtcttacgcccgtcgtcagctaaagaaaatcctaacatgcacgaagtgtccacgcttagcatggccaacacctgcgcggtgtccccgtttggaatgcccgtattaccttcgcccgctgcggcagatgccagcatgcgcgatgtgcccacgtttggcatgcccggtacaagcgaggccaaccttcacgatacatccccgcttgggatcgccctacgcccagtgtccgtctcgtctgatgcaaacatgcgcgccgtaactacgagcattgcagtgcacccaacgcctgtcataattgctgaagttcctcatagttttgccgcattgatgcgcaaaaggtaatttaataattgttttttgattgatcaaatagcctgtttgtaattcttactcttttcataaaacattaagacattaaatgttttttttttgaattttgtacattttccatgatgtacttatttttgcccttgttatgctcttatatttggccacaaacgccttttgctgatctggtccttttacagagtccttgtttcgaattaatttccattttattaggcctttctctgcgaatgaaatgccaagcgaagcgacgacttcctcttttactcaacatgaaatatctgtatttgtcagcagtttgaacaatataatgctgaaatttgcaatgaaacgatctgacaatgtgcaagacattatggagaaaatttgggagctgaaaggcattccgattggagagcagcggctgttcttccgaggcattcagctcaacaaggccgaattgcaaattttcctacacaatgggggacatgaaaatgagttcgttttttacctggtaccacgacctgccttgccaaggtcgttagaagaaaaaacgataatgtttaaacaaaatgttgattgatttagtgaggaaatgccaattcttgtaaaggatttaacaaataagaaaatgatcagactgcgggttaaaagcaccgacaccttgctcaacattgaatggatgatcaaagccaaagtgggcattccgcgcgatcagctaaggctttgtttgaatggaaacggatacagtttaaagcaagaattagccaaatacatcgaaggggcaaattggccagaaattacacttgaaattaagccacaattgcatgtctctgacggttggcggggataagattttcgttattccatgatattatataaagccgtacagggaaagcgttttcaagtgcataaaatcgtaaaattggtaccttaataagtacagaaatgtttattctatttttaactaatatatgctagatggcaatttgaaattttttttgaaatccattcactactaattactgcaattatgaatttattatcataaaataaggacattgaatgtaatgaatggtaaatggttatgctttattgtgtccactaattggttcttagttgacttttatcccaattcttaaaaaccgaatttttacatctgctaaaattagacgccatcatgcacaaacaaaagtaaataaaataaatacattaaatgtaaagaatagttatgttttccatcatgatcaaacaattactaaaaattgttttaagaaataaacataaaaatgccaaacggtaaagttatacaaatgagagtgcatcgatggtacaccattctatacataatgaggaaagtccaagaactggagaacattccactaattgaccaaacgctgctgtacaaaggaaaacggcttagaagcgatgtaaccctcgcgaattatggaatcgagaactatacgaacactgagtacgagataaaaactcttgacctgttggtgagccaagcattgccaataatcacttacggtcagttctttgcttaatctttagcccatttattaatagattntgacgcattatgacacactttaggcctcttgataaaattattgaaaaaagctatgaatttttatttttcgggggtggacaaagctaaattgtgtgatgaacagtgacagattttaggcaaaaaaggaagaaaaagcttttgaaaaatcgtgaaaatttttgttgcactaattttatttaaatatttaggcagtttttgatttttagcatattaaatattacccaatcgctttattactcaacgtaaacatatatttttaaattttactattaattgaattttttagaaatatttattggtgaattggtcttattaaaattggatgttcatgactggaacaccgtgcagcagctgaagaagaaaattgaggagaaaaaaggcattgccatgaacaagcaaaagttgaaacacggggaaattgaactgataaacgaattgacaatgtccgattacgaaatcagaaaattttcaatattgagtctgattataatttggtaa

SEQ ID NO: 52473 - DNA, 623 bp, Heterodera glycines
  Genomic contig location: Contig_ID=SeqID_21839; Location=1000..1622; Strand=+
  SCN-specific regions: Sequence locations=1-303,328-334,356-565,588-623
atgacgacgacgacgccacaaaaatatttgaattgtcacaatttgcacgcattttcgaatggaaatgggtgcagaaatggtatttctttaatttttttttcaatttgtttacattgtgcaccgtaaaattatcccgtgtatagactttataaaatagagaaacatttacaaatttgtcaggtgtgtcgtgttcgtcaacgcgagaaaagcggaaaaaatgctgggattattccgatgccatggcattccatcaacagcagcgtcaaccccagcaccaacactcaaagcggaatgggggcgaaccaacaacaataacaacaacaacaatgcatgttggagatggtggaggtggagaaattggcggcacaacaacaccgaaaaagttgggagcaatttgagttgttttttttgggggggggggggggcaaatcatgcaatttcaccacccggcggtttttcaaacaaatccaaattttaggcggtgtttttaaaaacacttataacctctgcgccgcgcggcgttggcaaatcgttgaacacaaaacaatggtgacggaaaatgcacacacaaacaaactcaatatatagattcgttttttgttttcttttctcataacatgcaa

SEQ ID NO: 52474 - DNA, 926 bp, Heterodera glycines
  Genomic contig location: Contig_ID=SeqID_21840; Location=62..987; Strand=-
  SCN-specific regions: Sequence locations=1-112,149-195,228-829,857 -874,897-926
atgaaaaatgccgtgaaaatggcattgattgttcagcagagaatcgccgtcaaatgcttggcccggcactgttcaaaattcgctttccgcttttgtcaaacgtggaatttacgaggaaaattggtaaaaaataagtcaaaatttcaaactcgttctctgatgagatgccgtaaactattcattgtttttgtggcgatttttaaaaatgtttttttaaatttatttttcaataagttaatacatatttacagttcccttcggtgttttatcaaaagatgaagtgatcgccgtttatcagttcaaatcccttccaaattgtcatgggatttccgacggacttttcccaatgccattttcgactaatggacggatttctgatcgaaaaaagggcacacttttgctggacattgaaaaagtgtcggaatttgcacgagaggaggttgggagcagtcggtacagcgaaaaagtgtacataaatggattaccatggaaaatagtggcacaaataaaaacgaaaaatggaggcactgacaatgagaaatggttgggcattttcatttgttgcgatacttcgaaaaaaggtgcaaaattactaatagttaatatatatattaacaacaattaattgttaattagtactaattaacagcaataattaatactccattaagattcgctttggcgctgctgcgttcgttcggcaacttttagaattatctcgcaaaaaaatgggacggagaattgcgttgggacacttagtaactttgtgttggacaacaaattgaccaatttgggattcactaatttcgtttcgtttgcggtaagtgccaattcaaacaaatatttaaatttgacattcgtggaccagccaatattgaagttcatttatttatttgcctggtgtaaagaaatcataaacaaataaa

SEQ ID NO: 52475 - DNA, 208 bp, Heterodera glycines
  misc_feature (94)..(94): n is a, c, g, or t
  Genomic contig location: Contig_ID=SeqID_21844; Location=104..311; Strand=-
  SCN-specific regions: Sequence locations=1-208
ggaatcccacactgaacccaatcatcgaacggctcgaaaagttggaaaggttggtggagcggctcgtggagggcgagaatcgatatggacatcngatttggtgacccccagcacacctcctccacttcggctcccacccccacaaacggcaattttcaatggggtcaaccgccgccttttgctggcaccggcgcagtgtcgcggatga

SEQ ID NO: 52476 - DNA, 874 bp, Heterodera glycines
  Genomic contig location: Contig_ID=SeqID_21846; Location=909..1782; Strand=-
  SCN-specific regions: Sequence locations=1-23,49-169,214-301,397 -402,424-503,526-578,616-655,682-874
cgggaaatcccggggttttcaggtcccggtcccgatcccggtcccggtttttggaaaaacagaaatcccggtcccgattttgccagtcccggtcccggcgggactaaataagcactgttaagaatgggggtctgggtgagaaaagagaagggaattggtgagggatcagaaatttttgataaaaataaattaaattatttattttcatttatagcatcttttcatgtgcataagtggtcaagtggctaaacctttttactttcattatttgtctcttcggttcaattccctgatggaacagaaaatttttttatattttctttaccattattttaattgaatttaattaataaaaaatattttaatttaaaattattatttttttcatttttaatagcctaaaaacccataaattaaccaaatatttggtcattttttgacaaattctgttaacaaattcgctcaaaatttcaaaatttttccggcggcgcctatcggcactgccggaccccgcccctcccactgttccaaaaaagttttttgaaaaaacattgccacaaaaacagcgatttaaaagcaaaaaatttaaaagattgtaaatttatttaaaaaatacagaattttgggactcagaaaattccaagaaccccccctgaaaacaaaatttttaaaaattttcctcgaactcgtcccccaaaacataaatacaaaattttatgggtacatttttgaatattgccaattttcgtaataaagtgcacttaaattttcaatttttttcaaaaaaattttcacttgggaaaagtcccggttggtcccggtcccgggttttttcgcggtcccggtcgaaaaacttggtcccggtcccgacttt

SEQ ID NO: 52477 - DNA, 710 bp, Heterodera glycines
  Genomic contig location: Contig_ID=SeqID_21847; Location=19..728; Strand=-
  SCN-specific regions: Sequence locations=1-710
atgccagttcagtgttcaatgtttgtagctcgtgctccttttcttccaacaatcgttttgcctgcaaaattggtaccatattataagtatttgtatagtaatggctcaatctatcggtgcattttctccattcaaaaaagatgtttttagatttcgaaaaaaatcctctcctcattctttaaaaaaggaaatgattcgagggaatagtaagcggttccgcaagactccacctcattcaactcgtaaatttgatcttccaggcgccgaattcgcccttgtgctacttccaactcgcgctgcgcactttccatctcctctttcatggataaccttaattttgttttcatactatttttggctcgcattgtacgccggaaaaaagaagctgacaatgaaagttcatatctgatttgattatttataaactttttgaatatagcaaataattagcatccgttttccggatcagaggatgctttcaaattctgatgtgttcaattctccctcgccgtttcatgcaaaaaaacttcaacaaaaaaaaattcttaaatttataggaaaatcaaaagaaattttttttttgtaaattgttattataactcaaacacccatacataaacgtacgtacattttggcttcatattcatgttgtttctgttcagccgcttccctggcgcacatttctcgctgcagcctgtaaaaacaataaa

SEQ ID NO: 52478 - DNA, 1108 bp, Heterodera glycines
  Genomic contig location: Contig_ID=SeqID_3927; Location=1149..2256; Strand=-
  SCN-specific regions: Sequence locations=1-262,284-288,317-388,410 -419,441-1108
atgcttttacttgcctccctccgtggtccgtgtcgtcgtcctcgcgttctcaaaacgctgcgctctcttaaagtccctcacttttccacaatgaaccgtgactatgtcattgaaactgtgaatgtattctctttgttttaatcaatcaaattagacgattttcgcacttttcttttagttcacttccgaacgtgactctgtgttcaaattcttgcaagaagtgtttttggtcaacgagccgatcacccgcgtcatcggtcctttttccacaaatgatataattttaccaataataatttttattttgattttttaaggttgcaccccctcggacacctcaccaatattcgacgacatttgtgagaagtgttctaaagttagttcgtggattagtttctccaatgctttgcttctcttcaccctcttccccctcattttcagtttgatttgtcatttgcggccaaaaacaacgatgggaaaatactgggagttctgttgaatgcgcccttcaaattggaaaatattcacgaaagctacagagacattgggcgcatgccgaacaaaaaggaattcggagaaggttaggcaacgtaaggcggagattgaagatgaaagcaaattgttaagagattcgcaatggcccttttccatctcaaaatgccaatcgaatccacgccattctcactttcgtgaatagtcatatcgcactgttgccccccgaagaggatattaaattagtcgaattgcaggccatggctgtaggtccaggacacgccaggtaacgttgtgttgaatgccaatcactcgctcgtcaaatgcggcactttccgctccttttcaggactggcttgggctccggtatgctccgtgcactcatccaaacggcttccgcaaaaggctattcccatttgttcacctgtgccaccgccatcgcctctcagacggggcttaaaaaagtgagttgtctgaccagcagtgatcactattttacttttccattttgaaatctttgactttacagtttggctttgacgagatcaaaactgtccctttcaactcttttctggaggacggagtgccaatcttttctggggttcacgacaacgga

SEQ ID NO: 52479 - DNA, 2618 bp, Heterodera glycines
  Genomic contig location: Contig_ID=SeqID_3928; Location=1..2618; Strand=+
  SCN-specific regions: Sequence locations=1-147,169-333,372-406,428 -639,661-701,724-781,817-914,936-936,971-1007,1031-1055,1083 -1274,1296-1444,1466-1709,1754-1910,1933-2012,2034-2363,2390 -2408,2449-2594,2616-2618
tcttctacctaatccaaatccaacattggtgatataattcgaaagctgaacatgtttagaagctttttctaagcgatttcttcgcgatcagacaattaccaaaaaagttatacatgaaaattgcgaaaagtcgaaatttttgaagttttttcttaataaaattttttacaggcatgaaaatctatccgctttttgtaaggctaatagagcatgttaaagctttcgaatgatacaaagattgttgaatttggatgccaaagtaaaaagctatcttggaaaaacgagctggcgccgcattgcgcgcgccgaaatgcgtgggtccctaatttcgcttataaaatttgaaaaccaaaagatttccatttaggtaattccatatttaaatgctcaattctattatttctttctctactttttgttcttttcatgtcctttcccccatcattttactcctctattattattcaattcgtttgttcgatttatttattgaaaattggaaaaaaatccatgtgaaatttggtgatggcaaagatcatctgttttccgaatatatttaagggaatttgaggccaacaagagaattttctgagaaacggctctctggagggagagatggtgggtgtaattaagaaaaccaaaaaatgaattttgtttgggaacggaatggaggaaataacggaaaaaggaaaacggagaataatttggggaggggagaggggtactgcatatgtcaaattatagtaggcctcatttttcaattaacgtaatcattaggcagttaatttatattgttaataatatttaatttttttagattgacgtaattattaggcattaatattcaatttttaattgagatttattattgtatagtaaagtttcgattttttgtgccgatcaaataaggaatttcacattttgtataatattaggaaataattaaatttttaataaatttattattatagaaagtagaagggaaccgaataaaatacatagcaaaatgtgaataaaaatcacattgattaatataattttataaatgttcttgctagtttccattttatttatttttgggagcacgacaaaacgtttgccgggcgaaccttttggaccatatctttttaaaatttttggtcatttttggttgcatttgaaaaaagttacaacaaaaaatatgtggtgcaagacttatttgtcaccctgtatacgttcaaaactttgaagacatataacttttttaatagggcaaaagaaaaaatctgaaaaatttacattttataactttttattcaccaaagtgatcagatcactcattcggatggatatgaaaccctaaatggcttgaaaacgggaaattctacaaaaaaatcttatgtggttgtaaaattgtttcgtggcagacgaacacaaacttgctataaaatgcaaaatccgcatatagcaaaatttgtgttctttctgtacgtaatattcgttttccgcgaaaaattttccgtccaaccccataggaatttttttctgaaagtttcgcaatttcatgccattttagggttttcagatcaccccgaatgagtgatctgatcactttggtgaaattgattttttggtcagtataaaagttttgtaaaattatgaatttttttttcttgtcctattaaaaaaatacatgtattcaaattttgaacaaataattgaaacagagcatataataaataattaaatgaaattttgttttattttataaaatgtgccacatccacctgttcctttttctgatcatcatgatggctattgtcaatgttgcgaatggaatggactacaaatatgaaaagttgaaagaaccgttactttcaaacgaaaacattgatcagcacgaatttgaagtgatcaaagatggcataaccgaagaggaggacatggaaaaagcaatgaaaatcggcaaaacattcttttggcgagttataatacaaattgtttttacattgatggaccagggggcacaggaaaatcatttgtttaatctgctatttttcatttgtccagaggttttttaaaaaaagtgacaaatatggcttttagtggaatagctgcaacattgttaaagaacggtcgaactgttcacaaccggtttaaattaccattagatttaaatataaattcatcatcgtcgattgaaaacaattctaaagaagcaaaagaaattagagaaacggatattatcatttttgacgaggcaccaatggcacctaaatttgtaattgaaataatcgataagaaattaagagagatacataagaacaatattatttttggtgggaaaattatgattttaagtggtgacttccgtcaatgtttgccaataaaaaataaagcatcaaaaaccgaaattttagatttaacactacaaaaaagtgagttgtgggttaattttaaaatattccatttgagaaaaaatatgcgaacggaaaatgaatcacaaaattttgcaaaccaaattttggaaatagggaacggtaaaggtaatgatgaaaacggtatatgtcttccaaaaatttgtgatattgaagacaatgatttggttgatgaaatttttggtgaaataattaaaacaa

SEQ ID NO: 52480 - DNA, 312 bp, Heterodera glycines
  Genomic contig location: Contig_ID=SeqID_3929; Location=1012..1323; Strand=-
  SCN-specific regions: Sequence locations=1-47,70-312
ttaaataattttattgaagaactattcctttttattgaaactgttttggaaagtgaagaatttgaaatccgaaatgacgtaatgaacaaattttggtcggcatggactgtcacactgaaaagaattgcacaaatggacaatttggcacaacgattttgtacacttcataaattcacaattatgaacatcagtcttttttggacgaatgccacggaacagcaaagagaagaattgtggcaaatgttgcgggaaaaaacggtggtcggatatgaaggattttgtgggccaatttaccgtatttccctacattaa

SEQ ID NO: 52481 - DNA, 398 bp, Heterodera glycines
  Genomic contig location: Contig_ID=SeqID_3930; Location=566..963; Strand=-
  SCN-specific regions: Sequence locations=1-121,145-398
atgggtggcaaagatttagattttggcaatggcattggtgaagaatggcacagtacgaataccatttttaatgaaaacccggtaatttttggtgaaagcccggaaataagctcaatgaataatgacgatgataacaacaacaactatcatccttattactactacaataattatggttatggtaacgacagtaattttcctggaaataataattggtataacgcaaacgcatacactgataactggtatagcgtaaatgatggtgatgatgacacgagtggttacggtagtactacaagtggaaactacggttttgagacgaacagttacagtagcagtacactgggtggcaattacgattacggtaacagtagtgagtcatcagcaccagcgtaccg

SEQ ID NO: 52482 - DNA, 380 bp, Heterodera glycines
  Genomic contig location: Contig_ID=SeqID_21850; Location=136..515; Strand=-
  SCN-specific regions: Sequence locations=1-271,293-380
atgttatctcgtccgcttctattcattgccgcccttctcttcctcttcggctgctgtcgtgcggatggaaatgttgtgcatctgtcgagcctcaattgtgccacgaaggacggaggaatcgatggcttcaaagctgtggacgacggtctgatgtgagttgtgttgttttgtgaaacaacaattaatcttcccaaatcccatttagcttggattcctcatctgtcaccgctgatacgtctgacctgcccctcatcggtttccagaagaacggaaaggaggacttgatcttcaaactctttgtgcgcaatggaggatgcgtctcaaaggccaatttcttcaccaacggtcaaccgtgtacactcggagagtcggaggacgtg

SEQ ID NO: 52483 - DNA, 114 bp, Heterodera glycines
  Genomic contig location: Contig_ID=SeqID_21850; Location=984..1097; Strand=+
  SCN-specific regions: Sequence locations=1-114
atgctcactaatcccattctctccccatatttaggcaccgttgcccgtcgcgagattcgccgttaccagagcaccactgaacttctgctgcgcaagttgccgttccagcgtttg

SEQ ID NO: 52484 - DNA, 800 bp, Heterodera glycines
  Genomic contig location: Contig_ID=SeqID_21851; Location=651..1450; Strand=-
  SCN-specific regions: Sequence locations=1-19,46-102,214-601,627 -710,733-763,792-800
atgaaattatttccgctactattattaattattttatttttaattgacaaaattggatcagaaaggaaaaaattgcaacaaaagtcatttggcgaaatatttggagaaaaatggcaagaaaaagaagaagaaaaacgaaatgaactcaaaaaaagagaaataattggaaaattttataaaataaaagaaaaaataaagcaaaaaggaagaaaatactcaacaaaagaatgggataaaattaactcaaaaatagcgaagaaattggggacaaatcgccaatatattcaaaaatggattaaagaatttggtctccaaaaaaagaaatgctataaatcaaaaactgatgaagaaaaattagaaattgtgcaaaaattcattaaaatgaaaaatgaatttaaacaaaaaagaaaatattcagtcaaagaatggaacaaaaattatgtcgaaatttgtaagaaaattggagtaggctatgtaacaattaaaaaatggaagaaacaatttggaattcgctgtaaaagaataacggaggaacaaaaaatagaaaaaatgaaaatttattgggaaataaaaaaagaaaatccaaaaatgagtgacacggaaattggaaaattttgaaaattaatagaaagagaatttcagaatggaagaaacattttggggaagaaattttgaaggattgaaaaacggaaaaatttacgaaaatttggataaatttatttaaaaaattatctgcgctctaaaaaatagatttgttatataaattttcaaaaagattgtatttgtatttgataaataaa

SEQ ID NO: 52485 - DNA, 1074 bp, Heterodera glycines
  Genomic contig location: Contig_ID=SeqID_21855; Location=1054..2127; Strand=+
  SCN-specific regions: Sequence locations=1-12,34-211,233-320,391 -593,616-662,736-787,810-1074
atgtccacaaatgatggtgatgaattggaacaaatgtcagcaaatagtggacaaatttccgatcatttttcaagtgaaattgataaaaagaaaagagaaattgtggaaaaatttgataaaattaaagaaaaagttaagcaaattggaaagaaatattcaacaaaagaatgggagaaaattgaaagaaaaattgcaaaaaaattaggtgcaaataaaatgaaaatttacaaatggaagagcgaacttggaatgatgacgaaaaaaaattattcagttgaagaaaaaagaataatgttaaagcaatttgatcaaatatattcaaaattaaaaataaaattaaatgaaaaattggaaggaaaaagagaaaaatgcaaaaaaataatagcaaaacatttgggcacaaatatcagcagtatttatcattggaagaaacaaagtggaaaaactaagaaaaatcaacaaattgatgatgaaaaaagagaaattgttgaaaaatattttaaaacaaaaaatgaatttatgcaaattgggaaacattcacgaaaggaatggaaagaatttcatgcaaaaattaaacaaatatttggtttgagttatatgacaattgaattatgggccaagaaaattaaaaatcaatcaaatgcttcaaaaggttatggtgcatttaaaatcaaaaatctaatcttttttaattaaatttatattttttcattttaaaattatttatttattttacagagcgaaattttatacaaatgccgaaaaaatggaaattatgaaaacatattatcagatgaaagagcaaaacccaaagttcactgatcccgaaattgctgtttgaagatagccgtccccacattacgcaaatacaaatccgatttaaagaaaatggaaagaaattttaaactttgataaacatattgccaaattttcaacattttaaattcattgtttatcgagatgcttcaattatttgttttttttttttgtaaacgaattttacttttgttgatttgacaaaaaaaaaaattctctattcagatttcttagtaaatttattaattttatgtaaaa

SEQ ID NO: 52486 - DNA, 103 bp, Heterodera glycines
  Genomic contig location: Contig_ID=SeqID_21856; Location=1536..1638; Strand=+
  SCN-specific regions: Sequence locations=1-103
atgcacactgacgaggatctgtctgacgacggcactgaatcatatacatttcgctctctgatttactacgaaaagaaacaatgctccaaatgtaagaagcttc

SEQ ID NO: 52487 - DNA, 654 bp, Heterodera glycines
  Genomic contig location: Contig_ID=SeqID_21856; Location=735..1388; Strand=-
  SCN-specific regions: Sequence locations=1-606,628-654
atggataacaaatctctcacaagtcaactacttcctacagtcaattttttggtcacaactcagggagtgactgttcacagtgaccgattggacactccgcgtgtagtgtttttcaatgatgatggtaccatttgcagacaatgccgatataatatggatttggactatctgatcagtaaggatggcgtctacattcattcgagccgactaaaaggcaccgaaaaatttgtaccattcgaccgagtgtatgacctgccgcgtttttgtgcgtttcgcgtacggtcgcgccgaatatttaaagtaccctatattttctcggattctccactagaaaaggcaatgtcgtcaactgttacatcaacgactgaaaaccctctcatcgacaatgttgagcggaaaaaagcgagatttgactcagacttgcgcgacattactacgaaaaatggcgaagatgagaaagcagaacttaccaatcggacggatgaattaaatgtgggagagaaagcaacagatgggatgatacggacagacaaaatggatctgtcacaagtacaactaatggacgaagcaaacacaatggaaaatacacctaaattcagaacaaataaatttatttctaatctagacaccatcaaggaagaaaaagatgtttaa

SEQ ID NO: 52488 - DNA, 2128 bp, Heterodera glycines
  Genomic contig location: Contig_ID=SeqID_21857; Location=160..2287; Strand=-
  SCN-specific regions: Sequence locations=1-274,304-750,797-819,841 -955,977-1153,1175-1324,1368-1591,1613-2034,2064-2128
atgccgagaacggatggccgtcccaagaaattgcgatgcctgacgtcgacattgtatcgacaacaaccagcaaatcttgaatggatcaccaatttcaaagaggtgtggtgtactaattgatttggtgattttgttgtcgggaataaatccattttttgggtgttttcgggaatatctaaattctcatttcgccatttttgcgttttttagtccatctttcggcaatttttggcaaatgttcacaagaaaaatgcaaaaaacacctctaaggatcaacttttcaggaaattaaaaaatatatactgccaacagtacgaaaatgtgagttttcgtcatcattttggccattttttgctaacttttctttttaatgagggttttttttctcgcaattttgccatatttggaggcattttttatccaattcccaattgttcagaaatttgtccgtgccaccacttcagtcagctaccaaatgaatttcgcaatgaagggttcaacaccaattgtgctgtttggattggtgaacgaacggacgaatgagaagctgacgctggagaaagtgccacggcaccccggcaattgggtgatgaaacgatgcccaattggggagacggcggttcagtgggaagacggcactttggatgccaatttcaacagtgtccattttataatggatattgacaaacaatgcattgggtgagtgtaaaagaggggacgagacataatttcgccgccgaaaaaaaaaaatccatatttttcttgaaaattcgaaaaaaaaattttaaaaatatttcttccccgaaattacgtcccggcgaattttttcgaaattttttccaaaatcgctattttcccttggaattgtcatgtaaaaaaattttctaatattttttttcttgaaatttgaaatgtcgaaactctcgaaaaatcatttgtggaagttcttccacagaaattaaaaaaaaaaaaatttcttcggcgaaatttttgggtgcacccgtaaaagatacataattctcaatcacccaaattcaaagttcacttaattttaggccattgtcgccaccagcagcggaagaagcgggtcaaagcaacgaaaaagtgttctcgacggacgattctcgggccaactgattgtgcggaatgaatgagtgattatttttgaaaatgtcgtctgatgattgcgcggaattaattattacctaattgtatttgagaaatggacggatttcaccaattggaaacggatttgatgctcattttccctcatcataaatgctctcctctctcaatttcatttgttgatttttctttcgaatacataaatttatttattaatttatttttgttttttgaatttttttgctggatgttccgactaaaaaagcacttgaaatagggatggcacggaattccgacattttttgggtcggaattgttacctaggaaaattttttaatccctaccggacaacaactaacaaataagcacaatattaccgaaagttttcccttcgagactctcgaactgaacgaaccccaaaaacatattttttgcccctttttcatttttaagctttcgctttccgtaaaaaacaatatttttttatttctcaacaaaaaaagaaaaaagtaacagcagaatggtgcaaaaaatgtctccgttctgtccaatggaccatacaaaatgaatgaatttgctcaacgcttgcgatggaattcgacggtgttttggcgtttccaacactttttgcgcgagcctccaatggtcttcgtgtgcttcattctgcaaaaatggggcaaatcaaatacatttagggaaaaatggaatgccaaaaaatcaaaattatgccatgaattattgcacaatcccctattaatattataggttttaaaacctagaaatttttcaaaaattaaaaaaaatcgctgaaaattttttcaaatgtaaaaattgccccaccctttgccgaggccacggcttttgcggccggccgaggtgagtccacgctgctcgcgatgcttctgcacgggtttggtgatccattgggtgtccgggttacgacgaatggtctaaaaaaccgagacaaatgaacggaaacagcgaaacagttatttaaaataaa

SEQ ID NO: 52489 - DNA, 777 bp, Heterodera glycines
  Genomic contig location: Contig_ID=SeqID_21858; Location=4..780; Strand=-
  SCN-specific regions: Sequence locations=1-359,405-643,665-679,701-756
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataagatttatcataaaatttcaattaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaaaagaattttggaatatatatttggaatttattaaaaattttgagaagtgagttagaaaattaaagatttaaagaaattttccttgttctaattatccgcgaaaaaaacattcaaatcaattaaatagcttcttgaaatataaggtttatcataaaatttcattttaaaataaa

SEQ ID NO: 52490 - DNA, 374 bp, Heterodera glycines
  Genomic contig location: Contig_ID=SeqID_21858; Location=816..1189; Strand=-
  SCN-specific regions: Sequence locations=1-374
atgcacgcgttttgcgctcgagctatttatcatcgggcttgtcaatccaaagagaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaccaattttcgttgctctaattaaccgcgataaaaacattcaaatcaattaaatagcttctgagataataaggtttatcataaaatttcatttaaaaataaa

SEQ ID NO: 52491 - DNA, 2916 bp, Heterodera glycines
  Genomic contig location: Contig_ID=SeqID_3931; Location=537..3452; Strand=+
  SCN-specific regions: Sequence locations=1-59,81-259,281-326,353 -428,451-461,483-529,551-957,979-1090,1112-1232,1254-1291,1313 -1902,1924-2053,2098-2350,2372-2651,2674-2916
atgatccgtttgttatgtgttcagttggattcgtcatccgagcgcgaggaaagcactcacgggacagatttgatgttggaaaggaacaaagagagattaagctgggagaccgcagaagcattggatcaaccagctgcagcaggggataaacaggcgctgaaaaatcctcgcgggggtcagtggtgaaaaaaagggcgaggggaaaattgtgcaacagaaagttggacaattcatcacaatattggtggtgaaatcccaatggggctacaggaaataaaaatacacttgttgtgcaataattcagtgtgtatttctccaattttatagccaaaatataaaagaaaattttaaagttagtcactacataaaaaaaactcataatcatcctaatttattaatgaatttttagataccagaataattttgcgtttaaaatatttaataaaaaaacgcttttttttacaaagttttcattttttaattacttatggcttagtgtttggcaccaattttggagtgtttttcgaagttagcacttattttccatttttaccattatttagtaggacatctttttgtgatttaagcctattgagaaatgatcttgatggcagattaatcagatcagcatcatatggacctgataaatatgtcaacttttgagcattgcattgattggaaattcttcaataggtttaagtgtactggactatttgtaactgatcagaattattattttttgcatgtctactgcaaataactgatcaaaaacttagttgaatgatcatgaactctttcattttacagaatttctgtatactgttaccgtaattaccgggaatcggtgggcggcggacacggaagcgaatctgtacattgacatgcacggcacggattctgattcggaacgcctgtggctcaagcaagaggtgaggagggcgcaaatactgggcgccaaaaagctttgccaaaaattattggcattttgtctgtctccccaacagtttaccagctggcttcacagtggaccagcgggaccacgttttcggcaaaaccaatccgattcctttacctttcgtctcccgtcacggctgggcatcatcaacaggcttactgtaggccatgaacggcacggctacggtgggggagaggagttaatttttcaaaaaaaaccatgttcttatttttggcttagaaaaaaaatgtctataaactttaatctcgatgtaatgattaaatatctttttcctcttgacatatcaaaaattttactggcgatatgccagcccctaatccttcagaaatgttcagaatttatactaggatttaaaaaatatcacgctatcagcgaaatccggtcgtcaatatttctgaaaaatttaattccgtccaagcctaatttgtatcggcatatgacagttatatccatgggattactgagtccgggttactgtggattttagttgaattccatgaatttgattacataatccacctatgttcagttggtcacaccattttgatcaattttttcaaggtgccggtgtgtttattgaccgcattttggtgacggaagatgaggtggatgaagcggatgaggagacgggggcggaagcgccggaagggcaaatgccaccattcgtggagcattgtggtgactgtcgccaatttctgttcctctgcaaccggtggttcgactcgggccaagtggacggaaagttggagcggaacgtacgcctcagtgccttttacatgatcagctcaatcccggtggacggacgcgtgacgcgtgagttttcatctgatcagtgatcaaaaaggatgattttggttagaaattgatgtgatcaatgatgatcagcaataattttagttcaaaactgatctgatcaatgatcagtcaaaattaaaattttattattactaaatctaatgtgttttattttagcaaattggttatttgatcatgataattttttgttcaattcaacgggataatgacctgaaaatcttggcttttaagatcccgctctgtcttggaatagatttactgttttaattgaaaataataatcttaaataatatatttgaatttttcttggcaaaggaagtcctggttgcttaccgaacctggtcgaaagcaaatttccctgtttttttttctcaaactatgcaagattttatcttttcaggcggtcgttgggagttcgttttacacggtggcacaaccgatggtcggggcagcaccagttctcagttagccatcaccggttacggcaccgccggccagtccaccaccaatggcctgtacgactctcgaatggccaacgcaccgtccgatgcactgatgcaggtgagaggaaaaacacatgctaattagcttattatggctcaatcaacccaattaatacacagctggactttggcaacattggcgaattgttgaaagtacgcgttgagcttgatggtggcgatggcaccagccctgactatttcctgaactttgttgagttcaaggtaagttaacgggggatgcgctatgattatgatgattcgcattcagattaagattgagaattctgaacgtaatcctaatagggactttaccgactaattttaggcaaattttttgaaaaatcgggtgatgcttaagaaacttagagaaacgaaaaacaaaatgaggccacgtttggagtgttaagcccaattttgaaatatttgctcaatttccatttacaggacttggacacggatgagaattttgtggtcatgtgcggcaaatggctgcgttggcgaagtgccaagaaaggcgatcagcccttccgggaactgatcgcttttcacattggcgttgaaccgttgccatgtaacatgacgggatgggaatggggaatttatataatattgtcggcctaa

SEQ ID NO: 52492 - DNA, 466 bp, Heterodera glycines
  Genomic contig location: Contig_ID=SeqID_3931; Location=6727..7192; Strand=+
  SCN-specific regions: Sequence locations=1-336,358-466
atggtgatcaccgactttcggggccgttccgccccattttatgcattcaaatttgccaggtgagcttttggtcgcaatactaattatcggatgaatcattctcaccatttggtcaattaataattaattagaccaaaattaattgaaaataagcgcaaagactagttcaaattggcctaatttgccaaaatttgcttaatagtctcagtttatttatttcagtcccttctctgtccaatgccgtgcccaaattgctaacgttttaccattcactgatgcgctctaatttatttgatcggacactgatcagatcccaacagttggtaaagcaaccattgacaaaattgatcgaagcattcattcgcgcattttgtacatacatatcgtaaattatgttcataaaaaatgtccattaattatcaaattatggtcattttataaacaatccacgacaaaaaatattaca

SEQ ID NO: 52493 - DNA, 612 bp, Heterodera glycines
  Genomic contig location: Contig_ID=SeqID_21862; Location=113..724; Strand=+
  SCN-specific regions: Sequence locations=1-84,106-225,273-353,378 -430,467-567,589-612
atgaaattgggtgcacttcatagagaattcttcgggctatcgaatgatatcaagattgttagaaattttgagtggcttaatatatatatttcaatgtgtaatttgatgacgacaactgacatctaactcatcactaacaaatatgatcagctgatttgtgagcaataatcactgaccaaaatcaatggctaataataaacggaatggaaaaacattaaaaatgttaaaataaaaatcaaaaaataaaagaaaataaaaagctaaaaacaaaataatattaatttataatttgaatttttggcacaactttatcttttatgctgaagagcttaaaaatgcattttaatggttatctaaataaaataaattaaaatgtagtttaattttacaaatccaattcaatgaagcgaattaactatatcaatgaaagtttttaaatttaattattttaaataatttttttttacagataatgaatcataacttagctcaaacttgatccaattaatcaatcttggagtttagcgacagctaaaagatctttactatcatatcaacttttaaaaatttagcaaaaatttatcaaacttgttactaaaaaatttcgaaaaa

SEQ ID NO: 52494 - DNA, 419 bp, Heterodera glycines
  Genomic contig location: Contig_ID=SeqID_21865; Location=181..599; Strand=-
  SCN-specific regions: Sequence locations=1-374,396-419
atgttcctttgtaagttcaaacatttatttcattgaaaagcatggtaaaaaaattgtagttttctgatcaataaaatgtcaatgccaatgaatggaatggccgaattcgcttcgttgcgtttgggggtgatccgagatagttcatttggcttttcgtaacgcgaattgaagcccgtacttcgtgttgatcgctttgattacatcgttgggcggctcccggccccagccacagaacagaatcagcccatgctcatcaatttccagccttggagctccgtccagcaccggcggcggtttgtgcgagtggagcagcacgaaataccacgcgatgccaatgcgaccatagcgcgttgtgccgtgcaacagaacgactcggtccttctcagggagctgtgacaatattcgagaacggatgttaa

SEQ ID NO: 52495 - DNA, 1268 bp, Heterodera glycines
  misc_feature (3)..(3): n is a, c, g, or t
  Genomic contig location: Contig_ID=SeqID_21865; Location=1061..2328; Strand=-
  SCN-specific regions: Sequence locations=1-89,121-550,582-1109,1146 -1268
atncaatcggccaaatttcacattgcattggtgcaaagtgaaagcatgctttcatcattgctgaaaattgtgaaagtttgggcgaaaagtaatttttttttattgaaaattaaatttattcatttagcatgttataatttgccttaaagctcgcttaatttattcgggattatttggctttttcaatggcatcactttgtcaataatggcaactcaaatttgcgttttgttcccaaattcacccgtatcatttttactttttcaattcttcgaaatttatgccaaatggtaaaaatattattaagcataatttttttaattcgtttttttaaatcaagggattggccaaatgttccaattatgctgaagcaattaactcctaacaaattgaacaaaattgtcgggcgtttttggccccccatttttttgggacaatcacttcaaagttcgatgacaataattacgccgagttttccagaacaaaatgctgcatttaatgtcaatcctttcacaatgaggacaattatcgaagaattaaaaattggtcgaaaatttaatttaatttaattaaaattaatttataaaaaattacttttcagcaagtgaaattttggcggagaatcctcaaaattgggaaaggatttttaaagagataaattatgaagaaaaatttgagcattttgcgctgattgtttgctcacaatcggtcggcttcgacttcgattcgtactcatcaaactgtgcctatcagaaaagccgacttcggcaaaatttgttgggatgggtcaattcagtccaagcccaattggacaattatcatcagatcccaaaatttgaacaaaaaaccatttgctacatattaaagtgataaatttaattaactctcgattcttttttttaaattttcaaatttagggaaaaatcattttgcactttttggctccttggcctttcactgaaaagagaatttaccacagagaatgaaaatttgaatggattggtgccaatttatcagcagaatcattcgaattcaccgcgccctaaacattttttaatgagttccttctttacaagtgcacaaaagcttcacaaaatgtataaaaaagtgcttaaaataatttttaaattaattttttgattttttaggattgatcaattaaagcatttgttaaatgaatctgaggaatttgacgaaaatgtgcagaatgaaatgctattaaatgcgtaattttaattgatttataatgaaatatttttgcttcaataaa

SEQ ID NO: 52496 - DNA, 1363 bp, Heterodera glycines
  Genomic contig location: Contig_ID=SeqID_21866; Location=176..1538; Strand=+
  SCN-specific regions: Sequence locations=1-138,169-182,220-347,377 -465,517-834,858-1009,1033-1196,1225-1363
gattgggccaacaaatgtgagggcgatgcgcccgtgttgccctgtcaggatgtgaatgcgcccgacctgtacattccgttgatggcgttcatcacctatgtgctggtgtctggttttgtcttcggagttcagaaaaggtatatatatatatatatattttttttttttgcaattcggtttcgtttaaatttgttaattttgaaaataaaaaaaaaatttctggtacaattggcgaaatcgcggggatacacccatcactttttgccacaaagatctgtacattgaacatttttaaatcaaaaggttgcgattttcattgaaatcggtgctcaagcgattgcgcaaatttttcattataaaaaattaaaagaaaattacggttttttcaaaaaaaaaaaattcggacatgaaacgataagggggggacaaacgtagtgcacccaggcgttatatcgatagacatggaaaaaaaaaatttttttaaacttaaacaaaaattgataaaatttaaaaaaacgatatattttcatctgcaaacatgtttcatttcatggcgacatatagtaaattattttagattccctaaatttataaagcatatctaaccaattaccacaaccaaaagtttttttttcaaaaaaaattttctctttttttttgcaggttcagccccgaaaagcttggcatgctgaccacaaatgcgttgttctatttgttccttgagaatggcattgtgttcgtgatgaaatacgcgttgaacatttcgcagagtttgaacatttggcacgcactgtcctacagttcctacaaattcaccgggtctgattttttggcatttttaaaataaatttatttttccccactttttaggatggttttgtgccttttgctctatttaattggcggtcgaaaagtgtattattgtgcactaatttacttcatattggcaactgtgtttttcctggtaactggatttgaacctggactcaccagaaatgcaaacccaaagaaattttttatttttatttttttgaaattggaataaaaatagagttaatgccattttgcttgctgtttttgaaaattatttttttttattcaattccgaacgaaacaattttttgatttagcaaatctcttatccagctccttataatttaaatttcaaaatttttcaatccattgatttcatcttcaaaaaaaatctaaaaatttaattttaatggtgccaaattcagttgcgcagtctgaagacgtttatcctggacatgggctggagcccgcacagcgggcgcaagcggaagctgtacctgttgttgtccatcaccgcgttccagtcgctgatcatgtggttgttgaccag

SEQ ID NO: 52497 - DNA, 1330 bp, Heterodera glycines
  Genomic contig location: Contig_ID=SeqID_21867; Location=351..1680; Strand=+
  SCN-specific regions: Sequence locations=1-628,735-1022,1054 -1163,1185-1330
  Gene Ontology: Mol. function=heat shock protein activity; Cellular component=endoplasmic reticulum; Biological process=response to stress
atggagcgtatcatgaagtcccaagcgtatgccaaagcgcgcgacccgtcccaggaattctatgccaagatgaagaagacgtttgaagtgaacccacgccatccggtggtccgggaactgctccgccgggtccaggaagatgcggaaggtgaaattttggcaaatattttttcaattttgtaacattaccacaatttttcttggtacacagatccgattgctgtctccaccgcccacttgttgttcgagaccgcaacactgcgttccggctactcgctggacgaccaagttggcttcgcggagcgcattgagggcgtaagttttttgggaactgtgcaatagcaatcaaatagacagacggacggtaccaaggggacgagggtccccacagggaggtaaatttaggagaaaaaaaacgaaaaacctataggcctatccaaattttttttctcttttgtgaacccaaaagccaaaaaaacccgtacgccgtcagggaacttgataatttgagcgaaaaatccaattttcatccattcatttattcagattttgcgcaagacaatggacctgagcgaaaccgccgaagtggaggaagaaattgagccgctggaagaggaagagcccgaaaagaaggaggaggaaggaaaggaagaagacggaggagaggaagatcaacagaaggaggaggaggatgaggaaaagaaaattgttgtggagggagaggaggaggaggaagcggcggcgcgagacgaactctgaagagagggagaggccgcaaaatgacgagcttttttttggagggggtattatgccttagggcgcgaaagaaatgatgatctgttgttgtttgtttttttctttttgactgattgttgcatttgatggatgttgtgatttatttgtggggtttagccggccgttattcgttcgttgattattatttattatttggacaaatttgacacacccaccacacactttgtttcccattttgagcaaaaaccgagaaaagagctttatcattggacaatgttcatgtttctgtattttatgcctgtgggcaatttgtgtggccagtggatttccacgaatttaaaaatttgcataattttatgaaaggtcttggcaaatacctttcccagtagagctgcaacctggacccaggcctgggtttttcccgggtccaggtccatgccatttttcgtcaacctggatttttgttctgaaaatataggctatgacacgcctgggtttttttgtccagcaggaaatccagttttttcgaaatgtcgagctcttaaaaaaatttccatcggtaggattaaagaca

SEQ ID NO: 52498 - DNA, 117 bp, Heterodera glycines
  Genomic contig location: Contig_ID=SeqID_21868; Location=113..229; Strand=+
  SCN-specific regions: Sequence locations=1-117
agtgcgccgtcatgttctaacttaactttgtttcgttttgttttaattttttctgctggtccatattatataatttaaatagccttaatttagtttataaactcattaaattataaa

SEQ ID NO: 52499 - DNA, 106 bp, Heterodera glycines
  Genomic contig location: Contig_ID=SeqID_21868; Location=271..376; Strand=-
  SCN-specific regions: Sequence locations=1-106
cgggccaggacgttttcgcgtggccgttttcgcgtgaggtacgttttcgcgtggccgttttcgcgtggttgcatataaaaaagaattcataactcacattatattt

SEQ ID NO: 52500 - DNA, 787 bp, Heterodera glycines
  Genomic contig location: Contig_ID=SeqID_21869; Location=741..1527; Strand=-
  SCN-specific regions: Sequence locations=1-109,132-169,203-787
atgaattctcttaaacgctttcaactcccggagcaagggacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaaattaattaattaaattattaatttttctgtttttaggcatgcccattccgttccaaggggctcatttgccgccgaaaattgtccgatgataacatgtgtgaggcttgcggccaaaaagcgattgcccccatccacacggtgtttgtccgtcttctgctgcaggatgttgaacaagcagacattgctcaacgtgtcaccatgttttcgagtgttgccgaagagtttttgggaatgaaagctgctgaattgctcgccaaggagaaggagccggaaagccttgcgaaacacttggacgatttgattgctgtgaagctgatcgcaaaagttaacattaaggttttttgttgatatttattatgtatttgacaaaccacgccctaggcgaacaatcagacgtacactggatttgattggattgtcaaccttttcaagaagtgcccagggaatgatgacagtgatgtgccaaaagaaaaaaatgatgttgatgagattgcaaccaagaaggccaagaaaaattgatagagagagagagagagaaaaatgattcatttgttgtgagctttaaaaaaaaagattgagcatgtcctttacttttttttaaatccattaaa

SEQ ID NO: 52501 - DNA, 120 bp, Heterodera glycines
  Genomic contig location: Contig_ID=SeqID_21870; Location=1345..1464; Strand=+
  SCN-specific regions: Sequence locations=1-120
atggccaaattaattaacggcaatgaaattgcgcaacaatttttggacgaagtggcccagggaatcagccgaattcgagaacagaacagcgacttcaacgttggcttggccattgttcag

SEQ ID NO: 52502 - DNA, 1052 bp, Heterodera glycines
  Genomic contig location: Contig_ID=SeqID_430; Location=223..1274; Strand=-
  SCN-specific regions: Sequence locations=1-118,140-192,215-332,354 -438,460-485,521-669,691-1052
atggactttgaccgcttccgacaatacctgacttccggatgtggtgtcggaagaaatgattgcaaagatgtccgaattgaatgcagaaccaattctattcaacaattagtaagtacgcaaattcaggcccttagccagggggagaggaattccccctctcgccaaatcaaaattattcaaaaaatgcattttttaatttcctccattttcttaataaatttgacccaaatttttttatgagttttcccaggaggagaattttttgatgatttggtcaaaattgtcatttttgggaaaacttactataaattccgactttttctgcccggcgttgaaaattttgaaaaacaaaacccgagagaaaacattttgtccgatgagcaaaaaggtcttcgggttccccgctccgaaatttttggctaagtgcctgtacacaattattatacagtcatggtcatatctttagactcactttaagtattggcattaagaagttaaaaataaaccaaattattttaaaataaacttggtcggattcatagtaatcggaacgcgaagaaaaaaatctttacgtgggaaatttatcgaaaattttgttattgagtttgaaaaaaacttattgggcacggaatacgtattaaggactaacaaataagagaaatttatctacaaaacctcttttgtttgtttacttactagctttctccgctgagttttggttgaaaacaattattttacatagtaattattcttactgtatgatccattattttcttcagcctatttccccatgatagtagtagagtcttgcgactttaagtttatagagaattttgtgctctttctaaagatctttttgttttctccagaaactttttccaaccctaagggatttactaaaaatgaaaatggctaggctgtcagttaaacaaagtttttagtacctttctgcgccggttgaggacgcattggaagctgctgcaacggcaataatccaaattcatgttgagaaacaatacggagacatccttgttttcgttgaaggggaggaa

SEQ ID NO: 52503 - DNA, 488 bp, Heterodera glycines
  Genomic contig location: Contig_ID=SeqID_431; Location=5101..5588; Strand=+
  SCN-specific regions: Sequence locations=1-273,336-373,395-488
atgaagaggaagagagtgtgccgagaagggaaatgtgtgagtcgagggggggaggacagtggcggttagagccataattgaaggtcaccggaggggcagcagatggaagcaaagcgacgggaaagagaaaataagggaccatatcttttttagcccaaaaattaacacattttccgagaaaaaatttaaaaattggtatggactaaattatataataacgagggctgggaatttggctctaggaaaatcggacactggaaaatcgacaccaactttaaattttaaaaataattttttgattctttgctttaatatttaaaatacatataaatttagcataaatacacatcacaaattacctataaaaatggacaatttaaacaaatctcttgggatagggattatgctttcttaacgtaaaaatagcaattggaaaatgcgccagtaatacagtattttgtaaaaataatattctgtagcaatatgta

SEQ ID NO: 52504 - DNA, 588 bp, Heterodera glycines
  Genomic contig location: Contig_ID=SeqID_3933; Location=520..1107; Strand=-
  SCN-specific regions: Sequence locations=1-588
atgcggaaaagaagaaaatcgcgttcaaatgagaaaagccttgaaatggtgaaatggcctcctgcaaaagccttctacaacgcttacatcaaacaaggtatatatgcaactctacaagctctaaattagtgttcttttgatatttcgcaagttttcctattctgtaaggattccttacatgtgaatttattttgccctatgtgtaacaaatagttacactacgcttgaaactaactaagttggaagaactcttacatatgagcatgcttacacacaggttaatcaataaatttcatgtaaagcctacggccgaggcaccgatcaccaattccaaaaagcagcaaccatcgctggacgcttccgcgcaaacttcttgggatcgtcgaccgctcgattggcgtcagccgcgtggtacgccacccgtggagtttactacccaatcgaggactgcccacccattcctgacgatcaggacgggtatgtgccaccagaacagcctggactcaacgcggacgaccaacctgtcactcttgcaaaggcattgcaagatgttagcaattttttacgtcttcaattttgactaataaa

SEQ ID NO: 52505 - DNA, 1903 bp, Heterodera glycines
  Genomic contig location: Contig_ID=SeqID_3933; Location=1374..3276; Strand=-
  SCN-specific regions: Sequence locations=1-25,50-259,288-300,322 -334,356-491,524-678,714-1412,1442-1513,1536-1541,1563-1595,1623 -1782,1804-1903
atgtactctcgtcttatctccaattctcctcttccacctcatcctcttcctcgtcgtcacttgcgccagcagcagtcggcgtcggcgtcagcagcgcagtacagatggcttgggcaacaggaagagcgaaaggttgctgcaaatgcacggcgtcagcagcgcaaggaattggaagctgggcccatgtactgcagtttctgccacttgttcggcacccatgtcgtcagcaactgtcctggtgacaaaggtgtttttttggaaatttaattttatttatttaaaaatttgaaaaccaaattctatgttttctaattttgaaaaccaaattctatgtttttctaattataaggaaatggatttttaggaataatcgccgccgcctgcgaagatggtggacttcaggctgagaatatcattcttttttgctgctgccagtgctgcaaattgcgcgggcacaagccaaaggactgctggacattggctgcttggcgtatatttatttatttatttttttaaatataaagacgacttcaggtgaaaaccttgccgcaattgcgtcagcaggcaaggaactcacgttcaagtggggaaaacgccgtttcgatgcgcgcggctatgccgagaaaatgtgcatcccacttgcgtcagcatgggatgtgctcggtaaggacaactaccaattttttgatattttataaattttcttaattattgtagaggaactcagagcggcagcgaaaagtgccaatgaattgtttccgccgcaatcgacaaaatggatgtgttttgcgtgccaacagacaagccaccgcaccgtgaaacattgcctcaacaaggtttaaaacaaatttttttcaatttatcttatttatttctttaaacaggacattgtgcgcaagtaccaccagttccttcgcacctgtccacaggataagcagacgatgcggctggttttgtctgacaagcgcggcttggacggcaaggtgctctgcgaagttgtcgagggcttcggtttgttttgtttcgtggttattgctttttgttctgtgatttaaattttgcggtttttttagacgggaagatcgtgcgccggcgtcagcaagaagaggaagccaaagccaaattgcgtcagcaagaggccgccgccaaattgcatcagcaagaggcggaggacaaattgcgtcagcaagaggagcgggagcaccttcgttcccttggggttagttttgtctcactcagttaaaaaatgcttacagctagtacagtttattctgttagctgttggctttacttacatgtcgtgttttaaaaaattgttttacagcggatgcccgcagcgctgctgacgttggcaaccggtcatcccgtcgatcatctggacgctaagaacagcatcgtcagaatgctgatgcagctggctgaggaggaggaggcggagaagaccccccactaattcttttttttcatatatttttgttttgtcacccccaacggctgtccccattgggacgggcgggtgggtggtggccggcgggtggccgaatgttttgaaaattaaaattgcgatcaacaggcgcctcaatagcgaggcgtctctaacccaaacggccctctttagggccgtaagagtgaaggaatacagtctgcccgccgtccacaaatttataactcatatatttgttctccacttagccatagctgggggatatgctagtgtaagcataactatttcggtaaaatgtgtattttacattagtattaaacgcttacactagcccgtctcccagccagcaaagacccctgccgtttttcctcaaatctttgaggttttttacccggcgggtcttcttctcaccccccccccacttcatcatttattcttttttattgtgtcagcaataaa

SEQ ID NO: 52506 - DNA, 557 bp, Heterodera glycines
  Genomic contig location: Contig_ID=SeqID_3933; Location=3361..3917; Strand=-
  SCN-specific regions: Sequence locations=1-42,72-89,111-248,277 -437,473-517
atgtcgtcagcaactgtcctggtgacaaaggtgtttttttggaaatttaattttatttgatttaaaaatttgaaaaacaaattctatgtttttctaattataaggaaatggatttttaggaataatcgccgccgcctgcgaagatggtggacttcaggctgagaatatcattcttttttgccgctgccagtgctgcaaattgcgcgggcacaagccaaaggactgctggacattggctgcttggcgtatatttagttatttattttttgaaaaataaagacgacttcaggtgagaaccttgccgcaattgcgtcagccagcaggcaaggaactcacgttcaagtggggaaaacgccgtttcgatgtacgcggctatgccgagaaaatgtgcatcccacttacgtcagcatgggatgtgctcgctaaggacaactaccaattttttgatattttataaattttcttaattattgtagaggaactcagagcggcagcgaaaagtgccacattgtttttcattttaattgtaaaattatttttaaaatttaattattaaa

SEQ ID NO: 52507 - DNA, 565 bp, Heterodera glycines
  Genomic contig location: Contig_ID=SeqID_3934; Location=1004..1568; Strand=+
  SCN-specific regions: Sequence locations=1-30,52-111,149-565
cttcaaggcagaagaggtgctgaacaactgaaaaagaggcgagaggaggaaaagcgcagacggagagggcgagacaaggccgatgggccaagaaaagtgagttttttcatcaattttatatcaaaaaaattaaaaaatcattttttttgttttccagccgctacacaaccgaatcccaatgccgaaatagcaccgcagaacgaagcagggccgtcaacatctgctgcatcaacggaagaagcggtggagcctccgccaccagctccaggaccagtgccaacgccagaatggacgaggaaattttggaatttggcttctcggcaaaattcacaatttttcaaaagtgttttgtccgattttattgagataaaatcataaattttaggcacaaattttgtccccaaatgacctggacggacttgagcgatcaactgacgatttcaaagtatttttggcagagcaggaccggatgagtgcctttctctcaaagaaaccaaggccttattctactcttccactttgtgccatttgcacgacaacatcaattcattggccttttggatga

SEQ ID NO: 52508 - DNA, 79 bp, Heterodera glycines
  Genomic contig location: Contig_ID=SeqID_3934; Location=672..750; Strand=-
  SCN-specific regions: Sequence locations=1-79
tagagaaaaaaagataatgtttttctctggcactctctatttattggtacacatctcgttttttgaaacggtgtgtgta

SEQ ID NO: 52509 - DNA, 548 bp, Heterodera glycines
  Genomic contig location: Contig_ID=SeqID_3934; Location=1674..2221; Strand=+
  SCN-specific regions: Sequence locations=1-95,122-290,325-446,468-548
atgcctgacgcggaacaaattttgcaacaattggagcaccatttcgtcaacaattggctgctggacaccggaaggattgacgaattgaagcgggtttgttttttcaaaaggtttcccatttctgaattctcatttttagaattatgaagaaagggagggtgaggatgacacggataaagaagcggcggaagaaattgatgacgaatgccaaattgatgtaatttaacaaatttggattaaaggatgattttcaaaaaaaaagtgaagtaacaaaatgttttatcatttttgtttattttcagaatatttatttgtcattttacaagtcttattttgcttaaaatcaccaaaaacgtccgttaacatggatcggattcgaacctggaaccccccttttggtgactagcacatataccactgagacaaaaattcaaatctttttggaactgggaggaaaaaactgaaacggtgtgttaagttaactaaatttatactatttaaagagcttatagtggacttaagtctaaaaatttataacgatattatta

SEQ ID NO: 52510 - DNA, 980 bp, Heterodera glycines
  Genomic contig location: Contig_ID=SeqID_21871; Location=145..1124; Strand=+
  SCN-specific regions: Sequence locations=1-468,491-980
  Gene Ontology: Mol. function=transporter activity; Cellular component= secretory vesicle; Biological process=locomotory behavior
atggctcttctgaaaaaatttgaatcaaagagtgcacgagttaaaggtgtgttaatcagttaaaaacacaattcataatttttatacaaatttttgtccaggcatttccttccatcccacgcgtccgtgggtgttggcctctctgcacagcggagtcatccaactttgggactaccgactgtgtgtgctcattgacaaggtttttcaatggaaagctaacaaattctgggcatttacgacccttttataatggagggggagggtgatggaaaagccaaaagtggtgctaaatagggtaattaatttgttttgttcttttctaaaagaagcaaaacccctttgggttcttcgaaattccacgcttccccctcatttataaaagtgccatttaacttctcgtggttggagaataagtactcgcatcaataaatgtctaattcattcgcattcagtttgacgaacatgatggacctgtccggggctgtgacttccattcgcagcagcccattttcgtgtcgggtggcgacgactataaaatcaaggttaatacttttactctctgcacattaattagtcaacctcataacagttaatcctgggattttttcaattctattgaaacaatgtaattcagaggcttacaattactttattttcttgaaaatcctaaaaaaaattgacgggttcgtttcaaagcaattttggtgccaaaaagtatgggaatgaatgtaaatgcccattttaattgtaacactgactaaattatccatttcggagtttctcagtccgttccatgtccaatgttcaggtgtggaactacaggcagcgcaagtgcattttcaccctgctcggccacttggactacattcggaccaccttcttccacaagcagcacccgtggattatcagcgcatccgacgaccaaacggtgcgcatttggaattggcagtcgcgcaattccatcgccattctcacaggtt

SEQ ID NO: 52511 - DNA, 633 bp, Heterodera glycines
  Genomic contig location: Contig_ID=SeqID_21871; Location=583..1215; Strand=-
  SCN-specific regions: Sequence locations=1-581,604-633
atgtatgtggaattgctccggtaaactagaaaagtaccaaaagattggaatggcccttttcaaatacaaaaaatgtcccctcctctcaaaaaacctgtgagaatggcgatggaattgcgcgactgccaattccaaatgcgcaccgtttggtcgtcggatgcgctgataatccacgggtgctgcttgtggaagaaggtggtccgaatgtagtccaagtggccgagcagggtgaaaatgcacttgcgctgcctgtagttccacacctgaacattggacatggaacggactgagaaactccgaaatggataatttagtcagtgttacaattaaaatgggcatttacattcattcccatactttttggcaccaaaattgctttgaaacgaacccgtcaattttttttaggattttcaagaaaataaagtaattgtaagcctctgaattacattgtttcaatagaattgaaaaaatcccaggattaactgttatgaggttgactaattaatgtgcagagagtaaaagtattaaccttgattttatagtcgtcgccacccgacacgaaaatgggctgctgcgaatggaagtcacagccccggacaggtccatcatgttcgtcaaactgaatgcgaatga

SEQ ID NO: 52512 - DNA, 867 bp, Heterodera glycines
  Genomic contig location: Contig_ID=SeqID_21872; Location=544..1410; Strand=+
  SCN-specific regions: Sequence locations=1-253,275-286,308-549,584 -599,621-648,728-762,785-867
atgtgcaattttagcaaaaaatcagctaataaacaagccaaattttacataattcccggctgtgtgttatcgctggatactaatagtcaaggttaggctttatttttttatatgctattatgtgaaaatgttttggcataataagctttttttcattcagagaatatataacgcgcaagatttagttgcacaatagtcggctaaccacaattatcattacaagcgcttggaattatatgtaataaaaattgcaaaattggatataaatatttttaaaaatgccgaaatatgctaaatatattcaaaaactcaaaaatatgtacctaatgtaaataaatgatttttgattttttagaaaaaaatatattagaaaagcatgaaatagggcaagcgcaaaatgccacgaagttaccgaagatcttcgaataacattttgtgtgttttaaaaaatttgtttttatacgactttttgaaaatgccattttatgggtacattttccaattttttgtattttttcttaaggaatttctaaaaattcataaaacttcaaaatataaaaaataaaaatatttaataaaaattgcaaaattggggtattgttttgatcatttaagaaaaatttccataaataatcttcaaaaatagccatattatttgaaataaatttggttttaattgaaataattataattatcttaatttattatatattaaattaaatttttactttaacatttgcctatataaatgaaaaacaaaagaaaagtattatttataatattttcagttgaaaaaatacccttactaatcaaaaaagcattcaactaaatgaattgaaaatgggacatcaattataaaagctttaa

SEQ ID NO: 52513 - DNA, 855 bp, Heterodera glycines
  Genomic contig location: Contig_ID=SeqID_21872; Location=1525..2379; Strand=+
  SCN-specific regions: Sequence locations=1-358,403-496,521-526,548 -595,617-855
atggacaagtgggctgcacttgtgtaagttaattgggtgggggaggggttaattgcccctagaatgaggcaatcaaagcaaaacccgaaaaatactgatcaccaaaacggtttaaatgcgtttaattgatctaaattaaaacaaaaaaaaacacgaaaatgagggtttttaatcggtgttaaatgggaaaccgaactagtcctaaacgaatcgagaaacacaggccaaatatagactatctgtccactttcagtctgttgatcgccctgatcaacgcgctggacagcgctgttgttcgacaacagcgcgccgccaacgcggacgcatcgaaaccggaaccgaacaacgaaaagccaggtaaattaaaatgaatttaataaaaaaaatttaatttattaatttgatttaggaaatgtggactgggacaaaggaaattcggacaaaagccagggagcgggtacggaaggaaagaacccggatgagccaacggaaagccagaaagtggaagaggatggaccaaatccgaagaatccaaaggaaagccaggaagtggaagaggatgaaccaaatccgaagaagccaaaggaaagccaggaagtggaagaggatggaccaaatccggaggagccaaagaagccgggaacgcgggaagcggaaggaacctggaggaaaaaaggccaaggcggaggcggaaagaaaacgggtggaaagggagggaagaacgcgaaaaaaaggggaaagagagcgcccgatgagccggcaccaaagtcgccgaaaatgccggataaatttgacctaaaactgccaagtatgcataaaacactgatcgtcctggggtcagatccaatcttctga

SEQ ID NO: 52514 - DNA, 508 bp, Heterodera glycines
  Genomic contig location: Contig_ID=SeqID_21876; Location=801..1308; Strand=-
  SCN-specific regions: Sequence locations=1-199,223-228,257-264,287-508
atgttttaaatgccgatcaatcgggcttcgagctcgagctgcatcaaaaaaggtcgttggctccaattggaaccaagcttgtggaatgtgttgtgcagtcggtttcaagcacaacacatagctatacgatcatgccaatcattacagctgatggcatgcttttgtcaccactatatattgttattgctgaaagacaaggaaaatttcctcaaaaaggaatttttcaggtttaaattattttattaatttttaatttgctaaaaattaaggccaaaaatgtttttgctgttccaaatacaagccatattatgaccaaaaatttaatgatcgattgggttcacaatgttttggtcccagttttacgccctggagaacaatcattattgttggtggatagttggaatggttggaatgattttcgactcccggataatgttaaattaaaagtgaagcaaatcccaaaacatgcaactggaatatgccaaccattagatgtttacattttccg

SEQ ID NO: 52515 - DNA, 173 bp, Heterodera glycines
  Genomic contig location: Contig_ID=SeqID_21876; Location=48..220; Strand=-
  SCN-specific regions: Sequence locations=1-2,24-173
gcaaatatttatttaatttattgcgataaaaaaagtttggcacgtcataactcggcactcagactcatttcgcagaaaataaaaacacttttcttaagaacccatgggtgctctatccacccaccaaatttcatttggaaatcccacggacacctggggaccttcctttgtca

SEQ ID NO: 52516 - DNA, 569 bp, Heterodera glycines
  Genomic contig location: Contig_ID=SeqID_21877; Location=154..722; Strand=+
  SCN-specific regions: Sequence locations=1-80,103-108,144-200,222 -276,300-569
atgaacacattcagcgcatttttgcggccatgtgggacaaggataagttccaggcccattacaacaactgccgacattggagtgacggattttggtggaaagtgtaagaaaattaattgtaaaaaataataataaattttattgatacggaaaataatttaaaaagacgttttctctaaaactaattaattctcagttttttgtgaaaattaattaaataacattttcagtggttttttaaaaagcaaaaaaattcactgatttttaaattgatatatgctaattttctaaaaatttaactgagtttgggttggaaaatctaagttttaatatgaatttttaatgtcttaattaaccttaattgcttaaagacaccctgatgagtaccaaaagaaaaaggcagccgaagaaaaaatgggcgcgagaccgttggatgtgaagagttaaatggcaaaattaatcatgtgttttgagagaataatgaaatctttcgattttattcaaaatttattttggtatttgtcacaaataatcatatttacacagaaaaaatattgaaagatatcaaa

SEQ ID NO: 52517 - DNA, 438 bp, Heterodera glycines
  Genomic contig location: Contig_ID=SeqID_21877; Location=1312..1749; Strand=+
  SCN-specific regions: Sequence locations=1-260,286-438
atgggaaaatgctcttcaaaattagtcaaatttttattttgctttttacgattaatactaattgggtcattggagcattacctgattcaactcaatgtgtagcaagcacaacaatcagcaaacaatttacgaacatttagacatttttcatttgaaattattttaatggagaattggtgtcggacatagacaccattgatggtttatatccgggtgtcaatttactcgcataacttgtatcaagaacgccaaaacaggtaacataattaaattaaatgaataaaaacataaattttgatttttcaatgtttgcaggtggtatcattcaacttcatgatgcgtatcatattccgcaattcacaactgctagacagtttgattaccctttggtctatcgacaccgacaaacatctatgcccaagtatggcaattcattaa

SEQ ID NO: 52518 - DNA, 948 bp, Heterodera glycines
  Genomic contig location: Contig_ID=SeqID_21878; Location=646..1593; Strand=+
  SCN-specific regions: Sequence locations=1-183,206-287,309-686,708-948
atgtctctttttcttcttcgtgctttgcctcttttcttccttttctctctgtgcttcgctgcctctcccttcaattttcgcgcaaatcattcgcttggtgccgaaaccactcaacagattgtgcccaccgtggcgactgaaacgaccgacggaccgaagcctacggaaaatgttccccttatgttggagaatgacaatgtcaccgaagttgccaaagttgaaggacggaatgccagtgacagcgaaattgaaatgagggaggaccaaggtttgcaaaaggaatgtaaaaaatgggttttcattttcaacggattcggaatggatttccttaggtttttaatttgggatggatttaatcgattatttcaaagtgtgattcgctttaaatatgtgtcatttgtttagcctttgccaacatcactgctcattcctccgacaatgcttcgcttactgagagttgtggcttcttttgccgaaacggtactgccaacaaagcccgaaaaacccaattattttctgcgtttagctaaatattccatacaaaaccatttttggcctaaaaaataatgcattccggacagtgtcctctaaaattctgtcagatttgctccggttctgccaccaaaaattccttcgtttttcagtgcctttattcgtcggcttcatcttgaccctcgtctgcgtttctctgctcctcattctttccattgttttgtaccgttattttacgcggcgcacttacgccgacgagtgaaaagacagcgaatggacgcaaagaaacgatgattcttcttaaaatgtcatttcattttgttgagccatcaatcaatttgttgcttttcccttttgttggcctcctttttgaggcctttggatttattttttgatcattttttgctgaattacaatacaacactatgatttgaataacgtttctccttttgatga

SEQ ID NO: 52519 - DNA, 116 bp, Heterodera glycines
  Genomic contig location: Contig_ID=SeqID_21878; Location=56..171; Strand=-
  SCN-specific regions: Sequence locations=1-116
agtagggatgcgatttttggattttaactgcgcgcctaaagtgtatataaaagcaacctgcttcattcacattcacttttgccaacaccaccaactgttcactcgtaatttctgag

SEQ ID NO: 52520 - DNA, 818 bp, Heterodera glycines
  Genomic contig location: Contig_ID=SeqID_21880; Location=1911..2728; Strand=-
  SCN-specific regions: Sequence locations=1-203,259-362,388-423,445 -474,496-505,612-617,639-818
atgaatttaaataaaattgaatttaaaagaatgaaagatagtttttataatgagaaaaagaaagaattctttgaaagatttgatgactttaaaaggttatgtaaaggcaaacaaaaagaatttacgaaggaattgggaatttcagaaaaagcatttcgaagatggaaaaaagaattggtgccaaaatattataaaagtaagggaaataattagatttttattaattattatttttaagcatgcaaaagacattctgatgaggagaaattaaaaaagttgaagcaatattttaatcaaagaaagaaatccaaagtcagcgatggaataattgcaaagcaattgaaaattggctatgaaacgctaagaaagtggaaaaagaaatttgcttcagtttcgtagatgtaattttggaggatgttattgtttgttatatttgattattttcccattataattttcgttatttgcattatcttttcttagttctgttattaatttccttttcatatattaattttattgaaatataaaattatattaagcttaaatatttattttcattttatgaattacatttaaataacattataaaataatatttttttaaattagtacccaaaatcaaataattcacaattccattagcaaaatcaaaaaattgaaaaaacagcaaaaagcaattaaaacaccagcagaacagacgaacataattaactaatctctattaaaaaataactggaagggaaattaacggggacaattaacaaaaatgagagcacagaaaaatgtaattagataacaaaactaatgccaataaa

SEQ ID NO: 52521 - DNA, 188 bp, Heterodera glycines
  Genomic contig location: Contig_ID=SeqID_21881; Location=1695..1882; Strand=+
  SCN-specific regions: Sequence locations=1-30,52-188
aaaatttaaataagttttggcaaaatgtcccccttttcctctttctcctttccatcgtcgctttggtgcttctccttgccgcttctcccgccgcttccttcgctttctatcccgtaccttggcctttgacgacgacgccgtcggcagaagatgacgaagcgttttacgataattatgacgacgaatga

SEQ ID NO: 52522 - DNA, 739 bp, Heterodera glycines
  Genomic contig location: Contig_ID=SeqID_3935; Location=70..808; Strand=+
  SCN-specific regions: Sequence locations=1-528,552-590,612-631,654-739
atggaagaaaaaacttttgtcgcagttgaaagacaaaaaccggtgccaaagccacggcgacaccacacaattggcattttagcatcagcagaaggccaactgaaaaacgaacacccggacaaagaggaagcggaaaaagcggacaaatcaaagggaaaaaatggggcggaacggagaaaaagtgtggaagaaaagcacgaaacgcaacagaaatatgggacggacgaacagcagcgtaacggggtcagttggtcattcgattgaccattaggccaattgtccattcttttgacccaatcgatcactctttggccaattgtccattgttttgaccaatcatttaattttttgacccaatcgatcactttttgaccaattgtccactcttttggccactgtgaccaatcacttactcttttgtccccaaatcgatcattttctgaaaaatatccttgacccattttacgctttctttttgaccaaccaatcattttttggcctttcatttttattctttggcctcttttaaattgtcaaaattcagacaattcgctcatcgcagcagccaacaaaaggccctttcaaacaacaaaagtgggaaataaagacaaaaaattaacattttatcacaccaaaacaaaaagaaatgcccaacggaacatcggaagaccaaaggtcgagggaaagcgattgccaatggtcggcaaatggcaagacaaagcgaatgaggacaaagagg

SEQ ID NO: 52523 - DNA, 610 bp, Heterodera glycines
  Genomic contig location: Contig_ID=SeqID_3937; Location=357..966; Strand=+
  SCN-specific regions: Sequence locations=1-239,261-610
atggcggctttttgcgcggattattttctccgtcgccgcagcgaaaacactcgtcgacgaacagaacgacgacaagcggcagaagaaggacaatggcaaggaatgaagtgtacggaacgctgtgggaagagccggaattgaacaacggcaacaatagcagcaggtcgagcagaacggcacaaatgatcaaaaatcaaggggggatgtctgatcagccaaatttgaggaatgacactgatcagccaaattggggggactggcaccgatcggtcaaattaaaaggaatggtactgattagccaatttcgagagtatgacaattaattaatcatgggtattaaatttcgtttatttttcagcgattggcttgcccatcaacaacgcatactttttgcgcgcgaagctgaagaacaacagaaaagcggcaaatcctttttcgcccgacttaagggattcaagcggacaaattccactttttctttgggctcaaaacgcgacgacaccaatggcttatgcttcgatgacagcagcggcactttaacacaaagtgacgcccggggaaggggtggggtttgaccatcatttttaaaaatcttgccaaaaatactaaa

SEQ ID NO: 52524 - DNA, 2571 bp, Heterodera glycines
  Genomic contig location: Contig_ID=SeqID_3937; Location=1285..3855; Strand=+
  SCN-specific regions: Sequence locations=1-1394,1416-1820,1846-2571
atggcggaaaggcaacgaggggatgagaaagagtgcaaaacgccagcggaagagacagcgcaacagaagcaaaagtgagaacgcacttggaaccccgttgatcattaattagtgcaaccacaatgatcaacaaatcacttaattaactgtttttgattttagcaacagcacaactccgtccgagcccccgattcttttcaaaattttaaaagattgatttacgcgtattatttataatgccaaaattaaggttctgaaaaaaaattaagtttccaattagaagtttatgttgtttttttcattttttttcatcgtttagctaatttatttgttattcttaactttttgattttgcatttttataattttagttttgccattccttcggcggaagaaatttgttcgacttcatcacttcaccgtcgagccgacaacagtttttccatgaatagaaataagagcgaccttccccatatttcgctgcccatcaaccgtttgttgcaacagaaagggacaacgatggacgcctttcctatttcgggccagcatttgtcgaccacttccaaccgtttacgacaaagcaacgccatggaaggctttgagcgtcgcttgggtgatgagaatttgggttggaagaaggcgaacgacgaacaccgaaacagtacgagcacaacgaattcaagcagacgaacttcaaaaacagcgatagccgcggtgagagagaaacagcagaagccatgggaaggacaacgcattcgcaaacattaaaaggatcatttacctaaaaccaaatgaaaagcaacttaaaaaataacaaaaattgaattacggggagaaatgtgagaaatattgtgtggtttttttttgaaaaaatttaattgatccattagatgggttcgtatttatagcaattgctttcatttctcatgtcatcattctcccaaaaagaacacatgcgcgccacttgagtgagacggggtaattagagcacttctctttcagcgtcgtctttatccctttttatattttatatgggtaaagaggcgctcatttgctaacccatttccattattaactgctaacaccttttcgttttgtgtttagtgagtccattttcaggtgcgtcctcagctcaaacaaatgcaactcaatggcatttcgacaaaactccgaaaggcgcccgatgtgccgacaaaggcacacagttccgactactcattgctgggcgaaatgtttccgcaccggaaaagcagcgaccagcggaacagcggggaaattgcaaactcacaattagccacggatggcaatgtggacgaaactgcgagacacggcttaataatgggtgagtgaaagggggggggggaaactgattgattgggggcactcatcgtcaaatattgtggcaacagatgaggatgaccagcacagtttggctggcactgatttcaatgagccgtgggattccaatgcgtgggagaatctgatggatttggcacgttttggcgatggtcaggtggaggaaagtccacgcgcgtcgcaaatcggtctcttttggagtgtttaacaaaaagacaatttaattttcagaaaacgacagcttggcagtgatggagaaagcggcaaaaatggtcaattgtttgcgcactcaaatccctcattttacgaccggagaacaccggcggagtttgatgagagtgcacgggaccaactcgatgatggacatttctgggatcggctccaacaaattgagttatccgatatcaacggaagccgctaacgaacccatgagagctaacggactcaattttggccaaaatagcatcggaaaacaacaacaacaaatacgccatcatcggcccgtccctgcctgctcgtcgtctgtcgatgaactcaacgcttacaatcagccgaacaaagtcacgtccatttgtccttctctcgtccccgtctttttgtcctctcgacttcgcaatttggcacacgaacatcccggagaagaggacccagcaaaagtcatccagcgatatgttgaagagtgagtggacacggaatttacagcccaattttgggtctgatgctttttgttttaagcctttccaaggatgaccaaactcttttcgaggccgctttgcatcagttcatcgaatgcactttgctttccaaggagaaggatccgtacgtggtcattcggcgagtgcgacagttcatcaccgggtcaataaatcaccagtgttttggcgtgacgctgcgctcccattttcaggatgaagaattatttgatgaaaatcggtgaggccgatttgcatccgatcattaagcgggagagaagtcgactgaacatcgacgaattcctcaacatcgatgcgatcctcgaagaagttctggtcaagattctgttgtgtgagttttctggagccaatggggtttaaaaattagtttctaccatttatttaattatattttcgtttaccggtcggtcacattttaattttcagccaaattgaaggcccatttgtaccgtctgatgattttggagagcaccagcaacggcgagctgagaaggctgtctga

SEQ ID NO: 52525 - DNA, 476 bp, Heterodera glycines
  Genomic contig location: Contig_ID=SeqID_21884; Location=466..941; Strand=-
  SCN-specific regions: Sequence locations=1-237,259-418,449-476
atgccttattatgtgttaatgttgtgcctaatgtttcacaccgtatttatggaattcattttaccaaaattttccattttctacaaaacagaaatgaatcaaattgtgcccattttaaaaaatgaaatcaaaaaaatgttccgaaacaaggattgggattatgcgacttttgactgtatgcacacaatcgaatggaatctgctcagaattgaccttgccaagatggggcaaacccaaaaatggaaacaaatggaaaaattgctgaaggaatggcgaattttgtacaacaattgggtgctgaacaaaagtgagatgaatcggccgaatttcgcaaaaataatgcaaaaaattgtgcaaaatttggaaatgatgagcataaaataaaagccaaaaaattgtttgcgaaattttttttttgttatcaaagtttgttttattttctttctgttactctttcagcagcgcgcgaaaataaa

SEQ ID NO: 52526 - DNA, 286 bp, Heterodera glycines
  Genomic contig location: Contig_ID=SeqID_21887; Location=53..338; Strand=-
  SCN-specific regions: Sequence locations=1-182,205-227,249-286
atgcctggacagagtaggagggttcattcctctaaatatgacctaaaaacctcgaatttattggcataaataggtcagaacattttttttatcgtatatataatattggttattcggattttatcgaaaaaggaaaattctcttaaatatttctaaaaattttctttggtttagttgaagaattggcctccaaaagtgttgaaacatccaattgatgtcaccgatacatgcaaatttataccaaaatgtttttatggagttgaaccgaacgaataaaagaaataaa

SEQ ID NO: 52527 - DNA, 381 bp, Heterodera glycines
  Genomic contig location: Contig_ID=SeqID_21887; Location=447..827; Strand=-
  SCN-specific regions: Sequence locations=1-56,82-244,266-381
atggaaaacggagattatacggaagccaaattcggcatgttcaaatatgatgtgatcaaaaacaattgcattcattttgtgagaactttcgccgcaaaacttataggagaagagcggctggctaaggcaagtgatggatttataagtgacataaaatctggcaaaatacgtaggtttggttaccccacaaatgcgacacggacatttgctgtccagaaattagctccatgtccaaaatcgggttcaaattttaagttttttcagtccctgatagcctaacatcattatataagtgatagaaaatgattgtttatgataatttgattgttagtaaatttttgaaaaagcattatttaatagagaattaattctcctaataaa

SEQ ID NO: 52528 - DNA, 1742 bp, Heterodera glycines
  misc_feature (1721)..(1721): n is a, c, g, or t
  Genomic contig location: Contig_ID=SeqID_21888; Location=1..1742; Strand=+
  SCN-specific regions: Sequence locations=1-211,261-415,438-492,516 -808,869-1035,1067-1202,1440-1445,1496-1608,1633-1742
tttttgaatttagtttatgggcagaactgatgagcaaggaaatttggtatacggcgactttgctaattggcgaacaattgaagtaattaaaataatttgtatttttaattgggtaattaactaattggttgtttattaggggaacccaaacattcgccgaggggtcggaagagatggaaaaggattcaccgaagacgagtcggaaaaagcctaaaaattaacaataataaaaatttaaaaatttaattttagaattaattggttccttagccaacagcaaattgatcaaattttggccttctctgctccgcaacctggcgtaattacttgattactttaattgaaattttgaaatggatttgaatgtaaaacgcataaattggcgttagcgaataaaattacattctttggctactttttaaaacaataaaagaaaattttttttatgaaaacaaatagaatttttccagttttataaatttttatttccggttaaaatttaattttatttttatgggcaaaagttaaattgatatattttgctcataaaccaaacgattttaacttttaaaattacccaaatcaaaatctcagttgacacatttcgtttcggcacatattagtgccagaatttattataaaccggattttaaaaagaacgacgtttaaaagaggatgtcattttcccaatcggtacagaatttcttcatagactctttcgggttggcgcctcgtttttttaacctcaaatttttcaggtttgcccaatcagaatcgaattccgctggatggaggtgtacaaattggcattttttacataaaaattttcatatttatttaaaatatttattttttaaatcaattttttccatttttaggtcacccatggcaacgtgcatctgtttgtcggcggcgccacgcagttgccgaacggcaccgatgaagcggacggggacatgtcggagcagacacgggccgcaaatgacccaatatttttcaatctccattcattcgttgattatgtaaaaaaatgggaaaaatttatttaataaattttttaaattttgaaggaattaagttttctaaaatttttggtccattaaaattggaggcactctctttttttcagatctgggagatgtggcgtcaatccagacaaacgcgcgaaagtcgagaaagggactacccaatggacaattcggtaaattatttatttattaaaaataatttaaatttaatatcatttaattaaatgaaaaaaaaaatttaaatttttttattaatattattccatttaaccctatcataattttttttctttttgtattgttattaatatttttatattaaaatagaatttttaaaataaatttggataattatttattatagattttaaaatattactttgttaaaaatttttctaattttaattatttctcatcattggtttttccatttaaaaagaaattaataaacagtttgatctttttcacatttttctttgcctttaagcaatgctcgagccctcaacattttggctcagcaccgatgcgaccatttcaggtaattaggcccaaatgtacaaaaaattacccaaatttacctaaatatttttaaaatttgaaaatttcttaagccgtggcaaaaccgtgacggcctgaacaacaaatacacggacaacatgtatgaatatgcgccacggccgagctgtcagatgngccctaattgtggatccaagt

SEQ ID NO: 52529 - DNA, 998 bp, Heterodera glycines
  Genomic contig location: Contig_ID=SeqID_21889; Location=446..1443; Strand=+
  SCN-specific regions: Sequence locations=1-45,98-180,229-350,431 -721,765-906,965-972
atggcatctgccaaaataaccgatgtgttcagacgactgacactgtaaaatatttcattaaatatttattcatttcagtttttattattatttatttcagtcaagcacgccatggccaatgccaccgacggatgtgacaacaccaaatccaattcggccagtacaagtgggtcattttactattttttaataattagtatttaaaaatattaaattttataaaatttagtcctgttacaatgagcacgaatgctgttctgtatggtcacaaaagggtgaatgtcaacgcaatccgggcttcatgaattcctggtgtaaggccagctgtcagcaagtaaaaatcgaaattcaaatatttaatttaaaaaattaattataaaaattagaattgcaaaatataattttataaaattaaataatatttaaatttccttacgcttttatttcaaatacttaagttgcttaattcagtgtcaacctgactatgatctttaccaaggtaattttttactgtttaatttatgtatgataattaagggtttggttttttcttaatactctacccattaaatcgctaattattgtgctgctgctgctgctgcttaattaattaatatctttcatttttgtaagaatgtgatgatcgtcatccgaattgccaaagttggaccagccaagggcaatgccaacagaacaaattttggatggtaaatatttaagcaaataattataattgtttattaaatttacaaaaaattttaattgtcagtttaaattttaaaggcagaaaattgtcgtcaatcatgtggaaaatgccgcgtttcacgtcaacaggtgtgcagcggagggcacgacagtcagcaaaatcagggtaaattcaaaatctcaaaaaagaaacataatgccaaaaaaattaatatacttaaatataatcatagaattaaaaatatttttttaaatatttcaattccgtaaaatagaaaagcataaaaaatata

SEQ ID NO: 52530 - DNA, 1091 bp, Heterodera glycines
  Genomic contig location: Contig_ID=SeqID_21891; Location=286..1376; Strand=-
  SCN-specific regions: Sequence locations=1-69,108-209,232-239,277 -433,460-472,494-574,603-680,702-1040,1064-1067,1089-1091
atgatttttgaccaatttggaagtgagtttgctaagaaaaaatgtttattttggcatggtgttaaggtaaaatttaaatatttggttgaaataacttttaaattttacaacgcccggtatccccgattcgaatggtattacaaaagccctacatcgcattttcggagaccattgtagaaggttcattccgattttgaacgacttcttgctttttaaaatgaaccgtttattttttcttgaatattttaaataaaaatttatttcaataatttttttctatttcatacatgtttattgaattttttggattttaatattcttaatttgttcgaattctgggttctttgtgcccctattttaagcctcggagccaaaattttgtaatttcgatatcacatcccttgtcagctgtataaacacataaaaccagtggataaattaaatttctattttcattataaaatctgctaaaatttctaaatgattagattcaaatgagtaagttaattgtgggatcatcagattggcttttcttccatctttcattcatcagatcaaagcagacattctgttcaaaaaaatttttttttttcattttatttgttatttgagcgaaaaaacatttttcgacaaattcaatttattatagtccgctgattaccgctaataaagcaattaaattaattttcaaatgaactgtaattattttagccattgtgaaatgcctagagacattggcataactgataattgacactttcaaactgaattttattaggctttaaaatgattccctatggcaacaccatctaaaacatctgtccgctgattatactcattaaatgtactgaaaattaatgtttagtaatttctgaatttcaattttgaactgtaattattttagccattgtcaaagcctagaaacattggcctgacttgatgaaatttcattaaatgcattttccgaagtcaaatggataagaaatcatttagagttagtagatagaaaattttagtctttaggaaccttttttctgtgcctataattttaaaaggttataaatttctttttgattttcgcattgaataaa

SEQ ID NO: 52531 - DNA, 565 bp, Heterodera glycines
  Genomic contig location: Contig_ID=SeqID_3938; Location=80..644; Strand=+
  SCN-specific regions: Sequence locations=1-234,258-565
atgcgcaatgagctgggcgcaaaccgagtcatcacaaaaccacaagaattctacaagcttgtccttgaccataaagtggtaaatgtctaagctgcttttttgttattaatggccaacaaaatgatggatgcatttaaggaaatttatgcaattattcctttgtctgatgatgtcatcagggtctcgtacaggacgaaaaaaaattttgtggacgagcattcgtcaagcaatattatgctcagcttgtggacaacgagtatgtgtgccttcgttcccagacaaacattccatcatcacatctctcattttataggtcgcgctaggcttaaactccttgactctatgcaacaagttcacgagacggaaggggcagaattgctttatacggtaatttgtagagataaatcatcatcacatcacgatagtgtttctttaggacacagacagcgtgattgtgaagcatcggcgcgatgtttctccacttcagactggcgaattccttggacaaatgtcggaggaatatgccggctatgccatccaatgttttgtttgcggaggtaaatag

SEQ ID NO: 52532 - DNA, 2222 bp, Heterodera glycines
  Genomic contig location: Contig_ID=SeqID_3939; Location=227..2448; Strand=-
  SCN-specific regions: Sequence locations=1-1229,1251-1656,1678 -1752,1782-2222
acattgtttctttcattgagagaacagaaggatgtcgtcattcttttatttcttgctgatcgccttcatttttttcaatgttctccatctatcttccggcgaatggattaatgtagagctgagtgtggacccaccaaacttttttgaccgttcattccgcaccatttccaagacttcacctgcgcaacattggttcggctataaccgggacaccgcatgtcatgttgaactggagaggaatatcaatcggctgtacaccaacccggatacatggaacattgccctgacagatgtggataatttaatgagcttaggacggacaacaattgagataccgtcaaccgcattaccatgggcatgttttgggcatggcggccatagttttgtaattttcaatcttcaaaatgacgcgggtgaggtgaccgtgctgcgtggacaccagcaaaagatagcacggcaattgagcgcttatggccgcattttgtttgatcatattgccgcccgattgtacattgtggacaagagtgaacgccgaatcaatgagttgctcattgccgatttggagcggtggtggacactgaataacacggacgatgcgttgaacacaacatcggcacatgttctgagaagcaattttgttggctttttgccggaacaaaaaacggattatttcattgcagctgaccatgtgtacatgatttggcgaaggcgagtgtacaagttccgcattggacactatttcaacgatccttcgtcacagctccagtttctgaccaactcaagcgacattcgcttcaacttcctcttatttgaagcaggtgccgaaaagttgggtgaagacggcgaccgtagaaacagcagatcagctattgttgtaccagcggtgtcgtccaatggaattgaacgtctcttgctcgctttgacttacctattcgatcttgtcgtcatattgcttgccatttgtgcattccgccatttccgccgattgggaactgatggcggatccgcacgaaatgggcatcacgctatggaactgaatgaatatgaccttttccactcgctatcatttcaaaacaacaacaatgggggcggagcctatggtgttcctgctgcttacaatcctacaaataccacgctatcccaccagttgaggtcttgtgccactatttaagcggctcacatttttgaatttgcccatacacatgtacctgcacaaaagttacaagcgctttttatgatcgacaaatataattatattgtcctggccgttgtttcatgcaaaaagcgataaagcattttcaacaagagcttgcacttgacagcgttgaagcgctgtacgcctattttaaagaggagattttgagtgcccctggtgaatattacccgaatcctctttgcgtgtataattgtgtgcacatttccaacgacgatcatcccgatttgccggtgctcgttgagggaacgcttgatctgattgccggactggaactcttctcaacatgctacccgaagacggaaaccgggagtatcgaatggtaaacgagttagagcaataactgtatttaatttttttcttaaatttaggagcgaacccctatatgtggagctaaaggacatgaagatttgcccgggcgagtcgcctcgttgtcgcttcgcacaaaccaacaacagcaacaacctgttacccaatcgactgctgatcgtggacgagctggacctgtggctgatggacaaccaatacaacccggggggcgtcgtcgaagaagaagaagacgagggaagcgccgaccgcttaacctagtgaaggcactgtgtcgcttcaacgctgggtgcatgccatcgcttttgccgcaaatgctccagaagagacggatggaaaacttacgctttcttggtgatcttcggctaaagactgttcatctgaagaataacattgaaatttcggccaattcattgtcatttcatggtgcggatcgtctttgtgcctaccgtggctatttgtcaataacggtagagcagcacttgtacgctcgccatcgcgttcgtctcagattccccttccttccatgtgttgtccaacatgggggcaatcaccattgttattattatccaattgaactgcttgaaatatgtttaccgcaactgagccctgattctaccaattaacatgtgtttttttcaatatgatattttttcgctaccgttattttcgagaaaataaa

SEQ ID NO: 52533 - DNA, 638 bp, Heterodera glycines
  Genomic contig location: Contig_ID=SeqID_21896; Location=525..1162; Strand=-
  SCN-specific regions: Sequence locations=1-262,284-354,384-420,442-638
atgtcatctgagactggtgctgaggatcctaccgaacaaaatgcatttgatgaaatgacacaagatcgtgctatagaattagacatatctataaagggtaataaaattgcttaaataacaatattaaaaaatacgtaaatttataataaagtgaaaatcgaagcaataattaattcataaatttcttactgtatttaaggcctttcaaaacaaaagcgcaagaaagggcaatttgaaacgaatgatttatgtttctttgcgccaaaatgcaaaaacaatgtgctcgaagaaatgggatacgccatcattgattgtggtcacaagtgtcattgggaaggagaatatgcaaaatggtaaattaatttaaatattcaaaattaaaacaaatcgattaattcggaaaattgggcaacaaataaatttttaaaaaagcaataaaatttaccatacgttttaattaatttcagggcttctgatggacattacaagcgatgtcacaaccaaagatgtaaaaaaaatgcatttataaaatgtaaaagctgtaaaaagaagattggttatggactatatgaatgtggctgttattgcacaaagaatgcccatgacatggacatccatgcagatactcttgaaaaaat

SEQ ID NO: 52534 - DNA, 229 bp, Heterodera glycines
  Genomic contig location: Contig_ID=SeqID_21896; Location=1077..1305; Strand=+
  SCN-specific regions: Sequence locations=1-131,163-229
atgtctaattctatagcacgatcttgtgtcatttcatcaaatgcattttgttcggtaggatcctcagcaccagtctcagatgacatttcatcataaattgttgagatagcatcacttataaatataggttcaatataaaaatattgtcaacaaattacagtataaatcttctgaagcaatggagcatcggttcgcaatgatccgtcctattgaagatcttgggttttag

SEQ ID NO: 52535 - DNA, 259 bp, Heterodera glycines
  Genomic contig location: Contig_ID=SeqID_21896; Location=1354..1612; Strand=-
  SCN-specific regions: Sequence locations=1-259
caaccaaccgaggggagaggtggtagaattacaatcaattgccaataattcaaagttgataataaatgatgaatctctatatctgtattttttgcacaaatacgaagctaacccaaatgacaaggcatctgctatgattgctactaaaaaacaatatggtattactgtcgcggaccgattcaaattgaatatatggtggttaaatttagttagaggatcatccatgatgcaatgctgcaggaagtgttggaacaattaa

SEQ ID NO: 52536 - DNA, 449 bp, Heterodera glycines
  Genomic contig location: Contig_ID=SeqID_21897; Location=72..520; Strand=-
  SCN-specific regions: Sequence locations=1-206,247-449
  Gene Ontology: Mol. function=hexokinase activity; Cellular component =membrane; Biological process=glycolysis
atggcgaccacccatcagcataatcccacgcccgaggtgtccatttttgtccatgtttttttcaacacagtcaattttttttaaccaggtgaaggagctgtgcaagtgcctggcgctggacgacaatcagctgcgcgacattatggcaaagatcgagatggactaccaaaaaggccttgatccagtgaccggtggagaattttgaccatttttaccccttccttcccctccctctcccattttcagctccgacagcttgcgtcaaaatgcttccgacgtacatccgcgcgattgctgttggcgaagaaaagggcgaattcctggcactggacctcggcggaaccaattttcgtgtcctgcgcatcactttggagggcggctgccgttctacgatgcacaacaaaatctacagcatgcccgacagtgttcagcaaggcaccggcacggag

SEQ ID NO: 52537 - DNA, 931 bp, Heterodera glycines
  Genomic contig location: Contig_ID=SeqID_21898; Location=67..997; Strand=-
  SCN-specific regions: Sequence locations=1-53,75-855,877-931
gcattaaatgccaaagtttactccctccacccaccacccaaccccattcaatgtctttctttcttttttaggatgcttgcggtcgtcccggccttttctcctctatcattaagggttctcagccgagcagtagcggcggactgagcggtgctccgtccgtctcgacaatgtctttcggcggaacggcgcctccgcgcaaatcggtcgggcaaagcgccggcggagatcaacaacagccgaacaaatcgcagtcgagcagccaactgcacggaagatccatcgacgtggtcgaaccgtcggggacgagcacgggcggcggaggagaacgtttggagccaggcgagtgaataattcaaacaaaagcagcagagggtttaaccgcttggccatgcgtctttctttccccaaggaatgcatccgcgcgccaaatcgatgggcgaaacctttttggtgtgtgtccacaacatttccgacaaccacccgtacgccattttgaggacaagcatcaacaacaccgcgcgggatatcatcaaacaggtggccaagcgaaggaaaagcgaccgtcgaagccaaaatctcaccctaccccccccccgctcctaatgaacagatatttgcaaaaactcaatgttacgaagtggacttggacgaatacgcgctggtggaagaaatcgttgtggggcagcaaaggacggagccaaaccgaacggagaaaggcaccggcggagcgatgaaaccacagcagcaggccaacttccgagtgttggagccggaggaaaacatttggaaagtgcaaagtcggtggagcggtgcctcgggacgctttctgctggagcggcgggaccaacaggtgacaatgaacgaatgaatgaccaatgattggacgggagagagaccatcgcccttcagaagccaagcaaacgggcgaaga

SEQ ID NO: 52538 - DNA, 557 bp, Heterodera glycines
  Genomic contig location: Contig_ID=SeqID_21900; Location=341..897; Strand=-
  SCN-specific regions: Sequence locations=1-233,256-392,446-557
atgaattttctcaaaaatatttttttgtttcttctgtttctgctaatttgcgtgatcagtgtcgagaattcgtgctttaattttctgtgtccaccgaaagaacaacgtccgaaatccaaggagagcccgaaggaacgaaaaaatctttcaggttgggctaaaaaatggatttgtccttgaaaagggaagtccttgaaaaatgcatttttttataaatgggatgcgatttatagaaacaaaaatagctcaaaataagaatttcattcaaaaatccacggatatgtaaaaatgaaacggaaaaaaccataaaaatttatttggtccttcatgtaataattttttttagcctaagttatgtgtaaaaccttggagaaatttgttattaacttaggtaaatttatatttttctaaattaatttttaatatttaaatacataattttatacccaattaattaaggagcagccttaattggaagcaaatttaaaaaaattggtcgacacgtcaaagatctaaaccaattgccatataacaaaaattaggaagatttaattaaa

SEQ ID NO: 52539 - DNA, 1372 bp, Heterodera glycines
  Genomic contig location: Contig_ID=SeqID_21904; Location=106..1477; Strand=-
  SCN-specific regions: Sequence locations=1-164,189-190,468-578,640 -854,876-1088,1150-1329,1370-1372
atgaatgtgtacatggcgaaccccgccaacaacaacacaatgaacaacaacaccggcacgttctatgcacagcagcagctgcacaacagcagcaactcatggaacagtcaaacaccacaatattacattgaaccgttgcattcgtatttttctgagtaaaaatcatttatttatttatttatttttttgcaaattttaattttttacaaagtttgaaatatgttttaaattcatgttattttcatttttttatattttaatgcacttttaaataatctaagaaattaaaatatttttttgaaattattaaaaaaatttaagaaatagaaaatatgtttttgaaattcgtatttatttatttatctatgttttgtatattatatttttaaaaaattattaatttttacgtccttttttaattttcaatataaataaaaaaattttctttatattaaatcatattttttgcagttcatcctattttggtcagccttcgtcaatgcttgggggctcagcttcgctcgattcgctcaatgcctatggccattttggcccactttttgctggacaacagggtgaattaattattataattatccatttttaaatcatttaaatcaattcatttatataatttaagaaattgagtattctgctaatttttcaacagcattttcagcgtttatcactggcggcattgaagcagcagcaccgatgcaataccatcagcaacatcatcatcacatggttggccaccatcatcagtccgcagcacttggcggtaaaattcaaaaaaaaattttatgattaaattcggggtgggcccccgcccgaactttcgggggtaaaaaaaagtcgggggagtcagggtttgtccagatgcggagcgcccgggtcggggtataccctgaaaaatggctacatttttgagtgtaggggtcggataataagttttcgaggataggggccacggtatatttcaaaaaatagcctaaattttcggggtaggcgtctgggtcctccctctaccctaattaattaattcaatttaataagttttattccacaattttttttattgttttggcttttttaaaaagttttttaagattttttaaaaattatttttcaaaatatcttttttataaacatgtaaaaagttgtctgaattgaaggtggcggcgattttctgatgggttcgctggttgttcatccgcttccatcgcaacagctggccgcagcagcaaccgctgctgaccgcgagtgcatttcatgtggtggccgtttatatgaggctgaatcggtccgcgttgatgcgcgcgggtattccaatcaatcaatcaatcaataaaacaatcatttaatcaataaa

SEQ ID NO: 52540 - DNA, 992 bp, Heterodera glycines
  Genomic contig location: Contig_ID=SeqID_21906; Location=752..1743; Strand=+
  SCN-specific regions: Sequence locations=1-148,170-362,384-882,912-992
ggccacgactccttccgtgccttccgctccgcttacgtcaattcggaggtgcgctttgagaccaactcgtgggaacagctgaaccggcagtgtccacaaattttgctgtacgccaacacgttcaaatgcctggactttctgatgcgcactctgatgacggtcaatcggccggtgaagcggggcccactgttcaaaagtacacaggccaaacgctatcagctgagcagacacttcaggttgggagcagttcttttctagcaattttttcaaatttgatgggaaaatccaagggtgggatttaagcaaaaatttaaatttccgaaactccgagtaaataagcggacgagccgactttaaacttatttattttatctcaattacaaccaaacatttaattttgacaccaaaatggcaaaaaacaatgatgttttttgggctaaaaacggctataaatttttactttttttagacgaaaattttaaggcgccccaacttcggatttcccctccgattttttttttttgcgggcctggatgcaataatctgcaattgttctgcttcgttctcgctgtcactacaatttaagaaaacttgagaattttttgtttaagaattctcaaattgaaattttttttttccattaattttttttgttagaattagcaacttttattttcagacgttaattaataatccatacttttgtttttcaggaatgtccaattgatggcgtcgatgccccgctttctgatctcttattggatgtcattttcctcctcccatggctttcgtgtgatcagtgactcgttgcaattcgcttgcgactttttgctacaaatccatcccgatcagtcaaatgttagacgagggttgggaaaaacctaaattttaaataaattttttaaattttaggacggcctcatccgcagggtcaggacagcgtggaaaattctgcacacgtcggccgagttggacaatgcccaaattcacct

SEQ ID NO: 52541 - DNA, 393 bp, Heterodera glycines
  Genomic contig location: Contig_ID=SeqID_3942; Location=801..1193; Strand=-
  SCN-specific regions: Sequence locations=1-118,149-208,230-263,294 -341,364-393
atgttgttgctgctcagtctgtccgtgttccttcttgcctctccgtccgtctgttccgcctccgcccaatttccaatgtccgcgggcatcggcgactctccgccatcgcttcagtacgtcgcttcttcttcttctttttccgcttcatcatcgtcgtcggaagagtttgcccgaaaaaatcagatgggcgaagaaaaagcggacgattgggaggaggaggaagacacgaagttgaagcaggaccagaaccaattgaagaagaacccccaccgaatggttgtgaagagacaaatgaaaagagcggcagaagcgatggaagtggcggaggacgaaaagctggtggaagaggagcaggaggagcagcaacagagctgcacagtgcgcgtccaagtg

SEQ ID NO: 52542 - DNA, 288 bp, Heterodera glycines
  Genomic contig location: Contig_ID=SeqID_3945; Location=1637..1924; Strand=-
  SCN-specific regions: Sequence locations=1-126,151-288
attttctaagaaaaaataggagtttggggggcgcggcggtgccgataggcgccgccggggaaaaaaattggaaattttgatcatttataaacaggttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctgc

SEQ ID NO: 52543 - DNA, 1882 bp, Heterodera glycines
  Genomic contig location: Contig_ID=SeqID_21908; Location=61..1942; Strand=+
  SCN-specific regions: Sequence locations=1-144,166-454,485-513,538 -697,736-880,902-928,950-950,972-1017,1039-1238,1261-1509,1531-1882
atgaggaagaaggaaatgaaggcgatggtttttcgaccgagaaagtgggacaaaaatacaattggcacagaaatcgaaattggcacgattacacaatgcatagtgatttggagagaaacgatggacgctgaactgttggcagttctaacaaaagttgaagaaatatgttatgaactgctttgtatttgggttgtccccaaaggagtgccaattcacgttatgaagaaaaggtttccggccattgttcgagtgccagaagaagaaaatattgacaatttattgacaaaattggaacaaattggaatgccaattgagaaaaagggcgaacaaagatggcacgagacagcttcaacaaacgcacctagagtgaattggaaccaattgggagacggtcacagagtgcaggccgcgggaagccattcatacaattcgtttgtggcgccacatttttcatcatatttgccaacaacaacaactaaaatgttcttcccaactccggaaatgccaaaaaaaggtgaaaattttggaaaaatccaatcagaaaaatttgatccctttgtggtattgggagtaaaacgaaagtctcaatctccagaatcaaattatgaagaagaagacatttttgaaggccctttgtgcacaaaacgaaccaaattttgggtaaattcgaaatgtgaaactacaaacacggagccgttgggggtcaaaacatttttcaaaaatgaaaataaggaaatttatcagccacattggaaaccaattgttttaagttcaccttcaggcaaaaaaggagctttctttttcgggaaaaattttgttttttccaattttcatccgtcttcttttatgatggatggctttaaatgggataatgtggaacaaaaatattgctttgaaaaggcctcgtattttggttattttaatttggcaaaaatgatcaaattcaaaaatgggatcacagaacccagtgaattcaaaaaatttacagacaaagacatggaccaatataagtcgcttgaagaaaatcccaaatcttttgatcagtatgaatggaatagagttcgagaaggtgtcattcgccctattttatgggcaaaattcacacaaaacgaaaaatttggtcaaatgttgtgggaaactggaaagtttccattatatgaagcctcagtcaatcttagctggggcatcggaattgacattagagaaagacagctaattttttcaaacatggaccaaggatttaaaggcaaaaatatgtgcggtcgtctgttagaagacattcgccaaaaacttaacccaatgggtacggtaaaccaaaaaaggcccacaaatcaaataaatgaaaaagatttagaccaaattttgaaaaagattgaaaacgacaggaaaatctctgttttcaaaactgaaaatattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaaaacgacagttgccaattttttgacaaattgcggaaaaagttaagagaatcgggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacttttttgaaattcaccaaagtgctaatggaggcggcactttaaattcttatg

SEQ ID NO: 52544 - DNA, 714 bp, Heterodera glycines
  Genomic contig location: Contig_ID=SeqID_21911; Location=139..852; Strand=+
  SCN-specific regions: Sequence locations=1-120,268-542,567-580,603-714
atggttatacaaatcagaaattcaatgaaacgatgggttagaaaagcttttggcatacaaaaaatatggtacaccccgaaatttggccgtcgaaacgtcgccggggcataatgccgcagcaaaaaatttttttttttttaaattcagagaaacaaaaaaatttcaagtttttttgttttgtttttgaaaatttttgtttttagtaatacttagtttttcaaaaaaaaaatttcttaaatctttaaaatttttattttattattttttgcggcgactgcaataaaataattttacatttttctctcttccggtgggatggataccgaacgactgtattcatttttttcgtgtttattattgctaatccataacctttgccaggtgctgctgttcttcaaacgcacactgtccaatgcgttgttccgccagtgcctaatggagcatccgaaagcggcacgccattacgtcacttatctgcgcgagtgcggtgacagtgccgaattggcggacaccctttttggtagcgtatcgcaatttttggggcacttctcccttttcctccacttttattagaattcccaaaaaatattgaaaaaattttcagcgatttcaactaggatgatttactaaaaaaaatttcaacaaaaatttccagaaaatagctgaaaaattttccaattttttttccttgaaactaaaaatttctgtttgaaa

SEQ ID NO: 52545 - DNA, 872 bp, Heterodera glycines
  Genomic contig location: Contig_ID=SeqID_21912; Location=8..879; Strand=-
  SCN-specific regions: Sequence locations=1-152,176-237,289-439,489-851
atggatgatcctaaaacctataatttttcttttcctgaacttgcggccaaaaatgcacttcatttcgcatttcgaaagcacaccaaaattgagaggattctcaaaaggattgatgtcgagcttcaagtaggagcatttactgtgaaaatctaccaaaatatacaaatattaaatacggtttactagtcaatgagtccgttccaatgtgcccaacccattactttatccgtccactcgaaaaattttgatttctaattaaaaatcaaaaaaaaaaaatttttttttaaacagaaagatggcacagagagcggagttcggcaattgctctttcacggcattggcgatggttgcgagcgatgcgtttcgtgtgttgaagtgctcaaaagtcgtttggccagtcagggaaaaaatgttttccaatggaatgcattgagcaacaagaaaacatcatcaacaacaacagaaaacagttcaaaatgtgatgaaatggaggccttgaaaatttcggaaaactcgccaaagttgtaaaatgtcaaccaaacttttgtctaaatgtttttttcccagtaatggtggtacaacaaaaccatcgaagaaagacgaaaatcgtcctcaacctgttttggccattcttatctcattggaccctttctcaacgacggacggcgacgattcacagcactcgctgaggtgcggaggccatcgaattcaaatcgaaattcgagtctttaaaatgtttcagaaattgggagattttgaccaagcaaaaatgacgaaatttggtattccaaggcccaaaagtaggaaatcggtcttagagtggtactaatttggtttgtatcctatattttggtcaaaattatattaataaa

SEQ ID NO: 52546 - DNA, 255 bp, Heterodera glycines
  Genomic contig location: Contig_ID=SeqID_21912; Location=339..593; Strand=+
  SCN-specific regions: Sequence locations=1-53,103-255
tttggttgacattttacaactttggcgagttttccgaaattttcaaggcctccatttcatcacattttgaactgttttctgttgttgttgatgatgttttcttgttgctcaatgcattccattggaaaacattttttccctgactggccaaacgacttttgagcacttcaacacacgaaacgcatcgctcgcaaccatcgccaatgccgtgaaagagcaattgccgaactccgctctctgtgccatctttctgtt

SEQ ID NO: 52547 - DNA, 1009 bp, Heterodera glycines
  Genomic contig location: Contig_ID=SeqID_21913; Location=57..1065; Strand=+
  SCN-specific regions: Sequence locations=1-72,97-97,119-451,477 -889,913-1009
atgaagaagtacatcatattatcttttaaaaaataatcaatcataaatttcactcattttttgtgtaatggcgggttttattttttcagaaaatttggactgattaatggtgccattggcgcgctgctcaaccgatcggtcagcgaatcgaaggcccttaaccaacagcatcaaaatgggggcggacactacggaaagctgaaggcccaccaacaatttcctttttcccaatcatttcccgtgaaagaaaactcgaaaaagcaacagcaagcaccaattgctcagtcggagccatcggacacggactttgacgattcactatcagccacatcagcagtggagacgggatcaacaccaatgggaagtggcgcgacgaggacaccgatcggacaaggctcggcggagggcgacacttcgcaacacgaaaaacgaccatttgttgcaatgtataaccaaacacaaaaacaccaaacaaattacgaagcgacaacaatggcaaacagttcaattagaggttcagtgtttgcagttaaaaccaaagctgtccagaatttcgagttaaaaacgccgaaagtgctaatagtcactttagtctttaatttaatgtgatcaattaagatcgtgcacagagctttgggtcgaccactccaaacgcaatgacaaaaagaccaaattcacgtgggaaaagtcattcgaagggaccgacctcacgagaaaacggcgaactgcctacggatgagaagcaaagaacgaatccaaaacccagcgaccgccttcgcattttctctacactcagaccatcaaagcctagtgtaaatatggacaattaggaagacttttaattagcaaatacaaattgcacatattagaacaattaatcattaaaaattgaaaggatacaaaaattataaatgtcgttgagcacattacatgccgacaatgactagctaacaaagtttggacagcccggtttcagaactgacttacgatgatgcacaaacaaaaatga

SEQ ID NO: 52548 - DNA, 686 bp, Heterodera glycines
  Genomic contig location: Contig_ID=SeqID_21913; Location=1330..2015; Strand=-
  SCN-specific regions: Sequence locations=1-648,670-686
  Gene Ontology: Mol. function=RNA binding; Cellular component =cytoplasm; Biological process=embryogenesis and morphogenesis
atgaaggcattctttgccaagaacatcaaattgacaaggaaggcgcaccaagacgaggccggccatttgacgttgccgccgttggagaaacaatttctcatctcaccgcccagctcaccgcccgtcggatgggtaagaaaaattgctatttccaaaatgttagggtcaaatgcgttttctcaaccagaatttagtatcatgacgcctgatgtaaaagaacccagaattattctgttatgtggtgaaatgtttgcttttgcgtttttttgggtcgtccaatttgatgagaacccattaattcaaaagctgcctaataattttcacaattttttctgggaaaatggtacacaaaagcaagagcatttccaatgccttttctgttgtttcagattcaacacgctgaaatggcacccgtcgtttgcgatttcgatttaatggcgcgcctcgcgtcgctaactgtggacgaaaaattcgaattgttcgaaggcgacgaacaccaacgacgcccgtccattgttatcactccgtgtgaaaaggggggaggcggaggactgctcgcaaaggacggaggccaaatggcaaactcagcggacgaatcggaagcagaaaaacagcgacaggccgaattaaggtcgaaagtgccccttccgcacacgccaagaccaccgactttgaaggaagagtga

SEQ ID NO: 52549 - DNA, 1324 bp, Heterodera glycines
  Genomic contig location: Contig_ID=SeqID_21914; Location=39..1362; Strand=-
  SCN-specific regions: Sequence locations=1-379,447-597,620-711,733 -835,857-982,1005-1103,1149-1223,1259-1324
atgacattccaatctctgggactcaatccaccagcatttcaatctctgagactcaattctcaggctttccaatcactgggactcaacccaccagcatttcaatctgtgggactcaaatctccggcattccaaacacggggactcaacccaccagcatttcaatctgtgggactcaaatctccggcattccaatctctgggactcaacccaccagcatttcaatctctgagactcaattctcaggctttcaaatcatctgttctaagcgtagctgtcgctctaacacactttcttcagatctttgactattatttctatttctcatctgttctaagcgcataattctttggtcttgtgactcgtttgcttgacaggctactttaataatttaattttgtttttttggttttatattattctaatttttctaaactatttttttatatgaaagaaaccaaggatactttaataatttaattatttcttaatagttgacaggctactttaataatttaattatttcttaatagttgacaggctactttaataatttaattatttcttaatagttgacaggatactttaataatttaattatttcttctttttgccacatttgatcaatcatcgtgcctatttaatgtttgatcgactctaaataccttaatccatttatccacaccaattatttttcaagctaattcctgtgtttattttttaaaagaggaatttggtgtccagttttccagtgtccaattttctggtgtccaatttaccggtcccccctcttggttgggactttttttgaaggtcttaactttttcgatcaaaagatacacattgcgtgtattggttctattataaggttcaaaattgtcgactaagcaagtttttgaactatcatgtttcgcaattttatccatgccaataagcatgtttttttatttatttcgtgcatttgaaatttggttgcataaatgtgaatttttaaaatttaaatttttgttcgaattcgggtctggggttcggatttggacgaaatggatgccgcggattcgtgatcagcgtacccgaaaacctttggaaatgtattttcatgacttataaaaaattttaattttgaactttttgttcgaattcgggttcgggattcgaaataggctgaaatagatgtcggattcggtttccccgaccctggcaacccctagaatggtgttatctcgaaaataattttgaaatttttttttcaaaaaattttcgtattcactaaaaattaattaaagcctttctataatttaaaaaatttatacttttccctaataaa

SEQ ID NO: 52550 - DNA, 978 bp, Heterodera glycines
  Genomic contig location: Contig_ID=SeqID_21916; Location=1..978; Strand=-
  SCN-specific regions: Sequence locations=1-524,546-547,569-724,746 -827,849-978
atccagtctccggattcttaaattggatcgtgaattttttttcgaatttacaattgatttcaaatcgctttgtaggacttccaggggcccgaaaattaggaggtaaggccggggtttaattattcaaatttcatacaagcaggtactttacgaatctgaagtccctaaagctccgggattttgagcccggtttcgggttccccgggagttgcggaaatgggtttagaacctatttttaggagggttcaaaactcgaaaaattgagagatttgacacttctaacttttttaaaacgatcgaatcttgataaatttggtatcatccgaaagctcttgacgagctgtctaaaaagcagtgaataaattttcttgtgtgttttaatctcaatgtttatcaatattcaacacttttggtatggaaatggcccaaatgccttagtagggaattggcggtagggaatcggccggtagggaattggccggtagggaattggcggtaggaattggctggaacacttgaattaagtttaatattatctgttttacaaatctttttctgaatctcttttcctagatgagttttccagtgccttctgacgatgatttttatgatgaaacaacagactatttatatttgaccaatgacaatgcaaatccgactaactgtgaacaggcgagtgccatttattttgaccctttcctttattacattgaaaatgtccatcaaaatagtgatttccttcaaaattaagactttggcgaatgaacacagtgccgtggcactttcgtcggcaatccccggcaatgatgaaaattcctcgtcgcccgccgttccctctgaacgaagtttagaattgctgaagaaatatttcggttattcgcgctttcgccctttgcaatacgaagtgatcgaagcggctctaagcaaacgcgaccaattgggtcgttatgtccaccggtcatttcatcggtcattttt

SEQ ID NO: 52551 - DNA, 959 bp, Heterodera glycines
  Genomic contig location: Contig_ID=SeqID_21917; Location=304..1262; Strand=+
  SCN-specific regions: Sequence locations=1-246,280-549,571-687,709-959
atgtccgaggaagttgacagacacatcgtggagcgttacaaaattcaaaagagactcgggaaggatgaggagtaatggacgttttttgtgggtggtgaattggtccctttcaggagcgtatggcattgtttggaaggcgattgaccgaaaaacgaacgatacaattgctctgaagaaaatcttcgacgctttccgaaatgctacggacgcacaacatacatttaggtgaacagaaggcgcggaaggacagccattaaataaataaatggaacatgaaaatggaattaactaactacggttttcagagaaataatgtttctgcaggagttcggacggcacccaaacatcatcaaactgttcaacattctcagagcggacaatgacaagtgagtgtttacaataagtgcaccttttgctgattcacccacatttaaaactcaaattgtttttcttttttagggacatttatttggtcttcgagtatatgcaggctgatcttcacaatgtcattaaaaaagttgttccattattagaattgtcatttctttcaatcttttctttgttttattcagatgaccattttgaaagacatacacaaacaatgtttgtccttttgttttgtttttttttctgcatttaatgatctgatcctacaacagatattatgtgccaacttttccgtgccgtcaaatttctgcacagtgggaatgtgttgcatcgagacttgaagccttcaaatgtgcttttggatgccgattgccgagtcaaggtaaagctgtgtccgtttctttcccaccttttgttttagctaacaaattcaattgtcatttagttggccgattttggactcgcgcgttcattcagccaggtcaaattgcaaaatgcgtttctttcgtttgtttgacattttttttcagatggatgattatttggatggcacaaatgtgccggaactgaca

SEQ ID NO: 52552 - DNA, 1485 bp, Heterodera glycines
  Genomic contig location: Contig_ID=SeqID_3946; Location=140..1624; Strand=-
  SCN-specific regions: Sequence locations=1-147,169-319,347-459,497 -627,654-662,699-846,890-1366,1388-1485
atgcgatcaccgccgatgtcagtgtcgcggaaactgctcgtgcggctgaacttttcctcgccgacggtgtgatcttaagcggtgccgccacgggtgaagcggcgtgtcccgacgaattggacggtgtgttagaaattgaaaattctcggcaatttaacaaatcatttttatggacagaagtgcgctccaaatgcacacttcccgttctgattggatcgggcatcgaagtgaacaatgtgaatttgttcaaaggggcggatgcgtttattgtcggctcaaatttcaaaaaagacggaaattggcgaaatgaaattgagagaaagcgcgtggaaaatttggtggaaaaagtgcggaggatggaaagaaaaagtgaatgaggtcttctttttgagtttttgtatgaattttccgtgtccacaagaatatcacctcagaaaacattgaaatgtatttgatttgttatttttgataataaatatttcttttttattattttgatagaatttttttcgtaaagcgtcaatttttgccattttttttttaaatttttctgtgcttttttcgactttttcattactattttaggtgcctttaaaaaaaattgaagtccccgtccccataattatctttttcaaatttttgcctttttaaaacatttcgccaaaaataatgaaactaaaaaatgttaggtttgtttttaggcctgcaaggatttcaatttaacttgtgttttattctgtgcaaaaatttccggaaaactcaaacccaggtgtatctggatcaagaaaaagctaagatctatatccagatcaaaatcgaactctgatttcctattgtaaaatgttaaaagcatcatttaaaaattttaagctaaaaatgctctttaacaatttgtcgtcaaaatttttgaaaaacggaccgttcacaaaagtcgcacttccattttttaggcgagtaaatacgattctattaatttatttttgtctattttatttttagtcgcttttgtttttcaaccgaagcatttgagaaggcgcaaaaggacatgaaacagctgaaggacgagccggacaacgacaccaaattggagctgtacgctttgttcaaacaggttgaattgtatagtcaaattttcctgcttttaagagggcaaaaaatttcgtttaaaaacgataattttcaattttccaggcaaatgaaggcgacgttcggggcgatcgtccaaaaatgctcgaatttgtggcgcgtgccaaattcgacgcctgggaaaaagtcaaagggatgccgaaggtgaactgtttgtttgctttaccaattgaaaatgcctgaattgccaaattattaaactttggccaacaaaaaactcaaaaatcattatttattttatattatcatttccaggcagatgctcagcacaaatatgcggagattgtcaattcgttgttgaaaaatgcggggattaacaacgcgaacacttcggaaaca

SEQ ID NO: 52553 - DNA, 98 bp, Heterodera glycines
  Genomic contig location: Contig_ID=SeqID_3947; Location=698..795; Strand=-
  SCN-specific regions: Sequence locations=1-98
atgtcctccattccaatactctcctccttttcacgtgctcttcaaatgcgccaacatccgttgctcttcggcatgattcatgtacccgcattgcccgg

SEQ ID NO: 52554 - DNA, 927 bp, Heterodera glycines
  Genomic contig location: Contig_ID=SeqID_3948; Location=668..1594; Strand=+
  SCN-specific regions: Sequence locations=1-218,242-276,306-628,651 -733,757-814,841-861
  Gene Ontology: Mol. function=transketolase activity; Biological process=positive regulation of growth rate
atgagtgcaccgccgcagtacaaaatgggcgaaaaggtggccactcgacaggcgtacggaaacgccttgctgaagctggcggaggccaacaaacgcgtcattgccttagacgggtgggacagataataggcacctaccgaatttaaatggatttaaataaaaaaaaatcctttttgatgtgtcaattcaatttttaattgttttttccgtttagtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcaggtgggcagaaagaagccttttggattgccaaatggccaagaagacaaactgctgttatattaaggggattttaaaaacaattaaaaatttttttgttacactgaatttacaacagaaaaaaaaccaccgggtttttgccaaaatttttattaaatttgccccctattttatgcattttacttttttagcacttttgccgccttcttcacccgtgccggtgaccaaattcgcatgggcgccgtgtccttcacaaatgtcaaattcaccggctctcactgcggcgtttccatcggcgaggacgggtaaactgctgctggcagagcacttggaaaaaaagggaattgcttcaatttctgttttgtttcagtcccagtcaaatggccctcgaggacttggcgctgttcagcgctttgcccgccagtgtcgtcctctacccatccgacgcggtgtcggccgaacgtgcgactgagttggccgccaattacacgggcatcacttacacgcgcgtctctcgacccgccaccccagtgctctacacaagtgacgagaagttcgagctgggcaagtgcaag

SEQ ID NO: 52555 - DNA, 1006 bp, Heterodera glycines
  Genomic contig location: Contig_ID=SeqID_21920; Location=434..1439; Strand=+
  SCN-specific regions: Sequence locations=1-129,151-277,299-486,508 -603,641-815,842-1006
atgattgatattttttacaattttactataggaaagtgcacgacgtcaaggccacttatgttggtgagaaaagtgcaattacctaatgctattttaatgattcattttcaactatttatcaccgatttcaattatttttgttgaccatttctcaggtgtctccgactcggtgttcaaagccgaaattgaatacgacgggcgggaaataaccaaggcgtatttgcaggagaaatgcaatttgacacaaatgctaaaagtgatcataaaagggtgtgattaaaagtcaaattgcatctttaaggaggtcaatgccttcaaaactgagaaagaattggcagagttcatgatgaaccatggcgaaaaactcgtcgatagagtacgccttttgagcaaaattccgacaatatttgtgtaatttttctttacttcttgccacagatgggcgacgatgttgacctgcttgaggaacgggtacaggaaaagcatccatcggttcggcatttggacttggagcccatgtgattgatcggctaatggccaggcgatggaccatttgcagacgaacctttcgcaaataacggacaaatgtcaaaaaattgcatcaaaattttaattaattaaatatttattttttaaaattctttttggccaatgttcttttcatttgaaggttgtgttggatattcgcataaatttttgagggaaaatgccaaaaatgcctttgctgatgcgtttaactcattgaatcatcggttgtaattcatattatgcttaaaattgtgctgctctaaacgaaaattccacaagaaaatgtcatttttaatttatttttttttaaaaacgtcaaaattcctttttaaatttccaaatcccattcctcaaagaatgtgttgtaaaaagttctcgagaacccgagactgttttatccggcccaagctctcgagcagcacaaatgaaaaagcatttttcgtctgttactatgatttctctgtataaaaatattcga

SEQ ID NO: 52556 - DNA, 472 bp, Heterodera glycines
  Genomic contig location: Contig_ID=SeqID_21920; Location=1794..2265; Strand=-
  SCN-specific regions: Sequence locations=1-124,147-165,196-341,363-472
acggctgtcaacaaaattttggaggcaaaagcgaaaaacgacgcggaattggaaagcgaagtgaaaacgaaaacggcaacactttctgaggacagcaaaaaggccagcgcagaggtgaaaaagcaatgaaattatttattggaaaaagcaattgtcagtaatttgattttaaatgtaaatttattttatttttttgcccttttcagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaataatgaaattcattgattaaa

SEQ ID NO: 52557 - DNA, 477 bp, Heterodera glycines
  Genomic contig location: Contig_ID=SeqID_21921; Location=2290..2766; Strand=+
  SCN-specific regions: Sequence locations=1-98,121-135,157-176,225-477
atgaatgagggaagtaagcactttaaaaagactttgatcagtcgcggtcgcaccgctgggcatcgccattctccacaaaacgacgatggggacgatgaccaacaacaacggcaacaacagaaccaatttgatgcttatctgaatccacaacaaatggacaattttgaaatgggggcagaaaaagaagaggaagaagaaggggaggaagaggaggaggaagaggacttttacgcacttttgcaacggtttgggggccacggaagagagggcggcaaaacggcggaggagtgcggttgtggaaggcggcgcaacggcattggcactgccggaaagagtgccgccgatggtccgggaagggagtacgacgcgccacggcactctctggggcaatttttcaacagcgaacaaagactccgagacagaggtccctctcggcttttacttttgattggaaatgccgagcggcataacaattaa

SEQ ID NO: 52558 - DNA, 582 bp, Heterodera glycines
  Genomic contig location: Contig_ID=SeqID_21922; Location=1771..2352; Strand=+
  SCN-specific regions: Sequence locations=1-57,81-94,116-210,233 -332,354-582
atgacaaattttgattcaaaaaacaacaaaattaaacaaaaccagtaattagacacctaatttttaaaatcaaaaattttcgtctaaaaaaaataaatattttggagatgaatttttgaggacatttttatttaacaggggtatgtattcttaaaaaaaggaagtaaaacaatataaaaaaggataattgatgaaagaaaaaatgaacattttggttttgtaaaataatataaatttttacgtattcgaaaaaaatgttttaataattcaataattaaggacattttcagtttttatttataatcctattcgattttttcaaattgatggcttttaatatttattgtatttttcttattttacgaaattaaatccggcaaaatccgacaaaattttgacgaaatatttggcgacggatgggacaaaaatgaaagtgaagaaaatgtgataaaaattgaacaaaaagaactaaatgaaaactgggaatttactcattcttctgtccgtcaaaatagtgatgaaaatattgcaacagacccaaatgatcaacaaaaaaaagaaatgattcagaaatttgaagca

SEQ ID NO: 52559 - DNA, 725 bp, Heterodera glycines
  Genomic contig location: Contig_ID=SeqID_21923; Location=278..1002; Strand=-
  SCN-specific regions: Sequence locations=1-590,614-725
  Gene Ontology: Mol. function=interleukin-8 receptor binding; Cellular component=cytoplasm; Biological process=apoptosis
atgccatcgaagagagtgagtgagcattgcttccctttttacaaattcttccgcttttttggtgaaaaatcggtcgatttcggccgattggatgttcgtgtcggtcgcgtggttgcggttcggaagcacccgaacgcggactcactgtatgtggcccacgtggagctgggcgagttgcagccgcgcacagtcattgccggactcgtcaaattcgtcggattggaagaggtgccaaacattgggcaatcccaagatattgaaatggtccataacatttgttttataaatggatgtacagcttcaaaaccggctcgtcgtttgcctttgcaatttgagaccgtcgaaaaaacgtggcatcgattcgcatgcgatgattttgtgcgcatcgaccgaacaaaaagtgaaaaaaagacagccattttttgtgtgatatttggtctaatcaggttgaaccgttggaattgtctgatcagtcgtcccctcccggctctttgatcatttgtcccaattttgctcgtcagccggacaaagtgttgaaaaagagtgtgtgggaagaaattgctttggtaaaaattctaacccaaagcatttcattttaaaattttttgtaggatatgcttgtttctggcactggcgagtgcgttttcaagggcactccgctgcgagtggacgccgaagacggcgcttcttcgctggtgaccgcgccgacactgcgcaatgttccg

SEQ ID NO: 52560 - DNA, 1110 bp, Heterodera glycines
  Genomic contig location: Contig_ID=SeqID_21924; Location=231..1340; Strand=+
  SCN-specific regions: Sequence locations=1-52,75-198,231-359,396 -409,436-555,578-1110
atgaaaagtaaagtaaaacagttaatttaaacattgtgggaagcattgctgaaaataataaatcaaataaaaaagtgaattattgaccgatagattttgtatatgttaaagatgcgaattaaaagaaaagcgaaatattgaaggaaagatgattagttggacttaaatgagtagaataaatacttatttaattgaatcaaattctccaattgaaataattcccaaacatattaattcatttgttcagattcccttgcttatttatcctctaattttccctctgagaatggccaacccttcggctgccattatatttgccctgttctcggctttttggtcaattatttttgaagcaacggtaatttattttttaataaaaaaattaatttttttttgccatgactttttctttaataaaaataaaaaataaaatttgctttaggctaggcctaggcttaggctttcttgggcttaggcgtaaacttaagcttaggctatgttttttaaatatgaattgctttgaacaagttgcctttgtataacattgtacgagttgccattaatccgaaaatataatccaatccaaattcgatacctaataaattctccctgattatttaaattttcagtgcaatgattccttttctgacacattcgcaacattcatcatttctcgtacggaagctgttgatgataatgccgctccaatggaaaatccttcctttgaacagcagcaaaatttggtggcattggacttgggaagagtgcgcgagttgcagcaaatgatcggacaaaatgccatcgatcacattgttgttgaggatggcattttctcaggcgtttactcatgccaatccaacattgagtttcaatttgatggactcagtctgggagatggcaaaatgcatcggatgctgttctcattcggagcaatattaagtgccgaaattgacggaccaaaacaaacggccagtgaaaatagcaactatttgcgttcacttttgaaggcttacgaatgcgtgggagggtcattaaaacaagacgaaggaaggtagtattgaaaaatttgcttagggttaattgttaggtcataaaagggcgtgttattta

SEQ ID NO: 52561 - DNA, 986 bp, Heterodera glycines
  Genomic contig location: Contig_ID=SeqID_21925; Location=877..1862; Strand=-
  SCN-specific regions: Sequence locations=1-40,62-259,337-681,710 -775,800-883,924-926
atggcccagccagactcgacgcggtgtggacgacccgcaaccgcagcagaacgaggaacagtctcggcgagctcagcggcaacaattagcgggggattattcgattggattggaggtgcgccaaacaatggaaaatcgtcggcttttgacggcggagtacgacgaaacgggggacaatagcagcggaggaagaggcgattttgttggtgattatggcagcagaaagaacggaaaaaggacggcggagggcgcggaaaaacggcagcggaacaaaggctgagacggtggcggaggaagcggcaaaacggcgacgacgacggtggcggcgaaaacggcactctccgacagtcaattgggggtgacatccacctaaacatggggagggcataaatctgataagggaaagtaagccaaaggatgacgactaattagttggggtaataagcaaaaggatgacgactaattagttggggtttgtccgggtatcgaaaagcgtgccttgaaagtaaagcagcatttgtggattggattttcaaaggatatttagaatgcccgagagtattggcctcaaatctcagcgtttaagatattcacttttgattatcggatttaaatcgattttcaagaaccaaatcggagaatggacggacaatcaattggaaaatcaaacgaaaatggcttcatattcagttttaatttaatttttattaccataaatggccaaaattgttggaggtgccaaaaggaatggccagcaaaaagtgtgatgaaaaataatggaggacaaaatgaagaacggagcaacggacgaaagaaagacggaacggtgaaaaagaaacgaacgaacgcccaaaggaaaggacgccgaggaaaagggaaactgaaataaagagggggaaattaatgagtgaattaattaattaggtaattaaaaattataaatatgtaaaatgaaaattaaagtaaaaaataataataagaataaa

SEQ ID NO: 52562 - DNA, 422 bp, Heterodera glycines
  Genomic contig location: Contig_ID=SeqID_21926; Location=70..491; Strand=-
  SCN-specific regions: Sequence locations=1-285,307-422
atggcaccacgtgatgactccagtaacaataccaatggtcagccagtcattcaatttgatcaacaaattcgccaggaccctggactaaatgccgtttttgactttgttcgggaacagggcgcgcgggtaatttgtcacaacaaattaattttttcattttttgattaattttgtttagcatggcattttcaacacacccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatgggaaattctgaattattatttttttttcttacatgattttcttcgcatgatttaatttgttaacgatgctaaaacaataaa

SEQ ID NO: 52563 - DNA, 425 bp, Heterodera glycines
  Genomic contig location: Contig_ID=SeqID_21927; Location=470..894; Strand=-
  SCN-specific regions: Sequence locations=1-50,74-158,184-209,231 -320,407-425
atggcatttcccgagccggagaagccaaaggaaccgacgccaccgccggcggagcccgagaaaccgaaaagggcgagtgactttgttgttgcgtttattcccctctccgatcacttttaaacgtcaaaacgctttcaggtgattttggcggacgacgacgacggcggaggcggaggcggcggattcgcggcgatgttacagcgaagggcgaagaaaatggagagcgggtcgacgctgcgcaaagggctaacggaacagagggggtccgagtcggaggccaaatggaaagaggcggcggaacggctcaaagacaaaccggtgagaggaaaagaagcggagaaaaagccaagggaaggaaaagccatgagaagggaaaatggggaggaaaagccatgagaggaaaagataaaaccatcactaattga

SEQ ID NO: 52564 - DNA, 583 bp, Heterodera glycines
  misc_feature (440)..(440): n is a, c, g, or t
  misc_feature (447)..(447): n is a, c, g, or t
  misc_feature (456)..(456): n is a, c, g, or t
  misc_feature (463)..(463): n is a, c, g, or t
  misc_feature (472)..(472): n is a, c, g, or t
  misc_feature (483)..(483): n is a, c, g, or t
  misc_feature (490)..(490): n is a, c, g, or t
  misc_feature (498)..(498): n is a, c, g, or t
  misc_feature (504)..(504): n is a, c, g, or t
  misc_feature (510)..(510): n is a, c, g, or t
  misc_feature (514)..(514): n is a, c, g, or t
  misc_feature (516)..(516): n is a, c, g, or t
  misc_feature (524)..(524): n is a, c, g, or t
  misc_feature (530)..(530): n is a, c, g, or t
  misc_feature (534)..(534): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (546)..(546): n is a, c, g, or t
  misc_feature (555)..(555): n is a, c, g, or t
  misc_feature (558)..(558): n is a, c, g, or t
  misc_feature (560)..(560): n is a, c, g, or t
  misc_feature (564)..(564): n is a, c, g, or t
  misc_feature (572)..(572): n is a, c, g, or t
  misc_feature (574)..(574): n is a, c, g, or t
  misc_feature (579)..(579): n is a, c, g, or t
  misc_feature (581)..(581): n is a, c, g, or t
  Genomic contig location: Contig_ID=SeqID_3950; Location=117..699; Strand=-
  SCN-specific regions: Sequence locations=1-173,195-218,271-583
ggtgtgtatgatccgatcgcaattcgttcaaaagctgtcgagaatctcgtgtttgctgtctcacaaatgagtgaatacgaacagagtcagatgggctacagtaagcgcgagttcatcaccaagtaaacaatgcacgaacaatcaaatgattatttgtgattatatgacggaaatttaacactaataataatcactgaccctttatgtacttttgatagttaattttcattaaatataattaaaatatttttatttaatatttatttttaagatgcagtttcaatgggagggaatgttcggtggaggaggacttctcattgtatgtggacccgacttatggcaactgtttcacattcaatgcccacccggacaaaaatgtgttgagtgaacgagccgggccaaattatggtaaaaatgcgtttcaattaaaaaacaaaatnaaaaatnccatttaanaaatttnaaatctttncaaatatttanccctccntttccaantttttntcaatntcancnactatttncccacnacanaanctnccnctnttaacattnctntncatnaatcaatncntcccntnct

SEQ ID NO: 52565 - DNA, 1765 bp, Heterodera glycines
  Genomic contig location: Contig_ID=SeqID_3951; Location=2327..4091; Strand=-
  SCN-specific regions: Sequence locations=1-585,607-704,727-893,916 -1421,1443-1448,1470-1575,1605-1622,1645-1730,1752-1765
atggctgcaaatttagtaccgtacccgcacatccatgcctggggaaagccgatacatacaattgaaatggtattcaaccggcgaattgcactcccggcacaccgtgccattggcttctgtaaacagctgagtaagggcaccgatcagtttggacttaaaggcaacagcgaaaaacagctggacgaaatgcccaaaattcgaggaataattttgggacttcgtgaagagttcaacacttttgtcatcgaaattatgttgacaagaattgaaaatgaaaagggtgccaatgaaaatggggcgaataaatcgttggaaaaaatgaacgaaattctgaaatttttgaaagagaaaaatggcagcgcattttgtgatcagtcaatcatcgaaagtgcgcaaggaaaagccgaggcacagatgaaaaagatgggggagaagaaggaaaagcaacaaatgatggaaaacattgcgaaggcattcgttgtgaaagcaaaactaagcattttaacggaagaaatgcgcaacaaaaaagatgccttaagcgattggaaggaattggatgcgctcattccaatcgcatttttttgccaatttggcacagcgttggagaacatcagacagtactgcaaaataacagacgaagcggggatggaggtgagtgagagaattcattagggctgctcgagattctcggctctcactcgagtcgaagaatttctcggttttttaggctctctgtctcaactttcggggatattttcggtctcgatcttttttggcggtttttagtcaatattttgaatttttttagtccatacatatagatctaataaattaaggaaaaactgaataatttggctgagatggcacggccattgactgatcaggtgaaatggctcgtcagccatcatctgtcggagcttatcactgatgttagtcatgtgcttgttctgctatattttaatgagtcaaagatcaacaaatttgtccattctatcgacgcaatttgtcacaccgttttaattgctgtgcaaacaattggcatcgaatatttggacattgtgtcaaaaataacggacattaaggctttgatcaaagagatggaaaatgtgcacaaagacaaagtgaccaaaacgattgaccaaacagacaaagacaaagtgaccaaaacgactaacgaacttttgcaactgctggagacgaaacaagacgcatttttggaaaacttccaactgctagtaatttgaataattattagatgcaaacaatcatttttcagtactttgcttagttgtgattgtttccatagcatccgatcactttcattggatttgatgatttgtgacggacgatcagacgaccataaccaaatatcatcatttatttaaaaattacaccttcgatatttagtcagtcatgtacatttattcttcttttttctactatcatttcttctttacatttaagttttgacaaaaccaaggatgggaattgtgcagcatcagaaaagccgagatcgggcttaattactgccatgtctttttggggtttcacttttgtccatttgtccgtttgacgattattattattacttaatttgtccagaggaaaattgcttgacaaacaaagaaaggaaaaagcactttaatttatgtcttgctgaaaatgcaggaagttatccatctgttttagtttgaatgagtgcacaaaattactactctcaaaagggagtaattttatcaaataaccatttaaacattaaaataaa

SEQ ID NO: 52566 - DNA, 1100 bp, Heterodera glycines
  Genomic contig location: Contig_ID=SeqID_3952; Location=319..1418; Strand=-
  SCN-specific regions: Sequence locations=1-270,299-308,338-482,511 -578,600-628,659-739,761-1100
atgaaaaaatttattccatcatttttatttgtttttatccaattttttatttgttttgatttgtccgtttcggtcgaattccatcgatgggttaaaaactgcgaagaagtgatttccaacatcgaaactaagccaattgtaactcgtgagtttgtttgtgtttataagaatgaaatcagcagatttttgcgtacaaaaaatgaaatttattttatacataggaaaagaggcgacattaagttagggcagcagaaatcgggcactacgacattaatttaaaattgaaaattttgctgtgttttcattactatatgacccaaactggctttttaaatatggaacctgtaaatcttgttatttagtcaattcttcaactgtttaacgtagggttagacttgcattagtttccgcttggattgagactcgaatacccggcttatatggaaccgaaatatcgagaaagtccaattttatttaagggcataaaaatgatataaaataatatattttgacattgatccataaagaattgtaatgagtccaggaaaattaaccttttaattgagtgtataattcgcttaaaattttaaatctaatttgattaaaatttttgctttgagattagaggtattttttatatatttaaatttttttaaatgctaaatattgtgccgaatctttccggtgtccaaatttctgttgcccctcgaacaccaagaaatttgacatttattcttggaaatgagctgttttttcttgaaaaacaaaacgcatataaactattttaactattaaaattctttctctatttattaattctcagaaaactcatcaacagttgacgtcggcgaactaattaatttggaaaaagaattggcaaattttgagcaaaatattctccaattttataaattgggtaattacataaattgaccatttatcccaattttgagaaggatttttccataattatgccaaaaaaaaattagccttaatctggggaacaatttaatgcgagcaaattaaatatttgattaaaagggattgattgattggttatacggttttgtctaaaaaaaatccttcgaaaaatgaataaa

SEQ ID NO: 52567 - DNA, 258 bp, Heterodera glycines
  Genomic contig location: Contig_ID=SeqID_21929; Location=57..314; Strand=-
  SCN-specific regions: Sequence locations=1-105,142-258
  Gene Ontology: Cellular component=cell wall (sensu Fungi); Biological process=GPI anchor biosynthesis
atgaaagccaaactttctcaagatggacttcgagcaagaacattctaccaacacccgcatctttctccttttttgcatgggcttattcgtgatggaaaagttgtcaaaaaaaaattaattaataaaaaaaaatcaatttttgaggctgcctggggcaatttggaaagtcatgtgccaactgagtccaggccgggccatgtggcgatgatggctgggttttatgaggacgttagcgcagtcacacgaggatggaagtag

SEQ ID NO: 52568 - DNA, 645 bp, Heterodera glycines
  Genomic contig location: Contig_ID=SeqID_21929; Location=1637..2281; Strand=-
  SCN-specific regions: Sequence locations=1-343,365-645
agctgaagattcgattgatttctccgacaatgccactcatccgatcactttgtcccggaggtccaattttacaaagactgacctggcattcattgccggatggggacgtatcaccggtaaatcaaaacaaaagcaggatttatttaaatttctgcttagactggagttctccggtcactctgcaaggtgccaatgtgctgatttggccaaaggatgaggcgcgttgcgacggcattatggagtcggaagtttgcgcatttggcgaagacggagctaatgtttgctttgtaagaatacatttaacagtgaaaagctgcttaactgttattacccttctgaatcacagggcgacagtggtggtccgttgttggtcaaaagttacgacggtcagcgctgggaacagatcggagtgaccagccgaggcaatttcgtatgcgaatcgaacggtgagggcagccaattaacaatcaattaactgatttaatcaatttttaattacccattagcattcattaattactcactgtgtttatttttattttcgaattgccttttcctattttaggcttcttctcctgcgtttatatctactgcgaatggttggcaaaaataacggagggcgaagttcagtgtctaaataatgag

SEQ ID NO: 52569 - DNA, 315 bp, Heterodera glycines
  Genomic contig location: Contig_ID=SeqID_21931; Location=38..352; Strand=-
  SCN-specific regions: Sequence locations=1-315
atgcattcctttcttgtactgaccattctttttgccaatttggcaacaaatgcttttgggcaacaatggccaaaagcgactagtgaagaaactgttaaggcaacaattaaagtgtcaggaggcgtcaaagattttggcttcaaacggttgaccgcctcttcggcattgggcaccggtgatcagtcggagggccaaaaagcactgatccgtgccgaaaagaatgcagtgatcaaaaatttgatcattggccaaaacggggcggacggcattcattgctatgacgggtgcaccctgcataatgtgtggtgggaacag

SEQ ID NO: 52570 - DNA, 79 bp, Heterodera glycines
  Genomic contig location: Contig_ID=SeqID_21931; Location=875..953; Strand=+
  SCN-specific regions: Sequence locations=1-79
cgtgctgacaaaggaaggtccccaggtgtccgtgggatttccaaatgaaatttggtgggtggatagagcacccatgggt

SEQ ID NO: 52571 - DNA, 1246 bp, Heterodera glycines
  Genomic contig location: Contig_ID=SeqID_21932; Location=459..1704; Strand=+
  SCN-specific regions: Sequence locations=1-42,64-75,97-398,420 -861,884-1246
gaggattttgacagttgttttgaaggtgatcgatggtcttgcgtttcgttttggcttccttttgtttaaccgttcttttttccccaaggctcaaaagttatcctgctcattcggtgtgcttgtgaaactcttttacgagaaatttccccatccgatgttggtggattattcaaatagaaatattttcgtgagcaggtgaggagtaaaattcacgcacattcgcgtaaagaaaatctgtttcatcagtggagcgaatactagggatcacaaactgttcagcaaggaggattcacgatcattcaccgccatcttagagttccacgagaaaaccttaaaacagggcattgagttgcccaagatgtgagagtttgtttactaattccaactttagtgattcaaaacatcttcagattcaaagacagagtcagtggtccttctgaagccccaaaagtgctcgttgagttggctaaaaagtataatgtgaagggtgggcattggattatgttcttcaacaaattggccacccacaaatgggaaaaagtcttcgacgaattgctctccggtcagtgatttctttaaatgcacagattagtttttaattttcagaagcattgaaacactgggggattctgaacagattcaacgcaaggatttcgtcggataatttaatcatttgttttgtcagttttccgattactgtacgatgcctcgtgattcatttccattttagggcaatgaaaaaacactggccgcgtcggatcccacgattttggactcatcggaccaactccaacggaacaatgtgaagaatgacccgggaccatacactgttctgcgaatcattgacgaaatttataaaccaaacagtaatttttcactttattcgtccattattctaaattattaagcatttggcaacatgggcgtcaaatgtattgtttgattttttttcctttatttctttttcattttagacaaattggacattgtcaggttaattttctcaaattttatactgatttattttttttctcagcgcctgttgcatccaacgggacaatttcattcggccaacaggtcaaatttgggagaattcctcaaattaatagttggtcgaaccctcgaataagatcgccattttcagtttaccaggctaactacggcgaatactctcaacgctttgtcccgtcgaatttgcctttgtcacgcggcggcgcattggagggaatgccaatgccaacggggc

SEQ ID NO: 52572 - DNA, 2021 bp, Heterodera glycines
  Genomic contig location: Contig_ID=SeqID_21933; Location=42..2062; Strand=-
  SCN-specific regions: Sequence locations=1-1248,1286-1675,1697-2021
atgattaaaattctaaagaacgcccatcatgaaatgcagcaacaagaggaaccggatttggaccaaatttccgacgacgaattgggcgacgaagttccaatcgatgacattgtgggtacacagcagaatgatgaggaaattgacgaaatgccggagctcgaactggcattggacaacgatgttgtcgaggaacaggaggaccctgaaatggatgcggtgggtacgtctactgcacagccaaatcccggacgcaatgaaaatgaggacgtcatctttgaccatgaagtggagactcgtggaggccggaccaacatctctgagcgacagttctaccgctaccgcatggcacttcgggggtccggcaagaacaccttccattggttgtggttcgctcgacgacttgccgagtacttcaccatctctgtgctcaaccggatcgagcggaacgagctcaaccacttgaaagccattcaagtgaagaagaactaccggcagcttctagcccgtgaatatatcgccgccatggagaagggggtccgacagcaaggaccaaatgccaagctcggccgtgttttcctcatgccacagaccttcgccgggtcgcggcagtattaccaagggaagtacgccgacttgatgacgatggttcgacacctgggggctccgacttggtaaaagagtcacaaattaattgtaatgatttatgagtattataataaatgttaaggtttgtgacatttactggaaacccgaaatggccagagatcgacgaagcattgcgggtgcgtcaaaactatgctcaccggcccgacattgtgtgccgaatcttcatggataaggcggcagaattcatcagggatgtgacggagcgtggtgtgctcggcaaagttgccggttggtgctacagtgtggaacatcaaaagcgcggtaattcattaaaattaatagcataattaaattataaaattgttaaggcatgccacacatccacatgcttctgatccttgaacggggggtccgcatcgaaactgcacagcaggtggacgaatatgtttccgcgcgcatcccgacgcttccaccgtcatcggatcaatcgcccgaaggacatcagcagcgtcgcctctggcactacgtcacttcaatgatgttgcacgactgcaacgcggcatgtctggaaggctcgcgatgccgcaagcattttcccaagccgtactctgaccggactgaactatcgggtaaatcatgttgtcatatatatctgataaatattttgtaaaaatttaaagaggtccgttacacgaattatgtgcgcataccccccgacgaaagtgacacgttttttggaagagccggtggccaggacaaccaacatgacgacgaccatcacgacccagctgctgacccggaacgagactgggccgaagtgcggtaccagcgctttcctcaccaaggaagagttccggcgaggcagcatgtactaatttttcttatattgtcaattcaaaatataattattaagggcgaacaaggccagacgcattacaagaagaaaaggggggtccggagcgcaattctgatggacgacagccgagtcattccatacaacccgtttcttctgctcaaatacggatgccacatcaatgtggagtacgtgttcggacagaaggcctgcaagtatatcttcaaatacctgttaaaaggttgttattttattaattttgggtttttcaataattccagaacattcagggtttgaaaaggcctatgtccgtgtcgcacagccacgaagatcggcgcaacagggcagaagcaacgaaactgcgggtgcggacgaagtgtacgactacgacgagattgcagccaccttcaaagtgcgctacatgacggccatggaagcatacctgcgcctgaactcgtacaaaatcgtgggtatgtcgcaccaaatctacacactcagcgtgcacgacgaacttggccaaacgattgtcgtggaagaagggcatgaagaggaaggacggtga

SEQ ID NO: 52573 - DNA, 1262 bp, Heterodera glycines
  Genomic contig location: Contig_ID=SeqID_21937; Location=1..1262; Strand=+
  SCN-specific regions: Sequence locations=1-153,177-319,341-949,971 -1102,1129-1211,1254-1262
gcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 52574 - DNA, 993 bp, Heterodera glycines
  Genomic contig location: Contig_ID=SeqID_21938; Location=830..1822; Strand=-
  SCN-specific regions: Sequence locations=1-104,126-161,187-398,456 -577,613-667,694-873,896-930,953-993
atgggactcaaacggccaggccccggatggatggatcagcaagtggtcgaactgatcgccggcggcggaatgctcggttagtgccagctgatttggcccacccagcggcggcggcggctggcagcaacggccgcccgccggcggctgaccaattggaggatgtccgtccgtccgtccgtccgaccgagcgggggccaatgccccaaatcacacatttttggtgcccccgccgccgaaggccaccgaatccattaatttttgggaggattttggacgccgtccgccggcaaaggatttacggatttaatgaccgcccgacgaacaattaactaaaatgtccccccccccccaatctctgtcaatctttcgccccgtctcccctttatcccaataattcaaaaatagccgttttttattttgctgtaaaaataaatatgtgcttcttcctaatgctgcgatgcttcgatgaataaaactttcccggaattttttaaaatttttttgtctttaattgaatctgagaattttcaaattttttgtccggtttattgggttttaatctcgagaaattctccgctttttaaatttaatgataaaaaattatgaatttttcattctcattctcagcactggctcattaaatatattttcgaacccattcatgaacaaaaggaaatttttgtttttgtaaaatttctatggctttttaacccgatcttggatgtggaactgaatttacctgaccctgacgtaagatttttgccgaaaattctttaaaatctcgggaaatcgcattaattttttctcccttaattcaaaaattttcttattttctagccccatttacggctcatgaaccaataaatctcaagcgcaaataaattattttctttttacccagtctcctcttatgtcatcgcgaaattttcgattttttatgattttcctctcattagtccctttttttttgcaaattcacttcggccaattaaa

SEQ ID NO: 52575 - DNA, 853 bp, Heterodera glycines
  misc_feature (806)..(806): n is a, c, g, or t
  Genomic contig location: Contig_ID=SeqID_3954; Location=32..884; Strand=-
  SCN-specific regions: Sequence locations=1-103,136-141,164-255,277 -390,420-657,679-853
atgtcctggcgacgtcttaatttttcaatttctcaaagtaagtgtatacacttgtcaaatgtgatttgttaataatatatgaaattttattgaaatcagcgcgaatttaatagattataaaaatattaaatttaacggttctcctttttgttacccccctgaaatttttttttaaatcatttttccggggtaattttatgcgctgacacatatgtgacgtttatttttagctcttatgctttttacgtttgttacgtgaaattttttgatttaaaagtcgtataaaacaccttccctaagaagcgtattattagaattttccgaaagtttttttttttgttcaggaccagtaaatgaaatgcttgtcgaaattttattgaaatcaacatgaattttaagttataaaaataatttaatttcactccttttctaagaatgttacattggctgtctgaagacaatttttgtgatcaccttcatcttggcggtggtctttgttgttgtgttccgaggtatttaccttgatcaaaaaaaatcaattgcggaaatgtcgcagatcgtcaatgaagtgatcgcaaattttagtcgaccgccggtataatcagaacaacattgaccaatataagatgtacatatttttattccttttagcgcttggcaaaagcctgctgttcatgttgtggcaaaggctaatgaattcaaatgtcgctggattttgaagttttaatgtaaataggtggtagcctctttttgaaatttttttttctcatttaataatccgagacattagaatccgaaggacatanggtatggcgagtatttttttttcttttgattgattttggcgaataaa

SEQ ID NO: 52576 - DNA, 150 bp, Heterodera glycines
  Genomic contig location: Contig_ID=SeqID_3954; Location=1045..1194; Strand=-
  SCN-specific regions: Sequence locations=1-75,98-129
acttttggcacaaggcaacgaactgttgctggtgtccgccccgaaaatgaggccaattgtttgctggccgatggcgaagaagaacacggaggaggaggagaatgattaaatgataaatgaatgcctcaacaaatgtgtcttatttattta

SEQ ID NO: 52577 - DNA, 243 bp, Heterodera glycines
  Genomic contig location: Contig_ID=SeqID_3956; Location=1337..1579; Strand=-
  SCN-specific regions: Sequence locations=1-130,176-243
atggccaaatatggaccaaaatatggactaaacactgccaaaatctatgttttaaaccctcaaaaattccaaaaaaggtatatatattcaatatttgcttaaataaacttaaaaaatacaataaacaaccaaaaaatgaatttaaaaacataaaaatgaaaatttttattaaattctagcttcacaattgcaaaccaaatacgtctcaaaatttttgtaataatctcattctgttgccagtaa

SEQ ID NO: 52578 - DNA, 155 bp, Heterodera glycines
  Genomic contig location: Contig_ID=SeqID_3956; Location=2137..2291; Strand=+
  SCN-specific regions: Sequence locations=1-155
atgtcacaatcaccgcaaatggcgactttcagcggtctgacagcaaatatttaccacgaaaaacagaagaggcaactttgcctgctccacacactgaacaaccttttccaacgtgaagaatttgtacgggatgaattggacgaaatttgtgaaag

SEQ ID NO: 52579 - DNA, 280 bp, Heterodera glycines
  Genomic contig location: Contig_ID=SeqID_3958; Location=355..634; Strand=-
  SCN-specific regions: Sequence locations=1-86,116-280
atggctgaattgttgcggcccaaagccaccagcattgctacgcgtaaaattcttattgccgaatatgtaataaatggcatttgatcatttttaataatataataatttttttttacaattttcagtctgaagttcgagctgttattgatccgctaattagtctgaaatttgcaaaattaaagagcgaacagagtgaccgaagttgtaagttttttgccaaatttaggcatgtgacccaaaaccggcaatgttaaagaacattggtcccggaaaaaataaa

SEQ ID NO: 52580 - DNA, 829 bp, Heterodera glycines
  Genomic contig location: Contig_ID=SeqID_21939; Location=202..1030; Strand=-
  SCN-specific regions: Sequence locations=1-54,76-516,538-669,696 -778,821-829
ggggactgcccgaaaccaaaaaaatcgatttttcaagtgtccgtttgggtactcaaacatttatgggagcaaaatccaacgcagaattaaagtacaggctataggaagctatcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 52581 - DNA, 1331 bp, Heterodera glycines
  Genomic contig location: Contig_ID=SeqID_21942; Location=153..1483; Strand=-
  SCN-specific regions: Sequence locations=1-261,301-423,445-603,626 -1331
  Gene Ontology: Biological process=axon guidance
atgaaaatgttctttgatggcaacatcttattatttgtaatattggcactttgtccaaaccgcatttcatctgcaagtactcgttcagtcgcaagcacggatgatgaagttgagcgtaagatgaaattagacctggctactcatcaaatgaagaaaaagcttggcaaatatgtagatgctattgaaaacccgtttcaagccacttcttcctcagaagtgcaacaaacaccaccagttaccgattcaaaacggaatgagacgtaaaattaaatttaaaaaatttaaacaaataaatttttagaatcaaaactcggactaacgctagcaatagtacatcgaaatgcgttaacaccaatgttgccagaactctttcacaaaataatggggaggacaagcagctgacaataggaacaaaattcccatgggaaaatgttagaagaaatttggctgaagaaaaaccggaccgagagcgtgagaaaaaagtacgcgaaccgaagcagcagcaaccacgtgaaagcacttcaagtaaaattgtgccattggaagaaaagcagcaaaagcaaagcatggataaaagcgcttacgaagagccggaacagtacgagcaacaaccagcaagaaaaagcaactcaatgagtgaaatgcttgcactagaaaaatacgaagcaagaagcaaaagcaggcaaattcgtgaggagagcagtggacaaagaaaccatcgaagatcatcagcaaggagaagcaactttgatgagcaaatgaaatatgaaaagccaagaaagagtcggtattctaaggaagagagtttgcgagagcatcgaccaaggaaaagtcacgcaaaagaaaagcagaaacagagagaagctccaaggaaaagcaactatgtggaggatgaatcgaaagactctcatgcggcaagaacaagcagttcaactgcgatagagagcttacgaaaattaaggcgccaaaaaagtagcagacgatcaggagggatgatcgaagcccaagagttgtcaagattattgacaatgacgagcgatacacgacaatcatcagggaggagaagcttttcaaaatcgagaacgatgatgaccgatcgagaattgtcaaaatggagggacggcggtgccattggcgaagaattggccacaaggagcagcagaccaatagtagctatgccagttgctcagaaaagaaaagaaaatagcattgctgacatgcaaaatttgcaagacgaaatgagggcgattaggctacgagaattggcccttaatgcatctaacaagaaaagagaggaggctgtcgcgctgtttcgtaaccaaatcgagtaa

SEQ ID NO: 52582 - DNA, 87 bp, Heterodera glycines
  Genomic contig location: Contig_ID=SeqID_21945; Location=747..833; Strand=-
  SCN-specific regions: Sequence locations=1-87
caacaaaatttgaataacgggcgcgaagcgcccgtccaaggccaacaaatttaaaaacgggcgcgaagcgcccgtcttgagcctcga

SEQ ID NO: 52583 - DNA, 899 bp, Heterodera glycines
  Genomic contig location: Contig_ID=SeqID_21946; Location=54..952; Strand=-
  SCN-specific regions: Sequence locations=1-65,87-251,305-899
ataaaagtcgattggactcataaactgcaatagagccaaaatccgttccctaatcatgacacataaacaaaaagatacaaaaacattcatcaatcccttttcatggctataaaaatgtttgttttttcgctttgtcttgcatttgaaaaaaaaataaaaatttctaacgcaattaattattctgctctttgttgtgtgatatcattcggaactcggccaaaattgtgctaattgccacaaaaatgaaccgacggtaagcaatttgaaaagtcacacaaattcatcatttatttaactaaactttttcccatttcagttggatttgcaacgacgtttggatggacattttcccctcttttgaccgtgctcaactcggcctcaaaatggcacttctttcgccacgtttcaatgcgttggtggacaaacatttcgatggcaaaagcgaattgacaatttggagatcaatcgaaattcgtcgcaaggacaaaggacctgaaccgaagctgtctgtacgaatcgatgacaaatttgtgccatttccattgcccgaccgtccgttgcccagcaaaatccgttttaagcatcttcggattgagtacttaaaaatcagagctatcgcaataaaagcattcatcccatttttaggtacatcgatcactccgtcatcgcttttcttcgttcaaatcaccaaattttcgacaaaagaggcaccaatttacatttgtggcttccttcttcacataccacgaatggccaacaaatttgggacatttttgttcgtgaaatttggccaattttttctgaaaacattcgccacttgggcttttacgatggttatcatttggacaatttgcttcgtcgcacttcgccaacaattttcaccgatctcaaccaattga

SEQ ID NO: 52584 - DNA, 1140 bp, Heterodera glycines
  Genomic contig location: Contig_ID=SeqID_21947; Location=102..1241; Strand=-
  SCN-specific regions: Sequence locations=1-464,486-736,758-922,944 -1140
atggaccatacgccgtggcgagtcgtcctttacgtcatcgacgactttcggattcatttgtgagttagtgagttgcatttaaatttctttatttcccttttttgctatattttatttccgctacttttgttttcttcagaaatcgtcgttttgatcatttggaacagtggcaaattgtcctttacactctgtcgttcgtcctttttgttcaatgggttcgcaaagtgttgaaattcgaagagttcgtctcatttcgccaattggtgtcgactgtctgttttttgtttttattttcattttcagtggaatgattcgttgctcagtttttccacgtacaaacacaaatgggaagagaacaaagaaaacgcgtacaaagaattggagggtggccaactgacggagatgaggtgcattcggaaatattttaaatttcagatcggatgcatcgcgccgatcggctgagggaattttacaaatatttgcccgaccgtggactgccccccgacgacatcattcgcgaggcgaccgcctacaaaacgatgagcgacattctcttcgagaggggccgactgtgcgggtcgctgtacgcggtggaggacgaagacagcaattaccagcggatgatcaaacaggtcgagggaggaggggggggggcgaaggattatttggaaaacttgtgtttgaacaggttttcgagctgtactctcatacaaatgccgctttccccgaagcgtgcccttccattaggaaaatggaggtcggtcctcttttgtgtgccatcattggatttagggtaaaacggcacttttaggccgaatgtatccggattttgtgcagtctttttcacggaggtgccaaaagttgtggagtggttaccaccagcgggtccgagtcgatcattttggcatgcctcggtttcacatttaaatttcccatttaatttatccgtcttttacagcttatcggaactctgcccacaaaaatggcattcgaagaccggaaattattgtgcccctcaacgcccatgtcggattttttaaagcagcgaaactattggggtaaatgaaaagacttcaatttttgtttatgtttttttccagaatgcgtttggtccgcgtcggcaccaacagcaaaggccaa

SEQ ID NO: 52585 - DNA, 456 bp, Heterodera glycines
  Genomic contig location: Contig_ID=SeqID_21947; Location=1318..1773; Strand=-
  SCN-specific regions: Sequence locations=1-412,434-456
atgaatgttagattcgttatctgcgaccctaaaaaccccataaaacgtgttttcacgacttttaaaaacttacaagaaaatttttgtcaaaaaggtgtggcaccatctaaactattaccgcggcttttactctctgaatttctccctaaatttgtcaatttcagggcgttgtcgttgaaattgaatatgccgcctccaacattctccatcaatgcaaggcccttctcgaagagattgttgaattcttttttggacagtcgaaagtgccggagccggaggtgttcaaacggcacagtgaacagctggacaattatatggcaatcgacactttgagccaatatttggatattttcactgcaattcgaaaacggtcatcctgacgaagagacttaaactttattatttttaaacttgcctaatttattgataaattatttcccatacgactttaataaa

SEQ ID NO: 52586 - DNA, 1044 bp, Heterodera glycines
  Genomic contig location: Contig_ID=SeqID_21949; Location=127..1170; Strand=-
  SCN-specific regions: Sequence locations=1-1044
aggtatatggtgagcctgatttaattattggaaacgattattataatcgtttgaacattagtgtcttagaggaattacaatcgggactgtatatcaatgactcaaatattggtcaatttttgagtggacaaggaaaggttcaattctttaagtcattaaacggatctcaatccgacatatcatcatcagtcattcaccatactgtaaaccaaaagtgtggtaatgatattcaatggattattggtcaacagtaacgaaggttcagtagaatgggaactgaatagcgaccaactgagtcggaattatttcaataaaatgattatggactggaatggtctagaacatgtcggtatgtctgatctcaattcagataagcaaaacgtgagacaaagaatgattgataaaatatcattcaatggggataggtatcaaacagaattgttatgggatgaagaattggctgctcaattgccaacaaattatgatatggcatttagacagttaatgtcaaatttgggcagacttagaaaaacaccggatttgcttcgacaaatccatgaaatcataatggaacaagtcgaaaccgggtttattgaagaatgtgagccattacctattgaagaaaggtatttggttggaagtaaggttcattatttaccacatcacccagtggtaaaggaaacgagtgaacatactaaggttcgaattgtgtataatgcgtccgctagatgcagaggaggtctcaccctcaaccaagtgttagaaaagggagaaaatgactataatgatttagcaggcattttaattcgaagtcgaattaaaccaattctcttgacatgtgacatagccaaggcatttcaccagattttgatacatcctaaggataggaatgcgatgcgattcttgtgggttagagacccatacgtggacgattctcccctcgtggagtatcggtttactagagtaacgtttggagtcatctgttcaccggcgcatctctccttgactatcaaacttcatttgtccaaatatactgacaaaaag

SEQ ID NO: 52587 - DNA, 6575 bp, Heterodera glycines
  Genomic contig location: Contig_ID=SeqID_3959; Location=132..6706; Strand=+
  SCN-specific regions: Sequence locations=1-125,168-281,355-418,640 -792,824-945,968-977,999-1064,1088-1359,1434-1597,1670-1691,1823 -2016,2081-2091,2212-2237,2260-2322,2364-2418,2440-2498,2520 -2743,2769-2912,3140-3162,...
  SCN-specific regions: Sequence locations=...3185-3185,3252-3402,3424 -3589,3611-3615,3638-3659,3723-3795,3830-3861,3888-4264,4286 -4358,4381-4387,4429-4477,4501-4594,4616-4646,4668-4721,4743 -4816,4839-4852,4885-5319,...
  SCN-specific regions: Sequence locations=...5341-5431,5453-5529,5607 -5620,5850-5852,5874-5914,5978-6240,6264-6337,6360-6575
  Gene Ontology: Mol. function=ubiquitin-protein ligase activity; Cellular component=ubiquitin ligase complex; Biological process=cell organization and biogenesis
gtgctttccttcactttgtcccagtggaaaatctccaagtcgaccattctgcagcccacccacaaccaccagcatctgctggttgccggcaatgagttggcgcccgactgtgtgaggcgccaaacaattttaaatttaaaaatgagaattttttttaaaattaatttcttggcgtatcgtcgttcattttatttcagatttatatgtttcacattgcctcacaattgcttgttcgcacattctcttcatctgaccagaaacaagtttatacataattagtcattaattaaaaataattaagaaatcaaaaaattaattttaatggaaattattttaataaaaaaaacaattttagcatttaaacaacataatttaagaatcccgatttgaattcaattcgctctttaaaccaatactcttttttttaaataaatttaaaaaactaataaatttttcaattttgaggaattattttgtttataataataaatactaataatattatgaatttgaaaaaattttaatgcatttaaaaatccgatttaaaaatttaaattaaatctttaattattaaaactagctctttattttttctttttttaaaaatattattagtaaatcttttaaaataattaatttccccccaaaggtcacttcgttgtgcgcatcgaaatggcgcgacggcggcgacacggttcagcaacacaaccaacaccatttctttgtcagcacatcagcagacggagcagttcgagtgtggagcttcacacaggtggaaaaatgtggaatttcataattaaatattaatttatttttaaaatttcaaatgggcaacaactaaattattaattaattggcgcataattattttgttcgtttttctgtaaaaagaaaaaaatctcaaaaagtttggctggagagaaatcctgcttctaatataggttattttaaaagccacatttgccatttacaaattgacattaaaaagaattttgccaattttcaaaattgccgagaaaattgggtgtcaaaaattgttgtttttttttgaggcttcggttgtgaatttttaaaaagtcataaaaattcaatgaattaacggatccggatgcggttttttgaattcaatgtagcataaaggcttgtctaaaatacaggcactggtgttgaacatcgaactcttgcttaaatcaggtttataacacgggaaacccggttttggccattttaacccaaaccgatccatgattttttctcgcattattttaaaattggcaacaatctttttaatgtcattttgttgtagataaatatggcttttaactaatataattagcagctttctctccagccagggtataattaattcatttctaattagttaattaactattaatatttaattaataaactaataatattttaattaattaggcgcaatgtttgaaaacgctgcacgcctgcagcgcgcgcattctgtgctccgtgctcagcagtgacgaccaatggattgcggtcggcagcgcggattcgtgtgcacgcgtgctgctgctggacagcgggcaggtgacgcgcacattcaaagagcacacaggtggaatttaaaaataaagaaaaatagttatttaattagtaattaaaattcattaaaaattaattaattaattaaattttacatatattttcaaagcaataaaattattaaattttaatttaaatattacaaagtaaaaatattgattttatataaatgttttgacttaattaattttataattattttatttaaattaaaatacaaaaataaataaaaataaaatttgcccataggccctgtggtcggtttgcaactgtcttctgacaacactcttctcgtcaccggttccggcgaatttgtcgtcatggtaaggccataattagctatacttttattattatttttttacaaatttcttaaggtttgggacattgaaaaaggcgaaattgttgtccgattacaaggtgtttattgtctagaattaaatttcactatttaattaatttaattacttcaccaattagttggctaattatccaattatactttttttcattatttagttaattaattagtggtaatttaactaagcaattgcatttttaaattcattaatcaattacattattgtttaattaattagttcattaattagttggctaattaattcattacttttttcaatcgcttttttaagggctgatggcaccggtcacttgcttggcattgacaaggtgttctaattaaattacaccccatttaaattttatttttttctccttttcaaaaattaatgatttacattttaaatttaaaattaaaaattcttttaagcaatgacgcctttctggccgttgcatgcgaggacgagacgctgcgcgtcttctctcttgtttctgcgcaagagctgcacgaactaaccgggcatgagtgagtacgcacgcaacacaatgcgtgcgcgcatattttatgcgcaaaaaatcccaatttttctagcaatttttgaaatttgatcataaaaatttccaatttaattttgtgttctatcgcaataaatgccattttttggcattctgcctctgttgcactttatcatcacattcgcatgcacctaggtcacgcatcaacgcgttggttgcgtccggcgacgactgcaagctgttcgcgggcacgcgcgggcgcgtcattgtctacgacatacacaacggccagctgctggaggtgctgcagtgcgcgctggagcgccaaccggtaggcatttattggtcgtgcagaaatttcaaaaaaaaaagttttaaaaaattttgtaggtctcctctgtgcggattagtgatgatgattcgttcgtgctggtcgcatgcggcgatcgcatgtgaaaattaaattaaattttttatctttaatatataaatttaaaatttataaaaataattttaaaagattaacgataaataatattttaaaatttaaattaattagaaaaataaaataaaagttatattaataataatattattaaaatgaattatggctaaattaaaattctgcataatttaatttaaaataataataactgttttcctaattaaatataattaattaccactaattgctttttataaaaatgatattaaaaacaatttttcatttaaaataaataaaacaaatagtattaaaatgaaaaaaattaaattaaattaaagttctattaaataacaataattattttttcctaattaataataattaccgctaattgcctctaagtcacatgtgggcgctggacagcattgagcgcgacgtcgccgcggtgcagcagcacaaaatggcggccgtgacggtggcgccgccggagtcgccgtcctccgcggaaccagcggcggcggaggcggaacaaaccgcgacggggggcggcaccgcgttgacaagcgtttcatgtgtgcaaattgcaccggacgaaaaggtggcacgcgaaagcaattaagaaattaattgatgcttgatttcatggtcgagaaatttctcgaggattatttggtgtctcggtatcgagacgcgtgggtttttctcaattttgagagtgcttttagaggaagcagctcgttccaccaccctctccctgaaattaaaaaaaacttaaacttagaaatttttcattaaaaaaatcttagaatattttttataagaaagtttgaagaaatttttttttttgacatatttgttttgaagaatgtagcagcgattcatcaataatgctgaaaaattttcaaaaaaatttttataaaaatttttctgagatttttcttgaaatttcggttaagaaacggcgacgggcggggagggggcataacgctatttacgactcttgaaaccaattattgatcacacttctgtgtgtgtgtgtttgtcagtctcgagatcaattatggtcacgagactcgattttttgaaaaagtttcaatttgatcaaaatccccgcgcgcatttcagagtgccggctgcgggacggcggatggcatcgtggcattttgggacttggacgtgtgccaatgcatgtggacaagcaatgcgcagcgcaacggtgccgtgagcgcgctgtgcttcagttccgactcctttctgttgctcagcggcagtgaacagggtgaacagcttgccaaggctgggaccaatatatctgatcactgatcaggccttgaagctttctttatgcagggattggatcgaaaatttttccaaatcagaacatcggccccaaaaatcagatttaggggtaaaaaatcagaacattttgcaaattaatgtagtatcaaatttcgtatttttggtctcccattatcgatcgatcttaaacaattttcttaaggaaattagcaaatcataaattttagtgcattcgggataaaaaaaatcagatttttaacaattttttgcggtgcgtttttccaaaaaacttttgggaagtgcgaggggggagatggtccggtggcgccggccgataggcacctccgagaaaattttgtaatttttaatgcgatttgttaacagattttgtccaaaaatgaccaaaatttgccacaaattctttattttcttgtaaaatagtgacattatgccataaaatttcaaatttctgaagaattttaagaaatcagaacaaaattgggtcactaccctccagctcaaaacatttttcagcaattttctggaaatttttttttgaaaacaattcgtaattcatcaaaatttcggaaaattgctagaaacattaaaaaaaaatttttccttgaaatttattgtgaaaaaattactaagatttaaattttctaaaatttaaaatattttttgcttagttgtgtggtcgggtctgattgtttactagacttgtccctaatcactttggtccattgggtctgatcaactcactcataggcattgtgcctgatcacctgaatggccagaccccgctttgatcattcaaactcggggactgatcagtacgcgccgataacatttttaaggtgccgtctcgttgtgggagaccaacaacggacaattgctgaagcaggtccaattgcatgccgaagcggttgtggcgttgtgcacatttgcggatgggtagaaaatttaaaatttgatttcgaaattttttgaattttgaaatttttagggttcgtgtgctgagctgcgattcgtcggacaatgcttatctgtggagtttggcatcgcttgacgaatcttctggcggaaaacggatggaagtgggcaaaagatggaaatactttaaaaatgaaactaaaaattagagaccgacctggacatggatccaggcctggatttttcctggatccaggtccaggccatttttcggcaacctggatttttcctggacttggattttcctggatttttgtccaggaaatcaaggtccaggtcaaatgtggaaaaaaaaatccaggtccaggctttttcaaaatgtcgatctctactaaaaatgtataaataaataatatttaaattaataataaaaaaatttaataaatatctaattaaaattgaaaaaagaaattatatttattcttcttttataattaatttttatttatttgaaaaaaatattaattaaacaaatgaaatatataataaaattccagaaactatctaatagcaaaataaaattaaattaacaatattttattaattaaaaaaaaattcataattcaaaaattttaaataaaaaaaatcttctaaatttcatatacaaaattgttgtaaaataaaataaaatatcaaaagaagattcaaaaatacaacgaaaatcaatttagttgaatatttgagtaattaatcgtcatgttttataacgaataatgccaattaatttaatttaattgaattgaattaattaattctttcatatttatttaaataattaaattttttaaaaagaattaaatccaaatttcaattttaacaattttcttagctgatcgcctccattgcgttcatgcatccgccactgtatgtgcgactgtcggataccgtactcatcgcgcagcatggcgccaacccgcgggagttcgttgcgatacccacaaaatctgaacaaaattcaaatgcaaattttcttttttttctccagaatgaatgtttggtcagtgtccggcgatcggctgtttacgcgatcgaaggtctttttgttttccaatgcaaaattttaccccgtagtgcgtcgacatttgcggaccaaatgtctgggttgaattttcgaataaagaaaaaaatacgaatgcattttcaataaattttaatacatcaaaattaaattaatgaaggtagctcatacaagtctacttttgcatttttttcttttttcttgatgggagagattggctagaataagatatttctaacctataattgaactgtgataaaaaaatttgctttattttataaaagtcttcaagaattttataccaaggaaagttttggtgtttcacttccatgctttggtagaccaagagcttaaatttttatc

SEQ ID NO: 52588 - DNA, 341 bp, Heterodera glycines
  Genomic contig location: Contig_ID=SeqID_3961; Location=233..573; Strand=+
  SCN-specific regions: Sequence locations=1-202,246-341
atttgccttcacaacacaccagccaatttgcattccacttctgccagccggtacgaacgcgtcacaatgccatcgccgtcgtcgtcgtccaaaaatcagccggaggcccaagcgagggcaccgccggcacgcggcggtgccggcggcgggtcattcgcattggaactcagtgccacaaccaccggagcagcaagtgaacaaattggggaggagagggagaagcaatagaaatggcatttttgaaatgattagaattccattcccgagtgatctgaaagttttcggcgggattagttaacggacaattgtttgggattaatataatggattctctaaagtga

SEQ ID NO: 52589 - DNA, 760 bp, Heterodera glycines
  Genomic contig location: Contig_ID=SeqID_3961; Location=903..1662; Strand=+
  SCN-specific regions: Sequence locations=1-86,136-243,285-357,379 -548,582-672,694-760
atgggcgacagaattccgcccgcaaacggtgcagacaaagagccggtgacaagtcgggtaagcgcatgcacatatggggaaattgcaaattttcaaaaaattaaatttaaaaataaaatttttaaaataaattttggcatttttttcgcgcgcaggcgtccgaagtcgaagcgcacgcgaaccgactgcgcgcggtggcggagcaagagcagaaacggcaagcggaacaacaggcactatgccaaaaaaaaaagaatttttaatttaaaaattcaaaaaaatttcaggcgacaaattccgccatcgccgcccctgcggaacgcgacgcggcgaccgcgtcagcgaccgccgcgcagtcgccggacgccgccgcctccaccgctcaacagtcgcagaaggagcggcggacgcggcgctccaaactttgtacaataatgtgatcggtggttggtcaccgcctgggccggcgagcgacggtgcgcacgattacggtattggtgcaacagcgacgcggcccgataccgtaaccatgaaagtgatttgtacagttcatactgtgtatatttttgttatgtttcatatacggtatcttttttttatttcagtaaacgtacagaaggaactttctattttttgtttttgggaagttgttggttttaatgggaccacttcttttttgaaattattgaacagaatttatccaacaatttttaggtaaaattggttaaccgtttacggggtgaagaatttgaaaatataa

SEQ ID NO: 52590 - DNA, 1396 bp, Heterodera glycines
  Genomic contig location: Contig_ID=SeqID_21954; Location=378..1773; Strand=+
  SCN-specific regions: Sequence locations=1-509,531-787,812-1021,1043 -1357,1379-1396
atgaccaacgagcttgccagcacagagacgcagactgaaccagaagagaagcccaaaacatttgcttttggattgcaaactgatcaaaccggtttgatcgattcggagatgcaaacagtttcagaagagaagccgaaaacggtcacttttgcaatgcaaactgttcaaaccgatctggtcaattcggagatgcaaacactgtctgaagaggaaccgaagattaccaacaagttaatcactacagaggcgcagactgaacctgaagagaagcccaaaacatttgcttttggattgcaaactgatcaaaccggtttgatcgattcggagatgcaaacagtttcagaagagaagccgaaaacggtcacttttgcaatgcaaactgttcaaaccgatctggtcaattcggagatgcaaatactgtctgaagagaaaccgaagatgaccaacgacgaggttcttgaactcaatgtctcggttagtttattttaaaaatgtttatttggtcttcatatattttcttgttgtcattttattctttgagactaattttatttttcgatgttgcagaaattgcctatggatgctgattcgtcatttctcagtaatcaaggacggagttcccctttgttggacgaatcattgcgccgtaaatacaatgaaaagtgtgaagaaatggcagaattacgttatgtaatttatctttttcttaaaatcttttctaaacattttctacaggcatatgagtttcaacagtcaatcatttctaatcaactggacgaaattgcgcggctaaagcaacaacaacaactacgaaatggcgttcaaaaaaatgggtgagcgaagaaatagattcttacactgacaatgagtacgtttaaaagcgtgttacttttttgaattaaatgatgcttaccgattacaatacaagtcattgttcagaagtccgtcctcgactcgtcactcagccattactgctgctgcttcgccgtcgtccgttttccccagcggtgctctgcccaccatttcgggtcgaccacgcgctgcaaggcgaacttattgcgaacattgcgaaatgtttgacgcacacgactcgtcagagtgtccaaaagaagaggcaaaaagagcagaacgacgcgaccatgaggcactttcaccgcagaagtgggacgaacgggaacgcaccttctggcattaatattgacgatgcatttagacccaccctttttctctttatttttgtccattcgtttgtatgatcttttgactttaaacccgtgtgcctttttctcttttttttgtctcattgagtttaattattttcatcagctgcctttcatattcttggttcggtttcctctttgacttttctttttacattaaaaatcgtaaaaactaa

SEQ ID NO: 52591 - DNA, 223 bp, Heterodera glycines
  Genomic contig location: Contig_ID=SeqID_21959; Location=905..1127; Strand=-
  SCN-specific regions: Sequence locations=1-223
cagagtgccgaaaaatcgcatgtgatctaagccgtagcaaaaaatggtgtaagtaaaaatcgtaattacgctcaaaaagctttgcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacg

SEQ ID NO: 52592 - DNA, 185 bp, Heterodera glycines
  Genomic contig location: Contig_ID=SeqID_21961; Location=914..1098; Strand=+
  SCN-specific regions: Sequence locations=1-113,135-185
ggtcaaatccgggtcctcccttctgatcagcttttatcatcgccctgatcaccacagatgccgcttctctgttgctgctgatcgcattgctgtgctgtaccgtgcccgcaccggtggccgcaatccgtggcgcatttttccgttccgggcattcgtcggccgctttgtcttgtctaccgatgcca

SEQ ID NO: 52593 - DNA, 317 bp, Heterodera glycines
  Genomic contig location: Contig_ID=SeqID_3962; Location=258..574; Strand=-
  SCN-specific regions: Sequence locations=1-166,188-317
atggctgttcgccgaagagtagcacaccacgaagccgggcacattatggcaaatcacctaaataaggatggggctgagtgcttagcagtaaaattttgaattgaaaaattaaaaattcattaattttagtcagatatagtggaagatcagtttaatgatggacacacttgggtttctcttcgcgaaaaatatacacttgcgcaagtaacggcaacactacagtattttttaggttggtttttcaagcttaacccaaaatttgttttgcacattaaggaggtgcggcatcggagaaaacaatatttggtgtttacgac

SEQ ID NO: 52594 - DNA, 204 bp, Heterodera glycines
  Genomic contig location: Contig_ID=SeqID_3962; Location=5469..5672; Strand=-
  SCN-specific regions: Sequence locations=1-70,93-204
atgacatgcataatttatatatttgattctccattattttatattaatgtaagactccgtttatttgattctttgttaaaaagtttttcttaaattcacgataattggttattgatttcagagaaaacaaccggattcaaagaacaacttaaattaaaatgcccattttctttataaattaagaagcataattacaaaaataaa

SEQ ID NO: 52595 - DNA, 2106 bp, Heterodera glycines
  Genomic contig location: Contig_ID=SeqID_21965; Location=387..2492; Strand=+
  SCN-specific regions: Sequence locations=1-122,144-994,1016-1402,1424- 2106
atggccgagccaaaagcaaaagctggaaaagggccgggaccctacacagcggagatggcatggaaaatctgggaggagcgcttcgaattcttcatcaaactccgagcagtcactgatgccgacacaaaaaagctgctgttcttcacagaaattgggccgatctacgaggaattacgacagatggcactaccggatgatgtcagagatatgcccttggataaaatcaaggcattgatgagagatcaatatggagagacaaagactgtggccgcgaaacgacacgaattgtttgctgcgaaacaaacgcaaggacaaaccatccgcgactatgcgattaaattgcgcactctgatcgccaacgcagaatggcacagagattcggtggacatgtgcctgacagcgttgttcatcaatggactcgcagatgattcaattcgagcggaactgatcaaaaaaggcgacaatgctctgaagttcaaagacgcaatagaaactgcggtgcttttggaacaatcatcattggacgcacagcgaatcggtggacatgggccaagagaaatagtggccaaggtttcatctcaatgaaaagagaagaaagccggcggcaacagcacaccagggaaatgtcatcgatgcggacggaacggtcattgggcgagtgaatgccccagcaaaaacaccgaatgccgaaaatgtggaaggattggacattgggcagtggcctgcaaagcaaagcagagcacggtatcaaatgccgcaaaaggaaggcaaggctcttcctactacaaaggaaagcctgtgcatcaaatcagcgcacaaaagcgtgattcttccgcggatgttgcgagcgtcgtcaagtcaaaacaagttaaatcactcacagctccaccagcattcgttcaattacaattgcaaaaagaggaagcagactttgaattggacagtggcgccgacgtttcgctggtctccgaagatgattggattgcaaatggcgagccaaaattttcaacatgttcgggattacacgcgtacggaggaaagccaatcaatgtccttggattcttcgagtcaaaagtaaagtacttggggagagaaaccacgacggacttgtatgtggtcaaggacaatgtgaagaatctgtgtggacgtgatttgatcaaaaagctgcagatcgacttgaacaaagcgtttggaattggaatggtgcaacaaattcgggacaccaaattcggcagtaaattggacgaagtgctccaaaattacgccgaagtctttagtgaaggacttggccgctgcacaaggcacatcgcgttaaaatttaaaacggatgtacagccgaaaagatgcaagcctcgtcccgtgccattcgcgttgcgttccgaggtggagaaggttataaaccaatgggaaaaggaaggagtcctcgagcctgtggcgacatctgaatgggcaactccgcttgtcattgtgccaaagcccggcaacaaaattcgtttgtgctgcgactataaggtcacagtcaatccgtgcctggacatccatcagtacccgctccctcgaccggaagaattgttcagcgctctcaataacggcgacaaattctcaaaattggacctgaaagaggcctatttgcagcttccgttggacgatcaggcgaaggaatgcctcacaatctgcacccataaagggctgtaccgattctcacgcatgccctacggagtggcatcggcaccagcgatattccagcaggtgatggaagaaattctctgcggaattgacggagtggcagtatatttggacgacatcgtcgtcactgctacaaacaatgccgaacatttgaagagattggatgcagttctccaaagacttcaaaaggcaggactacgagtaaaaaaggaaaaatgctcgttcatgcaagaaagcattgtctatctgggacacattatcgaccatcaaggaattcgaacttcgccagagaaggtggaagcgattcgaaaaatgccggcgccggaaaacttgaaagaattgcagtcgttttctcgggatggttggctattacgggaaaatcatcccttcattggcgacggcctcggaacctttgaatga

SEQ ID NO: 52596 - DNA, 220 bp, Heterodera glycines
  Genomic contig location: Contig_ID=SeqID_21966; Location=83..302; Strand=-
  SCN-specific regions: Sequence locations=1-220
atggatttccatataattggactctctagttatagcacaaattgttcgatgttgtcatatgatattttctcttcgatcccaatctgttttcattctgctcaattcgtggcagcatcgtcatgcttttccgtgcaaagaaccgattgcacatccaaaataacaatttccggacggtcagcaccgttcactgaaatgccggcagaagcgaatgatttgccgg

SEQ ID NO: 52597 - DNA, 101 bp, Heterodera glycines
  Genomic contig location: Contig_ID=SeqID_21966; Location=1939..2039; Strand=-
  SCN-specific regions: Sequence locations=1-22,46-101
ctgagaatcgccatttcaagcgaagtatcttcagtctctccggaataaagccacttatcccagtgtgtccatcaaaggcgggatgggatccctgggcttga

SEQ ID NO: 52598 - DNA, 471 bp, Heterodera glycines
  Genomic contig location: Contig_ID=SeqID_21967; Location=167..637; Strand=-
  SCN-specific regions: Sequence locations=1-13,40-108,257-323,347-471
atgaaattgtgtctatttttatttttatttatgtttttaattgttgaaattgcaaaagttggatcagaagagaaaaagctgcaacaaaagtcatttgatgaaatatttggagaaaaatggcaagaaaaagaagaaaaacaacgaaatgagcagaaaaaaagagaaataattagaacattcaacaaaataaaagagaaaataaaggaaaaaggaagaaaatatccaagaaaagaatggaacaaaattgatcagaaaatagcgaaaaaattggagacaaatccaatgaaaatttataaatgtattaaggaattaggacttaatcaaaagaattcttacaaatcaaaaactgatgaacaaaaaattgaaattgtacagaaatttattgaaatgacaaatgaatataagcaaaaaagaaaatattcatcaaaggaatgggagcaaaattatgaagaaattggcaagaaaattgga

SEQ ID NO: 52599 - DNA, 564 bp, Heterodera glycines
  Genomic contig location: Contig_ID=SeqID_21967; Location=1211..1774; Strand=+
  SCN-specific regions: Sequence locations=1-53,76-111,136-196,229 -254,276-277,386-417,439-516,558-564
atgccaaactcggccctgtatgtacccgagtatttgggcaaaaccgggtccaaaaagctgggttctctgcaaaaatttctcaaaatcgaatttgaaaattgtaatttgttcataattaaaaaataataatattttccgtcaaaaaaagatcaaaataaaacaaaaatatttagctaaaaaagatcaattatgaagcaaataatgttaaattttttattaaaaaataatcaatcaaaaatggagctctcattaatcacgaaatatggcaaattataggaatattagttataatatatattttttatttatattttatatgtcataaataaaaatattttaataaaataaatatcatcgtttttacataatatttttatttttatttcagatttagaagataatccatgaaattgactcataataataataataattttaggcaaagtatcattacaagaatgaaattgtgccaaataatggagctctcattaatcgcgaaatatggcaaattataggaatattagttataatatatattttttatttatattttatatgtcataa

SEQ ID NO: 52600 - DNA, 886 bp, Heterodera glycines
  Genomic contig location: Contig_ID=SeqID_21968; Location=343..1228; Strand=-
  SCN-specific regions: Sequence locations=1-57,232-526,557-568,602 -620,642-859
atgattagaagaggtacaacagtgattggaagaggtacaacagtaattagtaaattcattaaattaaaatgaaaatattttttaacaaatttaatttaaaacatacatgaaattctatcaattaaaaaaataattcatttaaacttataaaatttattcattaaaaaaaaattaatttaaatataattttttatttattaactcaaaaaatattttaaatgaataaaaattgaaaaacacgaaaaaaatggtagaaaaataatgtacaccgcccggcttcgaacttcgccccccccccctcaaaatgatgcctcagaatccccaatcacacggggattctgagggcttaacgatgtcataattgaaatctgatcacgtattcgtgatcagcggcccaaataacccctaaaatcatatttttggaatatttttttgaaaaaattttttcactcaaaaatcctgtccaccccctttggtcccgaaccccaaaatcacttttatttctataacttttttcaaaaaagtgataaaaatgtaaaataaaatttataaaatagagcaaaaaattgcggatttttatattattttacttttccaaaatatcttttcagaaccgagttatgaattttttactgaaaattcgaatttttccagaacttctggaataactttttttagtttcatgaaagaaaatctaaataaaacccataaaattctcctgatttttctctatttttagagctttaattcacttaaattgactgtgatcagaagaggtacaaaattgttagaagaggtacaaaagtgtttagaagaggtacaactgtgattgattagaagaggtacaaaaattgaatgcaatttattataaattttaaaaaataaa

SEQ ID NO: 52601 - DNA, 109 bp, Heterodera glycines
  Genomic contig location: Contig_ID=SeqID_21969; Location=183..291; Strand=+
  SCN-specific regions: Sequence locations=1-109
atggcgcagcagaggcaaaacgttggcggacaaaagccagcggtgggaacagcgcatgtcgacgatggacgtgctgtggaacgagccggtggtggtgaaggtgccgcgg

SEQ ID NO: 52602 - DNA, 100 bp, Heterodera glycines
  Genomic contig location: Contig_ID=SeqID_21970; Location=539..638; Strand=+
  SCN-specific regions: Sequence locations=1-100
atggcacaatcgctggacccaaaagtccgtcgacggcgtccgatgggaccgatgaaagtgccggcaattggcagcagaatcggtcgttggccgaccaaat

SEQ ID NO: 52603 - DNA, 410 bp, Heterodera glycines
  Genomic contig location: Contig_ID=SeqID_21971; Location=22..431; Strand=-
  SCN-specific regions: Sequence locations=1-410
atggaccaaattgaacacttttcagtttgtgaagagacaccaccgaaagagccaagtgttgttgacatcacttatgatcctggtaaaaattaatgcaaaaaaagtaaaaaaaaaaaaattcccagaatttttcacctctttattgggcaattaaaatactaatcatgtatgttgttccagcaattgtctcagtgtcaaagccgccggtcgccgcagatgcgtctgcaccacagcaacctgttcaacaaccatctgttgctgaacagttgcaacgaattgctgacgataaaagtaaagagattggaactcgacattttgaaaaagactggaaatagatctggaccttgatttcctggacaaaaatccaatgcttgtcatggctttgacttggattgtttctggaaattaaa

SEQ ID NO: 52604 - DNA, 1887 bp, Heterodera glycines
  Genomic contig location: Contig_ID=SeqID_21972; Location=160..2046; Strand=+
  SCN-specific regions: Sequence locations=1-492,534-657,679-692,749 -804,844-869,891-931,953-1445,1488-1563,1595-1693,1715-1887
  Gene Ontology: Mol. function=ubiquitin-specific protease activity; Cellular component=nucleus; Biological process=pathogenesis
ttccaactggtgtgttaacaattgaagaagtgaacagcgtgtatcagcattattcccatcaaaatttaagtgatgccactgggcttttcccattgaaatttccaacgcaccgacggaacaaaaacaaaggcacaattgagatggaaattgaaaaagtgtctgaatttgtgctggagcctgtgggaagtggccgatttagcgatgccatggacattgggggatttccatggaaaataatggcacaaatcagaacgaaaaacgaaagcaatgagaaatggttgggcttttgcctttccaacgatggccttgaaaatggtaaaaaaaagtctttttcataatctgtccgaatttaaattcaccaaaactaaatatgtataataaacgattatgcagacaaattagacaaagtgtaaacaataaaagaatgcaaaaataagggaaattgaaaatgtaggtgaaaagtacccaccctttcaacttaaataagtatcgtatttaaataaaatggtaattttattaaatatttatttattgtgcagaaaattggtcttgtaaaagttcggcaacacttcgaattgtttcacaaaagaatggcacggaggatttaattggaacattcaatgaccgcatttttaataaggaatggagcatttatggaaaatatttcattagttttgcggtgagtgggattcaaataaatttaataaacttcatattttgaaattaaaatttttaaaattttaaaaaagaaagtgacaaaaaattgaatagaattttttgaaattttttggttataactctttgtaaatttttttctagattttaaaaaattaaataaatataggatttgataggatatgtaatgcatcgcttaataccaatttttattaatttaactaaatttaagctaagttatggtttcttattagcaataaaattgaactaataataaatttaaatgtttctatcattgacacttttgtaactttggctcaccatgattttatattacataattgatttaaaattaaagttataatcggaaacattgctgattttcatgttaaaaaaattaattacaatatttgtcaaatttttgcatctccaaattcaaaattaaggaattgttggatccgggcaaaggattttacgacaaaagcgaggacaaagtaaaattggccattgatgtcattgtggatgagccaaaaacggagaaaagcatttccgatccgaacaaatccaacggcacactttcgacggaaattgaaaaactatcggaatttgctcgagaaatcgaaggaagtgaacgtaaaagtgaaactgctgtgtacataaagggaatgccatggaaaatattggcatatatcaaaatgaaaaatgaaagcactgagaaatggttgggctttttgcttttgtgcgatgcttctaaaaaaggtttgcttatcaaattatataatagaaataataattattttttgtataaaattggtgtaattaattattgaaaagactcatgtaaacattttaacataaaattagaagtgattttttaaaggaaatgagttaaaatataaatttgattattatttaatttgctttaaggtggaaattggagccgcaaatgttcgacaacacttcgaattgtatctcaaaaaaacggtgtggaggattttaagagagaatccagtgaaaaaagaatttttaacaatgcaaagccgagttggggttggaactatttcatttcttttgcggtgagtggaaattaattagttaatttacattttaatattgtaatggcaaattaaggaattaatggacccaagcaaagggttgtacaacaaagacgaggacagcgtcaccttggcaattgattttacatgtgaatag

SEQ ID NO: 52605 - DNA, 167 bp, Heterodera glycines
  Genomic contig location: Contig_ID=SeqID_21973; Location=707..873; Strand=-
  SCN-specific regions: Sequence locations=1-167
gcgatcagaaaaatactcaaaatgttaacgtcgaatgtaattgtccaattttgaattcaggcattggtcgttgaggagaaaaatcgtccaaagttttcgctgaccgaaccggaattgagccctgaacagcttcgtcaactttttccggaattgtccgaccactggag

SEQ ID NO: 52606 - DNA, 737 bp, Heterodera glycines
  Genomic contig location: Contig_ID=SeqID_3964; Location=458..1194; Strand=-
  SCN-specific regions: Sequence locations=1-267,296-737
atgcctccggggattagtcgtgagaatattaaaaagcgaaagacgagcacttccgaagggtcggatgaggaggattcggggcaagaggagcaacaggcgccggagttgaacattgcgagtcggcagcgcagaacggcggcaatgaaatcgcacaaagtgtgggacgtgttgaaaccgggggcgaagatgcacgccgaaggggagacggagccgaacgaagcgccgacgacgggtgagcaaatgaatactttttgatggttgaaaaacaaaatttttttttaatctaaatattttagacgtttaacaaatagcaattccttgaattcttgaggtgttttcggcactgaaggaaccaattccttataaacaaaaaagatttaaaaaaactaagtcttcgaattccctcccgaaattttctgtaaaaataattcattttagcaccaaaagttgggcgcccatcactaaaacgaaaaacgccatcttcgtcatttacgtcgccactcgaagacaatgccaaaatggaaacagaatttcctaccgaaatagtaaaggaacaaatggatgaaaaaactgatgatcatctgccaacccaaaggggaattcagcgcattattgtgaacagaaagatggccgcaacttcgctttcgacaacaaatttatggcctcagcctcaacctgccaaagacaaaggacaattgcaactgatcgaggcaaatcggaggaaaaataaaagttaa

SEQ ID NO: 52607 - DNA, 1750 bp, Heterodera glycines
  Genomic contig location: Contig_ID=SeqID_3965; Location=618..2367; Strand=-
  SCN-specific regions: Sequence locations=1-323,345-997,1019-1750
atgttcaacaatcacgccaaccacttcatgccgaatttttgcattcccccacctccgccaccacaacttcctcaacctttgaattcggctgtaaattcatttggtgttgatttttgtgatccctgttctttagcgagttttctttccgccggttcctcatcaccatcatccggcttactaccttcaacctcaacatgcacatcctcatatgaaccctcagttcttcaatttaagcgttccgcctcctccaattacgcaaaatatcagcagtttgatcgcagcaaatattaacaactgtaactgattattcctattaatattagtctttgttgtcttgtttttcaatttaaaattaggtagtcattattggtcatgatcctattcacttctatttcccttttgttttgtcagatccaactcgtcatccgctcaatggcacacatcaaataaccacatcggaaaggttcagcaaaacgttccatactgggcatgcgaatggtttcacatcgaaaggcaatggagcgccgctcagcaggtcaagaaagcgatttcttgaacaaattaccaacgaagaagggtggatttaattttaattaaatacatgtttgaaagattcagcacctcgggagaacttcgaattgaattggacacagcgcccagaaatcgtccactttcgggacaaagttctactgaagtcgaccaggaagccggttgttgtaacacattgtaggataaacctaaattcatctgcagccgacgaatcaccaaacagcaaagagtcgggttgcagtgaaaattcacaggaaagtctccgtttggtgcccacggacaatgacagcgacggcgaacaccccgaaatgggccgcaactggcggatattgatgctgttcaatgggctcgtcagggatgaggatttggccccgaattgcgaacggcctcaggcagaagatggacgaacttaccctgacattcagaagaaagtgttcacacaaaatggtgtggagcaaaaggaacagcatgaacaacacaaacttttgaaactgatgtcacttaaacttccactggacacaaaccatgaagttgtgccggcttcgagtagcagcaggctaggatatggcatgcgcacaagcaatgtgtgggtcagcactgatttgatggccaaaatgatacagcagcagcaaaccgtttcatttacgacgaaaagttctgcggcgagtgataattccattcctccccctccgattgtacacgacaagaataacctccaaccgaacacgagagaaactgtcgacgctcgacatcccggcactcgaaagcgtttacaccacaatcggagtctaatcattcttaaaactggacaacgtgtctatcagggctccaaagattgcttccaatttttggaaacagggaattgtcttaatggggttttctgtgaatatgagcacgaggagtcgacggaacattcggctaaaaaagtctgtccattgtaagcgacgggtgttggctaactatttttaaactttttccatgttgaagtttgatgcgcggacaatgtcggaacatcgatgacaactgctcacatgggccccactccacgttaaaagcacaccaaatgcccgtttgcgactactacttgaggatgtgttgcagcaaaggcaaggaccaatgcgcttatcttcatgtgaagcacacggacggcatggagccttgtgaagagttcaacaggggatgctgccagcagggagttatg

SEQ ID NO: 52608 - DNA, 793 bp, Heterodera glycines
  Genomic contig location: Contig_ID=SeqID_3965; Location=4249..5041; Strand=+
  SCN-specific regions: Sequence locations=1-163,190-194,217-387,409 -645,667-793
gtttttatgtgccaaaacgccaaaatatgtgtttttatgtttttataagtcgctctaaaacaaaaattgttcggagaaaatgctatttttgggcttctctcgccataactaagccgcaaaaaaaatatgttaaaacataaaaatcccagccctacctatgaccaatattttccaaaaataaaagatatggaagtttaaactttaaagtgaaaattttcagtttttaattacgcaatccgcgaccgtgggatttttctgtcctccccgctccaaactgattttttttagtttaagttttaatttttatttgaaatgacttcaataataaaattagaagcattgtccggtgttcaagatgatggtcctttgtgttacctattgcaggtatttttgcattgctttgtttttgtcgtcatttacgcatacacaagttgctttcattttgggtcgaccaagtgtattttttgctcgattgtggctgggatgagcaattcgatttggcgtacattgaagctataaaaatgcggataccgcaaataaatgctgtgcttctcagttacggagatgttccccacatcggtgctttgccttatctgttcaaaaatgggctgaattgtcccgtttatgcgacggttggtggtcatctccatatttaattcctttttagtatataaaaatcccgtatgttctcaggttcctgtttacaaaatgggccaactttttctctacgattggataaatggccatatgactggaaaggatttctcgctgttcaatttcgacgacatcgatt

SEQ ID NO: 52609 - DNA, 615 bp, Heterodera glycines
  Genomic contig location: Contig_ID=SeqID_3967; Location=176..790; Strand=+
  SCN-specific regions: Sequence locations=1-14,36-366,388-551,573-615
atgtacttaaccgaaaaatttgaaattttgctggctgttaagtcttatcttaaggtaattttatctgcaaaattaagcatttgttaattacgaactaaagaaaattgatttttcaaacttacaaatagaggatgttatatgacttcttagaaattagtgcatttttgttaaaaataatacttatttaggaattggaaggccaaatttgcttatcaccgacgcatttaactcactctatacgcaaccgaagcaaaagcagcgggacgaaaatttggtgtccaaacttctcgccacagttcgggacgggggcgacgtaatgatagtgagttggagggggtgaggggcagaaatgggacataaagtgattggaatcacattttgttaacaaggcaacattccgagctctgactaagaaattacatataaacgatataccattggatagagcagggtcgacttctagtgtgaatttttaattttagcggtgcattttgcctgcttcaaaagttagaaggcctcaaaaattgaaattttggctgtgtttttacataaaattggtggctcagttggttaaattcctaattttgggagtccgtgttcgaatccaacgtaaaa

SEQ ID NO: 52610 - DNA, 1051 bp, Heterodera glycines
  Genomic contig location: Contig_ID=SeqID_21975; Location=557..1607; Strand=+
  SCN-specific regions: Sequence locations=1-247,321-333,355-533,555 -567,590-844,908-1051
atgatagtgttgctgagcacggccaaaggcgccgatgcgcattttttggttggcaaaagtgacaaaaaagaggtgagcgagtgacattaattagtcaattaattattaaaagggaatatttttaggctctacaaacagccaaaataggctataaaatggaaaataagcgctaaaaacctcatttttaggggtgcaaaatgacataatgtattcaaaaaagtaaaaaaattaggcaaaatcaatattgaaataaataatttttaaatctaaaattctttcaagaaaaaataaaatttggaaatgaattttaataaatttttcatctttaggggttcttttttgaaaaaatttgggtcgattcttaggggtgaatttttcgtttttttattgcatttttattaataattttgggtaaaaggccaaaataggtcaaaatatgtttttctctaaattttgtagtttaacaatccaccaaaaaaaaaaacaagttttcgttgcatttcagtccatgatgaactcaagaataaataagcaaaacataaaaatatcatccctaatatggcacaattaaagaagcaattggttttggtaatgaattttttcagcttgttcatgctcataaaggcattcttatgatttcatccaatgtttttgaggcaatgtttcaaaaggaagcagaaaattcgaataaccgcacaacagacggaaagggtgggcaaaaaaaaaaagattttttttttttagaaattttgcctcaatgttttgcatgaatactaccgagtttttataaaaatattagtgattcaatgtgaaaactgctcttaattaatgcaaataaattggcttaaaaacttaatttttttttcatttattgaaaataaaattgaaatttaaattttcattttatcatcagttgtaaaggatggccctttgttgatttctgatgctgatgcagaagctttcaaagtgatgttgcgcttcatttattcggacgatttgagcgaattaaatggacaaaacgcagtcgaaattatttaaattttcatttcaa

SEQ ID NO: 52611 - DNA, 1345 bp, Heterodera glycines
  Genomic contig location: Contig_ID=SeqID_21976; Location=401..1745; Strand=+
  SCN-specific regions: Sequence locations=1-178,200-456,478-611,633 -1345
  Gene Ontology: Biological process=gametogenesis
atggcacaacatacggcaacgtggctcgagtacgaagatgggttctgctccctggccttggcaaaaggcggaaagggcaaagtcctagtcatgccattcgcggaatccgatgtctcggaccagggatttctcacggaatccggagtgtccaaaacagtggacgaattggagcgcatacttcgaggcaaaaaagaagaagcgtccagcagccttgacatccgactacagcgatttgtcgaagcaaggacccaccaagcagatgaggtaaacacaaacatgctcgatgtcgacacgtcaaagccaatggtggtgttagcagcatgcacatcggcagcgcaacatccgattgaacaccaggaagaagtccatatcgcaatgcctcaagcggaagaagtcccttggacttggggaacgaagcactattttgtgaacgacgtcaaaatcagcgcaacaaaaatgcgggagctggacgaagcactggaagcactgattctgtcccaagtgccaccacctgaagaaagggagctaaagcagctgaccttcgaggccgtcaaacgcattctgcgcagggacacatgggaagacttcgaaatgcgcatcgccggttctacaagggcaaacacggccctcagaaatggagacttggacatcatcctgatgcccaagtccggcgagccattgagccatgagcgaaagctccgcgagctcaaattcttggtaagggaattccgcctgatgaagcgccaatacccttaccgccactgtgtcgccatcaccaaaacgaaggcaccattgatcaaaatcagaacttcggaggacgtcgacattgacatcacaatggacaacaccgaagctttgagaaacagcaattggctagccgagcagacgaacgacagcaaattgtggcggctctatatgaccgtaaagatctttgccaaacataacggcattggcgatgcgagttgcggcggcctcaactccttggcatgggcagttctgacaacgcatttcgccgcctcacggggacaggagcgttgtgaaacgccactgctcgacttcttgcagatggcggagtacttctccgagttccccttcgagggctacaccatcaccaccacgggatggcgggagcggaaatcgtcgtctgtgcccatctacgtcgaggacccgcacaatagagaggacaattgcgccaggaaccgacaagcgcaagacgtctgccgggtcaaaaacaagctgacgcaggcatggagtcagttcatccgaaagaaggacaaatgccgactcgccgacctcggctttccatgtccgagggacgaagacgtcggctggccatcagcgaggg

SEQ ID NO: 52612 - DNA, 346 bp, Heterodera glycines
  Genomic contig location: Contig_ID=SeqID_21981; Location=1..346; Strand=+
  SCN-specific regions: Sequence locations=1-288,310-346
  Gene Ontology: Mol. function=protein binding; Cellular component =endocytic vesicle; Biological process=synaptic vesicle endocytosis
gggcggattgatgcgtagcacctgcgaggggagtcgtcagtcccccgaccgtcggtcgtatagcaactctccgctttacctgggtcctcctcccacacgactttgtccaccgtctcgtggagttcgggcgcttcaaatcggatccatcgctccgtgtacattggcaaaatgtctttgcgtcgcaccacctcttttccctcacggcgccggtcgttcagtccgatctccaggaaggaagtgccgctgagaaaggccaaacagaacagacggacgcgggcgcgctgattgctcacattgccctctttgtccaccgaagcctcgtactcgtcgtagcaatgaatctgca

SEQ ID NO: 52613 - DNA, 912 bp, Heterodera glycines
  Genomic contig location: Contig_ID=SeqID_21981; Location=1..912; Strand=-
  SCN-specific regions: Sequence locations=1-249,271-603,625-912
  Gene Ontology: Mol. function=protein binding; Cellular component =endocytic vesicle; Biological process=synaptic vesicle endocytosis
ctaattgggttcacgaccaatgaatttatatgctatgtttgttcaccgatcacttccgttgtgccaaattcaggccaattattcgctgtcggacattgtgctgcaaccgtacgacgttttcaccaaaattcacaccgtaaaattgcaacacattctgtacaaagaacgcattggcattcgccccggccaaatttcgcgcctcgtcgaaggccatctgaccaaatatggccttcctcttgagcacgcggcccagtgcacagtgctggccaagttcgggtcattgaacgaacggaccatcgccagtttcactgacgcattggaaaatgtgctgttccattgtccggcaaagcgcgagacggcgccgacttacaaacaggacgaagtgcaggtgaaaaaaaagaacggaggacaaagcgagagtgaatgagcaatagtcgagaatagacacgctggtcaagagtttacgacgggaaaaattgacactttgaaaagggagggacagagagtaattagtcggcaatggacatttagtacgggaatggcactttgaatgtcgtacatttgcatgcagattcattgctacgacgagtacgaggcttcggtggacaaagagggcaatgtgagcaatcagcgcgcccgcgtccgtctgttctgtttggcctttctcagcggcacttccttcctggagatcggactgaacgaccggcgccgtgagggaaaagaggtggtgcgacgcaaagacattttgccaatgtacacggagcgatggatccgatttgaagcgcccgaactccacgagacggtggacaaagtcgtgtgggaggaggacccaggtaaagcggagagttgctatacgaccgacggtcgggggactgacgactcccctcgcaggtgctacgcatcaatccgccc

SEQ ID NO: 52614 - DNA, 1956 bp, Heterodera glycines
  Genomic contig location: Contig_ID=SeqID_21982; Location=1..1956; Strand=-
  SCN-specific regions: Sequence locations=1-1,28-141,165-196,253 -253,343-348,412-425,455-491,519-735,768-776,820-1197,1223-1236,1274 -1397,1528-1574,1617-1660,1688-1700,1735-1751,1858-1858,1890 -1902,1925-1956
atgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacacacagggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaccagctactagatggttcgattagtctttcgcccctatacccaagtcagacgatcgatttgcacgtcagaatcgcttcggacttccaccagagtttcctctggcttcatcctgctcaggaaatagtcaccatctttcgggtctcagcgcatacgctctgtctcgccccatcgcat

SEQ ID NO: 52615 - DNA, 2155 bp, Heterodera glycines
  Genomic contig location: Contig_ID=SeqID_21983; Location=2..2156; Strand=+
  SCN-specific regions: Sequence locations=1-112,134-294,332-1128,1164 -1621,1654-1993,2030-2155
atgaaagtgaggaagcagaagcggcgaaatccaaacgtggtcttccgggactcattcaatttaatgccctgctcattggcagctctgatcccatcctacggccttgacgtcgaggacaaaccattcttcccccatttggccaaccgaccggagaattatggtagagcgattcatccaactcctgaggactatttggccaatgggatgatgccaggcaaaaggcggcaattcgacatgtggtatgagcagcaccgtgaggaggcatttgttttggatgaggcattagcaaggcacaaatttttaatatttttttcaatttttattttattttgttcagctattgcaccaacgacgttgaaattctgatggccgcactcgtcgcattccgtcgggaattcttcgaaataacgcgacgacaggagtatgtggaagggattgacgaccgcgagaaccatgacggaatagatgctctgcgtgaatgcatgacaattgcgggtgcctgcatgcgccatttccgtacaaaccatctgccagctgagcatctggcaattgtacccgagcgcgggtatgacaacgcgcagaatcaaagtctcctggcacttcgcttcttctactggtactcggaggagtacgatgtagaagtgcaaaccgcacactctgccggcggagaaaagcggattggtccctattccttggacggatggattgaggcggagggtcgagcaattgaagtcaatggtaggctttaatttgttcaaatttgaaaatcatgactttaaggttgtacatggcacggctgtaaaaaatgttaccccaacgacaacatggtacttcccagtggaaaaacggcagggcaaatacgggaacgtgatggtaaacgaatggaatacctaagcgcacgggtcaatcgcatagacgtgttttgggagtgtaaaattgacgagatgttggcgagaagcaaagcgatgcgtaaatgttttgctaactacgtggacgacggacctctggtgatacgcgacgctttcatgggagggcggacggggccaatgaagctgtatcacaaggcggccaggggcgaaaaaatttcttattacgattttacttctctgtacccctatgtgaagtgagttttttattattaaataaaacataaatatttaaaactttagcttcaccacccgttatccgattggacacccaaaagtccatgttttcaaccaacaagtggtgtggaccaaagagtacccgaccggcggtgtggacgacgactaccactgccaacacaatgatcaacagcgaggttgggtcagcacctgcacgtccatcgagctgaacgctgcgctggacgagggctatcgcgtcacccgtctgttccgtgtgttggaatatgaggacagtgacgaccaacttttccgcccgtacatcgcagagttcatggcgcaaaagatccaggccagcggatttgacaacgaaatcaaagggaatgccgccatggaggaacagtttgtgcgagagtgtgcggaaatgtttggcatcaacgtggacccaaccaagatggcgataaacaagggaaaacgttccatcgcaaagttgcgcttgaataacttatgtaagccatttgtttttcaatggattttaaattttaaatttaggggggcgcttttcattgcgaaactttggactttgtcagactctgattacggacagtcctgttgtgcttgccgaatatctggacaacaaatccgttgaagtcgcgtcaattgatcagctggatgagaagcacatcctcatcagctatcagcacaagaaggactgggtggatgagcatgcctgctcaaacattggtgagaattttctttaaatattaccgtaatcaaaaaaaaactacagtaatatctttgtggacaacttccacggcgcgacttgtcttgttgaaggcaatgcaaaaagtagtcaggtcggaacggtgcgagctactgtacacaggtaattgaaaaaaaatattgtttaataatatttttaaattttagacaccgatagtctcgtccttgtccacccggaggggcgttgccctctcaaaactggcccacacctgggccagttcacggatgagtaccccgatcacgacatcgttgagtactgcagcggcggatga

SEQ ID NO: 52616 - DNA, 411 bp, Heterodera glycines
  Genomic contig location: Contig_ID=SeqID_21985; Location=412..822; Strand=-
  SCN-specific regions: Sequence locations=1-4,27-319,341-411
atggcatttctgtgccattttcagcgttttttcggcacaaatttgtcaattgatacgaaaaatggccaaatttcggatttcactattcgcaatgcttggccaatgatcaaagacaacgtttgcacagtgcggtggttctcatcaaaacactccaaagatttgggacaatttgtcccaaccgatctgaacgaatgcaaatctctccgatatttatacagcgatggcaattttattgaattgcctgtccatgatggcaccggtgctctttcgatagggcaagcagtggctaaatggttgtttacgcctcgtcccggcggcgttccgaaaaatgtttcattgctattgtccaaatcaatggcagttcgtttaaagaaattcatacaatggcatttcgtacaaaaaagcgtttaa

SEQ ID NO: 52617 - DNA, 422 bp, Heterodera glycines
  misc_feature (8)..(8): n is a, c, g, or t
  Genomic contig location: Contig_ID=SeqID_21985; Location=1..422; Strand=+
  SCN-specific regions: Sequence locations=1-8,41-422
ttcttttntaatcattttgttttaaattttaccttccccaacggtggccttggacacttagttttgtgaaaaaacgttccccagtttttttagattggtcaagttaaacggcaccctcaaatgacgattatgtggaacagcgatgatgaaactgacaggggaagaagcaatggaaaaagcctaagggaggggaaaacaaattaatgaaaatcaattaaataaactgcttaaacaacacctctttggccctttgaacttgtgtttcaatttgcctaagaatcaatgcgtaaatggcactttgtacaaatgcaaattcgtacaattagccgcgtttcgtacaaaagcatttcaaataaatttgaaaaaagctaacctatttttggcttttttctaaatgctttaaatattatattaaacgcttt

SEQ ID NO: 52618 - DNA, 179 bp, Heterodera glycines
  Genomic contig location: Contig_ID=SeqID_21985; Location=1286..1464; Strand=-
  SCN-specific regions: Sequence locations=1-48,76-179
atgtcggacaacggaaaagaagcgaacaagcaaatagaaaaggaaacgtaaatttaattataataataaaatttacagaataaagcctaagcttaagcctaaagcttagggctaagcttaaagcctaggcatagcctaaggcattgtacgataattaaaagcaattatgaaaaaataaa

SEQ ID NO: 52619 - DNA, 628 bp, Heterodera glycines
  Genomic contig location: Contig_ID=SeqID_21986; Location=249..876; Strand=-
  SCN-specific regions: Sequence locations=1-226,248-458,490-531,555-628
atgggcatgcccaccgcattcaccaacagcgccaattttgagggcatttccggcaagaaaacgttgctgctcagcgaagtggtgcagaaggcggtcattgaggtacggtgattgcccacaattagtgcccttatttttgtggattccatttatacaaatttgccaccatcgaattgcaaaataaaaaaaagtcaccagccggtccaaagaaaatttatatatttttgaccagttttagctcaattctcaaaaaaaaaactaatttaaacaacgaaatttaggtgaatgaggagggcactgtcgctgcggcagtcacagaagaagaagtggagtgttgttcgagcaaagaataccgttttgtcgccgaccgtccgttctgtgcctttctgattcgcgatgacactgtgcttttcagtgtgattttccgcaaatgattccattccatttgtattaaatgcattttattttatgattttaaaaatattatttctaacttgtatttttttgatgggaattatatgtaagaaaatacacaaaatatatacataaaatatgaatgaaaaaaaatcatgaaatatgtaagaaaaatactcaaaaccccaatgtaagtattacatacctaaataaa

SEQ ID NO: 52620 - DNA, 559 bp, Heterodera glycines
  Genomic contig location: Contig_ID=SeqID_432; Location=1839..2397; Strand=+
  SCN-specific regions: Sequence locations=1-96,160-241,305-509,536-559
atggataacattttattagaaattttcatttgttgtttttgtataacgacatattcagttagtttcatattttaaaagtttcgattaaattattggtttatttataagtaaaaaatcagttatttaaaaattataaaaatcaaactatttttataaaatgttttgaagtttcagtaaaaaatttaattttaagcatactccaaaatttatttagacattctttatcaaaataacactttagaatttttagaaattaaaatttaaaatttgaaattaattttgaagaatttaataaatatattttggtttttagagggcaattgtaaccaactatcctcctcgggaggaggctaaggattttcatctgcagatacactagccaataccctatcattagcattgtgaatatgcaatgaggatagagttagagatggggatttttttgctagttcagaatatggataccttatccttatcattgtgaatatggatttatctgcagctagcgaatttaaaattcaacaaaatcacagttttattataaaatccattactagta

SEQ ID NO: 52621 - DNA, 4266 bp, Heterodera glycines
  Genomic contig location: Contig_ID=SeqID_432; Location=3852..8117; Strand=-
  SCN-specific regions: Sequence locations=1-1372,1394-1868,1890 -2508,2531-3853,3875-3941,3963-4266
atggacgcacaacaacttcagcaaattttggacgcggctctaaaaaaatcagccgaagtttttgccgccgcactcaacattcaaaatcaaaacccaaacccagggtcatccacaacggcatcacttgcggcatcaatcaatgtccgcctcgaaaaattcaattataatccagaggttggacagacttacgacgcttggctgaatcgatatggcaaaatcgttcaacaagacggcgcttcgctcccagagcagtccaaagtccaacttttggtcggaaaattagacgaggaggaatacaaacggtatattgacagcattgcaccaaaagccacagaacaattcaactggctcgaaaccgtggcaaatctgaaaaagatttttggtgagacgaggtcgctcttcctccgccgtttcgattgttttcaaattcgccaatgccaaaaccaagacctttcgagtcttttggcacaaatcaattcatcgtgtgaaaacgccgaattggatttgaagaaagaagagctaaagtgcatgattctcatcatctctttacgcgacgaattttcggatttgaaacagcgatgtctccagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaaagcagaccatccaaaatggtggaaaataccaatcaaagtgaatggctcagattatccaatgcatgttgattccggcgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgggcatgccatggatagaagctttggaggtgatcccaaaagagattatgcatccaaatcttcatccaaaaatcaatacaatttcaacgaaaaccaacgaaatcaaagacacggagacattaatttcggcgctcaaatcaacccactccgatgtcttcagcccagaattaggtcattgcaccaaattcaaggccaatctcattctgaaaaacggtgcaaagcctatctattgcaaggcaagaccagttccacatggcgctttggacgacgtaaatgccgaaattgaccgtctattgaaaatggaggcaataaagcccattgaatttagccattgggccgcgccaattctggcagttaaaaaaaggaatggcagaacacgcgtgtgtatcgatttttccacgggattaaacgacgcacttgagctacaccgccatccgctgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccaatgccagcgtttaccgttcggcgtaaaatcagcgcccgcaatttttcaaagtttgatggacaaaatcattacacccatcaatggcgcatttgtctatctcgatgatgtgattatcgccaacacaactctcgaccaacacgtcaaaacaattaccaaagtttttgacaaaatcaaacaatttggtttccaaattcaacaggaaaagtgcagttttctacaaaaagaaaccattttccttggccacataatttctgaaaatggcattcgcccggacccatcaagagccgaggctattcgaaaaatgccagcgccacacgacaagtcaactctacggtctttccttggagcactcacatactacggcaaattcatcaaacaaatgcgcgaaataagaagcccattagatgaattgcttaaaaaggatgtaccgtggaattgggaaactgatcaacaaaaatccttcgaaaaagctaaagaaattatgctttcagatttattgctgacgcatttcgaccccaaattgccgatcattgtggccgctgatgcttcaaaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaatttcaccgcatgctctacggcagaaaattcattctgttgaccgatcacaagcccctactggccatcttcggatcaacaaaaggcattccaatatattcagccagccgacttcagcgctgggcgttaattttgtcaaattacgaatttgatattaaatacgtcaacacaaaagcattcggaaatgccgacgtactttcgaggctcatcgctaattacccaaggccatcagaagacattctcatcgcaaatatctgcaacgatactgattgctgtgttaattttgtgtttgaggccaaaatagagcaactcccgatcaccgcaaaaataatagcggatgaaacagcaaaagacgaaattttacaacaaatcagtgccttcaccaaacaaggatggccgcaaaaatttgacaacattaaattgtctccttttcttccaaaaaaggcacaaatatccgaaatcgaaggatgtctcgcctacggtgaacgaattataatcccttcgacgctccggaacaacatcctcaaatcattgcatttcgcgcatcccggcattgtgcgaatgaaagccattgccaggaaccatgtttactggcccggaattgactccgaaattgaacgactggtgaagcaatgcgaggaatgtcactcagcagccaaaaatcctacaaaagcgaatcttcagccatggaaagcagcaaacggagtttttgagcgaattcacattgatttcgccggcccgtgtgctgacggccaaacatacctggttttggtcgacgcttactcaaaatggccagaagtatggcaaatggaaaggacatccagccaactcaccatttcaatgctgaaatcattcgtgcatcggcttggaattcccaaagaaattgtctccgacaatggaagccaatttcgatccgccgaatttgcacaattctgtaaagaattcgacataaaacacaccttcacgccgccgttccacccaatgtcgaatggggccgctgaacggtttgtcgacatttttaaaaggtcaatgaaaaagtgccgtcaagaaggcaaagattggcttcaaaaagtgcttttggcgtatcgcacgacaccaaacacggcactcaacggtcattcgccagacgaacttttccttggccgacgcatgcgcacaagaatgacacttgtccatcccgaaaaacaaaaactccagccaacaaatttggaaaattttcaacaattccaagggcaatacatcaaaaagatggaaaatcaattcaacaaaaaacatggagccaaatcaaccattttccaaaatgaggaaccaatttatttttggaatttgaaaaacaataaagccatttggctcccgggaaaaattatagagaaattcggcacatctccgacgtatcgcattttggcaccgacgcttggccgagccattcatcgtcatgccaaccaaatcaggcgacgtttcccaattgaattggaagacaatgatcaagttgtagaaaatgatcaaacccaggcacaaaatccgcaacaatcgccgatcgcgcacaaaccgcaaacaaatcgtcagcaatcgcctgctcaaccagttcttttgcgccgatcaggaagagccaaacaagcacctcaacgactggtcctggatccgacaaagccaaaatatggcttaatccgatcttaa

SEQ ID NO: 52622 - DNA, 1014 bp, Heterodera glycines
  Genomic contig location: Contig_ID=SeqID_433; Location=153..1166; Strand=-
  SCN-specific regions: Sequence locations=1-98,120-124,146-152,174 -620,642-1014
atggggcgtccacccaagaaattgttggcatatgtgagccccgaaattacccataatttattgggcatgccatggattgaagctttggaagtgattccgaaagagattatgcacccaaatcttcatccaaaaatcaatacaatttcaacgaaaataaacgaaatcaaagacacggagacattaatttcggcgctcaaaacaacacattccgatgtcttcagcccagaattaggtcattgcaccaaattcaaggccaatctcattctgaaaaacggtgcaaagcctatctattgcaaggcaagaccagttccacatggcgctttggacgacgtaaatgccgaaattgaccgtctattgaaaatggaggcaataaagcccattgaatttagccattgggccgcgccaattctggcagttaaaaaaaggaatggcagaacacgcgtgtgtatcgatttttccacgggattaaacgacgcacttgagctacaccgccatccgctgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccaatgccagcgtttaccgttcggcgtaaaatcagcgcccgcaatttttcaaagtttgatggacaaaatcattacacccatcaatggcgcattcgtctatctcgatgatgtgattatcgccaacacgactctcgaccaacacgtcaaaacgattaccaaagttttcgacaaaatcaaacaattcggtctccgaattcaactggaaaagtgcagttttcttcaaaaagaaaccgttttccttggccacataatttctgaaaatggcatccgcccggacccatcaagagccgaggctattcgaaaaatgccagcgccgcacgacaagtcaactctacggtctttccttggagcgctcacatactacggcaaatag

SEQ ID NO: 52623 - DNA, 204 bp, Heterodera glycines
  Genomic contig location: Contig_ID=SeqID_3969; Location=14..217; Strand=+
  SCN-specific regions: Sequence locations=1-44,100-123,145-204
atgaatttgaagaggtaaaatcaataatgatcttatcaattagcaattaaattttaaaaaattaaaaaattatttcagaaaaataaatctttttatattcaaatcggaaacggagtgcccaaaaaagacaaaaatgatgatgaatgtgcctgagaaacatttcggaaaatgaaagatgcacatactcatgaccttgattgttaa

SEQ ID NO: 52624 - DNA, 1094 bp, Heterodera glycines
  Genomic contig location: Contig_ID=SeqID_3969; Location=549..1642; Strand=+
  SCN-specific regions: Sequence locations=1-6,32-186,613-630,701 -703,725-870,898-1094
atgcaaacttattattattttttaatttgtttgtcgtgcttcttggccaacaaaattgaacggaacaattcagacgacgaagaagattattggcctaacgaaactgtagaaagctacatagacgacactgacagtgtggtaaagtaagttaattttttcgtagcaggacggttcagtgccaggacggagagaggagagagagagagtgagaatgaaagataatagtaaaaaaagagagagacaaagtgataaggagaaagagcgagagggtgaaataaggaaagagagagagagggaaagagaaaagagagagtagggaaaaaagagagagagataaaatggaaagagagagagagagaaaaagtgaaagagagagtgagaaagtcaaaaagaaaaagagagaggagagagagagaatgaaagagagtatttaaaaaagagagagacaaagtgagagggagagagataaccgaaagagagagagagagagatagaaagaatgaaagggcgaatgcgacaaaagagagagaaagagagagataaaatgaaaaaagagagagagagggaaaaagtgaaagagagagtgagaaaaaaagagagagagataaagagcgacaaaaacaaaagcgtgagagagatacagaaaaattgagggaaagagcgaatgagagcgttagagtgagacaaagtgagaggaagatcgaattcagcaaaactagactgactgttgagacaatgcgatgaaaactttcttttttggggtaattgggggatgggttaaaagcgggcacatcaggggaattaagaaaacaaaagaaaatgaatgagaaaaaatacgcgaaaaatgatgaattttgggttttctcattccaatctttttcttaatataaatatttgttcttttcttgtgtttataaattccctaatctctaagctttctagtgataccaataattgatggtcatttttttatattggactaattaaaagtgaatttttagattatgaattttcgacttttttcgagtccagatacgacaaatcgaaacgcatgttatattcgtgatcatcaacccagaaaatcccacaagaca

SEQ ID NO: 52625 - DNA, 274 bp, Heterodera glycines
  Genomic contig location: Contig_ID=SeqID_3970; Location=620..893; Strand=+
  SCN-specific regions: Sequence locations=1-44,76-78,100-123,145-274
atgaatttgaagaggtaaaatcaataatgatcttatcaattagcaattaaattttaaaaaatttaaaattaatttcagaaaaagaaatctttttatattcaaatcggaaacggagtgcccaaaaaagacaaaaatgatgatgaatgtgcctgagaaacatttcggaacaaaagggataggttgtggcacagatgaacggcataaatgtgaaaaatgtgacggacgacggaaagagcaacagaatggaaatggtcggtggacacgacacttttga

SEQ ID NO: 52626 - DNA, 1547 bp, Heterodera glycines
  Genomic contig location: Contig_ID=SeqID_3970; Location=1701..3247; Strand=+
  SCN-specific regions: Sequence locations=1-6,32-230,415-444,627 -642,741-1079,1106-1450,1472-1507,1529-1547
atgcaaacttattattattttttaatttgtttgtcgtgcttcttggccaacaaaattgaacggaacaattcagacgacgaagaagattattggcctaacgaaactgtagaaagctacatagacgacactgacagtgtggtaaagtgagttaattttttcgtagcaggacggttcagtgccagaaaggagagaggagagagagagtgagaatgaaagataatagtaaaaaaagagagagacaaagtgataaggagaaagagcgagagggtgaaataaggaaagagagagagagggaaagagaaaagagagagtagggaaaaaagagagagagataaaatggaaagagagagagagagaaaaagtgaaagagagagtgagaaagtcagaaagaaaaagagagaggagagagagagaatgaaagaatgaaagggcgaatgcgacaaaagagagagaaagagagagataaaatgaaaaaagagagagagggaaaaagtgaaagagagagtgagaaaaaaaagagagagagagataaagagcgacaaaaacaaaagcgtgagagagatacagaaaaattgagggaaagagcgaatgagagagttagacaaagagagaggaagagatagagaaaggagaagagataacagagagatagaaagagagcgggataaaaacgaaatagagagggaaagagtgaaagagcgacagggtgagataaggaaagagagagagagggaaagagaaaagatagaatagaaaaactctctgatctttctcattatctctgaaaccggtttaatcttagaatgcctttaaaccaataaatttttttagtttaccgccaaacgtaaaagagaaacttcgcgacttcaattttattccaatgacgccagcacctccaccgatggggttggtagtggggggggcgtcaaaaattttgtagttttgggtgcacacaaattccgctgcccgttagctcggatcgtgcaacctctctttccaaggacgggtataccagtttacaaggacataaggggaaagttccattaaattcaaggacatttaaaaattttgtcatatgcaatgaaaatgattaaattttacccaaatggtttatatttttcgccggaatgaagttttgattaattttgatgaccatattttacttttcacaacacttcttgcgggcgcttttcgacgactttctgggaatggggggggggggaaactgtaataggtttttcataattgataatttttaacgctttttgggtgtctttggaatcaaatcattgcccaaaagcgattagagaattttgtatttatattttgcaatttaagaagaatttttttcaccgttggagttatggttgccatttccattctctttggaattattatttttctgatatacaaaaaaaggaacaccaacggcacgcataccgaagcgccagcagatgaatttgaaatggaaactttagtctgatatcaatttttcgagatattttacttgatgaaattgctttgtctttttcagcattaatattcaa

SEQ ID NO: 52627 - DNA, 896 bp, Heterodera glycines
  Genomic contig location: Contig_ID=SeqID_3970; Location=3743..4638; Strand=+
  SCN-specific regions: Sequence locations=1-134,156-527,551-606,628-896
atgcaggaagtggcattggccaacgactcggcacaatttgccgagaagagcatgtcaatggcagcgaccaaatccaacggttgggtattgttgatgaaggtggtgatcattcttgaacaaaataaatttgtttcatttaacaatgaaagtaagaaaattaaaaaaccccgaagggtacggcgattttttcaatgtttcgcaaaaagtgccaattatttcggcattcattgtcggataggccggaaacgatcttaaaatggcaaaaattattcaatttaaagttcgatctgttgatatttgcagccataatttctttcaaaaggaatccttgtcgagtattttgaaaaaatagtgaaattttaaacaaattgtatagccaaaacccgaaatattcatagataccgaagtgagtcccgtctgaaccatttccgtcttaataattaagagccgattttgtctcaaatattattggaccatttttagagttcaagtgccaaggcggggggtcaatgtaattactattttgactttatttaaaatatttttcattaatcattcgctgatggggtggacgggattcaaaaaaacaatttgaattttataggagcaaaaattaatttaaaagcgattaattctgggccaaaaaacgcgcaccaattggcacatcgcggacgcgaaatcgtcgcagccgtacattttcagcgcgaagtcccacgagggtattttgccctcattatgcgcaattgcttcgggcgtcagcagatcaaggaacactttctgcagaatctcttcgctggtgttgtgcgctacgcaagtgaactccaaccggcgcggctcttccggagtgccgcgcgaccaactgaacgtgaaaattgaacaaatcattggccggtgga

SEQ ID NO: 52628 - DNA, 496 bp, Heterodera glycines
  Genomic contig location: Contig_ID=SeqID_21987; Location=1134..1629; Strand=+
  SCN-specific regions: Sequence locations=1-200,257-352,380-417,441-496
atgcctggacctggacctggacctggattccatgttggacctggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggtttttcgtgttttgcttggctttaatatgagtataaaaagattaaaattggttttttacattaaaaatgggacattacttattttgtcaccatgtaaaaaaataatttaatttatttgtttttacaaaactttgtcagtcacataactcggcattcatgcttatttagaagaa

SEQ ID NO: 52629 - DNA, 112 bp, Heterodera glycines
  Genomic contig location: Contig_ID=SeqID_21988; Location=154..265; Strand=-
  SCN-specific regions: Sequence locations=1-75,97-112
atggatgtgctgcaaacaaagagaattgcatttatcgaatttgcgaggaacggcgaagcggaaaatgcaatttcgaaaatggacggacgaacaattgacggatttgtgttaa

SEQ ID NO: 52630 - DNA, 730 bp, Heterodera glycines
  Genomic contig location: Contig_ID=SeqID_21988; Location=618..1347; Strand=-
  SCN-specific regions: Sequence locations=1-214,236-730
ggcggattgtcagaagcaaagctcatttcgcaaatggcacttttggagttgggcaattacgacacaatcccggaaacattgagcaaattaatgcagaaaaaactggccaatgttagtggggcgggtgccattgtccatttcggcatcgtttaggtcgttggccccggccgttggattgtgcccacttccgaaggccttcaaaggctcgaggcaactttccaatctgttttaaataaacacggattactaattaagtcttttcggcaagatggcgttgacacggacgggaacactgagcaagtgtcggacgacgttctagaaggttgtaattgccacacttctttaaataaaatgaaaattcgcagaaagggacgaagatgacggcagcgatgtcagagaagtgaagcagcacagcgacagaagggcgagaaaacgcgtccgttttgatttgaccgtccccacttcggcgctgttgcgaagtcggtcgatgggaccgatgagaagcctcgattttaacactggtggggtccatttgggtggaattgggttaatggcgattcaattgttagatcggtctcctccaattcggcgacatcgccgggctccttcgcccgaaattagtcgcaaaaatttcaatgacttttctccgacggaccgttctcatcaccctactcttcggacttctttcagccgtcattccatgcaggaaattggcaaacaacagcaaaga

SEQ ID NO: 52631 - DNA, 643 bp, Heterodera glycines; identical to SEQ ID NO: 21989
  Genomic contig location: Contig_ID=SeqID_21989; Location=1..643; Strand=+
  SCN-specific regions: Sequence locations=1-643
  Gene Ontology: Biological process=glutamate metabolism

SEQ ID NO: 52632 - DNA, 1075 bp, Heterodera glycines
  Genomic contig location: Contig_ID=SeqID_21990; Location=354..1428; Strand=+
  SCN-specific regions: Sequence locations=1-13,35-309,331-391,413 -614,636-1005,1028-1075
  Gene Ontology: Biological process=glutamate metabolism
atgcgagtggcattaattgtggagtcgggggaagtcaaacaggtgattcgctaaatgttatagtcctttagacttggccatcaatgtttgtcattttccaggtccacgacttttgcgtgttgctcggttacggtgcggatgccgtttgtccttacatggtgtacgagacaaggtaccgactgcgcagcatgggtctcatcgacaagtctctgacggacgacgatgtcttccaggggtacaaagcgggcatcgaacggggcatttacaaagtgatggccaaaatgggcatcagcacgttgcactcgtacaaggcgagacaataatatttttacagatcgttccaacaaaaatattgtttcagggtgctcaaatcttcgaaattgtcggcctcgcgcaagaggtggtggacaagtgagcacatttttgagcaattattacttaatagcatcaggtcaacgcacttttcgcgacttaacttttgcgacgattcgtaatttatctctctgtctgtttgtctttcattaacattcgctttcgtggctatttcttccctcttcggtgttcaggtgcttcaccaattccgtgtcccgtttgggcggtgccgacttcgagacgttggccatggaggcatgcagaaggcaccgaattggctatccgaatgtgctgaacagtgacttgtatttgtatggtgagcaaatttgttcagagttttctgtctatgactgtattaccgtaacactctgcaggagacagcaaagtgttggtcagtccgggcgtttaccattggcgcgacgggggcgaaaaacatgtcaacgaacccgtgaacatagccaagctgcaggcggcggcgcgactgaacgacgctaaaagttaccaggaattttcacgggcgtcgaatttggcccaaagactctgcactttacgaggccaattggagatcaaaacaaatgtgaagttgcagattccgttggaggaggtgctgtgacaattcatccgatctcacaaaacataaaatatataatatatgtggtttaggtggagccggccgcagaaattgtcaaacgtttcgtcactg

SEQ ID NO: 52633 - DNA, 645 bp, Heterodera glycines
  misc_feature (4)..(4): n is a, c, g, or t
  Genomic contig location: Contig_ID=SeqID_21995; Location=193..837; Strand=+
  SCN-specific regions: Sequence locations=1-114,136-645
atgnccttcaacccgggtctccgtctgatcgccaagactttggcgaactctctatggtattttatttttctacgatatattaaaaaaatgattggaaggggaaagctcgcgcagcgcgtcggccacactgagatacagtacacgcgcacgcctgccgaattccacaagctcctcgacgacccgacttacgacaaactggactttgtccacgtctccgaccacatggaccgtgtcgtcgtccggaagcgacccgagttcgccaaagcaccattgaccaactgccttccagtggccatcttcgtcacttcgtatgcacgtctccatctgtacggatacatggagcaagtgttgacattgaacaacgctgagcttctctactgtggtttgtcttttaccgtttaatgttttagtgacggtaatttagacacggactccatctattacgtcaacaagattggagctccgtgcgtaccggagggcgaagcgtttatgtagagaagaaaatggacacaatgacgataagtcggattctaacgggaaacacaaagaccagagaacactacttgggatgcttcccttgcgacaagctccccgacaaaatcatcaggtacccttcagcattggtggcgaacaatgacccatcca

SEQ ID NO: 52634 - DNA, 645 bp, Heterodera glycines
  Genomic contig location: Contig_ID=SeqID_21997; Location=1538..2182; Strand=-
  SCN-specific regions: Sequence locations=1-66,116-417,439-645
atgcatcgtctctcggctgaacttcctttttctcaagttttgtcgccgtccgggaagctgatgagtgccaatgccaatgccttcccgcttttgcacaacaacaacaacaatttgcaaattttttcatcgccaactaaaagtggcattctcgccgccgacagtccctccgcttcgcctggtaaacaatcggaagatgacgagttggcaaagcagaaaatacgttctacggaactgaacgggcgaatgaaacagttggagaaggccaacgagcagctgaacgaccaattgaacatggcacaggaggaatacaacaatttggaagtcaaattcgaggagatgcgggtcgtaaacatcaaattggtaagtttgttacttgttttgaaggaaattgatatgagctggacaagaaaaatgttaaaagcattggcacactttcagcaagaaaccatacgcaatttgaatggacgactgaaggaagcgcaggacgagtcggagttgcggcggtacgaatttgaacagttgaagagggagcaaagaaatgccaacgaacgaaatacaaaggcatcgggcaaaatggacaaacacgcgaaggaagtggaggaaaaggagagggaattgcagcttctacacaaacggtggatttga

SEQ ID NO: 52635 - DNA, 655 bp, Heterodera glycines
  Genomic contig location: Contig_ID=SeqID_3972; Location=899..1553; Strand=-
  SCN-specific regions: Sequence locations=1-240,262-567,621-655
atgacaggcagtggaccaatacaattcggactgcattcgccacaaccttcaactccaaccattccattgtcagaagaaagcagcttgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcagtaaaaaatttcatcggaaaacattattttttggtattttcagcgtgagctcaaccatcatccatcattgagcgacttcattgctgcattcacgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgccttgcacctgctcgggatcgtgatgcaaggctttgcggagggacttcacgtccgtggaaattcagagagtggtgaagaaactgaggccgatgaaaattgattttaaacattttcatattattgtttttttattgatattttatatattttatgaagatttctttgcttgaagcacttttataataaa

SEQ ID NO: 52636 - DNA, 1070 bp, Heterodera glycines
  Genomic contig location: Contig_ID=SeqID_3973; Location=28..1097; Strand=-
  SCN-specific regions: Sequence locations=1-255,277-925,971-1070
atgccaactgtacgcgaaatacttgagagtctgcaaaagccaattaaaagaccccgaattccaacaaatgaagacagcgtactgaatgctgagaggacagacgcagaacaacaaatggaagacacttcaaccaggaatgatttggacgtcgctgcaagcgatgatgaagaaaactgtgagcctgttcaattccaacgtggcgaaacaatccggggagcgctttgtctttggcaccaaggtgttaatagttttttgattatttatttatttatttttcaggctttcgctttctgaaaatcagaaaagatggcagctggtttaggtgcgaacagcgtaattgtcctgcgacagcaaaattggaagacaacggtttggtgacaggcattttgggcccaaaagaacatcaccatggttgtgcaccatcgcgttttgatgcagagacgaaacgaaatcagatgaagcgcctgatcaaggagaagccaaaaacgaaaccatgtcaactccgtgcacaaattcggactgacattgacgatgaagtcttagaattgctcggcaccaatgaagcgctcgaccaaatgacgaacaggtagaaaaaattcagagaaaataatgatacaatatttagaacaaagaacaaatcgttggtggtgtcaactgtgccgacccactgaacatacaaattccgtcaggtcttttaatgaagaatgatgagtccgtcctcatttatgacagccgtaatatgaggactggacaatctgatgtcgtcctgattttcagccatagcaaggcaagtctaccttcgtccgttttgcgcgagtcgcattccaatttcacgtccaccgaaaacaaacgtgtaagtataaatttaacggatcgatcgggagggggggggaagtcagaagtgaaaaatacgaatgaaatgcacaatttttttttaaatttttttgaaattaaaaaaaattttttttaagctggtgcgcgttgtgattgacgaagactcgtcaacagatgatcaatcaccggcaacttgcagcgttgggacacagacaaagatgagctttgcaaataaa

SEQ ID NO: 52637 - DNA, 474 bp, Heterodera glycines
  Genomic contig location: Contig_ID=SeqID_3973; Location=1312..1785; Strand=-
  SCN-specific regions: Sequence locations=1-156,181-188,241-474
atggccaaaaatgtcggggttcggggtgggggcccaaccctagttttgaagtaacccacaaataaccataaaaacaacgggggagggttaaaggttattcccatttctaaaataaattaatcggcctacgaatcagaaagttaaatacctattagactgatattttttcaaataattagatatgtaggtatataactttaaaattctaattttttcctttaaaaattatttattttatttcagtgacgaaaagtttagtgacgaaaggtgtaccgacatttcgccaacttgacatctcgccaactgacatctcgccaactgacattttgccaactcagccaaaaacattcatttcgccaactcaaccaaaaacattcatttcgccaactcagccaaaaacattcatttcgcctactaagccaaaatctgacatttcgccaactgacatttcgccaaatagttaaaaaaattaaa

SEQ ID NO: 52638 - DNA, 204 bp, Heterodera glycines
  Genomic contig location: Contig_ID=SeqID_21999; Location=516..719; Strand=+
  SCN-specific regions: Sequence locations=1-204
atggctgcaactgtagcagaagttgccgccgaggccgccgaaccgccggtgggcgagcaggacgcggacgacgaggcggacgacgcgttcgccgctcctgcggcgggcgttgcggcactcgctgccaacgacgacagtgtgccaccattctcgaccatgccgccgatgccattgttgacggatgaagccggcacgcgctcgtaa

SEQ ID NO: 52639 - DNA, 977 bp, Heterodera glycines
  Genomic contig location: Contig_ID=SeqID_22003; Location=107..1083; Strand=-
  SCN-specific regions: Sequence locations=1-10,33-213,264-364,386 -534,565-695,724-774,796-842,908-977
gggacagagggaaggagaaatgttaacaaatttaaaaaagcaaaaaaatgagttattaataattaacaaaattaaaaagtaatgattgccgtggtggcacacgtgaaaaaagaacggacttttaggaggaattggaaccaaatagaaggaaggaaaacacaaatgtacatatataatgttgtcgtaacgtaatgagaatttgatcggaagcataaggaaaaggaaaggaaagaaaataaaagaaaaggagagaaaaggagagatttatgaaagagagcgacagacggcggaaggagggacaactgacaaacgatcacagagcagaagcagacaacggaccaatggtacacaaatgggaaaggaatgaatgagagaaagtgaaggagaagggttaggacggaaagggccaaatttggtgccattccaaaaaaaaagaaaaagatggcattttgaaatcgcgaatctcttatctggcacagaacaaaaagccaaaacaaagcgatgaaatttgaaacaaacggcaggcagaatagcaaaaataatttaaattttttgacaaaaaagcagcgccaattaaattaagttatccctcggaagccaatttgtgggtttgttaagccacgcatttgtgcatctgtggagatgaagcctccccccccattttcaccaacagcagagaaggcagcggaaaaagcattgcccccctccctctctctccaccccaattggcgtgcctttcactgggtctggggctgtttttcaaaatatttttttaagcagtggaaatagtaatggaagaagtaaaattttgaagaaatagtgcgataataatatttttggttgagaaaaagagaggagagagagtgagagtgagagaggaaagcctagtgagagaggggagagagagtatgaggattttaaaggggaagagaatgagaatatggaggaaaagatatgaagcgaacgaagagagaagg

SEQ ID NO: 52640 - DNA, 828 bp, Heterodera glycines
  Genomic contig location: Contig_ID=SeqID_22007; Location=189..1016; Strand=+
  SCN-specific regions: Sequence locations=1-828
atggcctatcgacggctaacgacaatgcttcaacggctgcagaagactcccgaggtgctcaagctgtacaccacagtgatcaccgatcagctcaatgcagcaataatcgaggaaacgacgatcggagctggtaaacacgaacacttcatccctcaccaagcagtgatcacgcctaaaaagttgcgggtcgtctacgatgcgagcgcacacacacgaggggcaccttccctcaacgactgcctactcagaggcccagtttggctgccggatttggccggcatgctcattcggttccgagcatgccgagtaccagtgatcgccgatgtcgagaaagcatttctcatggtcgggattgaagaggacgacagagatgtgtgcaaatttttgtgggtgcgcgacccatttcggccagtgacaacggacaatttggtgacataccgatttcgacgcctcgcatttgggctcacgccaagccccttttgtctcgccgcagttgtacgacaccatctgcgcaaatacgactccaacttcgcggaagaactcattcgggacacatacgtggataatgtgctcatcccggcggacactgcggaagaagcagccattaaaggacgagaagcgaaacgaatgtttgcggacgcgaggatgaaccttcgggaattcttgagcaatgacgagacactcaacagcagcttttcggacgcggaattcctcggcaagacgacggccaaagtcttgggactcgaatggaatgcggagacggacaaaatacgaatgaagtaccccgggagcgaacccggcactccgatcagcaccacacgcagaacg

SEQ ID NO: 52641 - DNA, 251 bp, Heterodera glycines
  Genomic contig location: Contig_ID=SeqID_22008; Location=406..656; Strand=+
  SCN-specific regions: Sequence locations=1-251
  Gene Ontology: Cellular component=endoplasmic reticulum; Biological process=response to stress
gttctgtccgcgaatgcggaagcgtttgcgcaagtggagtgtgtgtttgaggaccgcgacttccgcgtcaaagtcactcgggacgagttggaggcgatgttccgcgactttgaacagcgtcacatggaacccatcaatgttgctttgacaatggcacaactgacgctggacaaattggaccgtgttgtgttgatgggtgccggcacacggatgccacgcctacagaccgtcctcgacatattcctccaggg

SEQ ID NO: 52642 - DNA, 381 bp, Heterodera glycines
  Genomic contig location: Contig_ID=SeqID_3975; Location=49..429; Strand=-
  SCN-specific regions: Sequence locations=1-381
atgaacagacggtaaggaaaatttttaaaaattacaaattttcattttccatgcaattttttccatgtttcagttggctttgtagcgacgtgtggatggacattctcccatcttttgaccgtcctcaactcggcctcaaaatggcattgctttccgaccgtttcgatgttttggtggacaaacattttgatggaaaaagcgaattggcaatttggagaatgatcagaattgacaaggacaaaggacccaaagccgaaattatctgtgcggatcgacggcacttttgtggaatttccgttccccgaccgtccgctgcccaacaaaatccgatttaaggaccttcagatttagtaatttcaaacattttttgtttatattaaa

SEQ ID NO: 52643 - DNA, 79 bp, Heterodera glycines; identical to SEQ ID NO: 52291
  Genomic contig location: Contig_ID=SeqID_22010; Location=281..359; Strand=+
  SCN-specific regions: Sequence locations=1-79

SEQ ID NO: 52644 - DNA, 379 bp, Heterodera glycines
  Genomic contig location: Contig_ID=SeqID_22010; Location=882..1260; Strand=+
  SCN-specific regions: Sequence locations=1-379
gcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaaccgaaaataattttcgtatatttttcacaatttatttcaaaa

SEQ ID NO: 52645 - DNA, 673 bp, Heterodera glycines
  Genomic contig location: Contig_ID=SeqID_22011; Location=73..745; Strand=-
  SCN-specific regions: Sequence locations=1-69,95-124,146-164,186 -203,230-402,424-507,529-673
atggcacctcctcccattagacagtcttccacctcatcatccgtcgaattggacgacgaaagggacgaacttccgccaccaccgccgccgatggttcagcaaaagttgcggaacggaatgcagcgggaggagagagaagaagcccatcgccattctcagcctctgcccctcccctcccttcctccgaccacggcacaactcccccatcaccagcagcagcaacagtcccttcctccgcttcgttcccatcttccgcttccctcccgcgtccatccgttacgtcctccgcctcctccgccaccgtccgttccgcccgtgtcaaagccatcggtgactccgttatggggccgtaatgagcgattggttaattatttgcacggatatggcactttgttgggcaagaacatggaggagaaggagaacatcatcgtcggaccacgaagagacgccaaattggaggaggaagaacgccgaagggcggacgaatgggctgtgcatccgataatgctgaaggagcagaggggccgacccgaggaacgagtgattcccatccaacgcagaacgacagcgcaggagacgacgccatggcgcgggtcgccgctgctcagatcgccacgacggatcagcacggaatggacgagcggaccaacgcaaaacggacaccgaagaaatg

SEQ ID NO: 52646 - DNA, 708 bp, Heterodera glycines
  Genomic contig location: Contig_ID=SeqID_22012; Location=157..864; Strand=+
  SCN-specific regions: Sequence locations=1-332,354-635,683-708
atgaaacaagacgaactcctcgcaaattttctcagcagccctctaccaccattgccaccaagaaaaaattcatcaacgaatacccgaaagagcacatcggtcaatgatcaacatgaaacgaactttcacaaacaatttggtcaaaatatttttaacagtaaggacggatcaactgaatctgaaaaacgatctaatcagcagacaaaaaaaaatccaattagcatatatggacgagaaggacaagaagtttccggcaaccaaagtgatcagaatactaaaaagacatcatctgataagcaaaggaacgaaaagaataaagacatttcatttgctaagaaagtagtcaaatatttatctgggcattcatctgacacccagaaagatcaaaagccaaaaaatggcaagaacgaagctggatcaactggaaagaatactaatcagtcgaatgatgtcccttctataaataaccagcgtgatcaaatttctcaaaaagcaaccaatgatttatatggacaaccatctgaaaccccaagttatcaaaagaaagcaaatcgcatgaacggagccggaccatcggagaagaaaagcgatcagaatgacaaaagcgagctgaatgaagggacaccatcagaaaatcaaattgacaaaaccaaaacaaatcgcttgttaaaagcaaaagaaattttgccctttcaacagaaagagtag

SEQ ID NO: 52647 - DNA, 461 bp, Heterodera glycines
  Genomic contig location: Contig_ID=SeqID_22013; Location=1588..2048; Strand=-
  SCN-specific regions: Sequence locations=1-461
  Gene Ontology: Mol. function=electron carrier activity; Cellular component=mitochondrial matrix; Biological process=electron transport
aaactgtccacacgttgaaaatgttatcgggtgatttcgaatacgaagaccctaagtcggaagaagaagtggtcaacataacctacgtgacaagagatggaacggagaaaaaaatacgtggaaaagtcggcgacaatgccatgtatcttgctcaccggtactcttgaataaggtaattagctcatcttttttttaggtataacattgaaattgagggagcttgtgaggcatcgttggcgtgttgcacttgtcatgtttatgtggatgaaaaatactacgacaaattgccagctgcagtggaagatgaagaagacatgctcgacatggccccattgctgaagcccaactcgaggctctcctgtcagattattctaaacaaagatttggagggcatcagagtgacactcccgaaaatcacgaggaatttttatgtcgatggccatgttccagagcctcactga

SEQ ID NO: 52648 - DNA, 1040 bp, Heterodera glycines
  Genomic contig location: Contig_ID=SeqID_22014; Location=233..1272; Strand=-
  SCN-specific regions: Sequence locations=1-149,208-425,466-620,658 -837,859-946,976-1009,1031-1040
atgcagcttctggctgacccgcttgtgaagcagattgccaacaaaactgcatttgttccaactgaggtggttacttttttgtataaaaatggcaaaaacggaaaaataataaaatttgttaactacctttgccatttttacgatttttgttaaaattattattttgttttttgcatttaaatttaatattttaatttaatattttttggacttgtttacagttttggtcagttctagaaatgctgtagcgtactttttagaaatttgcaattctcttcaaaaacattcgcatgaactgttcaatggaaattggcaataaatgtgcgtctggcaccaagctgatcatgttggcaatgtcgggcagggactcatttgagaggcgaacgggcgcgagagagacatggatgaaagaagcggtagggaacaatttaattgattttattattattaatttaataatttattggcgaaataacgggggaaacaatttaaagcactaattaagttggtttcatcattttattgatgaaacacgttgtgtaaattatttaattgggttaatcaattttgaattttaaggaattcaattaatgagaaatgtcgaataaattaatagtgagaaaaaaataattgaaatattcaattaaaaaaaaatttgatcataattaaagaatataacgaaaaagaacgggctgcacttatttgaatttaaaatttgagcaaaattgacattaatttttttttggattggataaatataaacttgcatttaattaggccccgggcgaaatacaacgattttttatcgccgacccatcgggaggagaagcggcagatgtaaaacaaaaattaaaagaagagcagaaaaagcatggagacattgtgtttttgcacggttttgtggataagtacaagcatttacatctcaaagtgatcagcaaatgacaattatttaattaattaataataattaatctgttttcaaatgatagaaacggagaaaaaaagcatttattttgacaattctttgacaaattaaa

SEQ ID NO: 52649 - DNA, 477 bp, Heterodera glycines
  Genomic contig location: Contig_ID=SeqID_22014; Location=1364..1840; Strand=-
  SCN-specific regions: Sequence locations=1-93,115-204,228-477
atgatcagcataaaagcattaaccgatgccaactttaaaagcattttggtggaacttttgaatgccaaaagtggtaaatgaaacattggcattattttattaatttatgaattttgacaaaattatttttagatggttcaacacaaactgaagtgagcttcaaaattggcactgacagtgattttgaagtagcattccccggagtaataattaatttattaaattatcaccatttgaatattttttatgtttcagtcaaagtcaatgccaggcaaaggcgtacggctgcccccaggcagttacctgctcaatttggacatcgtgcttaacgagcactgttctattatgctcaaattgaatggcacacaatttggagaatttatttgtccaaccgatgtcaaaatgccattgggggctatcagttggatcaaggtgaagccaatgggcgagaacagctttttgggtgtcgaagactaa

SEQ ID NO: 52650 - DNA, 1388 bp, Heterodera glycines
  Genomic contig location: Contig_ID=SeqID_22015; Location=53..1440; Strand=+
  SCN-specific regions: Sequence locations=1-106,139-257,279-635,668 -802,824-1073,1095-1225,1247-1315,1337-1388
atgtctaccgtgcgtacgtctggccgctgtattgtgactggagtaacggcctcttccactcctacctcaacaaattcctgcgcatcaaatttgagggtaagtagtaaattgatcaatcaatcaattaatcaataatcatttagccagcggtttccctgctgactgtgccgctgatgacattgacgaggaggagagggagcgcagaaagcagcaatacatcaacaacccctggaagggctgtacggtgcggctcgacgcaaacaacatcaagccgaatccgggcatgcggtacctttcgaagctgtgcctcaactcgctgtggggccgctttgcgttgcggaatcggctgacgaagacggaaatcatcgactgccacgccgacctggcgaagcttctgaacgacgtcaaaatcgacatcagcagcatcgaccaactgacggagaaattctggatggtgtgctacaaggcgaaggatgagcacgtggtggagcacgacaccagcaacgtcgccattgccctatggactacggcagcggccagagtgcacttgctcaactcactgcaattggtctacaggcaggaaaatctggttcagcgctacgacacgcgcattttatacatggtaagagtgtgacaataaaatattcataataaaatatttttttttcaggacaccgacagtatcttctacgacttcaagactgcactgggagacccgctgaagggaggcaacaagcttggggagctcgcggacgagtaccacagccataccatcgtcgagttcatctgtggtaaggactttgtccaaaataatttgaataaatttcaatcgatttttagctggacccaaggcctacgctctttggcttcggaacaacgcaaccggcgaggacgagtacaagctgaagctgcgaggcatcacgctggactcgaacgcctgcacccgcatcaactttgagaagatgaaagaaatggtgctggagaagtggggcacgcccggcaaccatgtgcggttcgactaccctacgaagaacttccgaatcacgaagcagggcgacattctgacggtgcccatcaccaagcagttcaaccccaccgtgaataagggggtgctccgggaccgtgggcttaaggttgtcccctttgggtatagctcatgggagtactgtaaggcccataacccctacgattgtctctgtaagcgcgaataatttattcattttgtacttttatttttcaaaatcctcatctgtgacccaatatttttccggaaatccgataaatttcaccaatatttccttttttccatccctcattcgttctttgtactttttctcgatcctatacattgtgttttcgtccacttgtacttttgttagctctggcaa

SEQ ID NO: 52651 - DNA, 573 bp, Heterodera glycines
  Genomic contig location: Contig_ID=SeqID_22015; Location=1597..2169; Strand=-
  SCN-specific regions: Sequence locations=1-573
gcggacttggctgacttccaagccctttcgcgaaagaacagcggctatcggtacctactgttggcggtggatgtgttgtcgcggcgtatgttcggctcacccgtaaagagtaagaggccggcggacgttaaaagggcatttgaggaggtgttgggccaaatgccaaggcttccggaaacactgtacacggaccgtgggctggagtttgtggccaagcccatgaaggagttcttcgctgagaatggcattaagaagtatgagaccagctcaaagaagaaggctgccgtcgcagagagagccatccgtacggtgaagactcggctgtacaaatatttctctgccaaaaacacctctgcgtgggtggatgtgttgcccaagtttttgtctgcaattaacaattctgtgtgccgcgcagacttaggccaaacgaaatcagtgacgtcaatgcgagagaggtgtggaagagggtctatggcgaaggacttgtaccagcggagaagagaccaaagatcaaagcgggagaaactgtcagaatcccagagctcaaacacatattcgagaagggtacagtga

SEQ ID NO: 52652 - DNA, 1296 bp, Heterodera glycines
  Genomic contig location: Contig_ID=SeqID_22016; Location=68..1363; Strand=-
  SCN-specific regions: Sequence locations=1-306,364-653,675-702,725 -769,812-903,947-1122,1153-1296
atggagatgggcgtggaggaacagcaaacggacaataatccccagcagcaacaaaaacacgtgccatctttgacatcaaaccctgtggacaatgccgtgggaggagtggaaacggcgacgactgcacatttcgacgggcatggggagagggcggcgacggcatcaccggcttcgtcatttgaggaagctttgccggcggagacaaccaggagcaacagtggcagtgggggcgaagacgaacatgacggggcacgccacggaaatgttgatggagatgaacatgatggacatggacgacaacacagccggcactaccaacaacagcaggagcaacagcagcgaccccaacgacagcagaagcggtgcagtcggcacttcttcagccaggagccgcccaagctgtgcagcatcatttatgccgagtttgacaacgacattggacgtgtgatacgctatcaagtgaatgtgtggcgtgaaaaaaatattcaaaatttttctataagtaattttaagaaaaaggttacaaatttttgcagggttttttttgaaagttttttggaaaatagtagtaattcattggaatctttaaaaaaatttcgagggggaagaacctgctccggcaaaatataaacgttgcccagaaactttgttggtatgaatttcaccaaataaactattttttcatggaatatttagaaaacggaaaagattttatttttaaattcgagcgattgtcgtttggccaaacattttaaacgcctagtcttccttattttttacaaaaaaaaatgaaaaagttattaataaatttgccgtgccgagttttttattaacaaagaaagtaatttataaagaacttcaaatttttattttgaaatatccaatataaaaaaaatttgcctctaaatttaatacaaaaaaaaataaatgaaaaataaaaatttaaggtgcccgatgagatttttgacaagcaacgcttcgacaccatttcgtccgcaataattccgtcggaggaaatgcgcgatcgtatgatcaagatcaacatgtacgactacaaaatcacgggccatcccgtcggcatcagtgagcactaaaaaatgttttttctcctagcagtaagccaaaaaattaaaaaaaaaaatttttttaaaacattagaaaagcaagaaaattcttgataatctgggaaattcactactttttcgagttttaagcagttgtcatttctttggcttacaaaaaaaatctcaaagaaaaaaatttctcgcggaaaaaaacaaaattgggggaaataaa

SEQ ID NO: 52653 - DNA, 105 bp, Heterodera glycines
  Genomic contig location: Contig_ID=SeqID_22017; Location=838..942; Strand=+
  SCN-specific regions: Sequence locations=1-105
ggtccgtttgggggactcaaacaattatggggagcaaaaatccaacgcagaattaaagtacaggctatagggaagctattcccgaaggattcggtctccccataa

SEQ ID NO: 52654 - DNA, 664 bp, Heterodera glycines
  Genomic contig location: Contig_ID=SeqID_22017; Location=153..816; Strand=-
  SCN-specific regions: Sequence locations=1-664
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttttgtttc

SEQ ID NO: 52655 - DNA, 959 bp, Heterodera glycines
  Genomic contig location: Contig_ID=SeqID_22018; Location=1119..2077; Strand=-
  SCN-specific regions: Sequence locations=1-377,399-959
atgcgtgtggcaatcggacgacggaagctgttcggacagtcaatttggtgtccagatggaacgccaacagtggcatttgctgacgcggaggagcggaaagttcatgttgaccggaaggccgagaagggcacacgcgactgcacagaaacgggtgagtaattagcaagggtgtgccatgttgatggataagttgggatggcatttcaaaggtccgtctctgtgcctattggactccgcctgcggcgcccttccatcgtcccgtcgcgccccccgcggactgtgccaatgcgtacgacccggtgcccatcggttcggctgagttggcccaacttcgcgtctattgcgtcctcgacactgcgatgggtgtgcagaatgttcggcagcaggaggagcagcagttgggcggacttttactggccgaaacgcacaattttctgctggcgctcaaagggccgttgtgctgttgccttgagcaaattgcgttccccggggggtgaaggccaccccaacgggggcagccagtacttggtgaggagaggagccactgataggagccgccaggaaaaactttggaattttcagtcgaacagttaacacattttggctattttaaatccacaaacccctaaaataccgaaatcctcaattctaaaaaaatcttcatcgttctagcaaaagccaataaggatgataaatcctcaaatatcggagggatcgaaaccaaagccccgccgggaaaagagaccaatatacaaaaaaacctggaacctaaagactctcacatatctctcaaattctcgtgttcaggagattccggaccacgtgcatcggtggtgtgctcagaacggattgcacttccaactgattgtgtccggcgtgccgtcgtccgccccctccccggcacttccgcgttcgctgtccggacgcatcgttctgtaccaaaagggcaacgcagctga

SEQ ID NO: 52656 - DNA, 2064 bp, Heterodera glycines
  Genomic contig location: Contig_ID=SeqID_22021; Location=1052..3115; Strand=+
  SCN-specific regions: Sequence locations=1-78,101-179,217-576,603 -819,843-1318,1340-1390,1432-1558,1738-1946,1968-2064
  Gene Ontology: Mol. function=myosin light chain kinase activity
atgtcaaatttattttacgttcttttacctagtgactctcctggttatgacaataagcctaataaatttagggttcatttgcctaggaccctaacttttggaggtcaatggttgtgtgggttgcacagtataatttatacaaattcttggcccgccattggtaccacagagaaccaatggattaaagtgcatttaaaaaatggtgataaaataaaaattgatattcccgctgggtcataccaaaatgagcaagaattggaaaatgctataaatgagtcgataaaaaatggtataaaacaaccagcaacaagaatgaaaagacaaacggaaaatggagtggatttgttttttcattataatccggatgactattgggataaaattgaggaagaaaggcagcgatacaacgaattgttaaaattaatagagacaaagtcaagtgaacgtgacaatgagatggacacacataggaagagaaaaatacaggaggaaaaaattactcctcttcaaaatcaatcattgactaagaaagcaagaatagaggcgttagaagaagcagcaaggcaaagagatgacggaaaggaggaaaaggaggagagaactggtcaagaatttctcaaaatgtatccagtaaactatagagagaagctaaatgaagttcgattagaattaataagagatttattcaacattcaagaccatatgaaaaaataccaaggagtaacagatggtagaacaattcaagaactaaatgaaatagcaataaagatgagaacagcaatgaaacacagaagaaaaaatttgaatgcttttaacaaggctgtattgaaaaatgatttacaaatatcagctgaagaatatgagaggacgagctatgaacaaaataaggattacgttgagccattttttgatagtcatccaacagattactgggaacatattcataaaaaatatgaaggccttcaagacgattacaaaaaaattcgcgaattaagagaacaacaacaatttttgactgatgaacagaaaaaacagtcaattcaggatgaaattgatcaacttcgtcgtcttgtcgattataggaaaaaaagatttgcagcgctagagtatgaagctaaaaagagggacgcactccaacaacaaccaatggctttagccttgactcatggtgaagcactgaaggaacgaataggaaaaattgagggaactaccaccacagcagacggggaagagacaaaaactcatggaaaatctttggttgagttaatagaacaggtacagaaagaaagagatgatagcaaggccaaaactgagggtaagacacgaggagaaattttaggagataaattaaaagccaaaattgatgaacaagacagtagtgcagatggtgcaacccatggtgaagcactaaaaaataaaccagaaacaactattggtgaaaaagtaatgacaagaggagaaattttaggcgaaaagttaaaatctaaagatgaagaaaagaaagaagaaagaataacccatggcgaagcattgaaaaatagaattgaacaaattcccgaagaagaaaaaacaaaaggaaaaataagaggcgaaatattaaaagaaaaaattggggctagtaaaccaatagaagaagaaaaaaaagaaggaaaaacaagaggcgaaatattaaaagaaaaaattggggctagtaaaccaatagaagaagaaaaaaaagaaggaaaaacaagaggagaactattaaaagaaaaaattggagttgataaaccaataagacaagaagaaattgaaggtgtgaaaacacgtggagaatcattaaaggatataattgtttcgaaacaaattgaagcagtattattcaaatatttgaatgagcgtaggaaattttcgatttattttaatgaccgaagaattgaatttattgaattatcagcacaattaggatacattcttgggtttgaagacacgacaaaaattaagaatggagatatagcaaagtattattgtgatttgaagggagggattgatagtctttgtgtttacattaatggaattactgagaat

SEQ ID NO: 52657 - DNA, 1113 bp, Heterodera glycines
  Genomic contig location: Contig_ID=SeqID_22022; Location=289..1401; Strand=-
  SCN-specific regions: Sequence locations=1-239,268-461,483-560,582 -721,758-1113
atgcaaaaatggatatttaaaagtgcaaatctgttagcaaaacatgcaaatgtttagttttcgttttttttctcaggaattgcctgtcgacaaagtttgattcttcatatttattttaaattgacaattttttatcattttttaagaaaacgcgttaagaatttgagcctagtaatcgccaaatctggtcatttttggacaaaatctgttgacaaattgcactcaattttcaaaattttcccgggcccggcgcaccgcccccccccctttttcttctcgaaattttttcttggaaaaagcgttccgcgaaaaaagtggtgaaaagcaaaaaaaaaaaaaagggtcgtcgaccagcagcagggcgatggtttcccctccaaggcaaaaaatcccgttgaccgtccctgactgctggacaaacaaaacatctcccttattcttaaaaaacgactcaaaacccaaaagtttggcgattttttggataaattctgtcaacaaatttttattaaaagttcaaagattttttacggcggtgccgaaaggcactgcctcccccacttacattggatttttggaaaataccgaagttatgaagttgtcgacaaaattttttcgattttccaaatcggtgttaccttctgatcagattaaggttgaaattctgaatttttaataatattctgattaattgtttggaaaaaatgaagtaaatttgatttggaaatattattaaatatatttattttaatttaattttgctttaacttttagcttttataaaataatgaagatttttgatacatattaaatatgaaattttcgattataaaacgatattcaattttcggtccttaacttttttcatcaaaaaaaatttaatatacgcaatggaaagtgcttattataattagggctccaatttatagttttttcactatttttttcctgagctctccgtggcctaaaacatacgaaaaacaagtttttttcggttgttgttaagctacttttcgagttattagcaactattttctagttttttatttttagcaactaaaaaactataaaatttttgaaaaaaactattttcaactatttttgcttgtgaataaa

SEQ ID NO: 52658 - DNA, 382 bp, Heterodera glycines
  Genomic contig location: Contig_ID=SeqID_22023; Location=285..666; Strand=+
  SCN-specific regions: Sequence locations=1-92,141-326,348-382
atggccaaagaatgcacaagtcggaaacggccaaattgcaaggatggccacaacaatttaatcgaaggacggaccgatcggagcagtaattgaaattattttaaaaatttatttgctaattatcattaattataattatactcagtctatagaaggtcatcctgtaaccatcaaattccttcggggcactgtgtacaggtcggacagtacgccgtcctgctaccgtaacaaacctaccgtactccttccaggcgttggtcgtctcgttgaaggttcaaaaattaaaaaaaatttgttttttcttggcatttttttatcaaattattaagaaattttgtacaaaaaatgacaatgttttgtggttttgagccgatttttgaaa

SEQ ID NO: 52659 - DNA, 63 bp, Heterodera glycines
  Genomic contig location: Contig_ID=SeqID_22024; Location=58..120; Strand=-
  SCN-specific regions: Sequence locations=1-4,36-42
atgaaggaggagaaagggtggggggagtatgagtatgatggtcaatatggagaaaaagaaaga

SEQ ID NO: 52660 - DNA, 805 bp, Heterodera glycines
  Genomic contig location: Contig_ID=SeqID_22027; Location=1282..2086; Strand=+
  SCN-specific regions: Sequence locations=1-116,138-196,225-544,567 -696,768-805
atggcggtaggggccaattccgtatcagcaaagttcaaaaagcttacacttttttctttgttgataaaattaacaaacatggtatcattcgaaagctttaaatcttttgaagatatttctagctatttttaaatggttaagcggctcacaaaaaaagtcgtcgcttgaaaaccgcaaaaaggcagaattttcgaagtttttttaaaatttttttttttataattcgacattctcagtaattatagtaggctattagagcctgtaaagagctttcgtttgatgaaaagtgttggattctgtcaaacaacttaaaaagttatattgactcaagttagctcagcagacggagttggcccgtttcgcccaatagaataatttgctccgccacgtttcatttcgccaacaatctctccgatctcgactcttcggttgaatacttttctgctcatgacttttttaaaacttaaattctttgaaattttacagctaatagaagactcttgtggctatcgaaagataccaagaatgttgaatttggatagtgtttaaaatttaaaatattttaagtgcctttacgatgtaactctctataggtctgagtagagcagcgcgggaccaggaattttgcccaaaaccgggacttgccgggacctgagaagccgggaccggaacctcgattttcgtgcgggaaccgggaatttttaaagataaaaaaaaaattcaaatttaatttattcaagtgaaaaaaatacaaaattaaatttttacacaaccagaacaagatttaaaaaaagaacaaacatta

SEQ ID NO: 52661 - DNA, 718 bp, Heterodera glycines
  Genomic contig location: Contig_ID=SeqID_22029; Location=124..841; Strand=+
  SCN-specific regions: Sequence locations=1-145,167-407,488-516,550 -603,646-718
atgaactcagtaagaaggatgagtgtggcggcaaaggcagaaaatgtttttgttgggcacatacgaagatcagctcgtgaatctgctggcggctggtgttatatttatgttctgggacaagacacaatgatctcgatgtgaaacggtagccatggataatgacaataatttgattaattaacgagaatttaattgtcattcttttgcattggtcataattctttcattcagactggctttcgaatgataccaattttgaagaaatcaaccgacgaacaaaaaagttatggccattcccattcaaattgtacgaaacgccattgtacgaactgccttgaccccagtttccttcattgtttttaagtggtgttatgtcgctgaaaaattcgtttgctcttttttgatgcaattttattgaatttttaaatttttatttcatctacattagattaaaacattttgatatctattaatttttattttttaagatatctcataatgggtcaacatttttgcaattattattataatatatataaacttttttaactgaatttatgttttttatgatctgaaaacgaaaactttcatttttttctttaaatgctcaatattcaatgtaatttttgtaataatttatattatatgacccctcatgataagcagggctgcaaaaaagtatgcacgaaatggccaaaatatgtgtataaatatgcaa

SEQ ID NO: 52662 - DNA, 2850 bp, Heterodera glycines
  Genomic contig location: Contig_ID=SeqID_3978; Location=2407..5256; Strand=-
  SCN-specific regions: Sequence locations=1-1306,1328-1397,1419 -1611,1633-1778,1800-2261,2283-2352,2374-2524,2546-2644,2666-2850
atggttaatcttccttttggtctaagaaatgcaaccagtgcgtttgccagatgcatggcgcatgtcctcacaggtttggacgattgtgtaatcgcatatgtcgatgatatattggtatacacaagggatgataattttggtgagcatctcaatgctttgagaagtgtctttgaaagatttaggagattcaacttaaaattaagccctaagaaatgcacattcgctgcggcgaccatgaattttctcggatacttagtcaatgctgttggctacactcctagtctaagcaaagtggaaataattaaaaatcttccagacccaaaaaccattcgagaagtgaaacacgtagtaggaatggcttcattctttcgtaaacatgtccctaatttttctacaatcgtagaaccattgaccagactaactaaaaaggagagcaatttcgagtggggtacagaacaggctgcggccttcaatgaagtaaaaagaattttgagtgagaaaccaatattggtgtttcccaattatgataaaccctttcacatattcacagatgcctctaatgttggccaaggtggggcactcatgcagtggaatgagttggcggaagcatatgaagttattgcttattgcagcagaacgctgtcagcatctgaacgcaaatggcctgctgtacaagcggaattgggagcaataatttttgctctgcgaaatttcaaaccctatatttttctgacagaaattgaattacattgtgatcataaacccctcgccttcctacttaaaaaggcagaagcgcatccacaccttgcgcgttggttaattgagttacagaattacaatattaaaataattcatgtagcggggaagcagaatcttttagctgacggtttgtcacggtacccacatgaaagaacccaagagattgccattagagatttggctgaattggaagacatagcaaattttcccgtctgtcttgcgctgaatatgaagccaagaatggttcatgagcattctcttttaaccatcactgctcgtgatatagaaggaaaaacattcgccattgatgttcggaaagaacaaaatgacgattctgaggttaggaaattaattgaatttgtaaattttggttcattccctgaggggaccacagaagttgaaaaggaagatattgcatcaagagcggaaaatttgagtctttcctcaggcatattataccaacacttaccagatcaaaatgctcgaatgtacattccgctttctcttcgaccactaatttttgaagcttttcatacttcacaaataaatggtggtcacatgaatatcaaaaagacattagggaaatgtagaaagttttattggccgatgatgcaccgtgatataaccaattggaccagacaatgcatcacatgtcaactaagacattcacccaatccttcatatcgtgcagaaatgcaaatgccaccaaaaaatactctcttcgctcaaattgcacttgatttggcaggtcctcttcccctcacgcagaaaggtaacaaacatatccttaacataatttgcacatttaccaaatatgtaatctctgtacctgtccctgatgctaaatctcaaacaatagcactagcattttttaaacactgctatttaaagtttggaggctgtacgagtcttttaactgataatgccacggcatttacctctgatttttttaagtccttctgttcgcttctctatattaataaatgttatgctattccccattggagccaaggcaatgcagtagttgagcgatcttttaggacatttcacaatatacttgcgaaatatatttcaagtgaagaaccagattttgatgaatttcttgaatgtgccaacttctgctataacacatcaattcactcttccacaaaggagacccccttctttttggtctttgggcgagacccaatattttgcattgagcaaattttgaatcccaacaccgaacccgaaaatatcactgaggttgacaatgtaaagcagaaattagttaagtctcttagaaaagcttgggaatccgctgcggcggtcattaaagaagctcagttacggtcaaaagtacaatatgacaagttagtacgaaatcagaccgtccaaataggagatagggtcctattacgcaattacgcaggaaaagtcaaaacatccaagaaatttcaattaccctggaagggactttatcgagtcattgagattaatggtgtccttatcacaatcgtcagctgcacatctcctcaaacaaacccaagaattgtacacattaatcaaattaaaaagtattttgagtactcaggacccccttgcaccacgaaaaatcttcaaaaagatgaagaacaagcactaaaggaattagaatcaagagaacagaccaatgtacctggctattctcatgattcctatcaaaatatctctgataacacagtattaatagaaaacgcacctgcactcacccctaatccctcaccctcttcacagtccaataatcaggtaaaagaaaaagaactaaatagaaatctttgctcaaaacataatctccgtgaaaatcccaggaaaaagaagcattttggtaacttttctgaggactaatcacctgggatagccaaattcaatcatttttcttttcttttaatcatactgtattttaagtatgtggaccggtctcgagaagtcgtttcagcttgaaaatgccaacagaaattggacaggctttcgtaatttttaaatttgttaaacaataagtcccgcgggactgtttattgcttatctctcttttatcagttctgaggaactcatcaatcattatctaataaa

SEQ ID NO: 52663 - DNA, 225 bp, Heterodera glycines; identical to SEQ ID NO: 50965
  Genomic contig location: Contig_ID=SeqID_3978; Location=1386..1610; Strand=-
  SCN-specific regions: Sequence locations=1-225

SEQ ID NO: 52664 - DNA, 487 bp, Heterodera glycines
  Genomic contig location: Contig_ID=SeqID_3978; Location=3141..3627; Strand=+
  SCN-specific regions: Sequence locations=1-317,339-487
ctaacttgtcatattgtacttttgaccgtaactgagcttctttaatgaccgccgcagcggattcccaagcttttctaagagacttaactaatttctgctttacattgtcaacctcagtgatattttcgggttcggtgttgggattcaaaatttgctcaatgcaaaatattgggtctcgcccaaagaccaaaaagaagggggtctcctttgtggaagagtgaattgatgtgttatagcagaagttggcacattcaagaaattcatcaaaatctggttcttcacttgaaatatatttcgcaagtatattgtgaaatgtcctaaaagatcgctcaactactgcattgccttggctccaatggggaatagcataacatttattaatatagagaagcgaacagaaggacttaaaaaaatcagaggtaaatgccgtggcattatcagttaaaagactcgtacagcctccaaactttaaatagcagtgtttaaa

SEQ ID NO: 52665 - DNA, 957 bp, Heterodera glycines
  Genomic contig location: Contig_ID=SeqID_22030; Location=544..1500; Strand=-
  SCN-specific regions: Sequence locations=1-422,450-659,683-957
atgcctttatcgccagcgccgtccgtccatttccttcgaaccgaagtggaagaaagggtaggcatgggagggactgacctagtgtaatttccatttgatcattttcagcaattctagttgtcctccttgtctctggtgttattgttttgataatactggtttgttcgcatttgtttccttaaatttgacccctaatatctttaggaggccagatcgaatttggcgaccgacgaagagggagaaggtttggaggagcaccggcgaatgaaggaggagaatcggaggggccgccaggagcggatggaagctaatcggctgcctccggcagagccggaagccgaggaagagccggtggaggttattccatggcaaggtaaaagtttatgccttttaaactaaatcgcgtaacacaattcagcgcggatgacgatgatgataataatgatgatcctgatgcgcccgaccattggcgaagtatgctatttatttgagtgctgtttcaaattgaataaatttagaccagacaaactgaataaaatacgttgttgtggacagccattttttgaatgttatgtggatctctcgcataaattgtttttgttttttaatatttgtccaacaaaatgtctaaacgaaattacctaattatttaccttttcttaaattattaattatataaaaagtgcacttttgacgatgacacagcagcaaggcgcaacagacactgaccaactgaagaacgaaacaaatcagaattatttaatttatagacgtcgcctggaatttcaaattcgagcacattcgttaacagattttaaggaaaattgttatttttgaatagggcagtcaaattgtaactctcgcaatatggaactaaattgcaaaatgtagggctttctctattgcacaaagcaactcaatttgggtctgttcgacaattattattttttcaataaa

SEQ ID NO: 52666 - DNA, 228 bp, Heterodera glycines
  Genomic contig location: Contig_ID=SeqID_22030; Location=1737..1964; Strand=-
  SCN-specific regions: Sequence locations=1-27,50-228
aaaaaggccattacgcaaatcgttgtacgaagggaattttggcctttttgtccaacaccgccacagcgagcgaccagcagagagaacagccgcgagacaatcaacagaagaaatacgccggcggagaggggggacgaaaacgcaaaatgacggacaggaaaatttcgattgatattttgttttgcaaatttatttgttgctatttccccctaagtgagaagaactgaa

SEQ ID NO: 52667 - DNA, 1159 bp, Heterodera glycines
  Genomic contig location: Contig_ID=SeqID_22031; Location=27..1185; Strand=-
  SCN-specific regions: Sequence locations=1-1079,1101-1159
atgccgactgatgttgttgttcgcaaaactgttgaagaaagggagccgagaacgggcgcaaaaattagagaatcagtgattaaggcggcctcggggagtgtcaacgagatgggagagaacgtcctcaaatttgggttctttcaaatcaatttttttcatgaaggaaatttgaaaaatttgatgaacaaccgccacgaatttgccaaattggtcaataaacgggacaacgaccaacacggaaaaggggcggagacagtttcaaaactgatcgcttacttaaaggagaagcgggatccggtgatcaatgaaattattgccgaagttttagaggaaagtgccatcttcggggataactctcagaaaggccaaaagcacattctgttgttcacttacattcgcctgtatcgcaaattggccaatgctttgcggtgggctttgatcagcgacagcggagacaacgaaaccttcgtgcaagaaacgaacactctgttgaaatggcttaatgagatgggtgacacacttctgaacgccctgtcaaaatccccaattgtaatgaattttgaaaattaaaaagtttgaaaacccggaaaagggacttggaaggaccggaacagcgttaaaatcctttttccgaattttccaatcacaatccactaaaaccattaaaattgtgccaatctccaatttttttctttttgatccaatataatcaagatttgctgaacctattttgcaccagaaaaagtatttttggcttttagatggcaagataaaagccgaaaaattcgagattttttgtgttgttaactgccgaccccggtctttccttccggaggctggggaaatcccgacgatctaccgatccggtccaggcccctaatgaatatgtattttggttgtttggaattttttcaatttcctcagacggcgagatgggtgaaaaatttgtgccgaatggaagcggcggttgaactgacaaactttggcatttttctgattttgccaagccacacttggcaaagtgtcggggccgaacgtccaacagcggtgaatgacttattcgaaacaattggcaccacagaaattttggaacaaattaacgatccctgcgacacaaattgcattgatcagatggtgaagcaaaagttggagctgatga

SEQ ID NO: 52668 - DNA, 1656 bp, Heterodera glycines
  Genomic contig location: Contig_ID=SeqID_22032; Location=27..1682; Strand=-
  SCN-specific regions: Sequence locations=1-62,111-270,318-491,520 -746,811-850,878-1020,1048-1268,1318-1499,1521-1569,1592-1656
atgcgtgccgttctcttcctggctatggtttgtctggtgatggctgttattttggagactggtaataaaaattatttaaaaataaacaataataaaatatatctattttagcgaactcaaaagcagtgaaaaaggacggtaaaaaaggtgaatataattgttgaaaataacaatatattaaaatttaaggagctgttgcatcgcctgccaaaggaaaagcttcgccaaaaggtgccagcccagcaaaaggaaaagctgcaaagggtaacgaatttaatatgtttttaattatattaaataataatttaaattaataaggtgggaaaaaagatgcaaaaaaagcgggcaaaaaggacggaaaagtgaaaaagggttagttggtatttgaaaaagattttttgaaaatgtttttgaaatctagaaaagaaagaaaagccggcaaagaaggcaggcaaagggaaagatgcagctaagaaaggtaatattgtaagaataatttaatttaaaaaatgaaatttagacaaaacaaaggacaaaaaggtaccagcagcaggtaaactcattaaattctaacttaatgaatggcattgtgccaatttggcgatttaagccaagccaaaggctgagcctgtagagactgaaccatccagtgcacaagttgtagcttgaaatagaaaattgtataattgaaaaaatataagaagattttatataaatgcgtacggagcaacggtgtactcaaattgtaaatattattattgatacattttcattaaaaatgagaaaattataaaataaatattataaattgaatgaaaattacttttcctttggcaggcgatgcaacagcttttttttaattaatattatatttttagtcctcgttttatttcgcgtgcgaattccactttttacttgggtttatgcccaattttttggacctacagcagttattaattctttcataatctgttttggataagtattgatcgattggtggcattggcattccccgttttgtaattatttaatatttaaataaaatttgtctttgtatttttagtttccgtaacagctccagatcagccggcaaatatgtcatatttaccaatgttttttcatcgtcaattaccttttatatcctttatttgtgttttaaatttgccctacaacatcccaaatgtaattatgcttggttctcatataacggttatttttactttggctacaattgtcatttatattgtcatgggaattatactaaagggtaaatttaattacacaattaaaaatatttcatataaatttaaattaaaacaatgccttttcagatttttgtttgcactgatcaacaagattttggcacgaggactgatcaccagtgatacttaactgcagtttctaatcaatcgattagcagcacaattgatcacaattgctggtgcgattaatgcaccaattctatacatttgcatgcgttgtggaaatggaaaagccataaaaacactaaaaatattttttattcgttctgaatatcttgagataatcaaaagtgaattcgcatggatcaaatttgtgctgtgcttaaataataataatatcgatgttatatctgtcgttgtcggaccaaaaattctcaattcttcgggtgtataa

SEQ ID NO: 52669 - DNA, 343 bp, Heterodera glycines
  Genomic contig location: Contig_ID=SeqID_22033; Location=1026..1368; Strand=-
  SCN-specific regions: Sequence locations=1-72,95-118,141-343
atgtgggaaaaattgaagaatatgtgtacctcaccgaattggacgaatgatatatcatttgacgcctctcggtctgtaatgcaggaatctgaaagaattttttggcgaatttgaaaattggtcaaagggttcttcgattacattaaatcataaatcccttacttctctttcagatttctcgccatgtcgaatactgattttaaatgtttgatagtcaaagctatcaaaaaattaaaaaatttttcgatcaatccaatgactgtttgttctgggtattgaattttaaatgtctttataattttcaaatgcgggtaaaagttgaagtttgacagcattaattaaa

SEQ ID NO: 52670 - DNA, 481 bp, Heterodera glycines
  Genomic contig location: Contig_ID=SeqID_22033; Location=1449..1929; Strand=-
  SCN-specific regions: Sequence locations=1-195,218-481
atgctaatttcaccacagtattggcagaactccaacggttaccgagcggaggacgaagcgctgacagtggcattcgatgtgagcacaccgtgagaagtggcggcggcaccacccaaattggtgattaatggcactaatggaaggaaacggactgaacttgggaggagtttcgagggtttcactgaataaaacaccaaatattgcaatcaaacattttgaaatcaacgccaaaatttcagatttttttttgcataccaacaaaaaattgtggcaaatcaaaaatttaaatggaatttcatggtaaaagaaatctcgtttattttttgttgttgtgcaaaattcgctaactgattaattaattattgttcgattgtccaaagcctagctaatatatatgtaaatgtgttttgtttgttatttaccaaaattaagttccattatgtggttgttttattttcatgctttgtcgattaataataaa

SEQ ID NO: 52671 - DNA, 697 bp, Heterodera glycines
  Genomic contig location: Contig_ID=SeqID_22034; Location=326..1022; Strand=+
  SCN-specific regions: Sequence locations=1-181,203-365,387-454,490-660
atggaccacaaatatttcaatgattcggagaaaatgcggttgaacaatttttacgacagatttcgccacaacttaagcattgaccaatttttcaacgaattttttgataattttggcttatcatgcaagcaattttttcaattctgccaactcggcgacacagttttggactgttgcaaggtgaaatatttttcttcaataaccttggaaaattatgaaactaagttccaaagtcgaacgcataaattttgcccaacaaaatatttaaccgatttcaatgacagaaaatcattttaaacaaaaaaatttcgattcttattcgttttatggtggaattttcagcccaattttttttcaaaaaatattaaaagtcaaattttaatgaattaccaattgcacgctttaagaatttttttaagaaaaaaaaaaacttttgcttttttccttttcggacaatttataaaatattattaaattaaacaatttaaagatttttgagccaatttatctgatcagacggggccgttgctttcgtagcatcaaattgtaccaaagcaattttgatgagcttggaaaattgcgtgttcaacttcggcagccctacaaaatggacccacaaatgaaagaccaagaagtaataaaaatgctaaaatgcctttcaaataataaataaaatatacaaaaactaaaattttta

SEQ ID NO: 52672 - DNA, 650 bp, Heterodera glycines
  Genomic contig location: Contig_ID=SeqID_22034; Location=1257..1906; Strand=+
  SCN-specific regions: Sequence locations=1-141,163-222,245-355,380 -510,562-567,589-629
atggcatttattgccgaatataagccccaacttgcgccattcccacgccattatctgcagcagggaacatggacaaaaatgcggttgaatgccaagcatatcagtctgtttccggcagaagaagtggggacccaaaaaaaatcaataaatatttgaaaaaattatcgattgaatttacaaaccttttcgcctgttattgattaaaggtgtgcagtcagacaaatgatcaattgggcaaggacacatgctatgttgaaaattggctacaaacacatgtggaaggcccactaaattgcacttttccgtatgtgcaagaaattacaaaggataggcaattagagaggtaattaacggcaattaatttttaattaaaaaatttgagtgttcaatttaatgaagttgtgagccattgaaattggttgacaattatataaatgctgtgcagacaacaaattacacaattcattcggtgagttagagaaaatttaaaggtttttttgtggattattcaataaaaattaatttatttatggattaaagtaatataaaataaatttaattgttgcgttttttagtgtgtgttggcttgtgaccgttgggagtacatggtttccatagaagtaattaaagattgtatacattttttaaaa

SEQ ID NO: 52673 - DNA, 468 bp, Heterodera glycines
  Genomic contig location: Contig_ID=SeqID_22035; Location=253..720; Strand=+
  SCN-specific regions: Sequence locations=1-39,62-468
ttccatccgaagtgttatcagaagatgaagtgatcgacatttatcagttccatgcccttccaaattgtcatggaatatccgacggatttttcccaatgcaattttcgacaaatgaacggtttatgaacacgggcacacttttgctggacattgaaaaagtgtcggaatttgggcaagaggaagatagtagtcggtgcagcaaaaaaatgtacataaatggactgtcatggaaaatattggcacaaattggaacgagaattgaatccgatgagagacgtatctacatttatctgttgtgcgatgctccaaatgaaggtgcaaattaagggctaattaatattaattaaccaattaatttaaattgagcagaaaattggagttgcaaatgttcggcaaccattcgaattatctcacaaaagtgtgatgtggcggatgtacggaaagaatacgatgtcgattttggaaaaa

SEQ ID NO: 52674 - DNA, 2744 bp, Heterodera glycines
  Genomic contig location: Contig_ID=SeqID_22039; Location=628..3371; Strand=-
  SCN-specific regions: Sequence locations=1-87,109-486,508-703,725 -808,852-900,922-1291,1313-1352,1374-1937,1959-2270,2293-2573,2605 -2605,2627-2655,2678-2744
  Gene Ontology: Mol. function=zinc ion binding; Cellular component =integral to membrane; Biological process=digestion
ttctgttccatcgccatcactcatcatcagctcattcaattatcacttggtgttctgctgctgatcattccttggccattcattatcaattttttcttcccatttttccctctttttgtcaatgatctccaaattcatccgtctgctcctccattttgtaccgcttcacaacgcttgggccgatcaacgccattttttatcggtttgttttgttcacttttccatccctctccttttggctgatcaaaattctatatcctctaaacccctaaaaatgtctgatcattgtcaaaaatgttcaaaaggtgcgcaattcgatgttttcctcctctgccggtgattcatccgtttcttccgctggtggtgccgttgcgcaacttttgtccaattcgccgtcagttgcgttcaattcttacgggggaaattttgacgatggcggagcaaaacgggtggacgacattcagcgcccgaatggaccaccaactgatcagaaaaacaaacaaatcattcccgactcaattccgatcacttccgaatcccatcggaatttgccgacagatcaattaaaaagttccgcagaaagctccgcttctatagaagtttatgaagagatgaacccaattccggcatcaactgccattgtcagagagccggcttggcttcgatcgggtcagcaatttcaaatgcgttcctttccaaaccattgacattgtaaatataatttggcacttcattttcgcttatttttaattgaaacactttcctattttaactgatcaaattaactcattaattactttctgtgtatagaaaaattaagcataaacaaataaaataaaacaaatttaagggaaattccaaggcgacatcgatggcgttgatgagcatttgctgcgccaagtaaataaaataattggcaaaatgatgacattttggcaaatttccctgaactttgaagctgcaaaacccggccatacaattcaacgcattgcgaaatcggcagctgatttggtaattgatgaagagaattgtggaacagattagatcagaaaatttaatcaccaacaggggagaaaagggcggtgccttcttagaaagagtcccgaaaaaattggcattggcactatgaaaaatggtaaaaattggcacaaaaagtcagggcacagcggtaaataatcagcagatctgatcggaacattttgaataaaacgtcacacatgtgtgctatcaaatacattgatcgcctttccccggttcaggcccaaaggcgttgtaccgtacgaattggacgtggcattctgtacgtaagtctataccgtatttgctctcctccgaccgtaccccgacaattgccttgggcacacacacagcactgagtgaggctcgtcttctgcagcgcgtctttcgcacgtaccgccgccgcaccttcggctgcatccgtttcagaccgaggcgaagcggcgaaacggactatttaagcattgtgaagggcaacgggtgagctgggacagaagaaaactgggaccgaaatggcaatgcttatgtggcccaaaaacggacgggacatttgggcacggccgaaagcggaccgagatgtttgggcacggccgcttgggtgccaggaaattcagaatgctttatacaaatgattccaacccgatcgaagatttgaaattaggcctaaaagaatgaggggtaattgtcgaaaaacactcacagaactcaaagcggcatttcccctgcgtacatcgctcaaaaagtggcatttgtgccgtgccaattccattcccttcccctcccctcccggatcagatgctattcacaggtgggcagaacaggcggaaagcaggagctgtcgctgggacgcggctgtctgttcaacgaaacgataacacacgaagtgaaaaacggaggggcactattatgattattatataacattgacaaatgagcaattaattttgtccgaccattttcgattaattaccttgtaattaggttcaaaaagtgttggcctaaattcacggagttttgaggtctcattccaattcttgaaattttcagctcaaataacacctaaccataaattctaacaaaaaatatttctctttcttagttaatgcattcactgggcttttggcacgaacatagccgggcaggtacggtagtggtgggcgtacggtaacactgtaaaagcaaatgaagacagagacgaacacattgtcatccgatgggagaacattttgcccggcatgtttaaaggaataatcattaaaaaaataaattaaatatctagttaatccatagtttttaattgtttctttcccagggatggactcgcagtttgacatcgtttcctcggcaattcaggacacacttggcgagccgtacgattacaggtctatttgatatgctttaactgataagttatcatggcattattaaactctttgctgtcatctttcaggtcaattatgcattacgggtcgtcggcattcagtcgaaacggtcggaacacattggaagcagttgttgaccaagtgagcaagcagcacagtcataaaattaatggcttttttaaatttcatttaaaaaattaataaacggattttaaaatgatttattgaaaatgattatgcaacggattcataatgcgaatgtttacagttcacaaatgtaatcggaacagcgatggaactcagtgaaatggacgtggcaaaggtaaatgaggggggagggactaa

SEQ ID NO: 52675 - DNA, 1911 bp, Heterodera glycines
  Genomic contig location: Contig_ID=SeqID_3979; Location=381..2291; Strand=-
  SCN-specific regions: Sequence locations=1-7,29-381,403-836,859 -979,1001-1439,1461-1792,1816-1911
atggctaccaagcccatctccgtaatggttcgatcggaggactgctcaagatcggcggaaggactgaaatgcgcgggaacagcggcgacagtgctagcactactgccatcggatcagacgaactcattcgtcattcgaacccaacaggacgagctgctcggagccgtccgacttcgcctcgcctcaatcacgatgatgtgtgtgccaaaaacggaaagttggctgcgttcctactccatctcaacgacagccgtgaagcgatgcccatcggcaggatcgtgtcgcggaaacacatgcagtgccattcgcaaccgggagacgattcccgaacttattgccctcaatcatcggccggggcattcattctgtatgcgcagcaccagtttttggcagaattcgtgtgggctgccctcggcttcatgcctcttctaccgatgggctgcggtgccaacaacgaccacagtcttcgaggagttcacgtgtctcgaatgggacatgcagatcagcgcttgggtggaattggaaaccaacaacggccaaattgactcacaacgactgacactacacccgggagtatcggagccgtggggaaacatgaccatctcagtcatacccacctctctcccgccaatgccggcactttcagcacatttcgtcaccgatggacgagctgtggccatggggagacccatgccgtcagacctgcactgccccgacgaagagacagcacggggtttcgacaaatgccaactctccattggggcgtgccaaaaatgcgcccccgatcacgacaatggcacggtacactgtcactgcagagacctcgacattggacgggtgttgaacaacccggaacaacgattgccattggacgtggcacgattgcaccttcacaatcacggctcttcgatccgagctgaatttcagtattcacccgttcaggtacatatccaactcaatggcctggagctgatcagcgagtacagcaatacaaaatgttgggtgtcctcacccacactcagtgggtgctacagatgcacatcgggcgcaacattcaacgcaacatgccgcacggatcacggcactgctttggccaaagtcaagtgcgctgatgggacactgtttgcccttcactgcggcggaaatgactcaacaagggaggcgattcccttcgaccgtgcagaaatattcacggaatgcaaagtgaagtgccccgctggcaccacgacttttcggttaaagggagagctgatcttcctccctaaggagcagcaatttggatttcatcggcgggattcgagcggagggaaaattgagcccgggatcacctttaattttcccgactggcagattgacccattcccgctgctaaaccttctcagcagttggcaatggatgctaatggcagcgggagcagcagcgatcggatttgtggcacttttcctttttatcaaatttaacccccattttcgtctctaccgggctctgatggccacaattctgcttgtaatactgatcggaaagactgaagcaaaagattcgaggggagagatctcccccgccacgtttgatcgatggactaatggagaaaaaataagcgttacaaccgggacagatttcgtggcacttgggcctcaacgactgactgaaacgccacaaacgactgccaaaggagatccgaacaatttttcagagggagcattctccctcatcatttgtgccatttacttgtacttcaccatcattagccttttttgccgcctgctttggacaccccgacatcgcatctcacctttgtttgcccctcccccattgaccgttgtcattttgggggcgatctgcgctgctaattcattaacgggggccagagagccgaaatggagagagggagacaatttccctacgtccctg

SEQ ID NO: 52676 - DNA, 3492 bp, Heterodera glycines
  Genomic contig location: Contig_ID=SeqID_3980; Location=28..3519; Strand=-
  SCN-specific regions: Sequence locations=1-267,293-687,709-1635,1657 -2728,2750-3223,3245-3492
atggctgcgctcatccaacgccgctcaaataccccatcagtggccagtgttcgggtgaacaacccggtcagggaatggatggcaaggaaccgagggggagagaacgaacccccggcgcaacagcagccacaagctcagcaaccgctgcaagccgagcagcaacgatttgagcgacttacgctcaatgaccagggacaagcattccctcgggcatcccatcatgcccgtattcgaagggaggagcatcccagtcgggaacgcctccgaactcagggagcagctccctcacatcaccatcgttcggaaactcgagcagacacattgacgactttcgaaacggttcgattgcagccaccgacgttttccgggaaaccggaggattggaccaccttttgggcctacttccaacgggcggtggacgacaaaccaatcccgggattcgaaaagcagcttcatctgctgcggtgcctaaaagaaggatcgccggcgcgaagagcggtggaggtgtacccaccgtcggatggaaattacccagttgtggtacaactgctgaaggagcgattcggcgacaccaacgatttgcaacgagcaattcgtgctcagctgctgcatttgccaccagctaaagacaacgtggccagtctgacggcaatgatcgacgagttcgagaggggagtgtgccaactcgagcagctgggagccaacgtggacgacgagtcattcggtccgctgttggaagccaaactcccagtgagcatcctgactgagctgaggattcgggagagcatgatgggagcgaaatggacggtgagggagttccgaaaagcagtcgcggcacaagtcaaatgcatgagggccgcccaatcggcgctcgcagcaatgaaggaacccgaacgccgacatgagcagcgatcagaggcagaccgaggcggacgaaatgcacggacgggacaaggattcaatcgagcattcatgataagggagaaccctcccgaacgacatggtacggtgggggccggaaatcatgggagtgtgcacacacctccgcgatcgggttttctaccgcccgggagcaactcccgccaaacggaatcacgacgaatgggacaaggcgggagtggttgctcgctgtgtggacaagcaggccaccagccgagccgctgcatcaaatatgggtcggcccaagccaaacggcggagactgatcgagcaacgccggtgcctgaagtgcttggggtcggaccacacggcttcgcagtgcacccgagcgcatccttgccgaaagtgccagcgaccagaccatcattggctgatttgttgggaaggagggaaaaaggatgaacctcaaattcaggcgaaagcggaagagccgcgggcaaacaggaccatggtcattcaaagaatggagccgacagaggagcgaacattcgccgccaattcaggaatggaaggcagaggggagagtccctccccgcaccaagaaccaaggaccttcacgacagtcggtcagcaactcccggcatatttgatgatttgccaggtggtggtagcggcggatgatgaaaagggtgaatgtcagaccaccctgctgctcgaccccgccagtcacggggattatgtggacacggaactcatcagacagctgggtcttgagaagtccgaaagcgaaacgctcaccattcaagtctttggcgggaagaaagtgaaagtgccatcggggagatacaaagccaaaatcaagcggacggatggcgaatgggagagcatcgagttgtcggaagtcccgaccatctgtactcccatcaagacggaatttgtgctcccgggagtggctcccgagcagattagaacgacaacggacacagttcaaccgcagctgctgatcggaattcgacgtttttgggatttcgtgcgagcattccggaagaccgacgaaggcacttatctgatcgacacagtattcggcacagtgatctgcggagaacaatttcaagtgtccacgggagttcctcccgactcatcagtcttcgcaattccgccatgcggggaagacgaacgggatcaaatgccatcggtcaaggcgatcgagcaattttggtcagtcgaagcgatcggaattcgagacgacccaacacaggacgcggacagtgcggcgatcatccaatttgagcagtcagtgcgacagcaagacgacgggcggtacaatattcgtttaccatggagggaggagcaccccgaactccctaacaactacgctgtggcctatcgaaggctgatcgggctgctgcaacggcttcagaggacaccggaaatcctcaagcagtaccagcaagtgatcgaagagcagtcccgaatgggcgtgattgaggaagcaacgatcggcacgggaaaatgcgaatatttcatccctcatcaagcggtgatcacgccgaagaagctgagagtcgtctacgatgcgagtgcacacgccaagggagtcccttccctcaacgattgtttgttgagagggccggtttggctgccggacctggccggaatgcttatccgttttcgggcatgccaagtgcccgtgattgccgatgtggagaaagcatttctgatggttggaatcgaagaagccgatcgagaagtgtgcaagtttttgtgggtgcgcgacccactcgggccgctaacgacggcaaatttggtgccctaccgatttcggcgattggcgttcggcttaacgcccagcccgttctgcttggctgcggtggtgcggcaccacctacgcaagtacggctcggattttgcggagcagctcatcagggacacatacgtcgacaatgtgctcataccggcggacacagtcgaagaagcatcgcaaaaggctcgggaagccaaacgaatgttcacggaagcgaaaatgaacctgcgcgagttcctgacaaatgatcaaaacctgaacagcagcttttcagaggcggacgccctgggcaaaacgacggcgaagatgctgggactcgaatgggacgcggagaaagactcaattcggatggtctttccgggagtgactcccgccggtgccggaggccacagttcaaggcgggcggtgctgaagactattgcccgactgtttgacccactgggactgcttgcgccggcaactctcccagccaagcaattcttccaacgattgtgggagtccacacacagctgggatgccccgctggacgcggacgatgcgcgagaatggaacagaattatggcaagttgggacggggaattcatcactatccccagagtcgcccgagcggacggggccgaatcttgccagctgcacgtgttcaccgacgcatcggaaaacgcatatgccgctgcagcatatctccgatcagaaggagtggacgggagcattctctcccgtctcatcatggccaaatcccgacttaagccaaagaaggcttcggggacgttcacaatccccagaatggagctgatgggcctcgttttaagc

SEQ ID NO: 52677 - DNA, 66 bp, Heterodera glycines
  Genomic contig location: Contig_ID=SeqID_3980; Location=3602..3667; Strand=+
  SCN-specific regions: Sequence locations=1-66
gcctaggcatccctgaacgatgtctcccactctggcatgcttcgtcttgccatggtgcgtgggagc

SEQ ID NO: 52678 - DNA, 565 bp, Heterodera glycines
  misc_feature (145)..(145): n is a, c, g, or t
  misc_feature (197)..(197): n is a, c, g, or t
  Genomic contig location: Contig_ID=SeqID_3981; Location=1..565; Strand=+
  SCN-specific regions: Sequence locations=1-565
cctcggtgtcgactgatctgcttcgatcgggagatgctctgctccctttcttcgtctcaaaatgtttgcctcatcgcctgcagatcacggaaaaggctcagcgcaaattggagcagtcggcaggagttggatgctcccgcagtgncagatacttcgtcgaaggctggcaagggggcggccacgaaatcatacaaganatcctgccgctcctcgggtgccgcacccgctttctgctattcccttatcgaaatgcccttcaaaaatccgagtgacctgtccaagtccccgttccattgccatcagccgcgcggcgtgctcgggcgcttcgcccctcgtgaaatccgagtccatcagctcccgcgcttctgcgattcgcgacgagagtgtgtcagccgctctctcaatccgatctcgggccgacctcaccgtcattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcg

SEQ ID NO: 52679 - DNA, 648 bp, Heterodera glycines
  Genomic contig location: Contig_ID=SeqID_22040; Location=283..930; Strand=+
  SCN-specific regions: Sequence locations=1-189,211-417,439-540,564-620
aaaattttatgctaatagagtaagtcaagagctatcgtatggtatcaagataatttctggttgtgtttaagaaaagctatgacgggttttcctcgaaaatctgtaaaattggcagtttttacgaaacgacccagcacgaaatgagagagacctatagataagaaaatctttttaattctttaaattttctaaaattacaatatcaatattggtaaatttgttcaaatcagttgcatgatacctggttcaaaattcaatccttcagaaaaacaaaaagcgggaacaaattgcaagtgaattgggtgtgacgattcatcaaattaaaaattggacaaggaaatttggcttgggtaagacatatttttttcttaaaatttttcacgcacccacaaaaatagcagaattcagcattacgtttttaggcaatcaaaaatggttgacagatcgccaacgaaaaatgcttattaaaaaatttgacaaaatcaaagaaaagcgcactcaaaacggtttaccagctggtgaaattcgagaattggaagaaaaaatcgcagaagaaataggcataaacattcggacaatttacaaatggagaaagaaatttggcatctcaggaagttggcaaaaataaacaaaaaatattaaaaatta

SEQ ID NO: 52680 - DNA, 443 bp, Heterodera glycines
  Genomic contig location: Contig_ID=SeqID_22040; Location=1094..1536; Strand=-
  SCN-specific regions: Sequence locations=1-38,60-215,237-277,299-443
atgtttaatagtgcaaagttgaaaaggtaaaactttaatttttccaaggatttaaaaaagatttctattcatttaagagaaacaacaatgcattcaaaaactatcaaaataaaatttaggatggcaaaaatacgtaaatacatatttttcctgggttaatatttttgactttttctaaggaatatttttgagaaagatttgaatgtgccatgaccaacttttgtttggctttaaatattcttcgaaattcagccaatcaaaagatatgtttttcaggaaaaagcattttttgggaaataacaagaataaatcccaagtaaatctgtcacatttatcgaaaaatgctgacaataacaaacgaattaataaaattgatcggatttgtaataccaatcccacatagtttaaaaaaagcaaagaatttactttttttaacaaataaa

SEQ ID NO: 52681 - DNA, 836 bp, Heterodera glycines
  Genomic contig location: Contig_ID=SeqID_22042; Location=297..1132; Strand=-
  SCN-specific regions: Sequence locations=1-143,165-729,751-799,824-836
atgtttcaatttgagcctctgaacaatgtggcaagtacaagtagtacgacaaacattggtacacattttttggggggacttaggggaaatcttatttatcttttcattaaatgggccttggtatttttctagtaaaaacgggcaaagttttggaaaatttcataatttcttttcatattaattcaaattctcagaaaacacatcggcacagttggacctcctacaataaaaaaggtgcttaatccgggtacccgatttttattgacctgattttgagacaaaatccttctgtggcttcataaactatcgaaataggtaatctaattttctttaaagaaccattgcaacatcaaaatgttgcattctctgaaatttccgaaacgccagtgcttgaaattgccgaaagtgaatcgttcccggtggagacaaccgtaatgcggagcattttggacgtaataaaaatagaattttgtcgcaaaaattatattctcttttagcaactcgatagcgacaaatcgcagcgatctacctattcacaaaaaagcacttccacacagaaacaaacacagcaacacgtacgacgagcgtacagccgactaggaatcgaaaggcctgaagagcgtgaaactgctcgacaagccatcacggcatcaacgagtgccgcaagctccagtgcctcctcacaagggtcaaaacgtgagagaggagaaactacaaaggcagacaaaatgaagaaggaagttgtgagaaaattaaaaggcaaatgcgaagatgactgcgatatttgctcaaattttttgaaaaaatatctgcaaaaatgtttcgttttgggctaa

SEQ ID NO: 52682 - DNA, 767 bp, Heterodera glycines
  Genomic contig location: Contig_ID=SeqID_22043; Location=45..811; Strand=-
  SCN-specific regions: Sequence locations=1-292,316-374,396-767
atgataaacagaagagacagtgagtagaggaatgtaatgagattttagctacccaaagcatacgatgattggcttctacgcgttggcatttgtatgtttcactttcattaagtgtactcattaattcctttactagtcaatggaggagtttaaataataattacccacttttggcaccgccgtcctcgacagatttaagtgccattaaaccaatgtatcaaactttcgttttattccttcatagaaaagtttgttgtgcgaaatggcatagtttttatgaattttttagtttaaagatgcttataaaaatattaattagcaaattggttgtttagcttcataataaatatttgattaagtgatataattgacaaaatcttaaaatctatttttacagaatttaaaaacgaaaattcgataaggcggattcggccgaaaaaaatttcgaagtgttggcagcatctttgtatgacatcaaagaatgtgccgtctgtagggaagagcgcaaatgttatataattaccttcaaacaagtcggaaaaatgtcctcacgacccgttggtcaaacgtctacctccttgatgaagatgtttgggaacacgtaaataatgagcaagaaacaattgatttttaatttagagcggctttttgttgggaaacctcctggcaacaatttatgctcgagcgctggtttataacatgttggacattgcccgagcccggcaaatgtatttcataactatttttataaactttgcaagaataaa

SEQ ID NO: 52683 - DNA, 576 bp, Heterodera glycines
  Genomic contig location: Contig_ID=SeqID_22045; Location=1588..2163; Strand=+
  SCN-specific regions: Sequence locations=1-20,89-107,155-172,379 -420,455-503,563-576
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatc

SEQ ID NO: 52684 - DNA, 2070 bp, Heterodera glycines
  Genomic contig location: Contig_ID=SeqID_22048; Location=16..2085; Strand=+
  SCN-specific regions: Sequence locations=1-230,252-581,644-1359,1383 -1527,1550-2070
atggccgccaaattcaatttgtgcctgctgctggagcgcggccatttcaactacattggccgcgttgaacaactgttcgatgtccaacgctactgcatcgactgtgaacggcgagcacacctgcgctaccacttctccggttgtaaggttgtgtgccgcctttgtttacggtttgggcccgaatatccgtgccaagcacaacaggtacttttcgaaataaaattaaatagaaaaacgtactaaaaaattaagcttccaaacggcgcaagtactgcccgacgttgtgctgcgtgccagttcatctttccaaacgatgactgctacgactaccacctgatcgaacatgctccagctccaatggatgcccgtggacagcgtcagcgtcagccaatctgtcaatggcgccgagtgtgtcgtgattgcgggcgtatcgcctaccagggcaagcatcaatgcccatgccaacaccctgatggcaacaggaactgcaaacgttgtgacgggccacacacgaccgacgagccctgcttcatccagccaatttgcgatgcgtctgctcgacaacgcgcatcaattgctgtcgataacgatgacgacaactccgatgacaacgacgaagacaacgacgaggacaaagacgacgttttgccgcttcgactttgcttcttcgatgcagagacgtcgcaggacagcccgctccagctgaacaaccgattggtgcagaagcacgtgccgctgctgatcgtcgctgaagtcatctgtgaacgttgtatccaggcaggcatcagcgttaacgatgggcttggaagaagagcgccggattgtgtttgtctgtgtcgtatggtgaggggacaacagttgcgccagtggtcttcaccaccgtttgccaacgcacccggagacaacacagctgtgccagtggaggcgccgacattcaaccagcgccgcttctacttccactcattcgacaacgacggcaacgacccagtggaccaatttttggattttttgactcatcatgggccaaaaaaggcccacacggtgtgcgtcgcgcacaacggtggcaagtacgacttccatctaatccttgaggcactacatcgccgaaatatgccaccaaagcgcctgtgcacaacggggctcaagatttactccatgcgtctgtcgggacgtaaccaacgacgagtcaccttcaaagactccatcaattacttcttctgtgaattggatgcgttggtgaagagctttgaactgcccgaacatcaggcgatggttaagcccttcttcccctacctctacattcagcgacaacatctgtcgcagcgcctcaacggtctaccggctcaagagttttactcaccagacacgatgaaagcggacaaacgggccaaatttttgcgttggcatgccaacaacaacggcaacagatttcaactgcgcgaacaactcatcatgtactgcgccaacgacgtggccattttgagggagtcggttatccgatttcggcagctcatcgccgacaacacgcagggcctcgaccccttcctcaacgcatccacggctgccggtcttgcgctcgccacgcttcgtcgttgttttctggccccaaatcgcctggtgcactcacccgagggcggctacctgcgcggacgtcgtgcttcagctgagtcgcagcgctacatacgcttcttcgagctggagaaccccggagcgcaagtgcaatgtgcaagctggtccgtcggggaggcgcacattgaggacaccggctaccgcgtggatggtctttggcgacgcgatgcgcctctccgtcccctggccattgaatggctcggctgttactatcatggtaatttttttttccttaaccaaaataaataaaaattaaggctgcccaaagtgcttccccgaccgacaacagcgacttgcggcgggacgcaccgcagaagacctgtatgaacggacggagcggcgcctatttgagctggagcatgactatggttgtgagatccacaaggtgtgggcatgccagtggagtgaacgaatgcgccacgacccggagctgaagcgacg

SEQ ID NO: 52685 - DNA, 1238 bp, Heterodera glycines
  Genomic contig location: Contig_ID=SeqID_22051; Location=298..1535; Strand=-
  SCN-specific regions: Sequence locations=1-123,166-169,196-256,299 -468,505-951,985-1083,1105-1135,1181-1238
atgatggcacctccccatttgggtggacaaaatgcacaaccccaaaaagagacagaaatggctttttcggatgaagcgccgccctgcccacaaccgacatggaaggaagcgatggaaaaagtgaaataattataaaaaaatttaaaaattaatttaaatatatatgttttttcccaaaggcaatcacaaaaaacccaaatgaatcgaccaacaaagtgcaaacggtaaacattttcctatttatttttgttcaaagttttaaattgtattaaaaattaaagaattattttctatatttgtttggtctaaacaagaatgactaattctgtgccaattaaagaaaaatgaaaaattaattattttgcttattttctaaaaaattaaaagcattcacgtccattgaaattaaagattaaaaaaatgtaagagaaaattgtgtacatttttgaatttgaaacaatttttacctatatattatagtaaaaataagttaaaaattttaaagctttttcccaatgccgccaatcgacacattgattttttctggatacgggatacggcgctgatttgaaatcccaaagtttttctcattttttaggcattgtcgcgtgccgtgcgcggaactttcattgttgcatgttcgccagccgatcgccgcgaggctttccagaaaaagatgcggctgtcagcaaccggggacaatttttgccatgtgattaaagacggcgtctggtgccaagcggtggcaatgaacatgggcggcggcaagggcatttcaattgggatgggtcgtcgataagtaaaagttgatgaattttttttgataatttttaaaattagaaccaatgcttattataaaggataaaatgtgatcagggtaaaaaagcggaaaacataatgattaatgaaaattgataataaaaaaaataaatcttgtggatgtcttaccactaaatttaataaacaaaattttaattaatattactttactcattttcgtagaattcagaataaattaaaaaaacaaacaaacaaatttcctctcaaacatccgatcatcaaagcatgaatataaattatgcactattttaaaattccttttttatttgatacaaatttgcatttgtatacattgaaaataatttcaaaagaaaataataattaaaatctattaatttaagggccattccggattggccccgttccaaaaattccgactatcctttgaagacagtcaa

SEQ ID NO: 52686 - DNA, 1074 bp, Heterodera glycines
  misc_feature (566)..(566): n is a, c, g, or t
  Genomic contig location: Contig_ID=SeqID_3982; Location=52..1125; Strand=-
  SCN-specific regions: Sequence locations=1-383,405-537,559-636,658 -717,752-754,777-942,964-1074
atgggaaaattgaaaaaattcgaagacgccgacaaacgtcccaaatatgagaacaaaacggttggacgctttgtgaaacatgcgctctttgaactgaactcatcatccgattgtgtaaatacaacatctgaacagaccgaatgcgaagtgagttgatgccattttttaactgctacagattagagatcgacattttggcgctactttaaaagtggccgtttttgaaattttttttacttttgcataatttttgtttttttgactcataatgatgaatattaagtattaacagcataattatggcgaataaaaaatatcacgattttttatctcaaaaaaattttgcaaaacaatagggtcccccctttggtttttgataaaactcaaaatttgtgaatttttaactagcgctaaattttcttttaaaatgtttttttcagtttattaaatagtatgcaatacgttccatgttaaaaaaacaaattctgcataaaaaaacaaaaaaaaaattgaccaaaaaaagtgaaaaaaaatttcaaaaggtttgctctttgcaaatagcgccncagattttcgtttcaattttttgtccttttttcagacttctcgacgattcccatgcgccgagggctcggaatcagaataaagtgaatgatggaattaattaattaattgatgcaaagtgtttgtgatcccgaaatattgccatttcactattattgtatatgtatgtatatgcggttgtatgttgtacttattttacttttttcttgcccacaaattcactatcaattatgtaattggtgttatgctttgatatgataaaatggtaaaaagtatgataattatttttttcagaaattcttagggcctacggatgtatgaaaaacgaaaatttatttgactgtcaaaaagtggcaaaactgaattttaagattttaggtcatcatttttacgaaaatacaatatgcatatgaaactgtatttcactattttggcgttttctcactattttaaacatttttttgaaaatttggatagatctgtaacagagtttgtccaaaaaataataaa

SEQ ID NO: 52687 - DNA, 1076 bp, Heterodera glycines
  Genomic contig location: Contig_ID=SeqID_3982; Location=3561..4636; Strand=+
  SCN-specific regions: Sequence locations=1-226,248-933,956-1076
atgggcaccaccaaattggaagtgtttgtggatgcaattgatacggatgtccaaccgatttgggatgtttttatccgtcaaatttggcctatttttgcaaaaagcattcgccatttgagcttcgaagatggcaatcatttggacaatttgcgtcgccgcatttcaccgacacttctcactgatcttgatcaattgatttcaatcgattccggttatctgtgccccgatggaattgctgatgatgggccaaatggaattgctggtcaagcgttgaccaaatggcttcacactccgacaaaaaatgggcaaccgaagcaattacatcgctataattgttttggtccacagaatctcgaatgggtcaacaacttcaaagaggtggccggccatattttttttaatctctttgtttgggtcaatatggcaactcgtacaaaaaaaaattttctaagaattttcaactaaaacttagtatttatgaaaaacatgaaaattgcgaaaaggtcgaaattatgaagttttttcttaataaaattttttccaggctagaaaatcatttcattttttgtaaggctaatagagcatatgaagagctttcgaatgataccaacaatcttggatttggatgccaaagaaaaaagttatagcgaaaaacataaaaatttttaaaatctgcccacagataacacacaagtacctttttttgtacgagttgccatgaaaccttttgttttacaaattttgtttagacatttcgccgtgccaccacttcggtcagttaccatattcaactgttttttcttgtggaaccaatgccaattgaaccatttgaattggtgaatgaacggacgaatgaaaagctgacactgaaacaggagatcgacgaattcgacttaaatgcgtataattggctgttgcaacggtgcccaattggggagacggcgacggcgccagcaattaaatggaaagacagcgtaaatccgagtgccaatttgaacaatgtcacttttgatctgtggagtttcgataaatccattgggtgagcagcagccgatagcgtttgattttgccgaaaa

SEQ ID NO: 52688 - DNA, 376 bp, Heterodera glycines
  Genomic contig location: Contig_ID=SeqID_3983; Location=2113..2488; Strand=+
  SCN-specific regions: Sequence locations=1-106,134-376
atgtccttgatcattttggttttcattgggaccatgtgcgataacaagccttcgtattgcctgatcattaagcggcggattgactacactgtgctcgcatttctccgttccaacaagccaatttgggacagaatgggcaccaaattggaattgtggccatacagaaccgagaaagatcagtcaatttgggatgtttttgtccgtgaaatttggaaggaattgccgatgccaccacttctgtcactgaaacaggagaaaccgcgaaaattcggatgccattttgaacaatatccaatttattttttggggcggcagtaattgtatttggtgagcagatcaattggtaccaagaaattctcacttaaaaaagaagcaa

SEQ ID NO: 52689 - DNA, 1415 bp, Heterodera glycines
  Genomic contig location: Contig_ID=SeqID_3983; Location=444..1858; Strand=-
  SCN-specific regions: Sequence locations=1-1305,1328-1415
tgtgcactgggctttaccagtggcgatgctttggacaatttgcgtcgccgcacttcaccgacaattctcactgatcttgatcagttgtattcgatcgatttcgctcttatgtgctccggcacgattgacaatcaaattctgtccaaatggttgcacacgccgagcaaagatggtcaaccaaagcgattgcgtttccgtgcttatgtgggcccaccaaatctcgaatggctcaacaatttccgagaggtgatcactgatcagccatattttcattaaacgacgactaattgatttaattgtccttgattttgacgagcagacaacggaaaatccacaaaattgccaccaatcgatacattgccatcgattagtaaagacattttctgttctggtccattatcgtttgcttttggtacttcgtccttgattgattggatcaataacttcaaagaggtgtctcgccatttttctcaaattgtttttgtttttcccaattttgtttagacatttcaccgtgccacctcttcggccagttacactgttcgaattatttttcgttaaacgacgaccaattgcgccatttgaattgatgaacgcttgattttgacgagcagacactgattaagggtggaaaatccacaaaattgccaccaatcgatacattgccatcgattagtaaagacattttctgttctggtccattatcgtttgcttttggtacttcgtccttgccaattctgatcatccttcaaattaccaaattggatttgtatgtgcctttatatatgaccgaaacttgggatgtttttgcccgtcacatttggccaatttttgcgacaagcattcgccatttgagctttgccgatggcgatgatttggataatttgcgtcgtttggtttcccctacaattctcactgattgcgaccaattcaaaatcaaacttctggccaatcattgaccaaatggttgcacactccgacaactgatggtcaaccgaagagattgtttgcagtgattatttggatccaccaaaaattgattggatcaacaatttcaaagaggtgtctcgccatttttctcaaatttttttgtttttcccaattttgtttagacatttcaccgtgccacctcttcggccagttacactgttcgaattatttttcgtgtgaaaccaatgccaattgcgccatttgaattgatgaacgaagtgacaaatgagaagctgacactgattaagggtggaacttttcgttggctgttgaaacggtgcccaattgttggggagacggcggcggtggttcagaaacagcagaagaaagacgagaaattggaccgtttgaacggagtctacttctgtctttatgatgccattttctcgactcccgggcacattgatcagcggaagaaaaagtga

SEQ ID NO: 52690 - DNA, 387 bp, Heterodera glycines
  Genomic contig location: Contig_ID=SeqID_22052; Location=420..806; Strand=-
  SCN-specific regions: Sequence locations=1-20,42-275,297-387
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggccccagccacagccccttgcttctcccagttttaagtcttggatttgtcaaataaa

SEQ ID NO: 52691 - DNA, 845 bp, Heterodera glycines
  Genomic contig location: Contig_ID=SeqID_22056; Location=196..1040; Strand=+
  SCN-specific regions: Sequence locations=1-150,172-845
tgaaccgttcagtgcaatcaaacggagacgaaggaatggaaatggttgaaatgaccggtaagaatggacgaagcattgaaaccgttgaaaaacgattgacaattttcattttcagagattcgctacgaacagaagcaacaggtcgccgccgggggtctctgctgctgctgcataccgtgtggctttttcaacgaatcgtcaaacgaggaaccgccgaaaatcttcaaattcttcatgacaaaaaagaagactccacaaccgcctccagcagcagaagtcgtgcaaccgcaaaactccgttccatcgccaaaggcccttcctgtcgaaaactacacactcaacgcgacgtttaggaaggaagaggcgcgtggatacgcaaaaagtgaaaaataatgtctaaattgaatgtttcccaattattactcattttcagtgacttttaagaagagcaaaaagcgtgcagcacagaccaaacagccgaaactcgtcagaatttcaattttcttcgctttcccctgcaaaatttccacttcttttaggtttcggcctccagtcagcccagcgaaacttcggtgttgggtacggcttccgcatttgcagcaggtgtcgttgctccgcataaaaaacaacaaatatttttttcagcaagcatcagaacccctcagtcagtgggaagccatgtcggtccgtcgaaaagcaaacacgaaatggattctccctccgtaagacactcattacccacttatcgtccgctattatatttaaaattgtttagaatccgacttcaaagggcagcgcatacttttaagaaggaaggcccatcccatttcaactgtgagagatga

SEQ ID NO: 52692 - DNA, 68 bp, Heterodera glycines
  Genomic contig location: Contig_ID=SeqID_22056; Location=1248..1315; Strand=+
  SCN-specific regions: Sequence locations=1-68
gacataaacatttatttgatttattttaccatattcacaatttgatcaaaatataggtggacaaaagt

SEQ ID NO: 52693 - DNA, 240 bp, Heterodera glycines
  Genomic contig location: Contig_ID=SeqID_22057; Location=384..623; Strand=-
  SCN-specific regions: Sequence locations=1-51,74-240
atggcccgtcaatttgatcaacaccaaggatcaaaatcggttgagtttttgccaaaagatcccgttttgcttttgaatttcaaccgtggaaagagattttggctaaatggaaagatcatcgaaagattggaaaagtccccgacgtatcgtgtccacgtcccggctctcggaagaaacgtccaccggcacgcaaaccaactgcgacgccgttatcctcttgaggaggacggtaatgatacg

SEQ ID NO: 52694 - DNA, 484 bp, Heterodera glycines
  Genomic contig location: Contig_ID=SeqID_22060; Location=175..658; Strand=-
  SCN-specific regions: Sequence locations=1-395,417-429,452-484
atgctgaggcctttgtttgattgcattttacgacttttaaggtttttgtctggctaatgaggcttttgaaactctgattaattttatttgtttcggtgatttcaatgtcctctgatcattcattgttgctcctttaaaattttccaatttggattacatcgtattcatctctgttttaattatcactttttggcatttcattttttatttttagacaattttaccgaaaaatttggttggtcggaatagaattagaggacaacatttttacggaagagcattcatcagcagagggaaaaaagcataatcagcagacgaattggacagaatggagccaaagactaaattcaatgctttcatcgctattcgacgcggacattgtgagggcttatcgaattaagaaaaatttgatggatgcagcatcattaaacattcaattgagttcaaattatgagaaaagggggtgaaaaaaatgaaaattaaa

SEQ ID NO: 52695 - DNA, 101 bp, Heterodera glycines
  Genomic contig location: Contig_ID=SeqID_22060; Location=852..952; Strand=-
  SCN-specific regions: Sequence locations=1-101
ataaaagtcaacgtagaagcctcaaaccaagtggaaaatgcgttttttatgcttaatatatcgaaactagtgcgtagaaaaaaaggcatatgcctcaaaat

SEQ ID NO: 52696 - DNA, 580 bp, Heterodera glycines
  Genomic contig location: Contig_ID=SeqID_22061; Location=37..616; Strand=+
  SCN-specific regions: Sequence locations=1-213,237-302,325-452,489-580
ttggagaacgcattttgcaatactccaagaaggatggcaagcaatcaaaagattctttctttgtgggaatggccatgacgtttgtcgtgcgttcttctgcgtagcgagtaattaaaaaaattattcaaaaagattagtgatgaacgatgctttagaaatttactggccaaattaaccctaaccatcaatcggaaactgcttcttacattgacattagcagttttagtttatattttgccgattttctgtcatacgtattgattgggctgatcatttggacacgatcaacacaaagtctttccttttattaaaaccaaattttaacgagtttttggcattgacgcgttaaataatgtaaatttaaataattagtttcggcacaaacgaaaaaattgacagtttctgtcagtgttctcatggcaattgaactcatctgctttattttggtcagcatattaaatgtttaataattaaacttaaatattaatcatttcagaatacactctttgctcgtttcatatttccattgctcaattttgacgcatttgcaattggatttttcgttatccaattagtagag

SEQ ID NO: 52697 - DNA, 812 bp, Heterodera glycines
  Genomic contig location: Contig_ID=SeqID_3984; Location=94..905; Strand=-
  SCN-specific regions: Sequence locations=1-380,402-538,593-605,663-812
atgttccgtttggtgataatgcaactgtacgtgcctccaaccatgatgtttacttatggccaaggtgagttttttttctttttattttctgctgtcattgagagaaaatttgaaattatggcatagttttgcaacagattttgacaaaaataaatttcaacgaactttggaattttagtttggatgaccgtgagaaggaacttatccgttcggcttttgaacaaattcatcggcgaacatgcctaaggcaattttattatggatttgttgattttgagtttttattttttagagatcgacctggacttggatccaggcctggatttttccaggatccaggtacaggccatttttcggcaacctggatttttcctggacctggattttcctggatttttgtccaggaaatcaaggtccaagtcaaatgtgaaaaaaatccaggtccaggcaaaacaggaaaaaacctggattttcctggacaaaattttagaatttattttttcaagtgaccgatgttttttcaagttttcaaaaacagattaaataaatttaaaaacacattattattattattattaattagatatttttagatgcttctaagcaaataattaattttttcaaacattttttttttgatttttaaaataatttcaaaaaatccaggtccaggcctggatccagatctcaaggagcctggatttttcctggacctggattttcctggattttgtccaggaaatcaaggtccagctccaacatggaatccaggtccaggcttttttcaaaatgtcgatctctattatttttaa

SEQ ID NO: 52698 - DNA, 553 bp, Heterodera glycines
  Genomic contig location: Contig_ID=SeqID_3984; Location=1283..1835; Strand=+
  SCN-specific regions: Sequence locations=1-12,34-56,109-120,142 -296,338-379,401-553
atggcaaaaaagaagaacataaatttggattttatttggagcattaaaactgtaagaaaataattatttgtattttcatataaaataatattataaaataataaatttggaattaattagtcaccactgatcagattcgatttactcggataaacgaataaaacatgtttcgatcatttcattcaaccgcttctgatcaataattatccactattaattaatctattaggtgacgtacccggaaaagcagcgcaattaattgaagcttcatagccaaaataaaacataaatatatttttcagacattggaaaaaataacactttcaaaacttttaaatgaaccctttgtattagatattaatataatttgtataagaagtataattatttgtgtgaaaaagaggatgaaaagtttctaattttcttaacaatctcacattagaaatccattttttccagcggcgtttctcggcatcgccggatccaaaattacccgagaattttataaaagattgaagtgtcaaacccagccgggactgaactgagcgcccta

SEQ ID NO: 52699 - DNA, 64 bp, Heterodera glycines
  Genomic contig location: Contig_ID=SeqID_3985; Location=17..80; Strand=-
  SCN-specific regions: Sequence locations=1-64
atgttccgtttggtgataatgcaactgtacgtgcctccaaccatgatgtttacttatggccaag

SEQ ID NO: 52700 - DNA, 799 bp, Heterodera glycines
  Genomic contig location: Contig_ID=SeqID_3985; Location=459..1257; Strand=+
  SCN-specific regions: Sequence locations=1-12,34-56,96-107,129 -260,325-366,388-799
atggcaaaaaagaagaacataaatttggattttatttggagcattaaaactgtaagaaaataattatttgtattttcatataaaataataaatttggaattaattagtcaccactgatcagattcgatttactcggataaacgaataaaacatgtttcgatcatttcattcaaccgcttctgatcaataattatccacaattaatttatctattaggtgacgtacccggaaaagcagcgcaattaattgaagcttcatagccaaaataaaacataattatatttttcagacattggaaaaaataacactttcaaaacttttaaatgaaccctttgtattagatattaatataatttgtataagaagtataattatttgtgtgaaaaagaggatgaaaagtttctaattttcttaacaatctcacattagaaatccattttttccagcggcgtttatcggcatcgccggagccaaaattacccgagaattttataaaagattgaagtgccaaacccagccgggactgaactgatcgccctattaaagtgctcaaagacaatttatgatttttattgcttttatatttatatatccttctagataaaaggaatttcaatctaaagtttttttatgtaagaaatcctctgaaaaaatccaaaattctaatattatgccgggtttatgcagcggaaaggcctcagtttttgaaaatgatagaaatgcgttttttgtttttaaaaaaaagctccacatggatcgacacccatcagaaaattggccattgtttactgaatgaaaa

SEQ ID NO: 52701 - DNA, 2937 bp, Heterodera glycines
  Genomic contig location: Contig_ID=SeqID_3985; Location=1844..4780; Strand=+
  SCN-specific regions: Sequence locations=1-67,106-122,172-214,244 -244,273-281,319-324,354-405,433-760,803-1010,1046-1192,1219 -1372,1416-1530,1560-1943,1965-2214,2237-2397,2444-2571,2612-2937
  Gene Ontology: Biological process=body morphogenesis (sensu Nematoda)
attaaaattcttaccctttttgcctttggcgtccttttttccttttccctttgattttgcgtcttttttaattccttaattaattaattagttaattaattaatttgtattaattagtccctctcttttttctgctttacctcctttcgctgctcctttcggcgccgcttttccttttgctggcgttgtaattgctcctttaaaagcatattccaattaatatttattatcaatttatttatacctttcttattgtcttttttcactgcctttgagttggctaaaataataaaatatttttaaatttttaattaatttggccacctgtctcaagaataacagccatcaccaagcaaaccatggccaggaagagaacggcgcgcattttgaatgtttgggaaagggaattaattaatttaattaaaataatttcgaatatgattttcgcttggctttcttttggcttttatattcctccaaaaaacgtctattttctttgaaattggaaatgtttttccaaaattttttgccggaaattatgccaatgccaaccatttttccattgatttgtctatgccatttttatgttcggtttctttcctgtgatttcaacattttttatttcttcatcaatatgttttgttgaaatattcttttattggtaaatatcggtttgaggtcccaaactcagaattgcttacggtcagaattaatgtaaaaaggtttgaaaaaaagcatttgtgaagaattcaaaacggtcaaaaaaatcataaattaatttatataaattaatcattttttacagagcaatggcattggcaccattctcaaagacattgcgccgcaaatgttcaacggcactttggcaaaaaatgattcattttgtgccgccatgggatgatgacaaaatgcacgcgtttttccaaattgaaaggccaatattttcaaaacgcataatcaacgacgcggatttattgccctataaaaatgatccaaacagattcagtcagtaaaaaataaattgaatttttaaaaaaattaatttcggcactttttaagacagtctagacccatgtgatgaatacggcgcagattgtgtgccgatcagaaatttgttgttgaaaattgaggcattggcaacctgtggaaagaacgaaagcaaaacaaatgcggtaaaaaatagaaaaaacagtttaaaaatatttaaaaatatttttagatttctaaaatgccaccatgggccccaccacttccgccaccgatgccatggaaaaagccatccgaaacaatgctatgcgatggggatatgttttgtgataaacgaaagctgcgagaacagtacaaccgattgagggagagtgagtcattttacaaatattaattaattaagtaatgaaattaattaaattaaaattcagtttgtgggcttaagcccgaaaaagtggaaaccagcgcaaaaaacgacaataccatccaaaagagacattcatttatatttctcattgataattcattcataaaatttggcacaatttatttatttatttttattaattttacctatttttgtagcctgtggcgcatccccgttgggccgtgacagcggatggcaatcccttatgctgggaatgactaacgactggtgcatcgatgtaatttttgcatcatttattcattgcttattttcaaatccggcctcagtcgggattgaaaagtcgggactgggtataagagctatttgaaagactgtgatcggttttagaaaagcctggattatagggatccggaaactttggttttaatttgaaactgattaagaattttaacatgtccgtcgctgctggccatgaattgatgcacgcgattggctttcatcatgagcaaagccgaagtgatgtccgaaattacgtgattttacgggaagatgacggagtaattaacacaaataatttaaatataattttccatgtgctaattttaaagcaatcggaaattgacccatacacaaaaaactttgacttcccttacgatttcgggtcggtgatgcattatcaatctgggggcgatcatgaacagtaagaaaaagttggatttaataacgtaaaattggaattaaaggggcttatacaatctgatcactttgccacgcttttaccaacaaacgattggccaaagcgaacgaatctctttcaaagacgcggccataattaaccgaatttattgcgaaggcaaatcaattaaatataattaagtgatttcccatttgttcagactcatgcaaaggccatgaggacaagtgccaaaacgggggctatttgaatccgaatgattgcacaaaatgccattgtccggacggatacggtggcaaatactgtaaagaactcgaagagagtgagcaattaattaattcaattaaattcaaattaaattttgtaaatttttagatttgaattgcgaggatttgagtggaattccgagagaattggtggccaatcagtcagcagtgttactgaagacgaaggccaaatgtggggggaatgggccgtgccgatgccattggcgaattaaggcaataaataatatttttgaatttttagtttttttaattaatgcaaattttaattgctttcagcctgaagcggggaaaaaggtacgaattcagttcaaaagtttgagcaatttgtttgaatgcacatacaactgctcatcggcgtatgtcgaggtcaaataccgagacgacaaaagggcccaaggcaaaaagacaaataattaattactgattaattagcaaaaggatcgtttataaggtgccaaactttgctgtccccgtgcactcactgatctgaacgccaatgaatacaaaatattggattgatgcggaaaagccggacatggacatagtcatttctgcgctcctttcaacaaaatggaccatac

SEQ ID NO: 52702 - DNA, 959 bp, Heterodera glycines
  Genomic contig location: Contig_ID=SeqID_3985; Location=1270..2228; Strand=-
  SCN-specific regions: Sequence locations=1-32,62-67,105-113,142 -142,172-214,264-280,319-376,449-469,519-565,591-613,724-959
atgcgcgccgttctcttcctggccatggtttgcttggtgatggctgttattcttgagacaggtggccaaattaattaaaaatttaaaaatattttattattttagccaactcaaaggcagtgaaaaaagacaataagaaaggtataaataaattgataataaatattaattggaatatgcttttaaaggagcaattacaacgccagcaaaaggaaaagcggcgccgaaaggagcagcgaaaggaggtaaagcagaaaaaagagagggactaattaatacaaattaattaattaactaattaattaattaaggaattaaaaaagacgcaaaatcaaagggaaaaggaaaaaaggacgccaaaggcaaaaagggtaagaattttaatataaaaagaaatttaaaaagttaatttttgaattttagacaaaaaagctaagccagccaaagggaaaggagtgcctaaaaatggtaaataatattattaaacaaataataataatgaaaattgaataaatttagacaaaaaatccccagcggcaaaagcaactgacaaaaagagcccaagtaaataattaattatatttaatattgtgccaaaattgccaatttgaagccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaatggcaaacggaacaaaacgggacaaatgacacaaaatatcatttttggcatttcattttcagaaaaaataaa

SEQ ID NO: 52703 - DNA, 563 bp, Heterodera glycines
  Genomic contig location: Contig_ID=SeqID_3986; Location=764..1326; Strand=+
  SCN-specific regions: Sequence locations=1-341,363-505,530-563
atgataaaaactccatctacatataattttacttataaattcaaggtcaatggaattcaaatccaaggaaaaaggcaaacggtgtttactgacccaaataatgaaaaatacaattggactaaaattgatgttgattgttatgtgagttgtgtcttctaatttcgaaaagcctatttaattgacttaattcacagaaagccgaagggggtaccgtaaacttttggggctacagtaagccggagactaacgaaatcattcgggtggacgaaatccactgcttgatggatgatgcagttgctgaagtgccaaaacagtccaaaagcttacaaaccgatgaacagccgccgatgaaattgagtccaagtccattcttggccaataatgtttcatcacttatccatgtgttcgtgccatttgttggcaatccatgagagaaaatggggagaccagtgatcagttggggatctgtcttctactgcgatcagttggccaatttccaatcagcaaatttttatttttttttaaatttgacaaaatttgatttatatacgtcgaaaaaatta

SEQ ID NO: 52704 - DNA, 1187 bp, Heterodera glycines
  Genomic contig location: Contig_ID=SeqID_3986; Location=1624..2810; Strand=-
  SCN-specific regions: Sequence locations=1-651,677-1013,1051-1187
atgctcgacggcggctcccaaatttctttgatttcggtcaaattcttcttagaaatcatggacaaagtaagccaaaaggacatcgtcacccgctctgaaagccggatcatcgacataaatggaaaggaagtgaaatgtttttgaattgttgctttgccaattcagagaggaccattagaaacgaaaatccgtgtttttgtggcccaatctacatttggctatgatttgcttttcggcacaaatgccatggaccaattaggtttcaaaatgcttgacgcagtgaactgccgcattgtagacttttcgccagcttcgaagcccgaaaattcgcctctgatcactttcaaagccttcgtgtgccatggcaacaccagtaccaacagagaagggcagaaaaaggggaataaacataggtcggacccaaaaaatgacactggtaccaagaaaggtaaagtggtggagaagaaatcaaatcgaaatgctgtggacaataaaaggaggccattattcaacaaaacatttgtgccccaactgaaaaccaaagaaattccgatcaaaaattctgaaagttttggagaaagtgcggcaaacaaacagcgattgaattcggttcaagtgaaagtgggcgtgccaaacgaaaagccgatgaagtgtgtttggaaaaggaaaaatttgggccaaattcagttagggacaactgaaaagttgggtagggggaaggtcaacccaacaacgtgcaataaaacaaaaaataaacagaaaatataaaccttgaatttgtcccgctgtgcttcctgtgtgaagtttgagaattttgaaccaaaagcatttaaaatgtttgttgctctttttgattcaatttgaaaaaattgaacagaaaaaattttgttgaaattttttcgtggtttttgaattttcgtattttatatattttcattattggcttaaatttctacttaattaagcaatctctctttcatttaagagctttttgggatccttccccgctggccaaagaaaagaaccattttttgaaaattccaattttttcattgaaaattaaaaaaaaatccattgatcagcctgcttctcatatttatactgatggctttattccaaagctttgcatgtttatttaatttttaagattgaacagcaattaaacaacacaaaaagtgaataataaa

SEQ ID NO: 52705 - DNA, 822 bp, Heterodera glycines
  misc_feature (605)..(605): n is a, c, g, or t
  misc_feature (796)..(796): n is a, c, g, or t
  misc_feature (803)..(803): n is a, c, g, or t
  misc_feature (812)..(812): n is a, c, g, or t
  Genomic contig location: Contig_ID=SeqID_3987; Location=51..872; Strand=-
  SCN-specific regions: Sequence locations=1-92,114-134,156-822
atgcctgtgcttcggtctccaccattaacccggacgagggcactcaaccagggaatcattgttgaccgcgatggaaacgcatttagggctgaaaattttggagttttggggggcagaccgatctcgcccttagcgaacaacgaaaatcagcgactggacgacaatcatgaaaatgttttagcagagactgagattcgtcgtcgcctgctttacggaggaatggatcaaagcgcgccggacgaacaattggagtacgacgaaatggaaaacggcgacgaacaaaatgtcaacggtatggtgcaacaaaatttggaaaatggagttgaagctggggatagagggagttttggaaacgatgcgttggacgcacatggattgcgagccttttcaacaccgcttaacgaacaaaacctaagcgccctgcagcgagaccgaatgcaacttccagaaaatttgagcgtcatccaaaaccaaattagggttatgaatttcatgcaaaatcaaatgccaaacccagtcgcgcataatttccctgcattgaatcacccacaagcagtcaatccgattgcttgccgacccaatggtcagttgtacgaaaatgctgncggtaattttgagcggcagagagaacagcagataaggctcacacagcaaccggttgttgaggaccaacaatcacacgttcggcgaattctcccgcacatgcctatacacaaggacaccgccggtcccaagacgaaggatttgagtttcaccaaggacagcaacacccaaatttcaaaaaaacctacctatnaagagcnatcaacaanatcgtcttga

SEQ ID NO: 52706 - DNA, 94 bp, Heterodera glycines
  Genomic contig location: Contig_ID=SeqID_22062; Location=1751..1844; Strand=-
  SCN-specific regions: Sequence locations=1-94
atggataagcgcactgagaaggagccgaaccgaccgaccgatggacggacggagacgaaaactgaggacaaaatgccaagaatatatgtgatca

SEQ ID NO: 52707 - DNA, 1759 bp, Heterodera glycines
  Genomic contig location: Contig_ID=SeqID_22063; Location=47..1805; Strand=+
  SCN-specific regions: Sequence locations=1-288,324-441,501-505,527 -612,634-694,762-1166,1232-1323,1400-1563,1623-1759
atgataatcaattctgcaaaagatatgttccatcaagaaatggatcaacaaatattggaatcattctcgaacagtgcagatcacaacttgactgagcactcaacaaatggtataaatcaagaaaaattacaaaattaattactatttatttaatcgcattgtaatggatactctgaaaacttattaaaaatagtattttagaaattaatttttgagaattttttgttctcactcttacagataggacgtatactgtaaagaattttttgtaatatcgctgaagtcaacttaaattattaaatttttatatttttatttaatttgttataaccattaaagatggcatgactgatgaggagatacaattaatgtttgaatataaagacaattggactaagcaatatgagcaaatgctgagtagattaacgccagaaaaacaggtaataaattaatatttttttttacaaacattttgcatttttttaaaattaattttattacaatggaaaattcattttctgaaaattccttacacaaacgcaataaaaaacgaaaaaccactcttaataagttgaactaaaaaaatttcgtacaacaacaaataggcatccgttttttgtgattttgtacctaatttgtgcctgttttgacattgccgatttatgcctttactggcgattttttgtgtaatatgtataaaatatcaatttattcataaaaaattgaaatttaatttaatttaactttttgaaatttttttaggaaatggttataaattatgttatcacacaagaaaatgatattgaattattgaaacgattcttgaaaactgatcgttacgaattgcttcgggggttaaagagtgagtttaagttgcttatttgtgccatgacaaaatgaacataaaattgagcataaaaaaaataagaagccaagctacagtaggacgagaacggattcgtttttcgctaattagtttttaattacaatgattttttttttgtttgaaaatatgaaactctaataatttttgtctaatttcgtttttcgatggaaacaatacttttttaaatttgaaaacttgcttcgggggtttcaaggccttggccatgattatgatatcctattttttatcgaaaatgaataagtacgaattgaaaaatccgtttttttaatctaaaaaattgtaaaataaaaatttataagtttattgaatttaaattatttttaagccaaatttaaattgctttttgtagatatttataacgaaaaacgtcatttcataaaaaatttaaaagtgacatctaatcaaatgaacatatgaatattttatgataattaaataaaggaaaattcaatttttttttttttgttaaatgaatttataaatttaaatttagataatcggcttaaaaaaaagctaattgaagagatgcttggcaaaatggagcttgaagagtttaaaattcaaattgcacaagcgattgcgattaacgaatcaaacaacccaccaacagatcttagaaaggaatcaaaaacaaaaccaaaaattcgagttggtagaaaaaaaattatttttttaaataataaatttataatttaaaactaattagatatttaaagtaaaatggaacattttttacattattttaaggaacttaaaattgatgcccatcaatcatcacaaaatttggcaacaaatcttcgtgataaaggcaaagcgaaactggaagacggacataaatctccaaacattcgg

SEQ ID NO: 52708 - DNA, 1942 bp, Heterodera glycines
  Genomic contig location: Contig_ID=SeqID_22065; Location=333..2274; Strand=+
  SCN-specific regions: Sequence locations=1-970,992-1942
  Gene Ontology: Mol. function=hexokinase activity; Cellular component =soluble fraction; Biological process=glycolysis
atggctaccacccatcagcataatcccacgcccgaggtgtccatttttgtccatgtttttttcaacacatttaattttttttcgtccaggtgaaggagctgtgcaagtgcctggcgctggacgacaatcagctgcgcgacattatggcaaagttcgagatggaatacaaaaaaggccttgacccagtgaccggtggagaattttgaccatttttacccccttcgtaacctccctctcccattttcagctccgacagcttgcgtcaaaatgcttccgacgtacatccgcgcgattgctgttggcgaagaaaagggcgaattcctggcactggacctcggcggaaccaattttcgtgtcctgcgcatcaccttggagggcggctgccgttctacgatgcacaacaaaatctacagcatgcccgacagtgttcagcaaggcaccggcacggaggtgagttttgcggatgattcagaatttgttcaattttaatgtttcaacaattttttcagctgttcgaccacatcgctgcgtgtctggccgactacatgcgtgagcagaatctgacgagccattcgaagatgccgctcggcttcaccttttccttcccgtgccaacagaatgggctcaccaatgccgtcctgacaaactggacgaagggatttacggttagaaaattgatttctgaatatttagtaaactccatttttcaggcttctggcgttgttggggagaacgtcgtccatatgctgcacgacgcgttcaagcgacggggcgacgtggacatcgacgtagtcgcagtgctcaacgacaccacgggaacgatgctcgcctgctccttcattgaacaacattgctacgtcggggtcattgtcgggacgggtaaagaaacctaattttttgtttgattttcaattaattcccctttttttcttttcaggttgcaatgccgcatacatggagcgactggagaatgtgccgaaactcaagggaattgtcaactccgcggaaggtaaaaatgggaggtgacgggagcccgtaaacggcattaatttttgaaacaattcagatggtctgccggcggagatgtgcgtcaacacggaatggggaggattcggcgacgacggagcactggaccaattcctcaccatctacgaccagcagttggaccagcagagcctcaaccccggccgtcaacgcttcgagaagaccatctccggcatgtacatggtgggaaattttcaaatttaacaacaaattatgttaaagaaagttttcagggtgagatcgtccgtcttgcgctggaggacttggcacgtcgcgggctgttgttcagcggcgactccactcgaatttccgaacgcggctgcatctccaccaagatggtgtccgacatcgaagggtaaaactctgctctaaaaagtgcttaatttcccttcatttgcaggtttatgcacagcaccgacgggaacccattcgccaaagtcggcgagatgctgcgcgccattggtgagttgtcatttgatcactttagccattcaacatcccaatatcccattttaggcatttcgaactcatcggccgccgactgtgcaaatgtcgcctacatcagctcgttgattggcacgcgcgccgctcatctctgcgcctgtgggcttgccgccatcctcaaccgcatgcagaggccccgcgtgactatcggcgtcgacggctccgtgttccgcttccatccaaccttcaaattcaacctcgaccagaagatcaaggcgctgttggccgtcaaatgcgaagtgagttacatagtttctaatatcgtttcggaatgatatgaataaatctcctctaatttcagttcttcatggtgctcagcgaggacggaagtggacgaggcgcagcagtcgcagcagcagtcgcattgcggatgaatcgccttgtgggagcgtga

SEQ ID NO: 52709 - DNA, 814 bp, Heterodera glycines
  Genomic contig location: Contig_ID=SeqID_22068; Location=485..1298; Strand=+
  SCN-specific regions: Sequence locations=1-63,85-224,247-337,402 -650,672-721,743-791,813-814
atgaaaatttcttccagtttttaatttgaaaaaaaacaataagatttaccaatgcagttatatatacaaaaaggcagaaatttttcattgcacatttaaagattttcaaaaattttaatagttttttatgtgttttttgaaggattttatgcgtaaaatatttaatggcctccaagtaggcaagtttttttgtttttttttgtgtgtaaaaatgagaatgtttcaattttttaaattatttttttaggatttttttccaaaaaaccgaacttcaattttcagaatatcaaagtggcggacattctcccctttttgaccgtcgttatcttaagagaacatttttttcttaaaattaaaaaatctttttttttggaaattttacatttttaatttaattttttggccctttttattcattaaaaaatctttttttgtgatttgtacctcttctaatcactgttgtacctcttctgatcactgttatagcttttttcccattttttaaataactagagcgcaaaaaaccttttttttcagcgacgaatattgattatattttattattcattttctcagtatcaacattgctttcgccccgtttcaatgctctggtggacaaacatttcaatggaaaaagcggattgaagtcgtaagtttcattttttcaaattggcaatgaaaatatttctaagctctaaaattttgattggattcggtgcttaaaaaggaatttgtaaatattttttaagaaatttgcgattttacttatgtttcagcatattttatctatgttttaaattattttatttgataa

SEQ ID NO: 52710 - DNA, 152 bp, Heterodera glycines
  Genomic contig location: Contig_ID=SeqID_22070; Location=1..152; Strand=-
  SCN-specific regions: Sequence locations=1-152
gaggcggacgaacaccgtagggacggatgaccaccgtacgagcccgaagccgtggcaggagccgagcgggcatcagccgacttcgtccgcgtccggcgccgcccatgcgttgcccccgtcttcctccaaccgacccatccgctcgcaacgga

SEQ ID NO: 52711 - DNA, 1801 bp, Heterodera glycines
  Genomic contig location: Contig_ID=SeqID_22071; Location=358..2158; Strand=-
  SCN-specific regions: Sequence locations=1-588,635-925,947-1342,1407 -1438,1460-1505,1529-1766,1795-1801
  Gene Ontology: Mol. function=cleavage/polyadenylation specificity factor activity; Cellular component=mRNA cleavage factor complex; Biological process=growth
atggttttctgtccgactttcagatattgggaacaacaccccgaacttcacgacatccccgtttactgtgagtatttatcatttttgagttggaatgtgctttcatttgcttattttgtacagatgccagttcattggccaagaaatgtatggcggtctatcagacatttgtcagcggaatgaatcagaacatcaaacgccaaatttcgatcaacaatcccttcgtgtttaaacacgtctctaacctaaaggtaggtatcaaacatggcgcaataaattaaatttctttgagagcatcgaccatttcgacgatgttggcccatgcgtggtgttggccagccccggaatgttgcagaacggactcagtcgggaattgttcgagacttggtgcacggactcaaaggtacgactgacaatggtgcagagggagccccgatatttgcggccccgacatttgcggtccgacttttgcggccccgacatttgcgcctatgtccaaaatcggactcaaagttgaattttttcaacccctgatagcctaatatgcattaaaattaagaaagcacggttttatggttcattatgatcaataattttttgtttgaaaattttattattttttcaaaatttttttgaagatcaaatgatcatgtacaatcacttttaatcgcttatttaaagctatttatgcgatcagtgattgaaaaaacttagttttgaaccagattttggacaaaggcgcaaaggtcgggacactggtattatatattaccctccggttttaacattttttctgacatttcaaatgcattttatatgggtaatgttgagtttttgggcaatgaaattgctccaaaaaaagttgaaaaatttcgcaatttcttaaaattttccatttcaataacgccattaaattaggtagttcaaattctttaaaattttttaatttcccaggtccgtctctttcatacgcccaaattgcgcggcctcctcaaaagtgcgctgcccgaactgaccaacgaaattgtggggttacagcacatgaaattcttcgtcttcgacgactctgtgctcatcaccgggttcgtttttttgtgttataaatagggctataaattatatgcactaaaaaatgccaaatatgcgcataaaatatgcactaaaaatcccttaaatatgccttaaaaacccgaaaaatgcccaaacatgcactaaaacatgtcttaaaaactgccaaaaatggctttagccctcaaaaaaaaatgccaaaaattgtgtaaaaatttagaattgactttaaaacatccaaaacaatggctaatgagcgtttttagacaattgcaaaaaattttgaatttcaaaatttatttatgcaattttgaattttttttttttcaaatttttttgtttatgctcaaacaaaattactttttttgtatcttttgcatcaaaattttttcaaaagttcttacaagaagttcaaaatttttcgattttcaagggtgtattttttaaattcccaaaaaagtcgacccttagggtgtatttttcgtttttattgcatttttcttatgaaaatttgacaaaaatgatcgaaatattgactaaaaaggcaaaagtatcaaaatataatcactcggaaaatgccaaaacaatgacacacctcaaatgtttcagacggggaggggagttcagacaaaaataggcaaaaccctcaaaattcatcccttcttcagatagacacataagggcgtgtaaagaaactgttttttttatttttagtttttatttaatgaataaa

SEQ ID NO: 52712 - DNA, 2499 bp, Heterodera glycines
  Genomic contig location: Contig_ID=SeqID_22072; Location=1..2499; Strand=-
  SCN-specific regions: Sequence locations=1-92,116-277,299-536,645 -705,735-807,831-901,923-983,1019-1387,1438-1468,1512-1607,1638 -1984,2006-2058,2087-2499
  Gene Ontology: Mol. function=interleukin-8 receptor binding; Cellular component=cytoplasm; Biological process=apoptosis
tgccgaagaacggtcagtttggcgatgatggcatttgtgccattcccctaaccaagggaaggcacagagttcgataaaagccgaagaatttggagagttttagtaagttttttaaggaagcgggccgaaacgatcgttggcgtctccgccaacctcagtgtgctgctgtccgtgctgctctatcctttcatgcccaacatcagcgcacaaatccaacaacagtgcaatctgccgaaaaacattgtcatgcccgagcacttcgttttgtttctgaaagctggacacaaacacaacaaggtgacaatgatgcagcagcagcagcagcaacataattccgattcattttgacggatttaaaggggagaaaagggaaattccattggcacaaagaacagcacgggtttcatttttttatttgcccattgtttattataattctcaaaatcatttttaatttcctgcagccgtgaaaatgatagcgaaacattgaccaaaatgcgtaatcatttttcattaattttgcgactaaatcgctcctttctctctcactctctctttttgctctttctcgctttctcccttctcttttcctttttgtcttttctcacattttttctttcctcattctctcaccctttctctctattttatagtcacaggtcaatccgatgaaaatagagtgtaaaaagggggaggcaaattgattatttgatgaattgcatttgggtgggttgaaacggcgcaaaagcccattaaggaattcgtacgctaattgactatcacataatggttctcttagagcagcagtgattgcttctcccctccctttcttagcctttcgctttgttcaccaaaattgaaccggcgaaggtggccgagtggaaagaactctttggcagtgggaaacagcagcaaaatcagccgaagaacaacggaccaacggcgatgagcagtagcagcagcaaaaaggcaccaaacacgacggagaagcagcagcagaagaagaaaaaggaaaacatggcggaagagcggggcgaagtgggccaaatttacgcggaagtgatggccaaattcgaaaaagcgagtgagcggcctcttcttttatccatttggcattctgcccacaatggtctttttgcaacaatgggaaataacaaaaaattacttggctaaattggattttttaatttctgtcaatggttgctcatatttccaaattctagaagcacttttcgtcacaaatgaatctgaaaaattggacaccgaaattgccgcattgaaagaacaaataacggagcagaaggcgcgcctgggcttcaccggcgcattgttctcaccgccgatgccaaaagcaacgccggcaatcgttgtgccaccagcaggtgaatctccctttctttcgtactctctctccctttctttttctctccctctctcatcctttgtacggcgattggactttttgttcaattttaaaattaattatttattttttactcaaaaaatttttactataccttacccccccccccccctctttttttgcattcattgcatttttttcctttaattcgttttgtaattcatatggcctcattttctgcttcagttaaatgaactattaaaaaataagcaatttatttcatttggacagtttcttccccgcaaacaccgcccaaattgacagcagcgtcaaatgcgagcaaagaacaaacgcaacagaaacagcagccgaaacagaagaagccgcagcaacagcaagcgactgccccggccgatgacaccgtcgacgtcggttgcctcgacctccgtgtcggccgtatcattgaggcacagaaacacccggacgcggacgcactgtacgtggaacagattgacctcggggaggagaagccgcggacggtggtgtccggcctggtccgatttgtcccacttgagcaggtcagcagcagagtttcatgatttagatgggtgtatgtacatcattccccaccccacctcccgtgatttcctctcctattctttcgaaattttatgatgaattactaatttttccacaaaaaaaatttttaagtttaaaaattaacagctcaaaaaccgtcttgttgtctgtctgtgcaatttgaagccggccaaaatgcgtggcgttgagtcccaggcgatggtaatgtgtgcgtcgacgcctgaaaaggtggaagtgttggaagtgagcccggacagtgtgcccggtgatctcgtcgtctgtgaaccgttcgtacgccgtccgcctcagcaattaaatccgaagaagaaaatttgggagacagttgcaccggtaaggaaagaattaatccaatattaataaattgcactttcaaaatggtcatggcatagaaatgacacgtcttttgaaaaagagcaaaaatgggacccggtcaaagatactaattatttcttaattacaaaaatattttaggatttgagcgtctctgaaacgggcgaatgcatttacaaaggaca

SEQ ID NO: 52713 - DNA, 1135 bp, Heterodera glycines
  misc_feature (1119)..(1119): n is a, c, g, or t
  Genomic contig location: Contig_ID=SeqID_3988; Location=170..1304; Strand=+
  SCN-specific regions: Sequence locations=1-269,293-335,375-598,620 -633,661-699,723-1135
atgatgatggcgttggacgccgccggcggggcgacggcagcggccgccgactcggcccaactgatctccaccgactcgttggacatggaacagttgcgggtccgctgcgagtgcaccaagcacaacgccaactacaagctgacctttgacgaggacagcggccagtggaccaccagcggcattggcggctcgttcaccaccacggcgactgcgagtccgccggcggcgcaacaacagaaacaacagcaccagagacggttgaagcaacaccagcagttgaagcagttgctggcgatgaacaccaccgccactgccatgaataacaacaacaatagccatgaggaggaggacagggatggtcatggagatgaggtacggtgcctactatactaatattcgctacagagcaccaattttatttcgggagggacacccgaagagttttgtttttttgctccccatcctaaaatttttgtacaatataatttcttaaaaattttttggcgccctggaaaaaacgaggaattttggcctttttgagaccaaattttggcaaaaaatacatatatttttttatcccaacaattttcaccaccaaaaacaatattaacagtaaaaaatctttattccattgcagcatcaacaacagcagcagcagttgtacaccgccatcatggacaacaacggtgcactggggctgcaactgttggagcagttgaacaacgctgatgacgacgaccaagacaacgacaccagcgcgtacagcggcggcgtgttcaatgccaccgccgagaaacgaagcggcgtacgtcgtcgtccggcaacgagtgttggccatggcacaacgacgacggcaacggatggttggcgaaagaacagtttcatggacgcgctgttgaacaacaacccaaaccacaacgccaacacgtcttcttccgcatcgtcgactttccatggcaataatttccgtggcgacgcggcgacgaaaaaaggggacggcggaggcatgggaatgatgaccacttggggacgactgcaccagcagagcgacgacatgggtggaggacagcagccgcccttcaattccgagaaggttcacaggtcagtatttcggaaggngagggggcgagggtga

SEQ ID NO: 52714 - DNA, 723 bp, Heterodera glycines
  Genomic contig location: Contig_ID=SeqID_3988; Location=1722..2444; Strand=+
  SCN-specific regions: Sequence locations=1-12,36-723
atggccacatatcaacagcagcaacctcaacaacaccgtcatgttcaaccagtacacggctcagtttcgtcgtcatcgtcgtcggctggactcagacggccgacctcctcaagtttgctggacaatttcatcgccacgcaacgccaacaacaacagcaatggaacggcggcccgcaaatggtggactacgcctactcggagacgtatctgggcaacggacgctacattgacatgaacgaaaatggtagggattttgtttttacggggttttctcggtttctgtcctcacaaatcaagggtatccgagtcttaaaggatgcctaactcggactattattacttattttccaaatactaaaatggattttccgtcatttggcctgacggccctgacttttcttaaatcacaatgaaaaattctggaaaataccaatttctcaaaacaaaaaaaaaaaaatccaagcaaattttccgttttcgtaatataattcttttccgttttcgtaatataattcaattgcatgaaaaccggaggggcaagcaacagcaaaaaaaacggatttttttctccgaaaactttaatttcaaataatcacgcgttttgattaaatttgacaactttaatgatacaagaaatgttttgagaagtttttcagttttcaaagccacaaagtccgtccatttttgtcagtttcagagtcccctccattcattattgactaa

SEQ ID NO: 52715 - DNA, 1088 bp, Heterodera glycines
  Genomic contig location: Contig_ID=SeqID_3988; Location=3162..4249; Strand=+
  SCN-specific regions: Sequence locations=1-35,191-375,420-484,506-1088
atgacggagacggcaccgctggggcacaaattgggcaacgacaaccaactgcaacacaatgccaacgccaaccagcaacgacaacagcaacagcaaaggcggcagagccaccaccaaatgggtgcaaccaaaacaaaggcagcggcgacaatggcaatgccaacaacggcgaccatgccgcaacagcaacggcgcacgtttgccgacctgtccgccagtcggacagtgcccgacctgaagttcatcgcgttggcacacaatgtaagttgggacaggcaatagtgacggactttcgttggcaccggaagttggtcttacaatgggggactgattcaaaattgaaaaaagaaagttcgtgaggaaaaccatcggtcaaaaattatattgttttattttctttctttttcatttcacaaaatgagggatttcattcctcccatttcgttaggtcctccaataatctgacaatgaacaattttttttaatggattttactataaaaataaggcattcgtaatggcccaatttttcgagagtcactctcgaaaatactcaaaataattcgctctgtttgctttccgattactaaaaaattacattttcccgtctttcaggtgccaacaatttgtcccccctcctccgtgtcgttggacaatttgttgtgccgcgtgcgaaacagtgccaccgccgctgacggcaacggcggcattggtggtgccaatgccgcggccattgacgagctgatcgactgctgtgccagttcaatgcgcatcctttcggagccggacggcggcggggccagcgacgggcccgactcgggcctcggctcgtcccattccgacggtgagccaaaaaagcgaagaaaaaaatggaaaccgtcgtcaaaattttaatatgttaaatttttctggggattggctcttccgacgggataaactgcacggagaagggaaatgaagcacatcccattttttcatgttacatttatttacaaatattcaggcccctcgcacatcgaagattggtcttcactgtccgtgttgttgccaaggttggattcatttttatttttcaattttgagtgttga

SEQ ID NO: 52716 - DNA, 1256 bp, Heterodera glycines
  Genomic contig location: Contig_ID=SeqID_3990; Location=517..1772; Strand=+
  SCN-specific regions: Sequence locations=1-95,130-187,209-323,345 -525,549-603,626-1025,1048-1052,1074-1256
atggcaactaggacgatgatggcatggtgcggcggcagtgccgcccgtcttcccaaggattcgcgagtgccgaagagttcttcaatgccgaccaaactggtggcagcagcagcatcatcaacaaaattgtcaacggattgcattgaggaggaggagcaagaagttgaagttgttcactgccagcaggacaaacaacaacaccacaatagcatcaaattggagggtgagaaacaaaatgatgagtggtggaaggctaaatttaccagaatgacccggaaactttttttggatgctctcggcccatttttcgagtgtaacaggatcaggttcgggtttttcaaaatcccggtctctcgctctttaacattcatttgttagcagactcaatttccatttttcagatgtcaaatgggtcgaagtgcagcagcgcgagcaggaggaggacaaaacggcggaaaatgagcgaccaaactcaatggcggacaacgacaacgtcgttcagtcaaggaacactgatgctgttggtggtgctgctgacactgttgtgcacgccggtttgagaccgtccagttccaggatcccaatactacggtaaggttgattttaaaaaattaatccaaaattatgagccaaaaaaggcattcggtagaagtactgcttgaacatgctggacaaaacaacaacaatttgttgtttttccgtttagcacgcgaagtcgttcgtcaataatgcacagcgacgggggcagtccaattgcagcgcaacaacgccactctccgacgacgctttcccgtcgttcgtccagtgctcgccctacaccgtcgttgtcgcccgtttacatttgtccggtccgcgaggcgatcactggcgagcacacagaccaacagtcggcatcgctaccacatgggagcgccgctggcggtggcacgctgctgtacccgttgcgcaagggcgagcgcgtgcgagtgttggccatccgtggcgagtacacgcgttgcagtcgcttgcctgctgctgaacatcgccagcaacaactacaacaacagcggttggcgttgcagaacggcctggtgccgaccaggacgctccagtttggcgccaataatggcactacggcattaaacgacgagcggatgacggaactgtgactgatgattgacttgctgatcagtgtggtgatcggagtttgctgtgtgccatgaacggacaaagaaaagtgaacgaaacgatggaaacgtacaaaaaaggacaattaa

SEQ ID NO: 52717 - DNA, 319 bp, Heterodera glycines
  Genomic contig location: Contig_ID=SeqID_3990; Location=2188..2506; Strand=-
  SCN-specific regions: Sequence locations=1-49,72-172,201-271,294-319
gcgaatcggtccaccgtcagttctcgcgccgtgtgctcatcccggagggcatccaaaaggagagcatcaagtgcgagttggacggcggtcgcctgttcatcagcggaatgaaaacggctgacaaaggcggacgaaccattcccattgaaatgaagaagaaggcggccgtggaccagcagaaggaggaggagaagcagcagtagaaaaggacggcggaagtgaagacggactgactgtcggtcgaccgaatgatccattgacattgatctttttattttgatacttttgcaaagtgatctataaattatttttccttcaa

SEQ ID NO: 52718 - DNA, 370 bp, Heterodera glycines
  Genomic contig location: Contig_ID=SeqID_22073; Location=900..1269; Strand=-
  SCN-specific regions: Sequence locations=1-48,99-132,160-370
acattttggaaagttagaagagaatgaattggtgtggctgtggtgtttggggaggaaagggacgccggggggggggggggggagaggacggggaagggtcgaataaaacgctatgaaaaagacggagaggagcaaacacaacagcagcagcatcaacaggaagaggggggaatcaaagaatggacgtacgtttgaggatttgacatttgtaagtgcaaaatttcaaaataaatgtagacatacaacacagtaagtgaaggaaactcgacaaatttagaaaaaaatttttcgtcgggacatcaattcttaatgattgccgaaaaaacctcctaacaaataagtagacaatacagaagaacattttgtaaat

SEQ ID NO: 52719 - DNA, 374 bp, Heterodera glycines
  Genomic contig location: Contig_ID=SeqID_22075; Location=163..536; Strand=+
  SCN-specific regions: Sequence locations=1-131,173-259,310-374
atgccatacattggggagacaaatgatttcaaatttgagcaaaaggatgttgaacaatcattggtgctgatggacgatgatggggccacagatgtggccaaatcgtcatttgatgtggaggataaaagtgcaatttaattttaaataatttaattaaaattaatatttaaaaggaaaaaaattgaaaatatggaatcattaacatcaatagaaagcagtacaatggaaacatcttcagttgaaataattatgacttcacaaaatttaaaaattggaaaattaaagtaaatattaaaaatttttaattttctttcttaaattgggtttatttatgagaaattttttagattattctataaaaatgctaaaattaa

SEQ ID NO: 52720 - DNA, 61 bp, Heterodera glycines
  Genomic contig location: Contig_ID=SeqID_22075; Location=1293..1353; Strand=+
  SCN-specific regions: Sequence locations=1-61
atgaaatgcgctcaaagacgcgcccttcaagtgattggtactgacttccattatatccatt

SEQ ID NO: 52721 - DNA, 537 bp, Heterodera glycines
  Genomic contig location: Contig_ID=SeqID_22076; Location=259..795; Strand=-
  SCN-specific regions: Sequence locations=1-207,229-407,429-537
atggtcatcgacggactgcgcgactgtctcctgcaagtactccgcgattatgcgcttcgcgtcggactgttggagcattcgaattccgtcgcttcgtctgacacttttgcgctgtttcagcgacggctgaggccggagcctttcgttgctggcacccatggaatggtcaccgagctgagatgcgagatttgcttgtaagcattttctaatgattttctttaattattggtgatggatcgcattaattcagcgatccattagtcagtccttccgcctctgccccggtcggagatgttcgtttgttggtcaacggaagtgcggtccacgagaaatgccatggacaaaagcaaatgccaaacgcaaaagcactttacgaggaaaggagaaatgagtgaggcaaagactggagaaaaaagaaaagcgaagaaaacaaatcaaacgggtttattatcagtcatcaccaaacatatatatcacttatatgcctttaaagctcaaattttgttcacaattttgattttttatagtttaaataaa

SEQ ID NO: 52722 - DNA, 1667 bp, Heterodera glycines
  Genomic contig location: Contig_ID=SeqID_22079; Location=339..2005; Strand=-
  SCN-specific regions: Sequence locations=1-897,920-1317,1339 -1441,1465-1538,1560-1586,1609-1667
  Gene Ontology: Mol. function=creatine kinase activity; Cellular component=cytoplasm; Biological process=phosphocreatine metabolism
atggctgtccctcaggaagtaattgacaaaattgaggctggctacaaaaagcttcaggtgcacacaatgtgtgtgttaactattctaattttgaactaactttcaggcggcggctgattgcaaatcgttgttgaagaagtacctcaccaaggacgtcgtcgatgcatgcaaggacaagcgtaccaagctcggagcgacttttttggacgtcatccagtcgggggttgccaacttggacagtggtgtcggcgtgtatgcgccagatggtcagtaaattgctacgcataatcacaaccataaatattcattcagccgaggcttacacactcttcaaaccattgttcgacccgatcatcaacgactatcatggtggctttggaccgagcagcaagcaaccggcaacggaccttggtgaggggaagactcaactgctgacggacttggacccggaggggaaattcatcaattcgactcgcgttcgttgcggccgctctcttcaggtgtttgtttgaatttaacataccaaaaaacagtcgtattcaggggtatccattcaacccatgcttgaccaaggagaattacgtcgagatggaatcaaaggtcaaagcggtcttcgagcagctgaagagcggtaggcaaccgctaattattttctttgtaacattaatgttttagatgccgagttgggaggcacctactatccgctccagggcatgaccaaggacgtccagaaccaggttcggtccaacaaataataagtcattaatttttggaatatttagctgattgccgaccacttcttgtttaaagagggcgaccgttttctgcaggaggccaatgcttgccgttattggcccaccggacgcggaattttccataacgccaagaaaacctttttggtgtgggtcaacgaggaagatgtatgtttgtttgtttcattccatcttgatatcgattttcaattaagcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatattcgacttccgaagatcagcgcaaaacccgacttcaagtccatctgcgacggcctgaaattgcaaatccgcgggattcacggcgaacattccgagaggtaattgtttattgttctgtttttgaaacaattgtcctttacttagcgctggcggcgtttatgacatcagcaacaaggcccgtcttggtctcacggagttcgaagcggtgaagcagatgtacgacggagtgaaacacctgatcgaattggagaagaaagcataatgggaggaccgatctatgatgatgactttatattgcataatgtggagatttatagttgttctgaatctcttaggccttagctatttgtatatatgtgatattcctatattgttcatatcgcgcttgtgtgtaaatcagagttcccaagtgtgcttattttgaggggtcggatcttagaaagtaaaaatgtgcttatttctaagatttgtgcttatttcagcgttacgtgcttattttgtgcttatttttggatttgaaaataaa

SEQ ID NO: 52723 - DNA, 1054 bp, Heterodera glycines
  Genomic contig location: Contig_ID=SeqID_22081; Location=606..1659; Strand=-
  SCN-specific regions: Sequence locations=1-43,65-322,344-580,604-1054
atgagccgatcattttcgaagcgcacgatcacagaacgagtgagtgttgttgatgaatgttttagcatggattttcgagtgtcactgtgttaacaaatccggcaccatttcgaccaatttcgaattctttttctcgaaaaatgaaatttggatattttcttcgaattcttatccaggattcggaattggtcgaaatacggattccggcgatcaatttgtttggacataatatttttgttttccccatttgtgcagatatgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaattttgaaaaaatgcgtaattttttcccgtcattttttcccccacagtcacatttcttgtcgagaatggtgccaacatcaatctgcagaatggtgatggggcaacagcactgatgtacgcgtgttacacgggaaatgtagggaaaaatttccattggtgaaatgttttccaacatttccatttgaattcaggtggacattgtgcgcttgttgctgacacatggtgcaaatgtcgagcaaatggatttcgaaggtgggggattactgttacagtacccaaaaataccatgccacaaatgttgtcctaatttcaggattccatttcgcacttaagagcgctgccattggcggcagtttggaggtgtgccgtctgctggtggaggagtgggccgcagatgtcaaccaacaaaccatccaagagcgatacactccagtgatttgcgctgccagtataggacatttggccatcggtgggaagaaaattgggttctagtgatgaatgacgcggtccctggtattagctagattcagtctctgcaacttaactgagagaatgaacttatacaacctcatctagatcaacattttttccattttatataacacattttagctagttaaatacaacgagcaaaataaa

SEQ ID NO: 52724 - DNA, 789 bp, Heterodera glycines
  Genomic contig location: Contig_ID=SeqID_22082; Location=1189..1977; Strand=+
  SCN-specific regions: Sequence locations=1-789
atggctgttttgtctttcctaagctggtcatggtcaagggcgcttgatcaggggttgcgtgcgcctacctcaggtgcaagcgagcgaagggttgcgtgcgcctacctcaggcgcaagctagcggagagttgcgtgcgcctacctcaggcgcgagcgagcaaagagttgcgtacgcctatctcaagcgcaagcgagcggagagttgcgtgcgcctacgtcaagcgcaagcgagcggagagttgcgtgcgcctacctcaggcgcaagcgagcaaagagttgcgtacgcctatctcaagcgcaagcgagcggagagttgcgtgcgcctatctcaagcgcaagcgaggggagagttgcgtgcgcctacctcaagcgcaagcgagcggagagttgcgtgcgcctacctcaggcgcgagcgagcaaagagttgcgtacgcctatctcaagcgcaagcgagcggagagttgcgtgcgcctacgtcaagcgcaagcgagcggagagttgcgtgcgcctacctcaggcgcgagcgagcggagagttgcgtgcgcctacctcaggcgcaagcgagcaaagagttgtgtgcgcctacctcaagcgcaagcgagcggagagttgcgtgcgcctacctcaggcgcaagcgagcaaagagttgcgtacgcctacctcaagcgcaagcgagcggagagttgcgtgcgcctacctcaggcgcgagcgagcggagagttgcgtgcgcctacctcaggcgcaagcgagcaaagagttgcgtacgcctacctcaagcgcaagcgagcg

SEQ ID NO: 52725 - DNA, 738 bp, Heterodera glycines
  Genomic contig location: Contig_ID=SeqID_3993; Location=978..1715; Strand=-
  SCN-specific regions: Sequence locations=1-591,635-738
atgagcagtttaagaaagggatggaggcaaaacaatgcgaatgatggagaagaactcgaggtcggcggtggcaccgaaacgcgttgtgagaagcaaatcgatgtaaaaggtgagagtggcgaccaagtcgatgatgttcacgggggccttgaaatagtcgacctttgacggacacgcgacgaacctaagggagaaggacggacagaaatggcaaaacgagcgattggccaatgcccaagagtaacggttcagtctcgagtcgatcccaacccaaccccacctgattataatctcgatggtgaaccaaacattgcaaatcgtttcaattatctaaaaaaaggattccaacgatccattgtcacattggcatttcgtaaataatgttttgacttgccaagaagctcgggtgcggttttgagttgcgtttgtccactccgatggactccgtgcgatatttgaagaagggttttgtgggagggggcggagggtcggccggccttttggcggcggaatgattcataaacagcgaatggttcagcagagggccaatctcttccaagtcggccactgcaaagaaaattaatgaatgacatataatcttaaataataaacatttaaaataattaattattttcagccccccccctccgcccacctcttaagccggggtgcgttttgaggcaaaacacgagaatggcacagatcagaaagaacaccgaaatgacggccacaatctga

SEQ ID NO: 52726 - DNA, 1556 bp, Heterodera glycines
  Genomic contig location: Contig_ID=SeqID_3993; Location=475..2030; Strand=+
  SCN-specific regions: Sequence locations=1-379,401-607,651-1325,1347 -1556
  Gene Ontology: Cellular component=mitochondrion
atgacattcacgcaacatcgggacacacaagaagtgttgcaaacgctggacaaattggagttggacgacgaagcgatgcgtaacgaagtgggacaaaataagggggaggcgaggggggaagtgatcgaattgatcagacaaatgcagggggcagacatcggtcatcaacaacaacagatggctcgataatgattagaccggtcgggccaattcaccattttcgaaaagggttgggtagtcagcatgaccgcccatcggcaggggggagagggtgattgattgaactgattggtaccagggccggagggacggtcggactgatcagccaattcaggaagaactttacaagcgcttcggtttcgaggaacagtacaaaaacaaagagttgaactgttggcagaggacgaagccgaaactgtggcgaatgtttgacgagccgagctcatcgacaggggcaaaagtgaggccaaccgctaaactcgggagcaattgttggcattggctcagattgtggccgtcatttcggtgttctttctgatctgtgccattctcgtgttttgcctcaaaacgcaccccggcttaagaggtgggcggagggggggggctgaaaataattaattattttaaatgtttattatttaagattatatgtcattcattaattttctttgcagtggccgacttggaagagattggccctctgctgaaccattcgctgtttatgaatcattccgccgccaaaaggccggccgaccctccgccccctcccacaaaacccttcttcaaatatcgcacggagtccatcggagtggacaaacgcaactcaaaaccgcacccgagcttcttggcaagtcaaaacattatttacgaaatgccaatgtgacaatggatcgttggaatcctttttttagataattgaaacgatttgcaatgtttggttcaccatcgagattataatcaggtggggttgggttgggatcgactcgagactgaaccgttactcttgggcattggccaatcgctcgttttgccatttctgtccgtccttctcccttaggttcgtcgcgtgtccgtcaaaggtcgactatttcaaggcccccgtgaacatcatcgacttggtcgccactctcaccttttacatcgatttgcttctcacaacgcgtttcggtgccaccgccgacctcgagttcttctccatcattcgcattgttttgcctccatccctttcttaaactgctcatcgtcaccctttcccttaagcttcgtctgttcaaactcacccaacactctcaaggcctcaaaatccttctctacacgttcaggtgacaatggcattgtgggaactgtcgtcttcttctccccttttggcattccttccaaattggccaatttcctttccctgcagggcatcggccaaagaattaatgctgctggtctttttccttctgctcggaattgttgtattcgcttccttaatttattacgccgaacggatggaagacaatccggagaatcaggtgaagaagcacaacaaccgaatcgaccatgtcggatga

SEQ ID NO: 52727 - DNA, 1200 bp, Heterodera glycines
  Genomic contig location: Contig_ID=SeqID_3994; Location=89..1288; Strand=+
  SCN-specific regions: Sequence locations=1-1,43-43,120-215,237-1200
  Gene Ontology: Mol. function=calcium ion binding; Cellular component =integral to plasma membrane; Biological process=transport
atatcttggactttacacggaagaaaattataatagagaaacggttcgtcttttggcgagtgcggctgacacggcaaaggacggattgatttcatacgaggaattcagtgcttttgaaggtggttttgccggaacgactcaatttccatatttttaattgaaatcggttttaattgttcgttttagccagtctctgtgccccagatgctttgtaccttactgcctttgaaatttttgacaataatgcgtccgaatcaattactgccgatgaatttgagaaggtggaatttgttttgtttgtatttgcaattgaattctcaggtcatccgccacacaacccctctggtcgaattggattttgattttaacagcgaatttatcaagaaatatttcggcgcgttagttcttatgtttttcccaattcattaattaatttctttttgatttagcaaaaagcagcgctccattggttaccacgctttctgtcaattgcttcacgacttttacgaagaacaaggattacaagcatttaaaaagtaagacttgcagaatttaatttctgagttaatttcatattcagatttgacacgcaaaatgatgggagtattacagccactgacttttttcaacttatgacaacggtcaaaggccatttgctgacggatttttcgagaaacaatttgattgccgttgctggaggcacttcaagtgcgcataaagtgagaacctccgaaaaccgtgcatttgtactcatgcatattccattttctgtgcctttaattgagtgtctttttaggtgcgttttcccttttaccaagcattcaattcgctgttggccaaaatggaactgatcaaacgcgtttatcagagcattgcccgcgggaacattgacctgaaagtgactcgtgaagagtttttgcaggtgttttagcactccatttggtcatttatttataattagtaaaacaatccttttttgaaccatttttaggctacgcaatcctacgctcaaataacgccttatgaggtgagctattgcaattcaaatttgatgctaatcacaagtaaaccttattgtttgcaggtcgaaatactcttccacttggccgagctcaatcacccgggccatcggacagtcgatttgaccgacttggacaaaattgaccctgaacggctgaagcgcgtttcgcatatgatccg

SEQ ID NO: 52728 - DNA, 496 bp, Heterodera glycines
  Genomic contig location: Contig_ID=SeqID_22084; Location=367..862; Strand=-
  SCN-specific regions: Sequence locations=1-496
atgtccgtgtttagcagttcggatggttcatgcaaaaggttcttatttttagtttagcgattaattgtgctctatctctattataatcgtattttaatttcgatataccaatgaatgaatatggggatcaatttcgatttttttttcttgcaaaaaaattcataatctgcgacttggtgaaattgattaaaatataataaatcgttaccaagttatggtttttcagcggggtacctaaaactatgaatgtgccatacctttgtctcaacaaataaaaaaaatttttgtttctagcatcaacagtgaggcggttttcgagactgctgaagatctcggggaagcattgaatctcgacgccggtgttgttgagtggctaaaggaagcgccgcgttcggatgaggacccgattttggtgcttgattacaccgatttgttccatgctcttccaggaactctcaattacaacaaaacctgggtggcgaatctcttggtatga

SEQ ID NO: 52729 - DNA, 340 bp, Heterodera glycines
  Genomic contig location: Contig_ID=SeqID_22084; Location=1016..1355; Strand=+
  SCN-specific regions: Sequence locations=1-302,324-340
atggtcgattatttttttgcacaaatgcactttatgagtccaatcgacttttatgagcccaaaggtatttttatgagtccaatcaattgaaaatacttcgtttttatacaataactttgttcatgttcgagctaaacctatctttttggtatcattcgaaagcaccaagtgtaacgaagctaaaatatataaaatcgcagcgttcatgcaattaccaaaaaagctatggattgagtgatgctgattatttccatttgtaactttctttaaatgttataattctcttgttttctcgtataattacattattaagactatgggctttcgaatgataccaaaa

SEQ ID NO: 52730 - DNA, 823 bp, Heterodera glycines
  Genomic contig location: Contig_ID=SeqID_22087; Location=70..892; Strand=-
  SCN-specific regions: Sequence locations=1-134,168-235,257-492,522-823
  Gene Ontology: Mol. function=pre-mRNA splicing factor activity; Cellular component=spliceosome complex; Biological process=mRNA splicing
atggaatctttgcttgaagtccaacgaaattgtcatgaggagcgagaacggtgcatcgatctgatggttaaagaatttatgatggataaaaaatcagtatgtttttttggtacttatatgttagctgtgcggagattttccaaaaatttttgaaaataaatttgttttatgccgattctgacatccattttgacccaattcgaaccccgaacccggattcgaaaaaaagtcgaaaattcttttttcaccaaaattcacgttaattgctcaaaattgatttttaggggttttccgggtcgggaaaaccgatctgacatccatttaaccaatttgaaataattgaagcgattttgtggataaaatatgaatttttctgaaaaatggaatttgacttttttgttcgaatccgggttaggggttcgaattgggtcaaaacagatgctagaatcgggtttcccgaccccgaaaacctataaaacaaatttattttccaaaaatttttttttgaaaaaataaatttagtaattggaatttttttttagcaacgcgaaagaattaattccgatcaacgcataaaacggttgattgaggtaatttgtggtttaattcttaataggtaatgtcaaaactgtgtgttaagagaaaccaattggctacggaaaagctaatcaatgcctacaaagacgaacacggggaacgcagcaaagaagtccaatccattggcggtccaaacgaattcgccgagttttattctcgtttaaaaacgtttgaaggatgttcatcgaaaaaacccgaacgacactgctcgaacactgacaattga

SEQ ID NO: 52731 - DNA, 230 bp, Heterodera glycines
  Genomic contig location: Contig_ID=SeqID_22090; Location=532..761; Strand=+
  SCN-specific regions: Sequence locations=1-58,97-196,219-230
atgtatatttgggcatatttcagtgagttacagtgcatattttatgcgtttattgaccaaaaaaaaaagattattaaattaaatatatatatttaagagaatcctgaagtagcggcactcccatgggaatgcacttgtgaaattggcgaaaagtacgaaagttttgcagtttcagcgccaagtttgttgttaaacgattattatttttaattaattaaccatttaaaata

SEQ ID NO: 52732 - DNA, 1344 bp, Heterodera glycines
  Genomic contig location: Contig_ID=SeqID_22092; Location=325..1668; Strand=+
  SCN-specific regions: Sequence locations=1-36,91-96,156-156,231 -293,315-616,719-822,847-1344
  Gene Ontology: Mol. function=protein binding; Cellular component =nucleolus; Biological process=N-linked glycosylation
atgagcaattcaaagtcattagcggatttctgtaacgatgaggaagaagaagaagaagaagaggaatacggtggaggggaaacaaaggaaagcagtgaagaggaggaggagaaagaggaggagaaagaggaggaggaagaggaagaggaggaagataggaaaaagggaaacaaagagggaaaagagaaattgagagagaaaggaaaagagaaagaatcaatgggaaaaagtgatcaaaatcaagcagaggacgacaatgttgatcatgatcatgatcagcagcagatggatgatgatccatttgatcaaacacaaaagcaagctgatcaaactgatggccaagcaaaaagcgagcaatgtgaagctgatcagactgattccgagcaaacagaggaagaaacaatgttgtccgacttgaatgaagatgatggaaacggtggggaagaaaatccgaattctcttggatttggatacacggtatttcagggaaataatttttaaaacgatttttttaaatgtttgatttggctagtttcagtcagccgaatgcccgccaaaggaaatgccattaaaaatgctgcaggaaatagaccgaaagaatgttattggtaaatcgtaatttagtaaaaatataaataaaatcaattattttgtaaatcgaaattaaaaattatttttcaatcgaaaattaaaaagaatttaaaacatttaatattttcaatcggaaaatttattacctgtattaacaaattaggcaatgaaaaaatgtaattatgagaattgattggcatatgaaaattgagtatttggcagtttttgaatagaatttttaataaaatttgttaagaagatccttttcagacccggagcaacaccatctgatgggcaattatctccaattgttttggcatgacaatgaaaattttcttccattgtctccacaaaattcggttataatgaaagtcacccaaattttggccaccattgccttttatcgaaattgtgccatggaattgttcgcattgcccgatttgtacacggagaatggcactttttccgccaaaattggcgattatcggcaaaaatgggccgtgacacaaatgacggaaagtgaaacaatgggcgaaaacatttgcaaaatttaccaattcatttacgaaatggtgaacgatgaggagttgaaggccgccggggcggtgtgggagcagtatttggcacggaatgtggtgaaaattggccaaatggaagcgaaggaacaacttaaaaaagtggaaattttaaattggaaaatttaaaaaatggaattaaattgaaattagaaaaaaaacatattttattatggaa

SEQ ID NO: 52733 - DNA, 56 bp, Heterodera glycines
  Genomic contig location: Contig_ID=SeqID_22093; Location=746..801; Strand=+
  SCN-specific regions: Sequence locations=1-56
gctatagggaagctattcccgaaggattcggtctccccataaatctgggcgcatcg

SEQ ID NO: 52734 - DNA, 223 bp, Heterodera glycines
  Genomic contig location: Contig_ID=SeqID_22094; Location=917..1139; Strand=+
  SCN-specific regions: Sequence locations=1-223
atgggggcggaaacaatagcaaagccaacggcaccaccgcaaaaaatgaacacgcattttttgaacagcagtaccacgccacagcaaacgcaccaccgcaacaacagcaagcagccgccgcaaccgcaacaacaaccgcagacggcgcgccgcaactccgctgctcgacggcacacgacaccggacatggcggcttcggccgcatacggaatgggtaagcgaa

SEQ ID NO: 52735 - DNA, 542 bp, Heterodera glycines
  Genomic contig location: Contig_ID=SeqID_437; Location=6282..6823; Strand=-
  SCN-specific regions: Sequence locations=1-258,280-542
gaaaatggcccttttccgttttaatgagactaaaacaaatcgtggaagaagtttgatttcatgtcacaactttgattactgctttgaacgagatgcgcgaatcgcggagggctttgagtattggagatgcccaaggcgtcctccatattgcccaggaagagcaacagtccaaagtgcttggcaaattgatcccgacggcaaccgcttcaaaatggggcgagtgacagcaccccataatcatccacctatttttggccaacacaatgtattaaatatttaatttgtaatcgaaattatcctatagttagccgggatggaatttctatgtcaaacaatacactaaatgatatttaaaagcgaaaagacccaaaactaacaaagtgtttgtcttcagcgtataagccaaaaagtttttgggattgcctaaatagcccatccctgctgatcagataagggaggcgaatgaacgagttcgtgaagaagcgcgcagcgactttcctacgactagccgtaacattgtacgtgatgttcgatcagaaatg

SEQ ID NO: 52736 - DNA, 321 bp, Heterodera glycines
  Genomic contig location: Contig_ID=SeqID_437; Location=5527..5847; Strand=-
  SCN-specific regions: Sequence locations=1-321
atgagcgtcatcattgatcactcagcagttccggtggtctatgggttgatgccgaataaggagttaggatcatacaccagcttttttgaaacaatccggaaccgaattggaaacaattggttccccacccgcatcatgagtgattttgagttggctgccatgaatgctgctggcattgtttttccaaattcggtcagaactggatgccttttccactttggccaagcgttataccgtcgtgtccaacgccttcctaatttgcacacacaatatttgcagaacagggatttacaaacgtctatccgatcattgcaagtataa

SEQ ID NO: 52737 - DNA, 909 bp, Heterodera glycines
  Genomic contig location: Contig_ID=SeqID_437; Location=12130..13038; Strand=+
  SCN-specific regions: Sequence locations=1-126,198-314,353-407,442 -766,788-854,876-909
atggcaaaacgaaagcagcacttcttcagggtcgaactcagtgccggagtgatgcgaaggcgaaaacacacggaaggcattggccgagaactaaagggagagagagaaggtaagaaataacataacagaaagagagggagaggagacgggagagagaaagggggcagagaaagagagggaagaggggggaggaggggaacagagtaaaggaaatgagtaagcaaaagaaagcaaaagatacagaccatttcgaagactgtccgataaacatcgaaactgaatttgtcctttctgatagccaagaaatcgatgcattcattcagtgacactcttttttcctcaataaaatatgttgtatgtgagacaattggaatttgtaaatgcataaatcttaaaatttaagttttccataacagcccacaaaacccacttctttcaaccgcaattccgacaaagggtcattggcaaaatcaaaaaccacggcacactgttttagcttctcgacgagcagaagttgtgctccccgttcgtccttaacctctaaaatggctgtcttatagaagcaaaaatggggacggaccgtcgaaatttgccaaattcggcccgccttctatcgaatgaatttccttctcctggggagattcgtccgtcctttccttcgccgatttaaaaggctgacaaagtgtacctgaagaaaaaggaacggttccaccatttgcggttatttttccaaactgaaacagacttgacacggggaccccctcatctgcagaaacacagccacagccaaagtccttcccgacattttcatcgtttaattccatcggaacaaatgttatttaatagacacgtattatttggtttaaagtaaagaattcgaaatagttatctttttgcaatttggagaga

SEQ ID NO: 52738 - DNA, 872 bp, Heterodera glycines
  Genomic contig location: Contig_ID=SeqID_437; Location=10366..11237; Strand=-
  SCN-specific regions: Sequence locations=1-302,324-622,645-698,735-872
atgttcattactgaactcgaagagattttggatgtcatcgacccgatcgaggtgttttgtatttggttgcttctgcttaattgttcagttctattttagttcaaaaatgtcatggtccctctcttttaccaactttcccgttgcgtttcttcaccgcatttccacgtctttctccccccccccccttttcccctttttaaattcctcttttttgttaaggttgcggaaaggacgctttatttctggaacaacgagtgcattctcgccctgataaggtctttttccaccggtcttttaaccttagatagtgcctattttcatattcagtgaaaatgtcgagaccattttgccaattatgttcccatcgctgtataaaaattccaggaatcattggagcaagtaatcaatcactgctcatggggtgcaacttaaattattgaaaatctatcatttttcgggtttcaaagaaagttttcttttatataaatttttcgaggtggagaacaacgcggggggatttggttaactgcttcggtcctcaagtatattcgataaaaatattccttttaggacgatccacggattgatttacaatgtctgttctgttctgtccggtcactcattttgccattttaccgatttttaaggcattgaaacttttcatggaagagaatcagaagttgttcgacctgtgcgtacagaacttcaacaaacagaaggagcaggagcaactgaagcagcagaacaaccgcagacggtgggaactgctcgaaaaagcggccatggaaaacgcacgcgcaattcgacagcaacagacggacggagaggcggagccgtactcaattggcgagggagagaagaagccaaagtga

SEQ ID NO: 52739 - DNA, 848 bp, Heterodera glycines
  Genomic contig location: Contig_ID=SeqID_438; Location=11..858; Strand=-
  SCN-specific regions: Sequence locations=1-123,145-217,249-394,416 -715,737-848
atggacttcattgaatgtcgccattttaaggccagcaaaatcgaggctgtattggaaacagcacgaattaatttggacgtggacaattcggactgccaaattcctaatatgcaacatttgttctccaatttctttttgcaaacaattttggctctgatgcaccattactttagcatggcatttcaaatgcgtttggtccagccttatgagttccattacatttattggtttgtttgtttttgatgaatatttggcctttttccgttttttttttagcacttttagagagtaggagtcgacaaaacaaaaaaagggacccttttgatttccaaaatatatttgtcggctcctattctataaaagtgcccttatttgtttaggtatttcggggaattcgtattgaaaaatttgagcaatatgtgcgagcaaaagtgcaattctttgataattgactttagcaaaagtaattgctcgaaatcagtgcataaaatttagtcataatcaaaattaaggttcacttcaccagctaaaaaaggtgtcgggtaaaaggcagctgcaaaagaccaaaatggacaatgagtttcgcaagacgctttcgctcatcaaagcgcggtcgcttcatcacaggttgaaatccgacagccaatctccacgcttttcgtctcaaaatttcatttttttaagggcagagactctgatgtgtcaggcaatgtgcagcatgaatttggatcttataatctcacaaagaatggctgtgcccccgggggaaggccttcgctacacaaaaagagtcgaactcttttcatcgataccgcctttgctcttttattcgtacgaagagtatttga

SEQ ID NO: 52740 - DNA, 195 bp, Heterodera glycines
  Genomic contig location: Contig_ID=SeqID_3996; Location=2188..2382; Strand=+
  SCN-specific regions: Sequence locations=1-49,74-195
atgtcaaaggcgatgaagaaggtgggcgaacagaggtcgaaggcacgacttaattgctgccaaaatgtgtttacgttttgtttttttcagctggtcgaaatggacgccaagttggacgaagaagagctcaatttgttgttcactggatacagaaaggcgattaaaattcttcagaaccagttgctcaaaaagtaa

SEQ ID NO: 52741 - DNA, 559 bp, Heterodera glycines
  Genomic contig location: Contig_ID=SeqID_3996; Location=2492..3050; Strand=+
  SCN-specific regions: Sequence locations=1-508,530-559
atgacggtaaaaaacgatcaaacaaatttttggattgtaaagtcttcccattttagatctccagaaggcaaagcagtcgtacgaggaggcgtgggacattgctcagcagaagatccggccatcgcatccgattcgcgttggagtggcgctcaattttgccgttttcctccacgaattcatgaaagggtcgcaaattggctcaaaaggtggtggacggagccgaacaaaactcattttaatcaccaatttattaacatatcccaattttttgcaggctcatgacgacggaaatgctgatctgctggcggagacgacctgcgattcgttcgaagtgtcaatggaaatcctcgagaaaattaacgcgaaattgaacgaatgggcccgtaaacagtaggataattgcgtcccatgtcacatatgtacaaatattgtaaatattaggcatttgtatcccatgtctgtgtatattgtattgttgtggaatcacgctgatatgtaaatgtttgcctattatatatgtatgtacagattcgttgttcattaattcgttcagttgtta

SEQ ID NO: 52742 - DNA, 1188 bp, Heterodera glycines
  Genomic contig location: Contig_ID=SeqID_3996; Location=3483..4670; Strand=-
  SCN-specific regions: Sequence locations=1-544,566-772,794-1097,1121 -1150,1172-1188
  Gene Ontology: Mol. function=DNA binding; Cellular component=nucleus; Biological process=protein targeting
atggcggccgagacgaaggaagagctgttgtttctcatcaatctgtgcgacacgtcggagtgcttcaacgaaatggtcgacgcagtgaaaaaggtgacaattttggatacattcagcagcttctaatgcttttccttccttttcagttggtcagcatttgccccgaattgtcctacgaggagcgctatttgctgtgggtggctttcaaaggcgcgatgtcgtcgattcgtcagccgtggcgtgccctctgcgccatcgaacaacgctctttttcggacataacggaggcgcaacggagcaattcgcatctgctggtgcttctcaaccattctttttttagtgttttaactgttttcattttccaggtcatagagacgtatcgcgaggagttggaatctgagctgcttgtcaattgccgtggagttttggtccgtttcgtgccttcatttttgatatcaatccaaataccatcgcttttcaggagttcctcgactcaactctgattccaaatgcgacgaccaacctggaggccaaggtgttctacctcaagatgaagggcgactacaaccgctacatttccgaaattgcgctgggcgaggacagaacgagtagggaatttgttttgatgttgctaacaaataattcgccattttttcatttcagccgccatcgaagaggcgaagcagtcctacaaccaagcggcagaacacgcagcgcagctgaccccgtccgacccgactcgtcttgctgtcgcactcaacatgtccgtgttctaccaccagctcctgaaagacgtggaccaagcgattcaaatgacggaacgagtgagttttgggctcacaacttaatttattcacagtgaaatttcctttgttcaggctcttaagagcgcgaaggcaatccctgcgacgcacatcgacagcaagaacattatcattcaaatgaagaagaacttggagctgtggaagccggtgaaccccaaacatgccgagacgaaatagggcagcaaagcaaggagatgttgagaagaagaccgaccgatcagatggataatattacaattgtatattccaattatgtatgtcacaaccattgtaaatatatataaattgtatattgttgtgattgtgataaataagggcacttttgtcacaaattttccagaaaagtgtcaaagacagaaataaa

SEQ ID NO: 52743 - DNA, 142 bp, Heterodera glycines
  Genomic contig location: Contig_ID=SeqID_3997; Location=861..1002; Strand=+
  SCN-specific regions: Sequence locations=1-142
aatgaataaaaataattcaatcaaatgttaaaaattcacaggtgataaaaatatagtgtaaatatggcaacatggaaaatcctactcagaactcattgcttttagtaaacccctgaattcctttgccttattaatttgcacc

SEQ ID NO: 52744 - DNA, 729 bp, Heterodera glycines
  Genomic contig location: Contig_ID=SeqID_22096; Location=935..1663; Strand=-
  SCN-specific regions: Sequence locations=1-423,445-729
atgtacataataccgtcctgtattttaccgtcctcttatattataaaaacatacaaggtgataatgcatttctgcaaccagctgcaacacgccgaggtgctgttcgcattgttgaaccattcaaaaagttctgccatttcaatgcgacgagccgctggtgtacaggtttgtggttgcccacgcgcacattgcactttctgaattttcctgcatctgcgggctctcggtatacccgtcggtgcatgcagaatatcatcttaaaaggcgagctttgctaatcgaggatttctcgcagtgtaaccgattcctggacctcgagatttaaatatttagaatagacaaaacgatgagtaagaatatccaaatatagtgcatcatatttgaaggcggattggaagacaccctcccgcatttgagcaagtcttgcttccgcctctttgttttggtctccactgtgtcgaatgtatctgctaaaatgtgttaaaaattaaaaaaatcaagtgtgttttgcataaaaattccaaaaatcctcattcattatcattttcgcctgcacagtcgcaaatcaaatacattgtgaagtgttctgggtaaaatggtcctttttcagataaattgttttgtaagttgtcagtcagttgaataagtctcagcagtgaacttcaaaaaccaatgacgaattaatgaaaacatctacagtaatttgcatctttagtcattcgaaataaa

SEQ ID NO: 52745 - DNA, 115 bp, Heterodera glycines
  Genomic contig location: Contig_ID=SeqID_22096; Location=1780..1894; Strand=+
  SCN-specific regions: Sequence locations=1-115
atgaaccagcagcaagtaattaaaacaaaacgaaataatgataaattggtgcatgatggtgcactttatgtgttccacaaattcagtaacgatggacttaagaaattttggcggt

SEQ ID NO: 52746 - DNA, 1484 bp, Heterodera glycines
  Genomic contig location: Contig_ID=SeqID_22097; Location=158..1641; Strand=-
  SCN-specific regions: Sequence locations=1-180,203-324,346-413,439 -471,513-523,584-838,877-970,991-1163,1185-1259,1340-1390,1413-1484
atgcctaagaaaaaatggctttgccctgaaggaattcgtggtgatcatgcccacaatgaaacggtgcacaaatgccggattctaaaatttgccaacaaagcattgcgcaattatttgagatttcacgcattaagagtttttaatgaagaaacaaacggaatggaaaagttggcatttatacaaaaagaaggtaaataattaatgcatgcgggacgtgagatttgacttggaaattaaaaatagttagattataggttcttaaaaagtggtttattgtttgcgttggggtagtgcgctggtctcaattttttcggtcacaggttctaacccactgcatgcaaaaaccatttaacaatttttatttttgcttttttttatgcaaagtcaattatcgaaaatatttttatgaaaccaaatttttattttttattattttaacaccataagatacgcaatgaagaatgttagacaaaatcaatttattttaacttaaaggagatttactgcttctttacctttaatgaattttttgattttaatgaaataattaaaaataaaggttttattgataaataatttttttgataattgacgttgcataaaaaagcaaaaataaaaattccgcaaaaaataaatgctctatccacccaccaagtttcattcagaaaccccacggatacctggggaccttcctttgttagataaatcctaaaatagagaaatacttattaattttgcaactcagggggctgaaatttttggaagtcggaaatgtgagcccaaaaattctgaagttggaacttagactttatcggagtttacaaaattttattggttcttaaaatttaattttatttaaaaatttattgaaaaattgcctataagcggtatccgttttgagttatttttttaaatatatgagttttggtccactgttaagttgcatagagtgtcattctgaattggcaaaatatatatatatatatatattttttaatttgaaaaagccgaaaatttaaaaaatttttagaccttttggagaatttggcgttgaagccatcatttctctcgagttcgaacgacaacatttcggagataaaaatcatattgttgaaagcgtacaaacattttaacattacacctgaagaggaaaaccttaatgaatttgaaaaaattacgcaaaattttgctaataaagaaaattatgaaaaagtgcagaaactggtcaaggcatttaaaatgagcagagtattggaacgtaattttattctaaagattttttaaaattaaaaaatatatttgtccattaaatattcaattaatgaataatttattttttctatggattattaagaatgacaagtagtgtctaaaattgacataagaaagataaaatttaaccaaaattccttcaaaacccattaaaaatttaatttacaaatttaaacaccatacgccaaactaaacggataaaaattaataaa

SEQ ID NO: 52747 - DNA, 395 bp, Heterodera glycines
  Genomic contig location: Contig_ID=SeqID_22098; Location=176..570; Strand=-
  SCN-specific regions: Sequence locations=1-12,172-184,318-395
atgagaggaaaaaggaggaagaggagacgaaaggaggaagagatgaggaggaggaagaggaaaagtgagaagatgaagagaaagggtggggaagcggagaacgatgaagaagaaaggaaggaggaagaggagaagaaagaagagggaagagaaagaggaagaatgggaggaaaaaggacgaattggggacgaaagaagagggcagtagaaagaggaagagatgaggaggaggaagaggaaaagtgagaagatgaaaagagaacggcggggggaagaggagaagaaataagagggaggaaggcaagggtggaggggggctcaaaaatacacaaaatttggatgggattttctaattaatgaggtctttctcattactttgcagttatccattctag

SEQ ID NO: 52748 - DNA, 996 bp, Heterodera glycines
  Genomic contig location: Contig_ID=SeqID_22099; Location=374..1369; Strand=-
  SCN-specific regions: Sequence locations=1-9,35-57,81-561,583-642,664- 726,749-935,957-996
atgacccattttcccccaaattttctccccaccattttcacccgcctcctcctaatcattttcataattattattattatcgacgaaactttgctgtccaaaggtggtgaggcagcaccacaagcagatcacaacgaaagcatcaccataaaagcctattttttgagagaaagctctctagcctagtcccagtctctgccaatgccaaaaaatgtttcgctgattgcgcaaagcttggacatacccttttaagtcaaggtgaagcataacataaagctcagaacaatcaattaattatttggccctatagaatttagcaccacattttttcatttttcaaaaaaataccaattaatatttaagggtcgctgatcacgaatccgacatccgtttgggacccttttgccagaaaaaaaggtggagcgtaaactgtataagggacaattattttcaaagaaagactctgcgaattcccatcctgctgtggattttcatggaaaaaagagcttccaaactaggcctggttccggaggcctacaaaaaatttcgcaaacattgagaattgaaaaatatatattaaagcgtcaaaaattatgttttgcaaaaactatgaaaattgggaactttttcagttttctggccaaatttagaacttttaaaaaatcaacagaaggcgcttataagtgcaaaagcaaagcaaaaaaaaaaaaaaacggcggcataagtgccaatttttaacaatttccttcactcttttcagaagtggaagcagaaaaaaacgacacttattacacatttcccttttcattgaaaaatgatcaaaaaatttctactaatgaaggagctgaatgtaaagattataaagataaagaagataaggaattggaaaaactgttgttggcattgatggatcgaaaaaggaactatgagaacgcgaagaatgagttggagaagaagcaaacggcacaggacagtgtgtcgaaaaatgaaaaataa

SEQ ID NO: 52749 - DNA, 534 bp, Heterodera glycines
  Genomic contig location: Contig_ID=SeqID_22101; Location=1417..1950; Strand=-
  SCN-specific regions: Sequence locations=1-534
cggggcagtccccccgaaccgatgcgcctagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcattggatttttgctccccataattgtttgagtaccccaaacggacacttgaaaaaatcgatttttttgttttcggggcagtccccccgaaccgatgcgcccagatttatgggga

SEQ ID NO: 52750 - DNA, 274 bp, Heterodera glycines
  Genomic contig location: Contig_ID=SeqID_22102; Location=595..868; Strand=+
  SCN-specific regions: Sequence locations=1-58,102-172,211-212,234-274
atggcaattttgtgcattttattgatgcatatgtaagtcagaggaaagagaaaaggctcaaacaaacaaacaaaaaaataacaaaataacaaagaaccaaagattacggcgggggaggacgggagggggaagtatcagctggaaatcacgcgaacaaagaagcgggtggcagaaagaaaagaaagaagggcacaagaaaagaaaagaaaatgccagaattatttaagaaaatttaaagaatttcataattattgtgatagaatttgagctctca

SEQ ID NO: 52751 - DNA, 1172 bp, Heterodera glycines
  Genomic contig location: Contig_ID=SeqID_22103; Location=92..1263; Strand=+
  SCN-specific regions: Sequence locations=1-106,150-246,316-482,526 -601,624-964,986-1103,1134-1172
atgtccgccaattttgcgacgaaaaaattgaaccaaatttcggagttatggcaacacatggcttttggagaggacagatttaacgaattggacatttacaatttggtatttttaattttaaataaattgcaaaatgaattatttatttagaaaaatgaaattgcaaagggaaataattatctgatttttgatgtaaatcaaaaagccatggttgaaaatataatcagagaaatggatgaacttctcaaaaattgggtaaatatttaataaatttgttgattttttaaaacttgatttttagtcatcaaaaataaattgccatttctccgacgaatggctgtttagacccaaagaagaagcgaaactcagtgccatttgcataatgccatttgaatttgacatttcgtcctttttgggcacttatttttcgagtaattcgtcagttttccatgaccaatcgctgttctgtcgactgtccaaagtaaataatttattttttcaaataaattttaaattctattttttcaatttccagaaggaaaatctattggcactccaaagaattcaaaaagattatttcaactccgtgccacaaattcatttcacttaccaaactctgcctgtaaccattatggccattttggtaccaaaccttggccaagaagtgccaaatgggccattggatgaccaaaaaatcaaaacaatcgcacaaaaatttggcgatgaaatcgaaaaattgatcagagctgatcatctttttgacgaaggccaatttcgaatcagccaaagagtgaacgaccaaacaatggagcagttggccaattcaattgttcacgcaggtaaaagggcggacaatcaaaatgaagagataattaggtaattaactgagtgttaagtgccaaaagaagcggccaaaattatgcaccaatgggtaatgttcgatcagttaaaagacctgctgttgaaggaccgacaaaaagcaatgaacctgagggaatctgtgaaaactcatttggccatgataaaggcatttgcaagtgcgaaaaatgccaaataaagtttaaaacccaatttttgaaattttagactttacaactcatgcaaaaatttcattggtttttattggacaaattggacacaacacaaaaagaagcagccagcactgtgcttaa

SEQ ID NO: 52752 - DNA, 605 bp, Heterodera glycines
  Genomic contig location: Contig_ID=SeqID_22104; Location=353..957; Strand=+
  SCN-specific regions: Sequence locations=1-92,117-364,407-605
atgataattttagcattgaaaactctgcgaaatgaatctgagaaaaatgcgctaattgggccattaatcaacaaaacattcagccaaatggtaaaataaaaattaatttcataaattgttccattaagtatgagcacttcattgttgtcatttgcgctgctccgaattatcaaattgaaacttttgctaattttgttggcattcgaattgggcacgaattgccagaaataatcgaaaatccgttggaaagatggattaagttttgccatctgtttgcccgtccaatttcacttggcgaatgtaataataataataataatgcaccatctccaaaatcatcgtcgacgtaaaaacatttttatgcttttaatttaatatatataaatttaaaaaaagatttatttttcagttattgtaaaaagatttggctggtcggaattgaagtgaatgagaagcaaaaagaattgagcaaatttcaggacaaaatgcgagaaaagcttaaaaagaaattggccaaaaaaatcatcagcaatttcgagggaagctttgttgaaattgaaacggactatgtcaatgagcgggaacagctccaaaaattgtggtga

SEQ ID NO: 52753 - DNA, 493 bp, Heterodera glycines
  Genomic contig location: Contig_ID=SeqID_22105; Location=903..1395; Strand=+
  SCN-specific regions: Sequence locations=1-305,328-398,420-423,450-493
atggcgagtcattccgatgaatacgaaattgatgaattttggttggataacattgcctatgatgacggcgagccacgtccaaagtcgaaaaaatgcgaaattattgcagggattgaccttcaaagtcacagacaacggcgagagtgggctgaaagtcgaatcttccgtcaatactacgatattattttggatggaaatggaaatttgactaattatgtaatatgcaaatcctgcgtgccacctgcgaaacctgttacatttaattatgccgggtttcataatttgcggtatattaaagactttaatttaaatatttttggatttgaggagacatttgaaaaattggcatgggataaaatttggcacaaatgacaaatatgacaaaatggaattagcattggttgaattttgtgttgctgatggacgtcccttttcaattatcaagggcgaaggattcaagcatttcatggatgcttatgccgaattaatgtaa

SEQ ID NO: 52754 - DNA, 783 bp, Heterodera glycines
  Genomic contig location: Contig_ID=SeqID_22107; Location=347..1129; Strand=+
  SCN-specific regions: Sequence locations=1-90,112-134,306-341,518 -711,748-753,775-783
atggcatacaaatgcattgatatgggcataaggttattgggaaattggtttggagaagaataaagaatatattgttgattgaattcgaaattgtaatttaaatttaaaaaggcacttttggaaaagcaaattcgattttttttttttttgattatttaattgatttctattttttcttatagatttataaaataaaaattatgcatttatttttataatcatttttcttttgtttaaatattttattttaaaaattatttcaatgaaaattatttataaaatatttaaagaattaaaaaattttagctccaatcatttcaaattagcatcataaaattggaaaatgaatgtgagttaagttaattttaaattttcaattaattaaaataaatttaaaagatttctcttaaaaacaatgaatgtattaaatgtatttataaaaataaaatttaaatttattttgaagctaaatttaatttgactaaaatttgtattaaacaatgaattaaattaaattttaaaagaaaaaaaagtattccagaggaaattcgaaaaaaataatttataattggaaaatggcaatgaaattaatcataaactcttttaaaacattgaagaattgcatcaaattttaccagggatacctagataacaggagactattttaatctgtaatttaatactcatatattagaaataacaatttattcgatttttaaattttaaaaattcatgtttaatttataactcttcaaaaatgctcagaagtctcatcaattaata

SEQ ID NO: 52755 - DNA, 824 bp, Heterodera glycines
  Genomic contig location: Contig_ID=SeqID_3998; Location=3525..4348; Strand=-
  SCN-specific regions: Sequence locations=1-136,158-665,687-727,749-824
cccgtttaatccataaattccgtttattgtggtactttcgccttgctgcaattccctcatttcagaccctcaaattgacgccgtttgttgtgttgggatggagcgaagggggcagaacatcgatacacgtggcaggccaagggaagggcctggtcagccacatggtactgctttcgtccggctcccaagtggacatgcggggagacttggcattcaaaggtgttggaattcctatttaaaggaaacgtattctttaactcattgaaaggcatgcgaaacacggaccaatggatgcccgcggcaaaggcaccctatttggagcattattccaacgaatttctcaaggaacaatgggccggactttgcgatgttgtagcaaagtgtgtgcacatgaatttttgaaattcgacctaatagtcaattaatttatcaaattcctttttatttttgaattaaaagggaaaaaataatcgaaacaaaaaagcggttaaatctttttaaatctgctcatttagagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggttttcgccatttcatttcttacaattagcaggaatgtaatttttaggattgaaatacatgcccagggagggcacgaccttcacatcaaatacccacgttggtttgctttaaaagtgactagttttgtgaaggaatcggcgaaaagtgatgtgaaagcgaataggaaa

SEQ ID NO: 52756 - DNA, 631 bp, Heterodera glycines
  Genomic contig location: Contig_ID=SeqID_3998; Location=2269..2899; Strand=+
  SCN-specific regions: Sequence locations=1-90,112-631
atgggcgctgaattcgtcaaacggcacggagaaaaagctaacaaccgaacattacacgaattgcagcgtctcgccatgcttctcaaccccggccctgagaacaaacagtgcactcccatccagcggtgcagtgacgttgcggtgtcggcgaggccccagttccccagcaaatgtccgttggatcggctcgccactcgtctgatggattcattccccaccataacgctaaagtagcgagtccttctaaccacattttcaagtgtaaaatctgtttttcccagaaacaatgaaccgcttactctcactgatgccactttttccatggccaaacgggcactgctggcggcgcaggagcgccattcgttgggagtgaataacacacgcggggactctttggcctccgaagctcccatcgaattggtgtgtattgtctattaatacattcaattgctttaccttctcacaatcaacaaaatttcagaacccgcttagatcgatcagtgaccaaaccatgtgctttttccgcgcatcggaggacgaagcggcgaattattcggatgaccaaaacggagaaatttcgatggacgagtcgccaaccgctgacatttatgtgcgtaacacaactcattaa

SEQ ID NO: 52757 - DNA, 769 bp, Heterodera glycines
  Genomic contig location: Contig_ID=SeqID_3999; Location=2211..2979; Strand=+
  SCN-specific regions: Sequence locations=1-746,768-769
atgatcttttccaacaattcttcatccaattcaaaatgtctcttttgtatttcatcgttgttcgttctttttgctgttctgcgtgagttgtttttagtgtgtattgctttctgaatttgcttctttctttttcagtatttccctcctctgaatattcgtcggtcgatgccactcgaattcgcttcaggccgaaagatttgcagccggcgattataaatcagacggagttatggaaacaaagtgtgttcgcttcttttttgctttttcattccaccgttaattcacacattactttcagaattgaagcgtcacgcaatcaaccgggcaagaaaactcgccaaacttgacaaattgccaccaattccggaggtcaaggtcaagcgtgtgatcagaaatgccaagggcgagtacaacccttgcagtgttgttgataatctctgtctgaatggtggcacatgctactccgataacgaagagtgagtgcgctggcagactagaaagcttcaacaaatatatgcagttttgctcaattttttttaaagatagtcatgtcttttagggcgtcgtataatgctgcataagtcgcgttcaatcgaagtcgaaattcgtacgtcttccccagtgcgacatcgactgcacttctcctcaatatcgccctaattgataagtgacgccttggatcaactgattcaataataatatcactatttgactgactaataatttttgatagtaatttgggtcgtttttaacctttttgtatttttaa

SEQ ID NO: 52758 - DNA, 1026 bp, Heterodera glycines
  Genomic contig location: Contig_ID=SeqID_3999; Location=1..1026; Strand=+
  SCN-specific regions: Sequence locations=1-43,65-402,424-1026
  Gene Ontology: Mol. function=hydrogen-transporting ATP synthase activity, rotational mechanism; Cellular component=proton -transporting ATP synthase complex (sensu Eukarya); Biological process=ATP synthesis coupled proton transport
gaaacgagtttttggatctatgatttttgacattttcttttatttcttaaaatattgctctctttattccaagaatccccttcaaaattctccgtgttttcaaatctcccgttttatttgctcctttttttgcagttacgtggagtattcgctggcccagttcctttactatgccatgaaagagggtgcgaccagtgaacaggcgtcgcggatgaccgcaatggacggggcgagcaaaaacgcaggcaaaaaatcattgattagcttggctaatagccatcccacccgaaaagggcgcttatgcggaatatttcgaacttgatgaaatgcttataaatgctgtgtcattggacctctgtttatagtctgaattcataattttagagatattgtggctaattaaaaagtaaaactctaattttattaagggaatttcagtaacaaaaaatgtaggaattttttcccctttttagaaaatccgcaaattttttattttcagtaacacataaaaataagaatttttacggcaacattatgtccggtgacgttttgagtgcactttgtttcgaaaaaaacttaactaccaaaaaaaaacttccaaaaattgctcttccgaatatttttggtcgtaattattttgaaactaacgaattattcgaaattttttgctatggaaaaagatatcccaaaacaggcccgggtcccagtttatccccagcgacggaatcgactttttaatccaatgatatcgcatttacatgcagttccgaaagttaccattttaggcaacatttgaatttttggcctaatttgcgctgagatttacccacaccggcgcctctttacgcttccctttttcaaaaagaaaaaactgaaatacaaaagaaaatgtatttcataataataaactgatttgaccaatgttaaggcgagatgattgacaaactgacgctgcaattcaatcggacgcgtcaagcggtgatcaccagggaactgatcgaaatcatttccggcgccgctgccgtt

SEQ ID NO: 52759 - DNA, 628 bp, Heterodera glycines
  Genomic contig location: Contig_ID=SeqID_3999; Location=3132..3759; Strand=-
  SCN-specific regions: Sequence locations=1-174,196-196,218-548,570-628
atgcttaaaggatgtctgtacattatcttagtgctgattgctgttagtttgattcggttgggcaaatgttagaggcgatttaagccttttggcccttaatttctcctgaaaacttagaaattcaacataactctgcctaaaagacatatttctattcgcaaaataaacagaaatgtgaaaaaagatttgttctttcttatttagcttattttatcagtttctttttggtagttgttgagattttgttcggttttcaaaagtgtccttattttaatgcaacaccccaattttgaaaaaaaatcgtaaaacttttttccgtcatcatttcggtttctcactttcagaatcttaatattttcagaatttctacgtacagttaaaaattcagctcgatcggttcatgggaagtggtcaaactcccaaaaaacagggtgtccttattctaatgcaaaacagtgtacaaataaaatatgtgacacgaaaagcaaatgatcaatcaaatcattatttttttcgtcaattcaaataaattgataacaataattgtaaaatgaaaacaaattattaagaaatataatatatgtaagggatgccagtcgtttttagccttgtaaactacacgaataaa

SEQ ID NO: 52760 - DNA, 894 bp, Heterodera glycines
  Genomic contig location: Contig_ID=SeqID_3999; Location=4300..5193; Strand=-
  SCN-specific regions: Sequence locations=1-116,140-260,282-848,870-894
atgtcacaaaaattaactgatcaaggcgcggaaaaaagaaagtcctctggaccacaaaatttgctcaagggagaggcgcaggactatgaggagatattgagttggttataatttctttataatttaagtttttggaaaagctttcaattataaaccaacgggcagattatattgtgtttaacaatattttacactataatatctattttttaaattgtagtggatggatttttctggttgtatgaaacgtgttacttcgatggaacctcttcgagcagttccgcagcatctgtaagttttggaaattgaattgaaagcatgcttttaaaatgttatttaatacatcgaaattttgaaggctgcacttctgccaatcgctccgcaagtggcgccgccgattgacccaccagtggctctgccaatcgctccgcccattgctcctccaatggcaccgcccattgctttgtcaattggcccggtaatcccctaatacaaaaaattcatcagaaagtataaaggaatcaaaaaaaaaccttttggaaattgaattgaaagcatgcttttaaaatgttattaatacatcgaaattttgaaggctgcacttctgccaatcgctccgcaagtggcgccgccgatcgctttgccaattgacccgccacagccgccaaacaatgctgagcgtattgatgagcttatcaaattagcgagtcaaatgcgtaggatggatcggcggattcgtcgcctcgagcgtatcgccagtatcgccatcggcgcacttttgacgacggcgcttggaactgttctttcgttatttaggaaataatctatatattgtgaaatggtgtttatgcattgatttgttctttacttttcctcgctttgtgacaaaataaa

SEQ ID NO: 52761 - DNA, 408 bp, Heterodera glycines
  Genomic contig location: Contig_ID=SeqID_22109; Location=692..1099; Strand=+
  SCN-specific regions: Sequence locations=1-384,406-408
atggctcatcccccgctcaatcactacgtaatgccaacgccaatcccattattcggcgggcgacgatttgcccctcgggcgaacttcccgcggtgcgacgaatgactgaaagtgaaatgaatgaaaaaggggggggggggggggagaccatcgcaggcaaaggcattgttcgtctgtccctctcctcccaatagcccggggattgcatggatttgatggcttcacaggtggcgcagtgccaaagaaaggggccaattcgaaggagggaaattccttcgtcggctcaattttaagaagaaactgaggaaataattattgtcctgaagataaagcataaaactttcagagaaacgcagaggaaatttgaacacaaatgttaggacaaattggaaaagcaattcaaattca

SEQ ID NO: 52762 - DNA, 90 bp, Heterodera glycines
  Genomic contig location: Contig_ID=SeqID_22111; Location=36..125; Strand=+
  SCN-specific regions: Sequence locations=1-90
ctttgcacccatacttcccccggaaccggaagactttcgtttccgggaagctccccaccagggcgaataaatccgccggcggatcgctag

SEQ ID NO: 52763 - DNA, 78 bp, Heterodera glycines
  Genomic contig location: Contig_ID=SeqID_22111; Location=481..558; Strand=+
  SCN-specific regions: Sequence locations=1-78
cttatcttccccccggtgcccgcacttacagttgcgcccattgccgtgccaatttggcccatcacaatgagctgatct

SEQ ID NO: 52764 - DNA, 1002 bp, Heterodera glycines
  Genomic contig location: Contig_ID=SeqID_22112; Location=79..1080; Strand=+
  SCN-specific regions: Sequence locations=1-221,243-328,361-433,456 -505,548-620,643-1002
atgggagaattgctcggcatttatcagttcaattcccatccttataatcttcgtggagaccccgggctgtactcgttgaaattcccaagccatggccgaatttttgattggaacatagccaaggacaaccgaagggggacacttgcattgcaaattgaagaagtgtcggaatttgcgggagagtctgtctggagtagacgattaagtgatgccgtggagataaaaggattggcattgaaaattagagcactaataagagaaaagagtgaaggcactgatgagaagaaatgcttgggattttacttatggtgcgatccaaaagaaggtcatattttaataaatattaaaaaaaaaaattttgatcaatgataggagggccgaggaacagcgttttttcggcaacatttcgaattgtatcggaaaagatcaaagtggaaaattccattgggaaactttatgataatgttattgaccctgtatatcaatttggattcggaaattttattacttttttagtgagtgagaatttaactttgccttaattggtctaattatggttacttaaggaattaatggacccaagaaatggtttttacgacagagaagaggacaaagtgatattggctattgatgtcattctgaaagatgaacaaatggagaaatttatttccgatccgaacaaatccaatggaacaattttaatggacattgaaaaagtgtcggaatttgcgcgagaaatcattgggagtgaacgcaaaagtgaagctgtgcacatcaaaggattcccatggaaaataagggcagaagtagaaaagaaaaatgacaatgagaaatggttgggcttttaccttttgtgtgccgctccaaaaaaaggtgcaaaattaaagttaattgataataatagtaattaatttgcattgtttagaaaattggagttacgaatgttcttcaacttttcgaattgtgtcgcaaaagagtggcataaaagattctaagagagaa

SEQ ID NO: 52765 - DNA, 895 bp, Heterodera glycines
  Genomic contig location: Contig_ID=SeqID_22113; Location=558..1452; Strand=+
  SCN-specific regions: Sequence locations=1-77,133-166,190-202,265 -346,369-435,465-547,570-724,788-895
atggcgaaccaattctccttgttctttttgctcatcattttcaatggaatcatgagttacgtttttgttccggtagcattttttattattttgctaaatatttaatttctatttatataaaaaaatatttttgtgggttttaggtgaagttttagggaaaaaggaatattaattattaattttgaagatagaatactactagtaattttattttaattatataaatcttttttttgaaatattaaaaaaaaatacaaaatttttctattcatttgcatggaagagggagcaaaataatttttttgctcacaaatcaaattccagtagggagggtgctccaaattgctatttgctttgcccttaataatatttgttcagtgacaaatgagcaacttttccattaacgtttaaccactatttttgtgtggtgaaatgtaaaattttcaaaaaatttatttaaatttgatcaaattcatttcttcggtggctatttgacaaagaatatttcttctttagaaatgtgttgttttttaattgaaattgatctgccctttttaaaaatttttagagacgctgctatcaattctacacgactgatgatgatgaaattgttggtgaagaacaaaaatggtcccgcacagattgtcaataccaagttggatttacgttcgtgcagcttaagtctaaatgctattttatgaactgctcaaatggtattttttcgaataaaattttaacaattataatgtatttatttataatttattctaatatacttaatttaaatcaaggagatactaaccagaaaacatatgggtgcgccactgatttcgattcttcctataatgacaaatgctttccctatgaaaaggatggtaatgcttgctggatttga

SEQ ID NO: 52766 - DNA, 1056 bp, Heterodera glycines
  Genomic contig location: Contig_ID=SeqID_22115; Location=239..1294; Strand=+
  SCN-specific regions: Sequence locations=1-394,416-998,1025-1056
atgtgccgaacccttcgcagcgagcgcatccgaacgccgtccgaaatggaaaactcactgatgctgctgcacagttacaatttggtcaaagttttgttgaaaaaaggcgacaattacgcgggcgggcgattgctgtgccgagtggtggccgacatcggccaatttcccgcacgtccgtgggaagggagtgaatgccaatcgcaaaaggttggaccattcagatgccgtgccgattctgaccagtgccgtgatcacgtgcacaaaaggtttctgctgttagtgctgagttcggcggatgattcccccaattttaacaattgaagccggcttcaaaaagtccgccttcaaatttgcttcccaattgatgcagccgacgaaccgacaaaaaattgacgagaaatacaaaaagaaaatcgagctggtgatcaggtggctgggctcgggcggcactgatcagccaataaatgcctttttgtgcacagaaaattcggccaaaatgcgcccgacgttgaggagcacagcgcgccctgtcccttctgcgacggtcccgtgaaagaatttgcgctgagctgcacggaatgtcaggcgaccattccctactgtattttaacggtaaatgctgaatttattcgatttaacgacaattcggaaaaggggcgacacattgtgaagacggactttgccctttgtccgcactgccaattcccgggaagtttcaccgaatttaacaagtcagtgatgagtgaatttatggtaaaaatgaagcaacatcagctcaacatattacgtattaagcatcaattattggtattagtgtagcttcatttaagtgcaatagaatcacaaatattttaaaaagcgtttagtcagaataattcaatgttaattttaataattgtaatttttaggtatttaaattcaagttgcccaatgtgctacgaaacgataaccgagcaaataatgccaagcaaattcgaacaatttatcaaagacaattctttttaaaataatgtgtaaaatcatgcacgcatttattatttaacgacaatagtacaa

SEQ ID NO: 52767 - DNA, 58 bp, Heterodera glycines
  Genomic contig location: Contig_ID=SeqID_22118; Location=891..948; Strand=-
  SCN-specific regions: Sequence locations=1-58
tatatatgttatataggttttgagtttcgtttcaaaaaacaaaatctcccggccgaag

SEQ ID NO: 52768 - DNA, 1452 bp, Heterodera glycines
  Genomic contig location: Contig_ID=SeqID_4000; Location=423..1874; Strand=-
  SCN-specific regions: Sequence locations=1-83,105-222,277-498,520 -790,838-1096,1128-1264,1291-1452
  Gene Ontology: Mol. function=RNA binding; Cellular component =cytoplasm; Biological process=reproduction
atgaaatccctaaaagtgatgtggattcactgaacgttgctttggatattttaaaatccgtcataaacgaatgggtaaagttgaaaatgattgaaatattttgacataaatacgttcgaaagattaggtctcgaaaaaagtttctttgccaaagtctttttataagttcactcaaattcccgaaatttcgttacaaaacgaaatctttcactttttaagaagaaaataatgaaaattgttttttaatttttttttatataaaaacaaaaatttattcgaaaatgactaattgtaaggtataattattagttttacttgatatattttttggtaagttgatgaaagttttgaaattttacagattactaaagaacacatatatcaatctatcaatgttaaatttagttggttctgggcaagagttaatcattttaaatccatttggcggcgttcttatgaaaagtcccacccaatagcacagttctgctgttaatagagggaaattaattagtaaatgaatcatttgctcattttcagtccaatggcactgctcgtctcgtcgtttcgggctcacattttcttggcacgcgctcttccgactcggacattgacaccatttgcgtggtgccacaaaaagggtcaattggggaggaaaaggctaaattttccggcactttcacctgtgttttggcaattccattggaacagcgaatttgtgaggacaattcgctgtactgccgactttgcaaagtgagcaaaaataattaggagacagaatgaggagaaaatcaatttaatttaaaatataaataaaataaattaaattttcaaattttacattttggcattttttagcaccccaaaataaggcatttgagcaaatttccaagtgcctatctccatttgatacagctgaagctgttcggtgttgagttcgatctttctttggtctctgtgccggacatggaatttctgccggacgaaccgttagaaccgatcgacgtggaattgatgatggaagtgctggccaatcaaaggatgccgtccgaagttatgatcaaatcattagccggtagggaattcaaatggaatagcctaaaaaaaaatcaattattaaatttatatttggaaattattcaccttcaggctatttggccaaccatcaaatgattgggctaattgccgaaagaaacagaccaaagttcagacgttttgtcgtggccctaaaacattgggcaaagagtgaacttttgcgcagaatattttttgaaaatgaatttatttattttagggtctcatatttacggaaacatttttggctttttcaatgggacaattttgtgcattttggcggcaaaagtcattctgtggtacccaaacggatcagtgcaattcttattccaaaagttcatgttgatctacgcgacttggtggctttatccattcatttaa

SEQ ID NO: 52769 - DNA, 804 bp, Heterodera glycines
  Genomic contig location: Contig_ID=SeqID_4001; Location=100..903; Strand=-
  SCN-specific regions: Sequence locations=1-367,389-477,499-761,783-804
atgtatttggagcaaaagacgggcagtgagcagcacataatcacagggacgcgacttgctttgccaatgcttctcattttcgtaaagtgccaaactaagcaaatgccgcaatctgtcggcaccaatcaaaaaacgcttcagcaatcattaaaagagaagctgaaacaaattcgggctcaaatttacccgaaaatggggcaagcccatcacagaatttgggcgttgtgcattttgcaacagtttatcaattttattagggaaataaaaaatgaagaagtgatcaaaatgaaagagtataaaatccagcggtgggacggagaagaaaaatgtgccgatgttaatgagcaaatgcgggcattcaatgtgcgaatgaatgaataaatggcttattaattaatatttatatgggtaattagagggcgggagttgagccggtagaacactggaccggaaagccagaagagacgccggttcaagtccggtccgcccattgtttttcaagtacttagtttaccctacctaaaaaatcagaaattttagagattcgagacatttttagggctaaataatttatctgtattgttaataggaacaacactttatgctcatggcttttcaccataaacatttgggcagtttaatgaaaatcgatttgtacgaagtcaaagaattcatcgcggaaaagcgtggggcgcggacccgactgaagaaattaattggggaaaagcaattagcactcattagtgttgagcatggagaaaaaatgagaaacaaagaaggtaatcatttggagcacagaataaa

SEQ ID NO: 52770 - DNA, 526 bp, Heterodera glycines
  Genomic contig location: Contig_ID=SeqID_4002; Location=803..1328; Strand=-
  SCN-specific regions: Sequence locations=1-37,68-85,126-526
atgacttcggaacgaataaatcgaaaaatcatctctctaattttatttttatttattattttaatttcgtcaaatttcgttctcagtggaaaaaacaaaagggcaaaagtgagtaaaagtgagaagcaagcgataacagcagaacgaaaatcagtggcaaatgagcaatttaaaggcattcgaaactcagtgaaattgacgcaccaatgcccaaaaaaggaaaaaggcggtgaaaattggccaccggaagaaacggaagaaaatttaggttttataaataaatcagcagaaattagagaataaactatgagcattttaagggtatgaaagaatcgaccagttcaaaaatttcattcgacaattgggcaatgtttcgtctgaaacaaatttgagattgcgagtgaacttggccaaatggaatttgcagagaaaaattgatggaatgttcgcatttgccggggaattgggcgagaaaatgaacgaaaaagaatttttggaagaaatggaaaagcaaaaaagcgaatga

SEQ ID NO: 52771 - DNA, 2120 bp, Heterodera glycines
  misc_feature (2054)..(2054): n is a, c, g, or t
  Genomic contig location: Contig_ID=SeqID_4003; Location=216..2335; Strand=+
  SCN-specific regions: Sequence locations=1-11,33-99,124-346,371 -462,499-524,546-663,687-934,956-1019,1041-1723,1748-1807,1829 -1832,1854-2120
atgacagtgccgggaaaaagaataagaccatcgggtacacctcagcagttgggcgctcatgtttgggcgccagcatgtttttggctaacattattggtatcatttttaaattttttcttaataattaacttacttcaaaagccaaaaattcttttttattttttgtaaggctaatagcgtttgttaagagcttatcgaatgatgccaagaatgttggatttggatgacaaataaaaaaaagttatagtggaaaaacgtgctggcgcccaactgacaaatgagcgagtccgatactagagaccggcgcgggacggaatcccgcgcgggattttgcgggatcccagtccgcaatggatttgcgggattaatcccgcgggatcccgtcccgcaaaaaattttggattccaatcccgcagcgggatccgcaaatttgaaatttccggtctctatccgataccaccacaattttcaattttaaaaaatattctttgactcttctaaaacaaaaaaatatccatatgctttttctttcttcgtttcccattcgtcaaaccaataaaattctttccttcgtgagtccccttacaaattaatcatttatttcgcctcccccaaatttttttttctttctgatcgatcggctggtcacacatatgtaataaagagtttactttattctttgttcacacattgcttacttaatatattcttttatctttcatggttcttattcctttttttatttgtagtatttggagaaaaatggcttattttgaacggtggcatcgttttcaggcgctaagaattatttattattcttgcatgcccaccaattttataaaactggtatcattcaaaagagcttaacattgggttgcagttttgaatttaaactcattatgcggttttttacaagtcaaatgtaataaatttattttttctcattttaaaaaatgcttctcaaattaacaattagagaaaccaaatattttatttatttcagcaaaccgcaaggcaacataatttttaaaaatggtcccgtcccaaaccacggaatagttgaaatttggaaaaaaaggtattttttatagttttttgacttttttcatccttcttcagcacacattttgctttttttgcttttgtattttaatgttttttttttattagttttctggtttttagcacataaatcccatctctgctgataagttatgtattatcacttacattcatttggggaatctttttcaaattcatagggaagttgatcaatgaatgaatgaatgataataataataataattccaattgcttattcgtcaacaataaatgaaaagccccaatagtttttcggcaactccaagcagttcacggtcatcggttggcgatgaacacgaacggtgtgagtgacacctcttttgagtccgcattttctgttcgttcttgctaaattaggttctgtgtttgttggccatgttccactagaaatgaacgaattccgacttggcaacatttttagccgatcaattgggcatgttaggtgattaataatgtcatttaattttttgattcctcagttttttccagaaaagttacaattttgcgcgactttcacactggacggagtcgggaatgtgccttcattcgctttgattccgaagattttgccaaaaaagcgatgaaaattcgctatgtttacgtaagtttgtctaacctgcagaaatttttttaaataataaaattagcatttttatgacccaattacggaccatcagctgattgtcaattcttacgacgcaaaattggcgaaaagaaaagcggaggagcaaaatttgaagaaaggagcaaaaaggacgaacgatgtgtggcaaagtcctcccaattttgtgcaagtcgacgacatttcgtcaacagttgaaatggcaggaaatgaggacaaagtgccagaaaaggtgggcaaaatgcgaagcaaaaaattcaaaccgatttttcagaaatttttctattcttacatttgaatccattttgggcaaaaaatatacctttttganattttttcaactttttgttcggtttcctggatcgaatttggttggattgggtttcatattcgttga

SEQ ID NO: 52772 - DNA, 504 bp, Heterodera glycines
  Genomic contig location: Contig_ID=SeqID_4004; Location=536..1039; Strand=+
  SCN-specific regions: Sequence locations=1-376,398-452,475-504
gaccaaccgacaattggtcgccattgttatgttggcaatttcgaatctgtgcagcactgtggtggtcagttgcataggaccaatttacccgggcgaagctaaacgaagagggtcacttttgaattcacatgcaaaaagctaacaattacggggcttcagaatgtcagaggctcaaatcgggttggtcttcggtttgttccaattggtgatgttcatttctgcacctcttcttggcaaatacgtaaacatttttttttgatttttttgccattttactaattgaaaacaaaattcagatgcatgtgattggctctaaatggatgtgtatcgctggccttcagatagccagtttggctgcaattgcatttgggtacgttgtttcttgaattcagcagaatatctttagttgggggttctgttttgcagttgggttccttcctaatagtcatcattgtttaaaattttgaactgcttcaacttcctaaaccttatccatgctgaatg

SEQ ID NO: 52773 - DNA, 800 bp, Heterodera glycines
  Genomic contig location: Contig_ID=SeqID_22121; Location=776..1575; Strand=+
  SCN-specific regions: Sequence locations=1-39,61-111,133-150,173 -348,371-441,465-472,508-514,536-674,697-800
atgataccaaaattttcaaattgttgtcaatttctaaaaacttttacaagagctcattttcgggatggtgtgttaagtgaaatatcacaccacttaacacaaatttaatgctttttggtttaaaaattttattaagtatatggcatagtgtttatttttatttttttaatttcagtgacgaaaagtttagtgacgaaagggttcagtgatgaaacatcagcagggagccttacgagttggcatagcacgagttatgtatgattttccattttaatcgtttagatagtttgacttttatcataactagggatggtaaaaatatggactaaaaatcgcgaaatatggacataaaatggtaaaaatctcaaaatatggacataaatttttctaaattgaggggtaaattttcaaaaaaacccgaccaaaaaaccgaaattttccattttttgcttatctttcacataaattaaccaatttttaagaaaatttaaatttaatcaattttttgacaaaattttgctaaaaaatgtctttttcggaaaattttccggtctttggggttaaaacggccaatttagctgatgggggccgttctaataggggtttttttggaaaatgccaaaatatggacataaatcgcaaaatatggaaaaatatggaaaatatggatatagaaatccatcttaaaagcttcaaaccaagctaaaggcccccagcagctaaattagcctttttgagcccaaaacccgaaaaatttttcaaaaaatcattttttcgccaaaatttctcgagaatattga

SEQ ID NO: 52774 - DNA, 137 bp, Heterodera glycines
  Genomic contig location: Contig_ID=SeqID_22121; Location=1..137; Strand=-
  SCN-specific regions: Sequence locations=1-56,78-137
attttctaagaaaaaataggagttttgggggcgcggcggtgccgataggcgccgccggggaaaaaattggaaattttgatcatttataaacagtttttcactgaaaattagccaatttataggtaaaattttgaaaa

SEQ ID NO: 52775 - DNA, 552 bp, Heterodera glycines
  Genomic contig location: Contig_ID=SeqID_22123; Location=378..929; Strand=+
  SCN-specific regions: Sequence locations=1-353,378-389,461-500,525-552
atgagtccagcagtgattagaagaggtacaacagtgattagaagaggtacaacagtaattagaagaggtacaactgtgattagaagaggtacaacagtgattaaaagaggtacaactgtgattagaagaggtacaactgtgattagaagaggtacaacagtgattagaagaggtgtaacagtgattagaagaggtacaacagtaattagaagaggtacaactgtgattagaagaggtacaccagtgattagaagaggtacaactgtgattagaagaggtacaccagtgattagaagaggtacaagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatattgtagaatatttattgaaattgaaaggaattaatttctcgaaaattcaaattaaataaaacatttattcatcagaaataatttaaaataatta

SEQ ID NO: 52776 - DNA, 768 bp, Heterodera glycines
  Genomic contig location: Contig_ID=SeqID_22124; Location=604..1371; Strand=+
  SCN-specific regions: Sequence locations=1-136,167-271,368-550,572 -592,616-768
atggcaatggttggagttttgaaacgaattcttttttgcgttatgttttgtcttttgggccagtgctacggtaagattatcaatttgttgtaaaaaatacgtgctgggacgttttataaatccgctaatgggttcgaaaataaaaaaaaattaacaaattaaaattcataacatggctcaaactcaaccaaattaatagggagccggaaaatccgacactggaaaatccgacacaagcggtaaatccgacattggaaaaactgacaccaactttaaattttaaaaataattttgattgtttgagttagtaaatatttaaaatatattaaaagttgaatacttaagttctttaaaataaataatttatggctataaaatagatttaaggtaagcatataataatcatattatttcaatgccctttttgatcatctcaaaaaaattgtaaacaatgcggcaaatggaatcagaggaaagggcatgaagcataagaaagtgtacgtggacaaatgacagagatttatgcgaatcgcatcaaccgacaaccctttattatttgccatcaatatcccatcgaatggcacaaccaattagttttttaaatccaattcgaaaacttgataaacttagccagatattaactcaaattacatttaaagttggtgtcgtgtcggattttcctagagccattaatatcccatagtatccttcaaaagctttaagtgttctttattagaaaattattattctttacatttttactaaaga

SEQ ID NO: 52777 - DNA, 1090 bp, Heterodera glycines
  Genomic contig location: Contig_ID=SeqID_22125; Location=165..1254; Strand=-
  SCN-specific regions: Sequence locations=1-1090
  Gene Ontology: Cellular component=cytoplasm; Biological process =negative regulation of cell growth
atgtccgacatttttggagtcggaattccggtttccgacatttttggagtcggaattccgatgtccgacatttttggagtcggaattccgatgtccgacatttttggagtcggaattccggtttccgacatttttggagtcggaattccgatgtccgacatttttggagtcggaattccgatgtccgacatttttggagtcggaattccgatgtccgacatttttggagtcggaattccgatgtccgacatttttggagtcggaattccgatgtccgacatttttggagtcggaattccgatgtccgacatttttggagtcggaattccgatgtccgacatttttggagtcggaattccgatgtccgacatttttggagtcggaattccaatgtccgacatttttggagtcggaattccgatgtccgacatttttggagtcggaattcagatgtccgacatttttggagtcggaattccgatgtccgacatttttggagtcggaattccgatgtccgacatttttggagtcggaattcagatgtccgacatttttggagtcggaattccgatgtccgacatttttggagtcggaattcagatgtccgacatttttggagtcggaattccgatgtccgacatttttggagtcggaattccgatgtccgacatttttggagtcggaattccgatgtccgacatttttggagtcggaattcagatgtccgacatttttggagtcggaattccgatgtccgacatttttggagtcggaattccgatgtccgacatttttggagtcggaattccgatgtccgacatttttggagtcggaatttcgatgtccgacatttttggagtcggaattccgatgtccgacgatgtgggagattcaattcccatattgcaattgctcggattttccatgtgtgggttagtgccttccttggagcataattactataaaaacggtatcaaaagcaagaatcctacgaaataggtaacgctttcattatgatcttatttcttaattaaatttatgagattcaaaaatcatgcaaatgagggagaagagctaaaatgcaaataaa

SEQ ID NO: 52778 - DNA, 878 bp, Heterodera glycines
  Genomic contig location: Contig_ID=SeqID_22125; Location=387..1264; Strand=+
  SCN-specific regions: Sequence locations=1-878
  Gene Ontology: Mol. function=ribosome receptor activity; Cellular component=integral to endoplasmic reticulum membrane; Biological process=signal transduction
gaattccgactccaaaaatgtcggacatcgaaattccgactccaaaaatgtcggacatcggaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacatctgaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacattggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggaaaccggaattccgactccaaaaatgtcggacatcggaattccgactccaaaaatgtcggacatcggaattccgactccaaaaatgtcggaaaccggaattccgactccaaaaatgtcggacatcggaattccg

SEQ ID NO: 52779 - DNA, 1612 bp, Heterodera glycines
  misc_feature (1109)..(1109): n is a, c, g, or t
  misc_feature (1195)..(1195): n is a, c, g, or t
  misc_feature (1296)..(1296): n is a, c, g, or t
  Genomic contig location: Contig_ID=SeqID_4005; Location=588..2199; Strand=+
  SCN-specific regions: Sequence locations=1-136,160-192,219-530,558 -706,728-1612
atgaaggagcagcagcaggcaatgaacaacaaattgaataacggattcaacatcgtcactcgcaaccagcacaagctttataagaagatggcaaaaattgagaagaaccagcaccaactgaagaagaaccagcaccaactgaagaagcagcagcaggaaatgaacaacaaattagacgtcctcatgtccatcaatcagcagcaacaacaggagcagccgcagcagaacgtggtgagttagtggcagggataaatgcattttaaattttctcccattttaagggtccaaatggagcgcgcaacttgtttgatgccttggcaaataagtgcaggaacgtgtgaaagaacatgcgatggacaaagctgtggaactcctcgccaatggattcgatgcacctacacacaaagttctccccaaaaagtgatgctcctataacctgatctattcaatgtgtatgatgctcctatacctgatctattcattgtatatgtttgtatgatgctcctataacctgatctaatcattgtgcatatttgtatatatattgttttacagtataaccgtcacttgcaatgaatattcaactcgttgtataaaatgaaaatgaattggcattctaattcgactcatttaactatgctagatctgtgtcaaaccaaatttctgataacgaaaaacaaacgcttttcaatgaaccgatcaaaactaattctttaacatttgcttagaaaaagcttcaattctagtcggttttacgcgtcccattacattttacgcgtaccatgatactttacccgtaccattatttactcgtcacaaaaacagttttttcaaaccgtcaatcgaaacattggtaattctgtcaatggtacccccccccttttttgagaaaaattatttttgttttcaaaaacatgaaaacacgttttcagggttttcggggtcgctgatcacgaatccggcatttattccgaccaatttcgaacccagacctgaattcgaaccaaagttcgaaaattaaaatttttcgaattttgtatttgtcgaaaccctaggaaacatgctttcatgtcttttgaaaacaaaaaaactttttctcaaaaaaaggngggggggggttaccatcgacagtattaccgaaactttatacctttcgaatctctaattgttcttgattgtatactttgattattanaatatgcaaaagcaaccctaagcacacttaatgatatcattagaaactaaaatttaaaaaaattacaaaaaagaaagcctaagattaagcctaaagcttangcctagtctaagcggtaggggtcagttgcgtctggccagttgcgtctggccgattgcgtctggccagttgcgtctggggccggttgcgtcttggccagttgcgtctggccagttgcgtctggcgccggttgcgtcttggccagttgcgtctggcgccggttgcgtcttggccagttgcgtcttagtgattaaagggccagttgcgtctggccagttgcgtcttagtgattaaagggccagttgcgtcttaaatatttggtaaccaaaaataccttttttgtattttttcgttttgtgaccccaaagaaattatcaa

SEQ ID NO: 52780 - DNA, 455 bp, Heterodera glycines
  misc_feature (5)..(5): n is a, c, g, or t
  misc_feature (8)..(8): n is a, c, g, or t
  misc_feature (13)..(13): n is a, c, g, or t
  misc_feature (42)..(42): n is a, c, g, or t
  misc_feature (122)..(122): n is a, c, g, or t
  Genomic contig location: Contig_ID=SeqID_4006; Location=1589..2043; Strand=-
  SCN-specific regions: Sequence locations=1-53,75-148,170-455
atgancancaaanttagacgtccctcatggtccatcaatcancagcacaaccagggagcagccgcagcagaacgtggtgagttagtggcagggataaatgcattttaaattttctcccattntaagggtccaaatggagcgcgcaatcagatcaaaatgcaggacaaattgcacgtcgacgtggacaatcaggacgaatcggacggtgccatgaccgataactgaacgctggtgatgaaccgagtgacgtgccgcgaggacgctgatctatttgctcattatattgtatcgtgtcgatgacgttgatctatttgctcgttatattgtatataattcaccatttgtcctttcacccccacgcattcatttcggcacttattgtatactgaacacactcccaatttcctcctgattgatatgtatgtattattgtgcttatgtcgacagaaaataaa

SEQ ID NO: 52781 - DNA, 1188 bp, Heterodera glycines
  Genomic contig location: Contig_ID=SeqID_4007; Location=94..1281; Strand=-
  SCN-specific regions: Sequence locations=1-142,166-309,331-459,483 -626,648-776,800-943,965-1093,1117-1188
  Gene Ontology: Mol. function=microtubule binding; Cellular component =Golgi membrane; Biological process=Golgi organization and biogenesis
atgcaggacaaatggcacgtcgacgtggacaatcaggacgaatcggacggtgccatgcgcattcagggcaaattggacgtcgtcaatcgcaaccagcacaagctttacaagaagatggcaaaaattgagaagaaccagcaccaactgaagaagcagcagcaggaaatgaacaacaaattagacgtcctcatgtccatcaatcaacagcaacaacaggagcagccgcagcagaacgtggtgagttagtggcagggataaatgcattttaaattttctcccattttaagggtccaaatggagcgcgcaatcagatcaaaatgcaggacaaattgcacgtcgacgtggacaatcaggacgaatcggacggtgccatgcgcattcagggcaaattggacgtcgtcaatcgcaaccagcacaagctttacaagaagatggcaaaaattgagaagaaccagcaccaactgaagaagcagcagcaggaaatgaacaacaaattagacgtcctcatgtccatcaatcaacagcaacaacaggagcagccgcagcagaacgtggtgagttagtggcagggataaatgcattttaaattttctcccattttaagggtccaaatggagcgcgcaatcagatcaaaatgcaggacaaattgcacgtcgacgtggacaatcaggacgaatcggacggtgccatgcgcattcagggcaaattggacgtcgtcaatcgcaaccagcacaagctttacaagaagatggcaaaaattgagaagaaccagcaccaactgaagaagcagcagcaggaaatgaacaacaaattagacgtcctcatgtccatcaatcaacagcaacaacaggagcagccgcagcagaacgtggtgagttagtggcagggataaatgcattttaaattttctcccattttaagggtccaaatggagcgcgcaatcagatcaaaatgcaggacaaattgcacgtcgacgtggacaatcaggacgaatcggacggtgccatgcgcattcagggcaaattggacgtcgtcaatcgcaaccagcacaagctttacaagaagatggcaaaaattgagaagaaccagcaccaactgaagaagcagcagcaggaaatgaacaacaaattagacgtcctcatgtccatcaatcaacagcaacaacaggagcagccgcagcagaacgtg

SEQ ID NO: 52782 - DNA, 761 bp, Heterodera glycines
  Genomic contig location: Contig_ID=SeqID_22133; Location=650..1410; Strand=-
  SCN-specific regions: Sequence locations=1-314,337-410,433-761
atggcttggattgctcttttgttgcaatttgagcatctttttggccacaatatacagcactttcgcttgaccttgggcatcgatctcccttttgggagcatgcacacggacattgttgccgtccgttgcccgagagaaggccgtgtataattgaccatgggtaaatacttccctttccaggtcaatgccgacagtgcggattgtttgaccttgacctttttgaatggtcatagcgaatgcaggcttaattgggaattgcaaacgcgcgtattttagcccaccaggcgttttgtcctcgaagatattgtgagatctttcaaggaaaaacctcacttgaccaccaatagcattgctattgattgattacacgaccgacaaggcgatcatcgccaagttcttcgaggacaatgcgtgtgccattgatcagcacttccctatcacttttgttgataaggaggacaacaacgcttccgacctttagttgcagacagtggggaggcatcccagagtctgtgcgtctgtttaatgctgccacttcggactcgatctcatcgatgtccaatgggcgatcgtcaagaggtttgtccgtggacaaatattcccgcacttgacctgtcacattcgccatcatcatttcgttgatctcgtcgcacgtatcaatgtgctgggcgagtatcaaacggttgagcagctccttgtcattgccaaggagttgttgaaagtttggataaacaaagtttatcagctcttccctgctcttt

SEQ ID NO: 52783 - DNA, 1407 bp, Heterodera glycines
  Genomic contig location: Contig_ID=SeqID_22133; Location=1..1407; Strand=+
  SCN-specific regions: Sequence locations=1-155,178-978,1001-1074,1097- 1407
ttttttagatcatttcttaggggtatattttctggaaattttttagatcatttcttagggtatattttctgaaattttttagatcaatttttaggggtatattttctgaaattttttagatcatttcttaggggtatattttctgaaattttttagatcatttcttagggtatattttctgaaattttttagatcaatttttaggggtatattttctgaaattttttagatcatttcttaggggtatattttctgaaatttaaggcgattgcggaaggccccatacaatcacaaagtgcttgccacgccatccactgggtgtgcagctattttgctgccgtatgggaagacagcccattccaccttcagactgggcagagatgtgtcactggacaagtttccaagcattccacttgagagcttctttgcccgacggattcgtgcggcacaactcatcatcagaaagacggttaaccgcacaagttacggcctgctttcaaacttctccgttgtttcgtcaattcaccacgatgaaattgaccatcaaccagagattaggccaaggccagcaagcttacttgcaaatgtgccgccaaattgggctcggagagaccggagaacacttctggattcctccgcagttcatcgtaaagagcagggaagagctgataaactttgtttatccaaactttcaacaactccttggcaatgacaaggagctgctcaaccgtttgatactcgcccagcacattgatacgtgcgacgagatcaacgaaatgatgatggcgaatgtgacaggtcaagtgcgggaatatttgtccacggacaaacctcttgacgatcgcccattggacatcgatgagatcgagtccgaagtggcagcattaaacagacgcacagactctgggatgcctccccactgtctgcaactaaaggtcggaagcgttgttgtcctccttatcaacaaaagtgatagggaagtgctgatcaatggcacacgcattgtcctcgaagaacttggcgatgatcgccttgtcggtcgtgtaatcaatcaatagcaatgctattggtggtcaagtgaggtttttccttgaaagatctcacaatatcttcgaggacaaaacgcctggtgggctaaaatacgcgcgtttgcaattcccaattaagcctgcattcgctatgaccattcaaaaaggtcaaggtcaaacaatccgcactgtcggcattgacctggaaagggaagtatttacccatggtcaattatacacggccttctctcgggcaacggacggcaacaatgtccgtgtgcatgctcccaaaagggagatcgatgcccaaggtcaagcgaaagtgctgtatattgtggccaaaaagatgctcaaattgcaacaaaagagcaatccaagc

SEQ ID NO: 52784 - DNA, 1323 bp, Heterodera glycines
  Genomic contig location: Contig_ID=SeqID_22134; Location=517..1839; Strand=-
  SCN-specific regions: Sequence locations=1-253,275-1323
atgtctttgtggaaaaacatctcggatgatgacgatttgcttcagtgcgaatggaaagcatttattgtgcgtttcatttccaatttttatttttaattgccatttaattgcatttttaaggacgatgtcgtggttcttctgaacaaggcggaaagcggtgctgaattgttggttgagcagtgttggcaaaagggcggcattttgaacacgaaggatttgcttttctacgccctcctcgggtgcgttcatttgttttttctttaaaatggcacacatttttcccccaactttcagaggcggtctcatcattttggctgccgttctgaccattgtcattgtgctggtggttcgtcgacaaagaaagtctgcttctcatacggttgggggtgatgatgacatggatgacaaacggacgaagaaaatggggagaccagcagcaacaagaattgtggtgcacaattgtcgcatggaacaaccggcgggaaatcagagtcaaatgtcacacgaaggtgatggatgattcgtcgtatacgatgaatatttggagaaatttctcattcaatgcatttcacaggctattcggcaagggcgtctgaattcggcgtggaagtgcctgaatcattgctctcggacagggaggacggcggacgcgggccatttatcaggaaagcgatgatcgcacccaaatttggagtggaagtgccggaatcattgcgctcggacgcgtcaagagatgtgacgatgccgcataaattcggagtggaagtgccggaatcgttgcgctcgaacgggtcggacgacggcagcggacgtttgctactcgttactgcaaccgcacggcctaaatctgcaccaaagaaaccgatgccaacagatgacatgtacgcgccacctaagaaatcggctcgctatggcaccggaaaattgcagcaaaaggaaatttatgctccccttccgccaatttaatgttcagactaggatatgtgtacactgttaagcctaaggcgtgacaaagataggcttatttatgccattattgtgtattgtaacaagcgccattattgttgttgctgcctttctgtttgtttaaagtgtcatttatgttatgataaagcctagtgttgaatgcggtaattattttgttaaccttcccccttacatccctgaagagaaggatcggataaaagataactattatcactcgactttattaattacaattttaacccgtcaaagagagacattcaaaatttatggccctttcaggcaacttaaactttgcagtacctattgctccaattttaagaaaagtcaaaaaataaa

SEQ ID NO: 52785 - DNA, 138 bp, Heterodera glycines
  Genomic contig location: Contig_ID=SeqID_22134; Location=1..138; Strand=-
  SCN-specific regions: Sequence locations=1-138
cacatatttaatatttatttggtttaataattgtgctaacatttctctgtctaatgtctctgatcagcgtccaacggtcgccctcgccgattgacgaaccttcggctgtgaacgattctgtgcgttttcgtctcctta

SEQ ID NO: 52786 - DNA, 538 bp, Heterodera glycines
  Genomic contig location: Contig_ID=SeqID_22137; Location=642..1179; Strand=+
  SCN-specific regions: Sequence locations=1-75,97-115,138-206,228 -244,266-292,314-538
atggtaaccgaaagtacgaaccgaactacaaatgaacagattttttatttatgcattcgataaattataattgtgaatttacaaatgtcaaaaggataaataatgcgaatagacaacaaatttaaataacaaaaattatgatgtgaaatgagatgaaagggagagcaaatggcgaagaaataatcgtcgaatgaattgaatttaagtgtcatcaataatttagtaaaagtttcgctacaaaagggtaaatatttcagtgactgaaagcaaaaaatgaaagtgagaagaaatttaataattaaagtgtttaaaagtgggtaattatggtcatgtccgtttcaaggatttctgagttcgttgtttttctcggccccaattcgttcacaaatttcgtacatatattcggagaaaacggagatcagactcagttcttgttcggattcacctcgcaaaaatttaagcaggaaaacgtgactttcgggaaggatggaatagccgacgatggcggaccatttcagaaaaagggtcctcgtcttaa

SEQ ID NO: 52787 - DNA, 1407 bp, Heterodera glycines
  Genomic contig location: Contig_ID=SeqID_22138; Location=69..1475; Strand=-
  SCN-specific regions: Sequence locations=1-86,108-126,173-222,244 -493,515-789,811-829,876-1194,1216-1407
atggtgagtttttcaatttctatgtactttattaagtaaacaataataatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagtgctgatcaaacacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagtccttttcgcctaccctgttaagagaaatcttaatttcactaataatttctcaattttcttctataacagattatctcttctatggtgagtttttcaatttctatgtactttattaagtaaacaataattatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtaacaaatagagaagataaagtctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagtccttttcgcctaccctgttaagagaaatcttaatttcactaataatttctcaattgtcttctataacagattatctcttctatg

SEQ ID NO: 52788 - DNA, 597 bp, Heterodera glycines
  Genomic contig location: Contig_ID=SeqID_22139; Location=631..1227; Strand=-
  SCN-specific regions: Sequence locations=1-161,191-350,372-597
aaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaacaaataaatcataaaattagaacaaaaattgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaaccgactatttagtcaacagaaaacaaataaatcataaaatt

SEQ ID NO: 52789 - DNA, 1062 bp, Heterodera glycines
  Genomic contig location: Contig_ID=SeqID_4008; Location=959..2020; Strand=+
  SCN-specific regions: Sequence locations=1-73,95-105,127-134,166 -421,460-600,623-1062
atggcaattacgttttggttgttttataggaaattttctgaatttttcgatgtttaccaattgccaaaagagtccaattttgcattccaacttcggattttacacataaataatgccaaagtgaaattgactcaaatcaaaaaggaaatgaagcaattgcttgacggaaaacattggaccattctcgaattcgaggctctcacttatttggccccgggtttgttatgaaaagtattgacagaggcattttataaatcctttaaaaaaactaggtagggtcaaaggtcgatttattaattgaagttttcgtttttcgggtccccggctttgtctttggctcagaagcgccgcttttcggtttaagttaaaagaccgtgacgaaccctaataaaaaaacgaaaaaatgaaagcaattaaaagcatttttaattttatttaaatttatattattattattttctttcgttctttagaactattagatgagcaatcacttgcaatgaaatatttaccaattatttcaatggggcacaacgaaatatttacagttgttgaggcaggcgtaagaatttattttggaagaatttggaaaatttttttggcattcaaaaggcaagaaaaagactccgttcaaagaagtgattgggcagcgattagcaaaaaattggaaaacaaattaaaaatatttttcggagaacaagtgaaaaaacattcgttgtcattttcccacaaaatttggttagatttggccaaaatgtacaacgaaacttttgcgttgaatgaaaatgaaaaaatggcaataaaaaattttgatttttcaaatttggaattgattgaacaagaaatagtcgaggatcattgccaaaatatggagcaactgatcggtgggaaaaatgaattcagtgaagtcatcaaaggggcgagtaacttggccaaatttcgagtgaagcaattcattacggcgagattaaatcgggaaaatttggacgaagaaaacgaattgatggcgaaattccctgcccttgggcaaatgcttcaatttggtattttaacttaatttca

SEQ ID NO: 52790 - DNA, 274 bp, Heterodera glycines
  Genomic contig location: Contig_ID=SeqID_4008; Location=2217..2490; Strand=+
  SCN-specific regions: Sequence locations=1-243,266-274
atgcttgagactgctctgtccggcgccgacttggacaccttcaacacaaatgtgctttattatgtatttagacaaatgttgattgaaaaagtggatgctagacaattagtcaaattaggtgcacaaaatgcgcaattgggacgaaaagtcgccgaattaatgcacgcaaatgccgacggccgattggaaggcgaggcggagaagcgcaaacaaatttgccacttggaacgctttatgaaatggtatgtgaaaaacaatgaaaaacaagacgaaa

SEQ ID NO: 52791 - DNA, 1348 bp, Heterodera glycines
  Genomic contig location: Contig_ID=SeqID_4009; Location=471..1818; Strand=+
  SCN-specific regions: Sequence locations=1-114,136-253,276-615,659 -705,742-751,798-1047,1095-1113,1135-1136,1158-1348
atgattttttcgccttacaacgacgataatcaaatgtatgcagaaataatgctcgcattaagatatgccatgattcgcatttatgggctaaaggaccaaattaaggggtcgcattcggaggatttggaaagagagacaattcgaattttgatagtgttgcgaatcattgaactgtttgacgacagaatgccaaatgtgcgaatgctttgcgttgcgatgtcatttttgaaaatgataatagacaaaagaaaaaccaaacggtaatttatttccccgggaaagcttcataaatttgttcatcaaaattttaaaataaattgcattttaagtctttcgtgggacccatccgccgtggtcgctcagtgcctggagacagaagctgagccaatttttgctgaacagcgattttatatggtgccgtaccatcaggaatatttcaaacagtttttggcgttgtgcaaacgtgatgatgcactgaccacaattattcgggaaggattgtgcaaactcagcctgttgagtcggctgatcggcgacgattcgctctttaggctgtttaatttcacactaattcgcgagaaattaattgaccgaaattgtaagtggaaaatatggaatataaattaattcaacttttaatttatatatatgataattagaggtgccgagaattcattttattgcacgtaacaaaaattaacaggcatttaaatttgatttatgatttatttttaaaaaattgggaaattgcaacaaattctatacttttctctcagttttcaacaacaaaaaatttttgctgtcgcaaaattatcttggattattgatcggtcgaactgacgaagaacgacagaccaacagagtgttggccgatctgatcgtgctaacgaccaattattttgaagtcgacaaattcgggcattcggaagcgatcagaaaaattgtggattttcagtggttgcactgtcgctttttgtacgaatcggtcgttgaaaatgtcgaagagtcgcggaaaatttcgttttttgtcggcatttttataccgggtaaaaaagttaataataataaaaattgggaatttttataaaaaactcaattcatttttcgctgaatttcatgaatttagaattaataaaatttttggaagccaataaaatgttggcaaataactcaaagaaattcactaacgctttgcaagtaacggaaagagaagcggttgcggagatggacacgcaatggttcaactcgaaaaatgagtatgcaaagccaagcgaaattgtccaaaaaatgcattttgatcagctaatgatgctgcgaaatgacgaaaattttacagaaatttacaaag

SEQ ID NO: 52792 - DNA, 412 bp, Heterodera glycines
  Genomic contig location: Contig_ID=SeqID_4010; Location=177..588; Strand=+
  SCN-specific regions: Sequence locations=1-119,194-251,274-344,366-412
atgaacgtttatgaggatttgcgaaaagaaggcctccgaaaaatgtattatgggcttcaaaaagtgaaaagcacacctaaagctgataagagaatacacagcaatacgaagccaaatttgaagagaaaaaagaggcggaaaatgtggaagaggaaaaagaaaatgaaaatagagaaaatggaaagaagaaaaatgatgaaaatgctaatgaaaatgatgaaaatgttaatgaaacaagggaatttttaacaggagagattgtgcccccaaaaaatgaccatggaaaagtattagctcctacagaaagttacagtaacaaattatcaggtttctaactgacaatcataattattttttacattaattcagcattatgtaaataaggctgagaattttagtcacgaaaaatcaa

SEQ ID NO: 52793 - DNA, 1529 bp, Heterodera glycines
  Genomic contig location: Contig_ID=SeqID_4010; Location=1008..2536; Strand=+
  SCN-specific regions: Sequence locations=1-46,68-310,334-366,388 -497,538-694,726-759,782-1061,1083-1129,1151-1177,1210-1226,1284-1499
atgaacatgcttacattgggtggctttataaatgaaatagaggatcgtttcaaaatggttgaaaacatcagcaaaatggaaaatttaagcgattttatgtgcaaagaaaaagcacaaaatttgctagaaaaatgggaagaatttaagaatgaaatggaccaattcaaaaaagtgaataaaaaagaatttgaaaatttggaagaaaaattatacgaaaaactgcgaaatttattgctttttatcgatggagaaggccaactgagcggacttaacgtgaaaaacaattttgcgaaggcaaatttgaaagtacaaattcatttaaaaaatattttgtgggcattaattagcgacaaaaaaatggggaaaaattggcagaaatttgacaatgagacgaagaaaatgaaattgtttaagctccttcaaactcaaatggagcaatttaaaattgaacaatcaatggagaaaatggaaaaaatgatggaacaaaatgaaattggtaattaaaatgtttatttttttaaattaaattaaattttagacaatgaattgttcgagaaaagcgcaattaaagaagacgaacaacaaaaatatttgctcactattttccccttgcattcacaacaaattaccattgtaaatcgcgattatttggtgaagaagttcaacgaaaatgtttgagatttattggattaaaattaattaattcattcattcattcattaattattgcttaatttagtttgacaattacttgacaaatgtattgtatcaaaatatttactacaaaaaggagtttgagcgtaaaagagaagctgcgcttggccaaataaatgcaattgtcgataattgggcatgttaatccgatttaattactcaattacacttaattaattgccacatttgtgccttttccagtccaataagcatgcccgactgctcatttcgggctcacttttgctcgatgtgcacacaattggctcggatgtgaatttgttttgtgtagcgcccggcgaacggctgaaactaagcgattttatgggaagcgataaaaatgggaaatgcatggaaaataaatgcaaaagcgaagaagcggacgatgcaaaatcacttttttgccaaatttgtgaggtaaaaagtgaaacattattatttgtttgggttaaatggcaaaaaataaaaataaataaatgaattaataaatgaataaatgctcgttaatcctattctatatattaaataaagctaaaaacttaatatttttaaacgaattaatatatttaataggataaaagcaccgccaatctgattaaaattgagtcagccagcattttacttattcgatttgccttcgatggcatcgaatttgacatttcattcgttgtcgtcccaaaagtgaaaactttggcacataaaatggatgacaacgaattaaaaagtttattggaacactttgattggtcggtcaacgaacaaaagcatatgctacgcagtctttcgagtaaaaaataaataaaaattttaatttttaa

SEQ ID NO: 52794 - DNA, 1149 bp, Heterodera glycines
  Genomic contig location: Contig_ID=SeqID_4011; Location=208..1356; Strand=+
  SCN-specific regions: Sequence locations=1-61,142-261,283-289,326 -727,749-825,847-1057,1079-1149
atgctgctcgactcgtcacacattcaaatgcaaaagtcatccgtcgccaaatgtttgatggtaaataattaaaaaattgtataaaaaatttaattaatttaatttttattttaaatatggaatttatttttaatattaaatgtttttgctaatattttgtaataataacatattacagccactaaaccaaatcagctcaatgaaaaataaacaatttgaattggacgcactgctgaaaaattcgattccattctctcaaaaagtacaaataaaattaaagaaaaatggcaaattaattcaaatttaaattttgtatttattttttcagtttggcaatttcatcgtcattaattgtgttgccgaagacaaagaagaagccgacgcattttgtgactttgttgaatggcgaatgcgcctccaaatcattttcgacattgacaaaaaggggggaggaggcattgagacgcatttgtacccaaatgtttaccaagaaaattgcattttaacacaaaaattggtgaaattttcctttcggtatgcatggattattccttaaacgaacacttttattatacctattttcccacattgaataattcaaatttgttcagggccaatcactgcaaaatttggcttctcggaatttacggaaaaaacgcaattagcgaaagaattacggcgatggcacaaagtttcgacacgaccattaaaaggcattatttcttgaagaaagttgaaaatggcaacattcgaaagatcgacgactttttcaacacaacgaaaattgaacttaagtcgataatggccaaaaaggaagaactaatttgaattttcaatgctttttgtttttatggacttgtattcttttcctagaaatgctaagctgtttactattttattgtgtataagattattatttttatatgttattatcacatatattgaccaaatttgatataaatattaccaattggcaaccatttggttgatgttgtaattgtttgtgagtaatttatgcttaaatcatttctaggccatatttgtaaaaatctaaaaattgatgttttgtgatttttaaaaacgaaaatatgatgtaaaaaagtgggactatcttatgaagttaccaatattttttttatcggccactaa

SEQ ID NO: 52795 - DNA, 1154 bp, Heterodera glycines
  Genomic contig location: Contig_ID=SeqID_22143; Location=668..1821; Strand=-
  SCN-specific regions: Sequence locations=1-102,124-242,274-293,316 -331,354-657,692-1154
atgcgtcatttccacataaaaatttcagatcgattggtccatgggaagtaggttaagcagcaaaaaaaacaaaattcttggcgctataattttggaacagactgtaagggcaaaatttattttgggcagaaattcaaaaatagggatttctaaggttcgaataggagcgttaaaaagaagaattagtcgtgacgctgacgtagtgcgacatttgcggaccactatttcccgattgaactgtcaaaataaagaaaataatttttttttaattttcacttaattaaatactcccaaaattgaaattagtgaaggtaagctgatgcaaggcgatctgtttcaattggagaattttattttatcttagaagtcccaaaacaagtgtaaatttttttcttgcttctcctctacacgtttagtgaaattagcgaaaaaatttgctattttaatacatataaaagtcagttcaggattttataccaaggaaaattttttcgtgtttcacttccatgctttggttaaccgagagcttaaaatttttatatggcataccaaacaattaaattaacaaacaaaaactaaaaatagttctatctttttcccaaaaatagcccatatttgctgttctaaaaccatcacaaaaaactaatttggtcactcaatttttataaatttattttttttttgttttttagacagttcaacccataaataatggtccgcaaatgtcggctaaccgatcaaacagtcaaatcactgcgtgcggtcgattatcctcttgccactgacccctgggcttttcctcggctttttctcctcgctgtgccgctttctgttccggtggctcggtttgcgtctccatcgttcgcctccccccaaaagtgccgtcctcgtcttgcggctgttccggcaccgtctgttttggtcgaaccttctcatagtccacccattgcatgtcccttatatcaagaaggcactattagtcgaccaatataagatgctcaccacccgcccttgctgatgtccaaatcgatcgaaatgccgcgcaattctgccattttccctcgcgcatttatcgccgaaatgtccaattttggtaatctcactttcaaaagcattgccttttttcgtccgcagctaataacgaaactaataaa

SEQ ID NO: 52796 - DNA, 198 bp, Heterodera glycines
  Genomic contig location: Contig_ID=SeqID_22143; Location=870..1067; Strand=+
  SCN-specific regions: Sequence locations=1-198
atgcaatgggtggactatgagaaggttcgaccaaaacagacggtgccggaacagccgcaagacgaggacggcacttttggggggaggcgaacgatggagacgcaaaccgagccaccggaacagaaagcggcacagcgaggagaaaaagccgaggaaaagcccaggggtcagtggcaagaggataatcgaccgcacgca

SEQ ID NO: 52797 - DNA, 272 bp, Heterodera glycines
  Genomic contig location: Contig_ID=SeqID_22144; Location=298..569; Strand=+
  SCN-specific regions: Sequence locations=1-123,151-272
atggattttacgacaatcgaagttaattatgtgagaaaaatgccatacttttttccattaatcatttttttctaatttcagaaatcgccgttttttgccctccctttttaccactctgagcctggagtaaaaaaggaatcctgggccactttccatgtcgaatttttcgacccaccggaaaatgagtttaacatttctcttctgcacgactcacccgaacacagcgaaaaaggcaagacaaaactttgaaaagctgagcaattaatggatta

SEQ ID NO: 52798 - DNA, 1273 bp, Heterodera glycines
  misc_feature (406)..(406): n is a, c, g, or t
  misc_feature (413)..(413): n is a, c, g, or t
  Genomic contig location: Contig_ID=SeqID_22144; Location=863..2135; Strand=+
  SCN-specific regions: Sequence locations=1-65,99-158,180-492,531 -557,610-652,714-783,805-891,913-1185,1235-1273
atgggaatgaatgtgaagccgaaggataagcgagtcgacgtcattttttggaactgttttgtgagaaaaatataaaatgttttaaatatttataataaggaaacgatttttagaaaaaacttccgggaaacaaagacagttgcgatgagacggaaacgaaaagttacaaaaatgaaaatcttggcaaagcagccgaatttcacatcgaagtgctaaacgacagtttttctgtgataatcaatggggatcagaagaagcctttggagtacaacagcacattgccagtttgggcaacaaactttttcagggtgagaaatgagaaaaacggagttttacgaaatcgccaggtttaaagactcggaatagacccggaacccgtactgacaaatgaacattttggccggtntagagtntaaaaatgaagtgaaattcatattaattttttagaagaaatatgattttatatgagaaaaatagagaaattacattaggaaaatattgattattttatttaaagatttttaaaatttgctttctttgaccaataatgaggctcgaatttttaattatttaataattatctaaacaaatttattttgaaatttttttcaaatgctcgaacgacccattctttgcttaatgataattttcgtaaatttaaataaaaataattgttgtttaatttgcattaaattttatttattttttataaaggttgaaggaaatgtcagactgttggggaggccactttggaaagaatgggaagtcgtaagtgcacaataattgcaaaattaaatatattttgtcattttcattcaattttaagtatggagacgaaaaaggctactttcacaacttttcaattccattgaaaactttgctgaattacggagaccaaatcattctgaggacactgatcattggcagcgagacggaattcccgcaaccgtttaacattacgctgttgcacgaagcggcggaatggaacgaaaaaagtcagtctatggcacaaaaatggaccaaagaatggcattagcggaattgggtcgattttgttaagttggcgatgtgattttgcaaatggcattcacattcggagatgatagtagcccgggcaaagcaaatcaattcatctgccgaaatttcatacacgaggtaacaaatttatgttggcaaatggtggccaaaaaattgttaattaaaatttgattaattattatttatatatttatttcggtcgaatgattgagtaccgatgatgaaaggctgttta

SEQ ID NO: 52799 - DNA, 811 bp, Heterodera glycines
  misc_feature (81)..(81): n is a, c, g, or t
  Genomic contig location: Contig_ID=SeqID_22144; Location=2523..3333; Strand=+
  SCN-specific regions: Sequence locations=1-216,238-287,321-758,780-811
atgggaagacttgacaaaaatacccaaccgattgaacaaatttggccaagagttcacgatgaagatcacggccaacacggnatcggtttgacattgagattgaaactctggccactatggagaaaatcgaatgcaaatatccgattttggacaatgtgcaaattccaccgtgggcaattgacaacattcgggtaaaaatattcacgggctcctaattgaaaatgaatatttttgtaatgatgtagcttttgggaaattttgtgctttttgaaatcgtccaaaaaatacatccctttttaatcaaaatctgtttttaaaaatcgcattacaaattccaaaattattcccggcaacgcctttcggcacctctggaccattccttcccagaaatttttcaaaaaaatacagctatggttgaaaaaaatttaacaacgttttttattgctcacgattacgtcagtaattgaattttaaaaataaagtttatgtagccttaattattgtaatacaaaggtcaaaattgtatatgaacctcgttctggattagtaatactagtccccccccccctcccgccccaaataaactagcttatcagtgaagaaaatcaaagactctaaatcttgacgaccataatcgtcgagtgtcttcaatatttttagctttttgtgttctaatcctttatgtgtttttaataattaaaaattgcttctttaacagtttgatggcgatgagttcagagtgattgacttcaacatatcccatccatcccccaaggctttaattacgaatcggatcaattacatcgcacaa

SEQ ID NO: 52800 - DNA, 654 bp, Heterodera glycines
  Genomic contig location: Contig_ID=SeqID_22145; Location=1..654; Strand=+
  SCN-specific regions: Sequence locations=1-524,546-654
  Gene Ontology: Cellular component=mitochondrion
ggtcgtgattgtcaaaaacggcaaataattgcccaggggcaacaacggtgcattttcttttgtttaaaatccaaatcattttcgcctcaaaaatcgagaccgaaacgccgtcctcccctccccccccgtaggtattcgttctccaacgacccaacggcacacgccgaagtgacggctcttcggggggcaagcaaagtgttggacagcttcgacctgagcgggtgcataccgtacacgagctcgttacccatcgtactcgtaaaagtgattactcgtacccttttcgctaatttaaatttaactttctcttccttcaccctataattgcttatccattttccaaggtcccatgtgtttgggcgctgttttgtggtcacggattagcaatgttttctatgctgctgcgcctaccgatgtttttccctcttttttattttgaatttttcggaatgttttaggccgcttcggtcggtttcgatgatcagaatttccacgaatttgtctctaatccgaaggttaattatttttatttgcatattttgcaattaaaaaattcagaaatacgaaaaactgatggcattggaacatttgccagtcgaagggcatatgaaagtgttcaaaatgtgggaacagagggacgagaagagaatgtac

SEQ ID NO: 52801 - DNA, 244 bp, Heterodera glycines
  Genomic contig location: Contig_ID=SeqID_22145; Location=1208..1451; Strand=-
  SCN-specific regions: Sequence locations=1-244
aatcgcaatggttcgtatcggtcggttgaagcgcgaattggagaacgcacaacagtcaggcgacgatcagctgctgttccgctgttgtgatgcgttgatggaccgtatgccggaccaattgcagttggactcggatgagtgtactgtggcattcgatctcgacaaatttgacgagggcgccgtgcagactttggagcaacttctgctgatcgatccgctgactcctctcaatggcaatagctga

SEQ ID NO: 52802 - DNA, 1293 bp, Heterodera glycines
  Genomic contig location: Contig_ID=SeqID_22147; Location=84..1376; Strand=+
  SCN-specific regions: Sequence locations=1-30,82-201,223-238,260 -344,486-600,622-1003,1033-1205,1227-1244,1268-1293
  Gene Ontology: Cellular component=nucleus; Biological process=border cell migration (sensu Insecta)
caggcaacaacagtgcaaaaaacgttcactcaacaacaacaacaacaacaacaaccatcacaactccaacaacagcaacaattcaaatttgcacagcaacaacggcacatggatttgatggcacaacaacagcaaggtcggcaacttcatgccgcaatcgctttacaacaacatccagttgctgctcaagttgttacagatggttgtgtttttgttggtggtcagcaacttgccaatgctgcaactgttgctgcttctgcatcagatagccgtccgacaacaatgcttcccgtatcgacggcggcggcatttgcacaacaacaatttattggcgcaaatggattgcaacatcaacaacaactacagcaagattttcaggcagctacagtataccagcatcatcaacaacagtatcagcagcagcaaatgaaatatcatagtcagcatgctgaagcagtacaacagcaacaacaacaacatcagtatggacgcgagggagctgttgcggctcaagcagcaccggtatgtttagagatcggctcgatcaaatttttatcataaaatgtctcccaaaaaataacggaatgccaaattcaaataaatgccattttttattttaaagcagcaaatggcggtagacaaagccgaacaacaacaccaacggcacctgcaaaggcacatgccaacgatggtgggaccaccaaagagtgcgccagccatttcaacaatgccgccccatcagccgcacttttggcacaatatgccaccaccatcgcagcacagcgagtcagttcagttccacattcattggtcccgcgggttttcaaaaaaaggcaaaatccccccccccttcgaaatcaaaatgccagagtataaaaaaaaacttagaaaatttccaagttggatttccaagaccgcaaaattaaaaaaaaactcacagttccttattaatagtacagtaatcattcaaggatgggcaaatttctatgctctcctccaccatatcctgctgctgctggtggtggcgttgtcctccctctgcatgcatacggtggtgcaccatacagtatgcttcatcatgccaacgccgctggtggtgccgccgaaagtggagggaaagaattgttgtttttgcaaaactctccggcgatggcaccgccgctgccgattacggtgaaattagaagaagacggcggaggagacggtcaacaacagaagcaacagcaaaatgatgaaaaagtgccgcaaaagaaacaacagcaacaaattggcaaatgccaaccgccgaaaagg

SEQ ID NO: 52803 - DNA, 1719 bp, Heterodera glycines
  Genomic contig location: Contig_ID=SeqID_22148; Location=2..1720; Strand=-
  SCN-specific regions: Sequence locations=1-149,171-310,332-1719
atggacactctctccacaagacttgaccaagttgtagagaaagttgaatctctggaaagccaagtggagaattgggatgaccctaatgctgataaattatcacaaaacgggaatgccactgtggtgctaaggggccgcgtggggttacttgaagaagaggacgatgaagacgaatttctaaacgttttgacaactgtggacccatttgctagtcaacttccggcatgcagggatgaaaatcttacctctttcgataactgggcccaaaaatttagagaccttttggattatgcgggcacaacatggtcagaaaaagaaaaattaggccgactcaaattttctcttgaagggcaaatcagaaagctctttgataagcttccggacaataaaaaggacactgtagataaggcattaaatgccattagggacaaattagattcccctgaacgccgggaaatgtcaaaaagggcactggtgacatgcaaacaacgagaaaccgaaacagtccgggaatttttgtcaagactttcgccattggttactactgtgtgtgccggtcaaagtgaggcacaaatacagtcacgactaagggatgaatttttggaaagggtcaagcccaatttaacctttcttatccgactgactggtgtcactaagaaccaagattttgaggctgtgttttcccaggcacaagaattagaacttcttttgactaataccaatgaaaataacgttttggacccgctcaaattcactgtccaagctataacccaatctccggtaaaccaatcgggttatcgtactaaccaattttcttcctccaatgtgaattcatgggcacccgctggacaaagatatacgaataaccgtcaggttaatcagcaaacacaaaataatcaaccaaatggttcaggaagaggctattttcggggtaaccacggtgaatccaacaggcctcaatttcaaagaaatagggctaatcaataccggtcgaaccgaggccgaggggaccgcaattggactggccgtccaaaatgccatcactgcggtagattgggacatgttgcgtacaactgtagggacaggcgctcacaatttcaaatgaatggtcccaataacaactcaaatagacctacctattacaccccggttaacatggtacagcctaattatccattccaagctaatgatgtcgtacctcagacatcttccaatcctcaaaacgtgactgttgatttaagtgccttagctgatcaactaattcaaaggatgaatgtacgagacggtctgcctcctgatcaaccaatttcatcgaatatgcagcacaatgcctgcaacgctctaatgccggaagaacatcttaatgatcaatcttcaacttctgaatgggcttctaatgaggttgactcttcagttcctcctctaaaagtttcaaattggggatttcctactactggaccacaattaagccgcatcctaatgctaacattgacactcatagcctcaatgctaattagtactaacgctgatcaattgttggttcctgaacatccactaatctgtcaaaccgcttttcatgctgccacttggggtcttcccaaattcaatggatgctcctctattgcagttaatctatctcacactcctaaatcacaacgaaagcgaatctatacccctattttttttgaatcagaactgaagaatgggcatgtaagatag

SEQ ID NO: 52804 - DNA, 1551 bp, Heterodera glycines
  Genomic contig location: Contig_ID=SeqID_22149; Location=121..1671; Strand=-
  SCN-specific regions: Sequence locations=1-292,315-1244,1266 -1404,1426-1551
cccagctattggaacttttcaaagtttttgtggttggcacgaatgaaacatctgccgcatcggctgatttcttgtgcccatgcacttcaaatcctgaactcattgttcccttggatcgtcgtgtatattcagaccttttggttggtactgtcgatgcggcacaggggaaggaattcgactacgtgatagtatctggtaagacaattttgtgacttattaaggcacattccatttataaacaaatttaaagagacatatattttttttaaatctagtcacaaccgattattaaaaattttgatcctaaattttttacttaattatgtgtctcattaaatgctgagccacattaatgtgtccattaatgtgagccacattaatgtgtccattaaagtgagctactttaatgtgtccactaacatgatcaaaatcatttgaataccctattaaagttggccgcaataacacctctacgcttggttttctggccgattcatatcatccgacacttcgaatgtggaagaatggtcgagttaatgtgatgttttcgcttcaccgaaaagcactgattgttctgtgtgacgcagcgtcattccttgcggttagtctgcatgcttttaaaaggaacttattaatcacgagcccgagtcacaagccctagcattcaattggaaccgcttgttagacacatatatgttaaatatacattaaaggacacattattcattctcagcatttcggggcagtattaggaaaaaggatagtgtgtctccttatatgattattatcataaatctgtctcacaaatcctgagtaacaaatgtcgttgcggtttagaattacaatgaaaatgtgtctcataatttgttccatgaattcttgaaagattgttggaatcattatgtttagaatcctctgctgacgacaaatactgctcctgaaggaactgaggccgttgaattcgagtcaggcatcgaagctggtcgctttatgccctacaccaaacaaagcttcatggttttcttgaaagaagcaagacgtgaagggctcattttcgatgccaaggacctcgagctctaagacagagctgaatatcactaatgtatatatacgttcccaaaaaattaaatcccacccccactcatatttttctcttttttatgtataagacacaatagtgtcttttttaaactcacccactcatatatgtttctcttttttatgcacaagacacatttatgtcctttttattttaacggcttaaatgacatttactcaagaaacacatcagtttatttcatcacaaaaacaaaaaacacttgatcagaaggaatattttagaatgaccgatccgattacctattggggacccatcctcgacccgcgtagagcttatgcatggttgcatcaaaatcaatgtcatcttccaattgcctaagaaagagataacttgaatacgaacgcagcattttgctagtggagtcttgataacgattagcgcaaactttccttaatgaaatacgcgttatttgtataaatttgctaaataaa

SEQ ID NO: 52805 - DNA, 2164 bp, Heterodera glycines
  Genomic contig location: Contig_ID=SeqID_22151; Location=303..2466; Strand=+
  SCN-specific regions: Sequence locations=1-721,743-747,769-1332,1365 -1443,1517-1570,1596-1610,1632-1776,1798-2164
atgtgtttaaacattgtaaaaacaccattgatgagagtttgcaaatttgataggccaaccacgccgaatgggcaccaaatttcgccaattcccgaggagaacgacgagttagaccaacttgtgtctgcactggtcgacaaccacaaccagcaacagaagcaaggcacagctgccacaaccgcctacgaccagagggcggtgaaaagtttggtcacacagctgcgcgatgtcatcgcccagtgggactgggcccaagcacggcacagacacgtggccaaaattgtaaaactatgcaatttgaaaaaaaatgaaaaatttgcgtggtagaagcaagggtgtagccagacccttggcttcgggaaggggggggggctgaattaaaaattcgattttaggggtgtattttttaggaatctcgagttttgagaggtgtatttttacaggattttctagccgtttttcgctaaaaaaaattattttttttgagtattttgaacgccaaaatgacgaattgaatgccaaatgggagcagctgaacgcggaggtggccaaattcaatgaaacaaaagcggacgaatgggcacagattgccaaagtgcgtaccgcactgcgtgcggagcgcgagaagcgactgggcaaaaaggaggcggaccgaatcatccaactggaaaaggaggtgaacagggaggcaattgggacaacaatttggagccggtttttccaaaaaccaacattttttcttggtgctcaaaaaatttacaatttttgcttggatttgacttatttttttacaaaaattttcaacttttacccccccccccccaatttcagttggccgatttcaaggccaaagatgcgcgtgcttctcggttggcctccgaattgcgcacccaaaaccgcgagttgcaaggcgttgttcgggtgcgtgagcagtcgtacaccgacaacatgatgaggctcaaacggctggagagtcagctcgtttctgctgaggtttgtttgcacctgttttttttgtcagggtttattggtcttacgaaaccctgagaaatccaataaattaagcgctggggtgaaaaagcaggaattgttagcggttttgcgccaagaattttttgcaattttcgggtcaaatattcaacaaaaaaaaaaaagcgaacaattgagtccggcggtgcctatgggcgccccctccccgagtgcaccgcaaaaattcgcgctgaaattacgccgggacaaacttccgctgccgaaatatttccggcgacgaaaattagtcctgttccagaattcccccctcactttccgtcctgtctgcggttttactttgaatgtattatttatttgtttgtttgttttaagcaagaaaactccaggctgcgcactcggcttaaactgatccgacaggaaccggcggcaacaaaagtgccgcaacatccgaaccaccaccagcagcaaaaacaatcacaacagcagctgccacagcaacaacatcgtcatcattcggaacaacaacgcggtgtcactttctctacggctgcccctgctgtgtttccgccatcaagttcaagcagttcaacaacaacagcaacaaccgtctcagctggtcgacagcagcagcagcaacatgtgcgacatcagcaagttggtgtttgaaaaatggaaatttgaatcttaccaaaaacccgaaggaaccaacaagcaattttcactgggatagcaacgcttgtggctgtgttatggcatcgcatgggacagctgctgagaatgttcaggtgatggtggtggtgtggtggtcaacaaattgaacgcgttcactccctcccactcccaaaattttatccatttttaatcgacagattgactatttgcatgacgatcgtgtttacgaagtgcgaatgccccgtgggcattcaatgcgttacatgttgaccggccaccttgacctgcgctgggccaacggcgatcggacactgatccgtccggatggcgaacgtcgcgagctgtacagcccggaaaagccgaactttggcattgaaatgtaatggcagtaaattaaaaacagcgtaaattttttaattttcagtttcctgccctcgggggtcgcctatcgcctaaacgctcagtcgcaatggcagcgcgaggaacttttaaaatgcgttaa

SEQ ID NO: 52806 - DNA, 164 bp, Heterodera glycines
  Genomic contig location: Contig_ID=SeqID_22152; Location=1111..1274; Strand=+
  SCN-specific regions: Sequence locations=1-164
atggatgaggagcaatcaaacaaggaacggaatgccaactttggacaaatggaattagtgccaaaaaaggcggcattacagcagcaaaaggagccaatcgaggcgatgatcatcaaacacagaaccatggcggacgaagaggaggccggcacggggatggacga

SEQ ID NO: 52807 - DNA, 590 bp, Heterodera glycines
  Genomic contig location: Contig_ID=SeqID_4012; Location=208..797; Strand=-
  SCN-specific regions: Sequence locations=1-127,150-244,266-590
accatttacgtcaatgatgcactttttgacgagttcatcgagctgttcagtcgacactgcattcgttcaccagctacggttaaggaagcgactgagagcggttcgctgatacggcctttccttccctcaatctctcagttattttttccagtttacatgtggcttttggccgattatttgcaatatctgttgcccgtcgatgaacagaagctgaacttgctgaagaactctacctggatttctgctcctttctcctctttaccaacgtcggcagtgacgagtccgcgcagattgctgcgccccgaagtgttggcccaatgtgccccacttgagcacgtttctcttcggtcgggcgccttcaaaacgctttacccgcgactcctccaatttgttggcacaatgttaagccatgtcgcttctctgtcaagtttgacacttcaaattcatcatttataaaatcgtttcaaagaacaataaaattttgaaaggcatggcatttgttttagattggccaagtgttgcccagttccaagtccttcgcattattctcgaccattacctcacttttttgttctctgaaacggaagacg

SEQ ID NO: 52808 - DNA, 1043 bp, Heterodera glycines
  Genomic contig location: Contig_ID=SeqID_4013; Location=1028..2070; Strand=+
  SCN-specific regions: Sequence locations=1-231,271-426,461-520,542 -570,592-1043
atgacacggaggtgcaccacatcaatggcgagggcaaggtggcctcatttatccgccaccaaaaaataaaaagaaaaattacaataaatttcagaaattcgggggttgtctacagcgagatgcaggcgcgagactccgaaatggactcgatgttggacaaaaaaagaaaagagctgttctaccccgcgggaagcagctacagagcgatgacggggcggttggtttcgactcaaaaatcaaaaaaataaaataaaaaacaaaaaagaaaaattcgtagcaaaaagaatagaggatgacttcgaaacacactcaaccataaaaaattccggcaatcatcaagaatttgtgtctcgacgaaaaaaaaatatggcaggcgtttttttctaggcttaaaaaagcgctgattacgaatttgattataaggttttgttcaaaatatgagaaatttgaaggtttttgaacctttaagttcagcgaaatctgttaaaaaataacaaaaattttcaaaaacaatccttttaggcaccctctctgacatccgcgaactgtgctcgctggaacgggtgcgaaactttcacaagaagaaaaaagacgggaaacgggaacgggattcccgggttttcccgcggcattcccgttcccgtccaactctagttttttgataggtcaatgaggctagattttcaaaatgaggctttttgtggtttttgagaaaacccgcaaaataaagaattttttaatgaaaaacggaatggaaaatcatcaaaataaaattttgaagcacaaatttgaaaaaaaagtgtcagattttggtttcgttttagagcttttgcttagtttgaaaaattagatttgtcttgcaattgccgattatcccatggtgagtgttctttgcttacccgcgcctcccatggcatttcacgagtgtccccacaaaatccgaaaccgttgaatatcctatcaaatgtagtaggccccaaaacattttatttttcagtctcaaaaatgctatttggacgcttaaaatgccacaggacgaatga

SEQ ID NO: 52809 - DNA, 96 bp, Heterodera glycines
  Genomic contig location: Contig_ID=SeqID_4013; Location=2638..2733; Strand=+
  SCN-specific regions: Sequence locations=1-25,47-96
atggccaacgcaatgtacgcggcacgggcgcgcgcggccaaggcggaaaagcgtcaagcgcagctgcgcaaggcggccagagcaagggcaggaaac

SEQ ID NO: 52810 - DNA, 633 bp, Heterodera glycines
  Genomic contig location: Contig_ID=SeqID_4013; Location=2262..2894; Strand=-
  SCN-specific regions: Sequence locations=1-104,131-211,233-633
ggtgcagcggatggtggcagcccatcgtggtacgcgtgattcggctcagtcggcccaggcaaattgaacagcgctcggctcgtcgcgatttggcggtctgtggggaaaacaattggggaaaattattttcggtttaaaatttttttttaatctaaacttacgtttcctgcccttgctctggccgccttgcgcagctgcgcttgacgcttttccgccttggccgcgcgcgcccgtgccgcgtacattgcgttggccattcgctgaaaaatggggggggggggcaattagcacaatgaaaatgcacataacaaaacaattaattacctaaataaactgacgatttaagtggcggtggaggaggacgaataattaagtggatggaatgaatgaacggaatgaacgtggataagcaaaatgtgtgggccttaaatagcaaattttttagtcggaagagtcaaatttttcggataaattcatatataaaaggcacaaaaaattcatttggttgccattattttcatcattcattaattatcggcaattcatcttcatcaatcatcccttctctgtgtacaacgaaaacgacgacaattgagcaatgtcggaccatccaaatgttgcgctggccgacct

SEQ ID NO: 52811 - DNA, 264 bp, Heterodera glycines
  Genomic contig location: Contig_ID=SeqID_4013; Location=4391..4654; Strand=+
  SCN-specific regions: Sequence locations=1-183,205-264
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactagagcatcagagtgctaaaattaagttgtaaataaaatt

SEQ ID NO: 52812 - DNA, 663 bp, Heterodera glycines
  Genomic contig location: Contig_ID=SeqID_4014; Location=117..779; Strand=-
  SCN-specific regions: Sequence locations=1-322,344-387,411-663
atgtctttgaccgcacagaactcttccgtgccttccagcacttcggtggcggagaggcgcgaacgtcggcggcagaaaatccttcagaatgcggaggatcgaatctcgaaaattttgacagcgcatggtggcgaaagaagacaggcgccaacgattgatggaatgtacggggaagaaagggcggacagtggtggcgaaactgcaccggtggaactgacgagcaacgaggggtcgtcagtgatggatgacggtgacgtggtacggtattttgaaccgtaccgacacaaacaactaccgtacccaattcaccatcattgagtacgatagttggtttatatcggtgcatatcataggaccaatgagcgaacactgccttaaagatgtccaatattttctcttttcagcagtgccgcctggtcaattgccgcgagcgtttcgactgccaccgtttgtccgccgccgcttcgtttggcgttttgttgcgtttgctcgtccactttgacttggtccgatccgttccattgacttttctccccgcgttcatcgcttgccaatttttcctgcgcttccgtttttcaaatggcgtcacactcaatgcccaggattcgctgatgacaaattttttgctcgtctgtggcctcaatgaacgcagtgtccgtttgg

SEQ ID NO: 52813 - DNA, 522 bp, Heterodera glycines
  Genomic contig location: Contig_ID=SeqID_4014; Location=1008..1529; Strand=-
  SCN-specific regions: Sequence locations=1-219,242-470,492-522
atgttgaaggcaaagcctcatgttctgttcgtccaatgtcggtttttgcgaatgatgaaaagcattcctaaggacagcaaattcactgccaaatttggtgacacttccatggtgggcttttctaccgtcttttttcaatggtcgatggttggaattgtagttcgattttggcgaggttcggacgagtctgctgaggaaggggcaagcgccggaagagaagtgcaagcagttgttcccgacggaccccgacgcaccgatccaattgggcttcaacccattccaacgggccgaccgaaagtgtctgttgtgcgagctgggcatccaattggactacaaaaacggacggctgctccaacagttcgtctccaacttcagcgggcgcgtgtacgaccagcacgtgaccgggctgtgcaaaaaacagtaccagactctgttggccaccatcgcgaccagtcgcaaggctggctacatgccggtgctggtgaaggacgccaaatatttgcgagacccgagactgtttga

SEQ ID NO: 52814 - DNA, 89 bp, Heterodera glycines
  Genomic contig location: Contig_ID=SeqID_22156; Location=339..427; Strand=+
  SCN-specific regions: Sequence locations=1-89
atgcgaaaagcgaaatgcgaaacgccaaaaaatgcgaataatgcgaaaggcgaaatgcgaaaagcgaaacctcggcccatccctggagt

SEQ ID NO: 52815 - DNA, 621 bp, Heterodera glycines
  Genomic contig location: Contig_ID=SeqID_22157; Location=377..997; Strand=+
  SCN-specific regions: Sequence locations=1-65,106-459,495-621
atgaaatttgttctcctcccattgtctctcttctgctgcttcgcttttccgtgcatttgctacggtaattttaaaactttaaataattaaaatataaatttatttcacagggattcattgcaaagttggaatgtacgacacattgggcaatgctgcgattgttatttctgaatgctggatggaccagcacttctgttcggccatcggttgcgcaatcggtgggccacaattacttaatcaacataatttgattatataattgccacgttttaggcactgatcagatcacagttgtgtgggcttgtgagcagcaaaatgaccccaaagtgctcgtcaaaagaacatcattcaaaaactatacgtgctttgcaaagattggccagaagggtgccaacatgtccaatgaagagtttgctttccccgagttggccgaattggtcaaatgaatggtaattagccaaaaaaatagttattaaattaaaattagaaaatttccagttttatcgacagaaagtgcgaatgattgtccaacggatgtttagtcattttctaaccgtcttaaaatttatgatccaaaaaaatttgatcgaattcttctaatgtattgtatttgatagaata

SEQ ID NO: 52816 - DNA, 151 bp, Heterodera glycines
  Genomic contig location: Contig_ID=SeqID_22157; Location=1796..1946; Strand=-
  SCN-specific regions: Sequence locations=1-151
tacacaaaatgccccaggcgatcccctgctgaccacccttatgctgcgagcgcgcgaccggcacagcatgcaccggctccgctggctggacgaatgcgttcggatgcacgactttttgcgccggaacatttccgccaccgttgggggacag

SEQ ID NO: 52817 - DNA, 1147 bp, Heterodera glycines
  Genomic contig location: Contig_ID=SeqID_22159; Location=865..2011; Strand=+
  SCN-specific regions: Sequence locations=1-1147
atggtactgttggtcagtgcactgtacgccgtctgttggctgccccaaaatttgttgatgaacatttttgttacgtacgacccgtccattctctctcatccgtacattctgtacatttggtgagttttcaaagatcattacagtactctgttctattgtcacctaatatttactggcatacagtatataagtaccgtattcaatttttttttgttttcaggtggggcagccattcccttgcaatgttccattctgcggtcaacccattcgtgtactatgtgacaaatcggcgcattcacgcagcagtgaaggtaccatattcacattctgtacagtacctcatataattatgatcgatactgtactaaaaattacacaactttttatctgtactgtgatacaaaattaaaaaaaaaatctaaggcactaacttggtactgtatgcggtacggtcggtactcgaattctttctcccattgaattatatgatagcaaattaagtctaattatttcctcaaatttacagcacttgctccgctggatgccatgctttcggaatgcgcgaaatttggcactggccgagtttgatgtgaagaagcggcttgcctcctccttccgctacacatccgcggatcaccaacagcagcgccggacaacactgtacaagaccgtatcgaacagtttacattaggcgcaattttgatggcattttgttcaaatgtgatcactgatcagccccggggtatatgtagacaaaaacttaatttatctgattttttgctcataaaatattgttttttcgttttgtgttcgactaattttaggtgtactttagaagtggtcccgttaaaaaaacgcccaaaacgtgttccaatcaatctctaaggacctctaatcatcgtaaaaaatattgccgaggtgcggaaaaatcaaaaaaccggtttttgagccggtttaaatcacgaaaaattgcaccaaaaatcagccaaaaacccatttaaattaaaaatttccaaacaaatttggtatcattcgaaagctcttgacgagctaagtctaaaaatttgggatggagttaagacgaggccacctgagcactggggcaactgagtgtcccaatgaaaatggacacttaagtaacaaagaa

SEQ ID NO: 52818 - DNA, 938 bp, Heterodera glycines
  Genomic contig location: Contig_ID=SeqID_22160; Location=504..1441; Strand=-
  SCN-specific regions: Sequence locations=1-344,366-650,672-901,923-938
atgacgacggcattgttgccaaggtcactgtcctcgttgagcgtgttgacgacggcgacatcagcagcagcgaatgccaacaacaacaggcatggagatgatggtggcggtggtgccaacaatggacgcgccggtggggacgattccgccgccgcttcggctgcaatagctgcggctgaactgctcgcgccgccttcacctttggcaccgccaactgttgcgtcagaaaaggacgacgagaaagtaatcaaatgatgatggggatgggattaatccgaaattttttttcaaaatttagaacatcaatggcaaaaccgccgactttgtggtgcctcccccgtcgaccaacgatggaagggaagacgacggagctacagcaacaatgccgccattcaaaccatcgccagttgccgaaggggccgtgacggttgccgcttcgtctccggccacctccgtggactcgggcgttgcgtcgccgggcgctgccgctgactatttgctgttgaacgggtcgtcgtcgtcactgcgcgccaaggagtcgactgcggccgacaagtcggagcagtacaacaacaccaacaacagcgcgaacagtccatgctgggccactgtgccacgcacgcggcgccgcattttcaactttggcacaatcatcgccggcgacaccaacagcacgggcagcaacgagtctccgctgattgacgcgctgacactgtcctcgaccatgtccagcagcagcagcatttgcacgacaactacgggcgcatcaacgaaaccacaaaaaacgggacaacattcgtcgacgtcatcgatggcaccgatgccgtcgttgacactgcagaggccaccattgaaaaaggtgggtgatgtcggtttcagttagatcgccatttttggttttaaatttcaattaaaaaactaatgaccctactaataaa

SEQ ID NO: 52819 - DNA, 324 bp, Heterodera glycines
  Genomic contig location: Contig_ID=SeqID_22160; Location=1859..2182; Strand=+
  SCN-specific regions: Sequence locations=1-275,317-324
atgcacaacggcgaccgcttggcggtggcgctgttcaacgacgccgcagcggcagccattttcagcgaccggtccaactcggcacgcaacagttcaacccgttggatgcgctccacgatggcaccaccgccaatggcactttgggaagaggatgacgaagaggtggtggacgaagaggacatgatcattttgagaataagtcaaaggttatatgggggaatgaatatgtgttgtacttctaatttatatgctaacctgaaaatggagaaaacattgaaaatggcattttttggaaaattggggaaatgaaatttaacaatggca

SEQ ID NO: 52820 - DNA, 1320 bp, Heterodera glycines
  misc_feature (1211)..(1211): n is a, c, g, or t
  misc_feature (1316)..(1316): n is a, c, g, or t
  Genomic contig location: Contig_ID=SeqID_22164; Location=221..1540; Strand=+
  SCN-specific regions: Sequence locations=1-666,688-1320
atgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacaggcagttggtgccattctcacccaagctcaagtggccggtgaaaaccaagctgacacgcttggtttggtgtcggagtcttgcatcccgcaagagccaattgcgcaggcagatgatgtaattttcatcagacctaagacgccaccaaggcgatcactgcgcgtgcaaaaaaggctttcagcttctgttagccgttcgccttcaccggcgccaaaacgacccccgccagcaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaaaaaatgatccaagtgcatcatcctgctgtgcaggcatataagcaggcgcgtgagcagctcactgagcttctccaacaacaaaatcaggaagagcttcgtttcttccgcatgactttgttggatagccgcagggctccagctggtcttanagacccaaaattgcacccacaccaaataatcaccccttctacgggtgaagggatgttcgctattcatgcggaccccactggtgctcctccgccccaagaatttgngtag

SEQ ID NO: 52821 - DNA, 1437 bp, Heterodera glycines
  Genomic contig location: Contig_ID=SeqID_4015; Location=142..1578; Strand=+
  SCN-specific regions: Sequence locations=1-1008,1030-1043,1065 -1140,1162-1170,1192-1290,1315-1367,1416-1437
tttccgcccccctcccccttcagtgctttaccatcagctcctcctcccaccgtcggtggacaaagccaattccatcggacgacaaatgccaaacaatcggtgccgaagcgcagacgaaaagtcattttgcgacggaaacttttgcgaaaaggcgccaccgccggcgatttgcagcagaaaaagaaaagcggaaatggtggggcacaaaaaaaggagggaaaaccaattaaaatttgaaaatgtgcagcaaaaagcggtgccgtccgccgcgtcgtttggcgcgttgtgccgttgcagcgattgccgccgtcagaggacggcgcgggacaaatggctgaaggcggaagtgccgaggagcgacagagcaatccatggaacacttttcccttcgaaaatgagtttggcgtgccatcgacgggagggacggagaagggagcgacgatgaggacgaagacgggcactgtggtggtgagggggacggacagaggagaaggcgtacagctgggaagacgaatggcacgacggagaacgacggcaccaaacgacggacaaaagccaacgcatgatgtggacggtaagcaacgaaatagtaaattgtgaacgtaacaaataggagggggcgggaagagtagtgctgttcgagagtctcgaatcgagaaaagtctcgggtttttttaattacggcataattgaactgtctcccctttccagcaactgcttcttctgctgatgattctctgtccgttgtcgattttcttgccccaaatcccatcgctttccgccgtttgccaccgtttaatcggtcgtcggcggttccgccgccgtccctcgcccaccaattggtcgccctgttcagtgtcggcctttgtctgtgccgtgccgttttcggtgccttttgtgccctttttgcccctctcattttcctccctcagattgttgggcccttctccaatgcttttgctgtgccctgtttctgctcggcctttgccttcgccgtcgtcccctttcgctgctgcccttggcctttgacgttttgtccgtccttttggcccttttcttttggtcagtctcttttttttggcattttggctaattaactatcctctccattgtccccatttttccaaattgcttcatcttccttccccctcctctctcttcagtctgtccctggttgttcttctgctcgtcctgtcactgctcgccccctccgtccctccgccgcctttgtcccttttccgctgctttcttttcatcgcctccctgtgctttgccgtcattctcttcaccttttgtacattttgtgaacagagcgcagtggccgaaatgactaaaaagaggaaaagacggaaaacggaggacaaaagggaggaggaggaggaagaggaagaggaagaaaaggaagaggaaaaggacagaagagaaaggagagtatga

SEQ ID NO: 52822 - DNA, 853 bp, Heterodera glycines
  Genomic contig location: Contig_ID=SeqID_4015; Location=3978..4830; Strand=+
  SCN-specific regions: Sequence locations=1-168,190-497,521-853
atgccgaaggcgctgtccgcccgtgtgccgccgccgttcagttttgtggagccgccggccgaggtggtggaccgtcgatggggtgccggcgacagcagcagtgaggacatgcgccagggcaacggcacggaggaggccgaacctgtaccgccgcttgtgccgttctgctgtgtcgtatggaaatgggacgacaagggttggaacatgggcctcgagggcagtgccgaggccgagtgccgatgccgcaacgcttccgtgccgtttctgctgagcgggggaggaaacaaaagttggtttttggtccgaatgccgacaaacaaatggcaattggcactttttatggatttttagtgcccgcattaagcaagctccgtccatggcatttttacatgccggtggtactgctaggcaaagccggtaaatatttttgaaatttttccggaattgtaacaatagcagtactgcactcaccgtgcgtggtggtggttgtcctgctggtgctgctgctgtccccccatttgccgacttcccccgccccccaccaattggactgggattagtgtggcggtggcgcgtgcgttggccgcgttcgtctcccgctgctgctcgcgctccctctgccgcctttgaagtgccacaatctgcgggtcgtgctgcggtgggcccgggttggacagaatgtgcccgcgcaagtcggacgagtaaacgtcggggaagggcagcgccgacccttctgccggcaccatggtcacggtgttgtgccctgagacggggagaggtgtgaaaaagccggggaaaatcgggggaaaattggcatttcttaaaggggggggggaagacaatagcatcaaga

SEQ ID NO: 52823 - DNA, 2152 bp, Heterodera glycines
  misc_feature (168)..(168): n is a, c, g, or t
  Genomic contig location: Contig_ID=SeqID_4015; Location=4445..6596; Strand=-
  SCN-specific regions: Sequence locations=1-385,420-661,684-716,766 -985,1043-1127,1156-1202,1260-1267,1290-1344,1373-1419,1477-1528,1572- 1606,1632-1641,1670-1674,1696-2099,2123-2152
atggcaaaacattggtggcatttccaactcattccacaggcattgacagcgtccgaattcgcatcgaagactcgccattcgcccgattggaccattactttgaccaaacggcggacaaaatcaaatcagtcaaggtgggctgattggtggacaaattctatcgagtgngggcatacaaaagatgccatggatttccgatttccgaaaatttttgaggcatcagaatgccatccatcccctggggcataccccaagggggggggggggaaggtgtttgcgcgttggcattttgcgtcccatcaaacaattttttttaattcctctcctttttgatgcgtttttatgcagaattcatccgattgcttttccctttgttcaccgattcaaataaattatttattatttaaatttatttttaactcatcaaaaactctgaactcatttttcaattcaaattcaaagtcctccccttttctgtttcgctttttggcatcttttgcccccccttccgttcacttcccatttctattaattatttcggcatgaccttctttaacttttgtctgtactgctccaggaacgcggtggcaatacgctcgtccattgcgtcgccggtgtttcccgctccgccaccctttgcatcgcttagtaagcaaattgatgttgtttttgttgtagtgtttaatttttatattagggctgaccaccaaaaagcgtttttaaatatatttttacaattaaattaattaattatgttattttaatggtaattcaatgggtttttttttgtccattttcagtctgatgaaacacgagcgaatgtcccttcgtcaggcttaccattacgtgaagtccgcccgtccaatcattcggccaaacctcggcttctggcagcagctggtggaatacgagcggaaattgagaggttcgttctttatgtttgccttttggtgactatctaatggtccccattcgttgggcactttggtgtagttggttatcacgtctgcttcacacgcagaaggtcggcggttcgagtccgccaagtgtcaacttgtttttttctaatttttagggttcaaaagtaattataaaaatagtgctaattaaacaattatggaaattggtttttttatttatatttatttatttattggtgtgcacaaaatgatttcaataaatcactttatcgttgggcactttggtgtagttggttatcacgtctgcttcacacgcagaaggtcggcggttcgagtccgccaagtgtcaacttccttttttctaatttttagggttcaaaagtaattataaaaatagtgctaattaaacaattatggaaattggtttttttatttatatttatttatttattggtgtgcacaaaatgctttcaataaatcactttatcgttgggcactttggtgtagttggttatcacgtctgcttcacacgcagaaggtcggcggttcgagtccgccaagtgtcaactcccttttttgtctcccgttttaatgtaatttaaaaaggcataattaaacaattaatagtttttttaaatttaattatttttacgaatattctctggtttcaactaaatccgagtttgaattaatatataattttttattattgccttttacctatttttaaattctattttatcctccaacaaaaaatttattaaacattttttggcggcattggcaccgccggaccttccttcgcttttaaattttcaaatatttactaaactttcatgtctttattcttgatgctattgtcttcccccccccctttaagaaatgccaattttcccccgattttccccggctttttcacacctctccccgtctcagggcacaacaccgtgaccatggtgccggcagaagggtcggcgctgcccttccccgacgtttactcgtccgacttgcgcgggcacattctgtccaacccgggcccaccgcagcacgacccgcagattgtggcacttcaaaggcggcagagggagcgcgagcagcagcgggagacgaacgcggccaacgcacgcgccaccgccacactaatcccagtccaattggtggggggcgggggaagtcggcaaatggggggacagcagcagcaccagcaggacaaccaccaccacgcacggtga

SEQ ID NO: 52824 - DNA, 323 bp, Heterodera glycines
  Genomic contig location: Contig_ID=SeqID_22165; Location=1818..2140; Strand=+
  SCN-specific regions: Sequence locations=1-110,158-204,285-323
atggcaagaaaattcatcggattgttgttggtgctgaagcttgtgcatgcccagtgggacggtggcatgaacggtggtgcaccgatgggcggcggaatgggtggaggaggtaaaataattaattgatttaaataaaataaaaatatagttttaaattcagtccctcttttttttttattaaattggtcatttcaaagtttatgcttttaaaaaattttttaggcttattattaataagatctaattaattaatttttataaaaaatgtgaatttttttttttttggtcaaattcatagattcaaaatattttatcctttagga

SEQ ID NO: 52825 - DNA, 706 bp, Heterodera glycines
  Genomic contig location: Contig_ID=SeqID_22166; Location=394..1099; Strand=-
  SCN-specific regions: Sequence locations=1-403,427-706
atgtcgtctttgatcaccttcataaggaaattgagtaacaaagcaaaaggagcatttggtcattgcctcggcaatttcatcagaaacgggttcaatgttctggcaaagccacttgaagaaggtttgttcctcgcttccagtcccattagccaactgaaaatgtaaatgatttgtaagaaaactttcgaagcgcaaattaaaagaatatatgattaaattctcaaagttggggtggtacacgtcaggggtgtaaccggatgagtcaaaagtaaacccagattctaaatttcaaaattcattagggattataacggacaagggggtggtcaaaatttatttacgaaatatccccccacctgggagtccgagccaggaaaaattttgaaatttgagtaatttctgacaagttttgtccaaaaatgaacatttgttatttttagccaattttcaagaaaatacttactttattttttccttgcttccatttgatttcagttgtcacactgttcggttctgctgcagtccaattgaattctttgactatttcagaattctcgaagaatggatttgggtcgaaagaaaactaaatgaaagaatttatttgttttgatggtccaacttttcagcgtctgtcccttaattactttcaacttataaccggccttgatgtcttcattttcctcaatcttgaaatgaaagtaataaa

SEQ ID NO: 52826 - DNA, 911 bp, Heterodera glycines
  Genomic contig location: Contig_ID=SeqID_22166; Location=316..1226; Strand=+
  SCN-specific regions: Sequence locations=1-67,89-358,382-848,904-911
caatatcctcgaggaagaagaggaagaatgcttgcactatttgacgaaagtcgaggttatcaagcccaaaacattaaatttattactttcatttcaagattgaggaaaatgaagacatcaaggccggttataagttgaaagtaattaagggacagacgctgaaaagttggaccatcaaaacaaataaattctttcatttagttttctttcgacccaaatccattcttcgagaattctgaaatagtcaaagaattcaattggactgcagcagaaccgaacagtgtgacaactgaaatcaaatggaagcaaggaaaaaataaagtaagtattttcttgaaaattggctaaaaataacaaatgttcatttttggacaaaacttgtcagaaattactcaaatttcaaaatttttcctggctcggactcccaggtggggggatatttcgtaaataaattttgaccacccccttgtccgttataatccctaatgaattttgaaatttagaatctgggtttacttttgactcatccggttacacccctgacgtgtaccaccccaactttgagaatttaatcatatattcttttaatttgcgcttcgaaagttttcttacaaatcatttacattttcagttggctaatgggactggaagcgaggaacaaaccttcttcaagtggctttgccagaacattgaacccgtttctgatgaaattgccgaggcaatgaccaaatgctccttttgctttgttactcaatttccttatgaaggtgatcaaagacgacatttggccaaatccgctgcaatattttcttgcgcctgacgtggaagcactcgacgatgaagaaaatgaggaggaggacgatggtggggatgaggaggaggaagaggagaaggaaggggagggccaatga

SEQ ID NO: 52827 - DNA, 474 bp, Heterodera glycines
  Genomic contig location: Contig_ID=SeqID_22167; Location=770..1243; Strand=-
  SCN-specific regions: Sequence locations=1-397,419-474
atgcttgcctatctgagtcccatcaccccgcttctcgtcttcattctgcccaattttcgtccatcactcttccaatgctttgtcatccaaagtgtgccattggtggcaaatttctatatttattcactgatccttgtgattgggcttgaccgtttgctcagcgcattctgcccaatttggttagttagtgcttggtagagaccggcgcaggacaggatcctgcgcaggattttgcaggatcacagtccgcaatcctgcatatttttgaaaatacaggatttacaggatttgcaggattaatcctgccggatcctgtcctgtaaaaaattttgaattccaatcctgcaacaggacccgcaaatttgatttatgcaggattcagcaggatcctgcattgattttttgaaaatttttaaaaatagaatgccaaatattcagaaactttcttttttcaaaaatttttttcttaataaa

SEQ ID NO: 52828 - DNA, 339 bp, Heterodera glycines
  Genomic contig location: Contig_ID=SeqID_22167; Location=178..516; Strand=-
  SCN-specific regions: Sequence locations=1-87,109-339
attatgagctacccaatttggcaaatcggtctttttaaacgcattaaagaagattcagtcaattgcttggagtgtaagcaaaaaacttattaatttttcatcttcatcattttttggtttaaaaatatatttgaatactttttttactttgaaagacttttttattaatacagaattttttgaaatttcataaaatccgcaatcctgcgcaggatcctgcagattttaaatgcaggattgcaggatttgcaggattaatcctgccggatcctgtcctgtaaaaaattttgaattccaatcctgcaacaggatccgcaaatttgaaatttccggtctcta

SEQ ID NO: 52829 - DNA, 817 bp, Heterodera glycines
  Genomic contig location: Contig_ID=SeqID_22169; Location=602..1418; Strand=+
  SCN-specific regions: Sequence locations=1-205,227-265,287-413,435 -573,596-817
atgccgtctaccgctattccaactgcgaccattctatttttccaagatgaaatagataaagaaccgaaaaaccgtgactttagcagagttaaagatgatgcattctgggcttttttacgtggatatcatccgctggacagtcttcgaaaagtacgttagcttagggctctatctccaaagtcccgaattgaaaaagaagggaccgagtttggcatcaggccggtataggattaccggaattcaaagcccgattttaaatttaggtaaataattattggaaattttcacaattttgaaaaaaagcccagtcgaaattttgacctggcccgggatgtccggtaaaacgggctttttttgaacgggcggaccggtcaactgtcaaagcccggtccgggtactttcaaaattccggtctctaataggtatgatattgccctttgccttcaaaaataataaccttcagcggagattggaacaaatcatcgatctgattcaagaatatggtgtgagtaggccacgagatgtgggcaagtcaattttgcttaacacgctcaatgaatgttaccgcaggatttatcacattaatttgtttaatggaaaaatggtgagagtttcatattaatttctattaatcaacactaaaccctttttccagttaactgcaatttttgggacccaaactggcaacaaagatctcgacgtgttcaatttcatacggaaatggtgtggcgcaatttttcgagcagaacagcaaagcggccattcgatcataagttatgtgcttgaggattatcctggtgaagcaaaggatattttt

SEQ ID NO: 52830 - DNA, 1215 bp, Heterodera glycines
  misc_feature (9)..(10): n is a, c, g, or t
  misc_feature (20)..(21): n is a, c, g, or t
  Genomic contig location: Contig_ID=SeqID_22172; Location=1..1215; Strand=+
  SCN-specific regions: Sequence locations=1-885,922-1188,1210-1215
tctagagtnncggtgaaatnntgaattggaaataaaatgccaaagcaaaaaaacggagcacggcattttacacagtatgaaatcaacccgtggatgaagcggggtacggtagtggacgaacggaaagcgatggaccaatggacgcaactcaaaagggccattgagggggagggagtcgaagtgagtaaaacgaaagcatagaaaggcacggggaaagcccaactgaatattgttgccccttttggtgctgacgctggaccaagtgaacggactgccggacatggtcttcgcctgcaacagcggtcagtccgcacagagacggcactttcgcaatgccaaaaagcgttaaatgaaccaatgaatgaattccaacaaactctttgccaggccttttctaccgcaataagctttacctttcccactttcgccacgctcaacgaatcggagagcagcggcacttcgccgacttttacaaagggctcggcttggagctgtacggcgccgattgcgcggaagtattcgaaggcggcggcgatgcgtttttctccgacgagcgaacgctttgggccggctggggagggccgaggacgaacagaaaggccgggcaaagccaacgaatgcatcgtgacgagggatttcggtcactttaggcctacgaacacatccgaaagatgggcgacttcgaaacagtgccctgcgaattggtcgacccgcgcttttaccatttggacacgtgcctttgcccggttggcattgactcggcggtaagttttttggcatttttcaattttatttcatttttcagctttggttccctcccgctttttctgagaacaccaaaaaagaagtgaaaatatttcgatattcattacttttacgcgttccaatttatttaattattccatttttaattaatttttaggttttttaatcccccccccccttcttttggtcctacggcgtttgccgcgggcgatcgcagtttcggagaaagaagcaatgacgtttgtgtgcaatgccatcacaatccgacgccgagtgatcagtccgaagggaattagcgaagaaacacatgcgaaattggcctctattggctatgcagtcaaagaattggaaatgggcgaatttatgaaagtggggagagggattttaaatggtggcgatttaatcttttagtccggtggtgcatgccaatgtttggtgatgaaattgtga

SEQ ID NO: 52831 - DNA, 254 bp, Heterodera glycines
  Genomic contig location: Contig_ID=SeqID_22172; Location=1519..1772; Strand=-
  SCN-specific regions: Sequence locations=1-254
ctggcaaattgttacgctggctccggctttgccaactcctgttcgtcaggctaaagaattggctaagcgtggtcgtgccaattttggggaattgaagcggtattatttaactgccttttaagagtttttcttgcttttgcagcactccacaatatatcccgcgcgccgagaaccagcaaatcgactaccagcagttgaacagacgcctctgctacaatggacatattttcgcggacactcgctttaatgcatga

SEQ ID NO: 52832 - DNA, 527 bp, Heterodera glycines
  Genomic contig location: Contig_ID=SeqID_22173; Location=34..560; Strand=-
  SCN-specific regions: Sequence locations=1-401,424-484,508-527
atggtcattgattggacgcgtaaaatggaatagaccctttttaaaacacttaaatttgttcagaatgtgcttcaactaaagccggacaaacgcttatcagcaaaaggaattgtgcaatatttaaatggagaatgcgaattggaagaatttttgagccttgaggggaatgatgcacggaaaattgtcatttttaatgacttaaaaatgcaaaatttggagcaattaatttcaaatttgtgtggcgaagaatcaaatttattcagggagttgaaaaatgtgatcgaaaaacagcagaaggaattattggcagggaatgagaaattggagaaatgtgacacaaaaggcacaaattttgatgagtgatttgagaaaaaagcaaagggtgtgattgatttgctttgtttccacttttgtatttaatttgtacacaccaaacggattcaaaccgctgacccacaaagtgtccaagccacgaaatgtccacaagagtaaaaatccatgaaatgcccagaaaaaatataattaaa

SEQ ID NO: 52833 - DNA, 719 bp, Heterodera glycines
  Genomic contig location: Contig_ID=SeqID_4017; Location=267..985; Strand=+
  SCN-specific regions: Sequence locations=1-554,576-644,668-719
  Gene Ontology: Mol. function=protein carrier activity; Cellular component=nucleus; Biological process=ribosomal large subunit nucleus export
ctaaaacgaattttgaatgacatgttgagcgtgtaccaagtgatttccggaaacctgaacaaagctgtgaacgagcagggcgaacaggcgctgaaatggccgttggtgaagcaaatgcgaattgtgaagaaggagattctgacccttctgtccacttggatttcgcgtgcttttgagccccgtgtcgctattcccgtaaaatccaagcgaattgttttaatctttttgtcttctttgaggatcctttgttcgtgccagttcagctggtcatcgagaatgtgattaagcctctgttcagcaccgttctcgtcgattatgaaatgaatattccgcaagcgcgagaaccgaaagtgctttccctcctttcgattaccattgtgtctctgaaggtttcacaccgtcattttgaatttgcaattgttggtttcttgaaggaggacgcgtcggcacaggtccccgctattctcgacgcggtgttcacgtgcactctcgaaatgatcaacaaagatatggaagccttcccggaacaccgcacgaatttcttccaactgctgaaggccatcaaccaacactgcttcgacgtgctgatcactcttcccgacgaagtttttggcctgctcatccaagccatcgtttgggcagtgaaacacacaatgagaaatgttgcggaaaatggcaagaaatttgcattaatgaatgagtgttttaatttacgatga

SEQ ID NO: 52834 - DNA, 1336 bp, Heterodera glycines
  Genomic contig location: Contig_ID=SeqID_4018; Location=1404..2739; Strand=-
  SCN-specific regions: Sequence locations=1-12,38-443,466-576,598 -635,657-919,941-993,1041-1042,1064-1336
atgctctttctgctcgtcctcctccccctgctgcccctctcttctcaaagtgatccctattcgtcgtctcccgctgcttcgcccgctttctctccgccttatccgccgcccattgccaatgcttttcccatttcccctcaattcccttcgtttttgtgcgttccgtgctccgccaaagaaaattctctacaaatccctccaccttttgtcggacaacaatatcccgttcaaaacgacgccaatttttcgccttttggttacggcacagtcgccggatacagtaatcaacagttatacggcaacgcacacggcactccaccgatagttagtgaaatagcatatgataatcagcaactgtacaacaatggggcgtatagtaatcctcgaccttatgccaacggaatatacggtaacgtgcatcaaattatttatatattgtaaagagaatttgaaaagatctttttgaaggatacagcaatgagcctgtgtatggaagaatgttcccggggtacggtagaacccccggatacggtgacgagaatgtgccgaatgcggcgggggcgtacattcaaacggaaatgccattgggaaaactgggaaaaggagtctttgggagggcaaaaggtaatgtgaaggggaaaagcaatggaagcagggctggacgtactggactttacttttaattacggaaaaccgtaattacgtggggttaaaaaacgccgtaattagcgaaacccgcaatcaataatctaaaaatgaaaaaaaaaacatcatcacattagcgtagttgagtcatatgacattttttctgcttctcttcctaaaattgagtccattcctgaaaaattagtgaaagtgatggaacaatttgcagaaggacgacggagaaacgaacgcaaagcggcgaaggaaacggatcgaacggaggaaaacacgaagaaattgggaagagatgaagggaatgcgaaatggaaagaaaggaatgcccgggggaatgaatcaacgcactcattaattaattagtcaattcattagttaatccttttgtattttatcacttttacaacgggccattggaacataaacactcgcaatgacatgaggaggatttgtcggattggtcaacaataatcgtcattcgttggcaattaattgcctttccttcatccgcccattagcaaagcgccgtatcccaacggcacacagcgacagtcgcgcaacagcgcaccgccgagcgaaaagtcggcacagccgcccttacaaatgcccagcaaatcgacgcaagtcgcttggctcggctcccatccgcagccacgtgcctttttaggaaaataaa

SEQ ID NO: 52835 - DNA, 638 bp, Heterodera glycines
  Genomic contig location: Contig_ID=SeqID_4018; Location=1..638; Strand=+
  SCN-specific regions: Sequence locations=1-406,428-610,636-638
  Gene Ontology: Cellular component=cytoplasm
gttaggcccgcaaattcgagtcacagtcaaagggttcttcagctttaaccgcacagttacaaagatgcgtgaacacatccgagacttcctcgtccagatcagggtttctctctcttcgaaattgaaaaaatgattttccattttgtccttaggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcggccctgccttccccgtttttgttttttccatttgtccatcctgacattaaacgatcgttcgtattttttctctgcgcccatttgaattcctttcgtctgtttttgctctccttttcatgttttgtgtccgttctgctgagctttcccctgcttcttctaatggagtttgtttctttgcttctgattgtctctactcgtctgttttggtgagagatttgattgtttctgagtgtgttcctccatccgttttgctttatgaattcgaccattgtcgaccctccattattcacagtctgtcatctcttttttaaatattttttgtctgaa

SEQ ID NO: 52836 - DNA, 288 bp, Heterodera glycines
  Genomic contig location: Contig_ID=SeqID_4018; Location=2744..3031; Strand=-
  SCN-specific regions: Sequence locations=1-99,121-288
aatttgaggaacgacggaagccatcagagaagggaaatgatgccaaaattggaatttggggcggggaattgcgattggttgccatagtgattagcaccaaaaatgttttggattattatggtattttagctaccatttgcttttgtctccttttttggtcgcccatttgtccgtccatccgacagataattccctttgtcagcgttccgcgtcaaattccctcccattcggcttcccgccggtgcttttaaagtgcgcttcgcccctccgcccattcattccgccgtg

SEQ ID NO: 52837 - DNA, 836 bp, Heterodera glycines
  Genomic contig location: Contig_ID=SeqID_4020; Location=1..836; Strand=-
  SCN-specific regions: Sequence locations=1-644,667-804,826-836
cttcgaactgacgaaaagttttttacgccgtcttctgctgttgtcacccaaataatccttccgacgatcgctttttgcgtcggaatggtcgtggccatgctgatcggaatcaacaaatgtaagcaatgggagctggacaaagtgatcgaaatcagacgaacccgacggatcatccaaaggctaacggcacgactccgcgaacgcaatttcaaagccattcaaagtattgtaaaggaatggtggcggaaaggcatttgaacgaattgcagaagcaagggacgtccgtaagagagccattgcggcgaaggaagcgcggggcgaacctacgccgcccgaaccgtccgccgtccccccgccgttttatcgtcaaagtcccccgacgggcaattcgcctccccccacttacgaagactctctcctgcaccaattcttcatggaatgcgtctcagtgaacgaaaatggccccacaatttgaaaactggttaagcttaaggccaagaagtacgtgaaaaggggtgcattgttggccaattcactggtgactcagacaattagcagaacgatctcatagtccaaagtttggttagtcataatattttgtacaattcttatgaaatattttctctgctttatacaaatatttgaagcaataaattcacaatttttggatttgcgacgattaaaagccggggaagagaatgaaagggacgcgggcgcagtgctgagcccacaattggccgtacaaagcgaagcagcgcaattcgtcccttttgattcggacccaaaaaagtgccagcagaaaggccaaagggagaaatgccattggccgtgtccat

SEQ ID NO: 52838 - DNA, 266 bp, Heterodera glycines
  Genomic contig location: Contig_ID=SeqID_22176; Location=1..266; Strand=-
  SCN-specific regions: Sequence locations=1-266
aaatgaaccagcagaaaagtgcgaagcgggcgacgcgcggacaacgccaaatttatgaagaaaacaagcagactttgttatgctatgtgctggccagcatttgctcttccgttttggtgttctctctcaattactttctttttctgccgcaaaagggcgcgtgggtaaagcgaaaatgctaaagaggcggacgaaccttttttcagattggactcgcgtcctgtgtggagcagtcaagcattttctgtgattcttatgtctatgat

SEQ ID NO: 52839 - DNA, 132 bp, Heterodera glycines
  Genomic contig location: Contig_ID=SeqID_22176; Location=1967..2098; Strand=+
  SCN-specific regions: Sequence locations=1-132
atggctgcattacattatgcagaatttttttctcaatcgattgcaaaatttggtgcaacttgtatgcatagaaaaaaagttatatggagagaagtaaatgtagttttttacattattaagaatgaagagata

SEQ ID NO: 52840 - DNA, 1064 bp, Heterodera glycines
  Genomic contig location: Contig_ID=SeqID_22179; Location=698..1761; Strand=-
  SCN-specific regions: Sequence locations=1-228,251-355,422-826,848 -928,950-1064
atggtcagtcccaagaccatgattctcgacttgactttgggtctaggcattaatttgccgagtaagttttatttcgaggcgacaaattcctgaattttttatgcctcgttaaccgattaaggttctgtaatatttactaattaattaagggctctgaatttggctaatccaaaaggttattaaaaagcctcttaaaaagtttaaggttaaagtctcaagaatttgttcaaaaatttttttttatatatttgggtttaatttcggcattttccacatatttggctatgaatctatttaaatgacgggactttgtttttgcacgttcttttctacatgcttgcagtttctgtctggcaattaattaattatttaataagtgctacttaattatttggtaattaattcattggcaccaattaatcgggcgcacaattggttgtctaaattgtcattctggcgtccggcacacatatgttttccgctgtttttcagggcaagcacctcggctgaacccgggcgtttggcacagtgtgccaattccgttggtcggctccgtgtcaatgattttcaccgaggtggtggccgccaccaatgccaatttggtggccaatgttatggccgagacgggccatcccgtccaatttgtccaagctgtctaatgcagcagcaagtagcataatgctgaagatgtgattgaagatgttaccgatgattgatttaaaatgaattataattaatgatgaagataaatcccccccccccctattttttggcattttacaatttttttataaatccggcaaattccattactgtaaaatgattgataatgatgatgatgacttttccatatatttcattaaaatttgaacataattttgtttttttaattcagaaaaaagtatcactagtgttatacaagggcccaggcatttggacaaaaactgtgtctgagtattgccaggatccagaaaagccgggctcgggcccgggtcaaagtttttaaaccggcccctttcctggaaaaaatattcataattgaaaaaaatgattattagaataaa

SEQ ID NO: 52841 - DNA, 702 bp, Heterodera glycines
  Genomic contig location: Contig_ID=SeqID_22180; Location=293..994; Strand=-
  SCN-specific regions: Sequence locations=1-702
  Gene Ontology: Mol. function=protein serine/threonine kinase activity; Cellular component=actin filament; Biological process =protein amino acid phosphorylation
atcatttgcagggacttaaagccggccaatttgatgttcagcgacccccaaacattgcaactgatcgattttggctcggccactgagtgtccgctgcgcattttggacgcacgcgacagccgacgcattttggacgaggcggccgaactttgcacaatgtgagcattttgtagtaccaaaaacgaacggcggaagtcgaactttttgtttacttttaggccttatagagcacctgagttattcacgtgtgaaattggagcgatgattggggaaagcgtggacatttgggtgggtgccattggttttggtaaaaccaattaattagggacggaaatgccattaacgactgactactattaatcggtctattactcccccccccccaatttgccattttgtcttcagtctctcggctgtgtgttgttcgccctgtgttactttcgctcgccttttgacggcgttcatgaaaggggcgacagcgtcgctttggcggtacaatcggcgaagataaacttcgacacggcggtgccgtaagttctaatctcattaagcgagcagtaataaagcctatttttgagagttgatcggcacattgccgaactgatccaatcgatggttttaatacggccctcggaaaggccgcacatatcgcagattaaaaaacgggtcgaccaaatgcaaactttggatgaagtgaaggac

SEQ ID NO: 52842 - DNA, 380 bp, Heterodera glycines
  Genomic contig location: Contig_ID=SeqID_22181; Location=18..397; Strand=+
  SCN-specific regions: Sequence locations=1-4,27-100,122-264,288-380
acattgtcacttctttcctccggctgagatctcctcgaagttacgtcggttcccttcgggcagcaccaggtattgcatgtgcgcgtcacaggtggcctttgtcttctctgggattgacacaacaggcacaagtgctccatacagtgccacttgacccgtgattgtgcagttgggacgtattttggcccctctttccagtgagatgaaggccatccctcctgccaggccgccggatggcccagacctgttgtagccggcctttacttaaataaacaaaaatttcaggtgcgtgtgctcttcgaaacatggaagagggaacatttgaacggagtgctgcagcaattaagaggcatgaaaccaaggaggtcccaggattttag

SEQ ID NO: 52843 - DNA, 855 bp, Heterodera glycines
  Genomic contig location: Contig_ID=SeqID_22182; Location=1054..1908; Strand=-
  SCN-specific regions: Sequence locations=1-3,51-195,223-423,445 -523,545-855
  Gene Ontology: Mol. function=inositol-145-triphosphate receptor activity; Cellular component=endoplasmic reticulum membrane; Biological process=calcium ion transport
ttcctctctctctctcgctctctctctctctcatttctctgtctttttctgtcagttttttggtccttcttaagcggaataacagaagcggccgttttctgacttatttggccgacctttgtatgtgccgaggggaggccaacaaaaagattcaagaattgatttgcaacaccgtgctcaagtaaccacctgctgaaataaataattattttaaatttaattcgaattcgagagtttatgccattttcccagtgaacgaaatcgcgacatttttatgcggacgatgatgaagccaatgggagcaaaagtggacaaagaggtgatcaaacgatttgggccttttaaatccattttattcagcgcaaattcgaagtgttcgtctgttggaattacgccggcaccaactgtcgcactttggtggcatgcgccgagtcgtgccgagaggaggacagagaaatgatcgactattatcggcatcagctcgaactgcttgcgcaggttggtggaccgaagtctaagcaagaaaatataagaaagcatttatcattttggagatgtgccaagaccaacaatatttggccattgatcctccccccgagcggaaactttggaacatcagccgcgaattgccagccgacctcgtcctccagtgcttctcccgccccccccccttccctcattctcattctctctcctttcaggtgtatgtccgaccatcgccttccgtttgacataagtccgttttggcattattctttttgcttttggcactttttttctccttttccgttaggggcttctttcactcgagttatggttcatattcacatgattcgttgggaataattattcatt

SEQ ID NO: 52844 - DNA, 1133 bp, Heterodera glycines
  Genomic contig location: Contig_ID=SeqID_22183; Location=92..1224; Strand=+
  SCN-specific regions: Sequence locations=1-58,128-330,353-360,413 -532,852-959,1014-1080,1113-1133
atggcaaatttaggcaaatgccatttaaatgagattttaagcagttttaactgttatctttttatttttcaaattaaatatttaattcttagttatatttttattttggtttatttaaataaatattctcatgctggtattcacaatgctaacatccgtatgaacaatgctaaggtaatcagcgtttttataaattctaaggaattaatctttttaaatttatgtttcagttattttatgttatttggttttttatataccataacgagatggtaatttcattcaaatgagtcatttttttgttgctatattaaggtacaatgtttttccagtttttataattataatttaagaaacgagaaaaaatataattaagaatttaaaaattttataataacatgaaatttttttagaatttaccttttggatttttctattatatatattagctgtttttataagtaattgtttttgtttatataaaaagggatttttaatgcgctttttgttggctactaatattttacaattcatataatttttaaaatttttaataatatttatttattctttataatataatttatgcttattctaacaggctataataatttaaatttgcagtataagtaaaaattattttttgtaaatttatttttgattaattagcaaaacaatttccttttttatttcattaatttattcaattaataatattattttttcatattgtatcaatgaaaatgattcatgagtagttttaatatttttgtgcatatttatttttctattataatttataattttataaaatattatttaattatttggaaaacattatttttatttttcgaatgaaatttttttagcaaatctaaatgattcatattttattgagttctgaattatttatttattttttacaggattttaccggcaaatttttgcaattagtaatcttatttaatatttttatataatttgtgatttaattatagatttttgttttatttgatctcttgattggagatcatcgccatctcgcacattaggaattttgttctttgctaatttatttgcttattattattttaattcttaaaattttttatgttcaaaaatatttctttata

SEQ ID NO: 52845 - DNA, 332 bp, Heterodera glycines
  Genomic contig location: Contig_ID=SeqID_4021; Location=190..521; Strand=+
  SCN-specific regions: Sequence locations=1-30,189-296
gaacggaaccaccggagactatttctcaagtaaaatttatttatatttataggattaaaatttatttattgataattatttatattttttaataattttaaatttttatttatgcttcatttaaatagtatcatcaattaattttttcatttaataaaaatttaattgttttaattaataatttatttctagctactttccgttgaatcattgaacccatttttcgatgcactgctctttgcagcaaatattacttcatcatcttcgtcaatcataaaaaataattcaaaaaaccgtaaaaattaaattaaatttaaaaatttattattaaa

SEQ ID NO: 52846 - DNA, 2216 bp, Heterodera glycines
  Genomic contig location: Contig_ID=SeqID_4022; Location=1502..3717; Strand=+
  SCN-specific regions: Sequence locations=1-121,146-309,350-415,437 -629,651-805,832-1022,1066-1125,1201-1291,1313-1314,1356-1580,1602 -1655,1708-1716,1797-1904,1942-1968,1993-2165,2187-2216
atggacacaaccaatgataataataaagtatttgtccatcaacaaaagcggggcatacgacgagaaatgagtgtttccattgcatcccaacggcctttaaacgatttgttttggcacagggtaattaattaataaattaaaattagagtattcaacaactaatcaatgctaattgcttttaggtgttggtcgaagtatttcgtggtgaaattcgtttttctgtcgaccgtttgaatgcatttcaaccactttcatttccattcgcaacatccacgaaatttagcattggaggcgatgaaaagtaaaaccataaaaatcatttttaaaaatttaatataaattttattttcagagggaatggctttgtcggatgcattggcaacttccaaattgatcaaatgctgcatgattggacccagcaattagcacagaaggacagggatgaagatggtaataaatagcccgacacatgacagtatcctatacagggtactgtacttttctgaaaaacgggattcatagggcttcgcaggactagtccagaaaaagcattatttcattgtaaactttaaaaactgaatcctaaaacaggactcggaaattcgaagtaaacccggcttttaaaatgcgtattttacagaaatgttttacaagtgtaatataatttacgaaaaaatgcggattttactatgttattttacaattgtaatttatcaccggaaaaaagcacatttatgttaatattttacaattgtgtattactggaaaatacattttatgaaacattttgtttaaataatcacctataacaaaaaacttttaaaatgattaaataatattttatccaaacattttatcttccaatttacaatccaacatttgacccaaacatgaaaagcacattttatgataatattttacatttgtaattgattaccggaaaaatgcgcattttacgatgacaaaatggcccttggaataaaaagattattatgtaaaagcattctctgaaagaattggccaaataataataattatataaataataatattttatttttttaacttagttcgtgttgtttctggttgtcttgagttatgtgctgagaataaatgtgaacaaggtcaaataattaattttttaaattttcattttattaattaaaattaaaactaattacccaatgaattaattaattactccccaaataaggctccaaatgtgtggaacattttgacacagaaacaacttcgtgtgcatgtaaattaccacgaattcattatggcgagcattgtgagaaaagtgagagaggaaaattaaaaattaaattaaaattaataaattaaattaatttttaaaattattatttttagatatcaatgaaaattcttccgctacttttcgtggtggatcttctggatttttacgcttttttaaccttcctatcagtgcccttcattcggacgtcatttttagcattcggactgatcagaggagggcattggtgggaaattgttgactttaattaccctagttaattagtattaattagttgttatgatacacaaataatatgtaattgtttcagctactttatgaacatgatcaggccgataattttgtgcaggtgaatgcaattaaatgtttttctaaatatatttttttacttaattttattttactcttaaaattttattttattttgtgtaaaacactaattattataaatgttttttacaaagattattttaaatttttattttttaaatatttaataaattcataaaatttttaagattcatttggctgatgactaccgaattgttctcacaatgaataatttgtcctccattgtcagctgctctgtttttgctccaccaataaaaagtcaattaaaaacaacaaaaattattttaaataaaattaaattctttataaaagcccaaattagtgtattttacctactctatttttattatttatttttaattcattttcagcatttaatgacatgcgttggcttcagctaattttggagcgcagcaatgagccgggcgcgacggcaccacaaacagtggtgcttcatgttgacgatgatcagtgtcaaattggacctgttctattgaatgatccggattcaaccgatcaccaaaatggattatcattaatggatgatgaagaaaagacggtggaggagggtaaaaatgttaattaa

SEQ ID NO: 52847 - DNA, 3000 bp, Heterodera glycines
  misc_feature (1130)..(1130): n is a, c, g, or t
  Genomic contig location: Contig_ID=SeqID_4022; Location=6275..9274; Strand=+
  SCN-specific regions: Sequence locations=1-193,236-359,383-412,437 -440,513-702,1058-1082,1104-1229,1273-1304,1326-1414,1437-1615,1653 -1661,1683-1757,1817-2101,2123-2186,2210-2476,2511-2514,2542 -2731,2755-2770,2793-2807,2829-2946,2968-3000
atgcgcgaaattttggcgcgtcgcagtgccaacgctaatgagcagaacgaaaatgggcaacaaaggcatatggacaaaattgggacagcgacagtaaaagtgccaaatgcaaagtcaacaacggcgtcaacagaatttttatggccacaacaaattgtccattttgtgggatgcatttcgagtgaatttttgcaaaatttaataattttttattaataacaatttttattaatttcggatgtgttggttgtgttcgagaatgacctgaatctgatcacttttacgccatttttgtattatttacaaaaaagtgaactgttgcatcgcaatgttttcgttgtgccatccgatgatcagccaaaacaacaccaaaaacaaaaactgttggcaccgatggcatgtggccaatttaaagtgccagaaatggcaaaaagtaggccttttaaacaatttaattttttaaatttaaaaattatttttcgtaaatgtatgtaaataaatttaattataaagttttttgaacagaaaaattatcatttttatctttctgtcagaaaataatttcgtttcattaaaacagtaattgacatgtttatgtgatttgaaaaaattaattgttttatcagattataatttgaaaaacgggaaggaaaccgtttaccgcaatttaaattggaaaagggacgattgaatcaaaagttgtaaaattaattaaaattttctaattatatgtcttttttaatatttcataaaaataacattaaaattattttaaatttcatatattttataatagtatcataaaaatcattaaatattttaattcaaattttaatttaatatggttaataaaaattaattaaataatatctttttttgaaaattcttaaataattaattcaaatgttgaattaataagtttttgtcattgcaaatattttaatatctttattgaaaattaattaaaaaaacaattagttaatttaaattttcattaatatttttctttttggaaaattatttaataatttattttcatcatttaaaaataattaatccacttcacttttagccatttcaaattaaaaatgcatttagagtcacgccgaaatgtgacttttcccgtttgngaggcaccctttggaccaattgcattccatgagaacgatgttagctctgagaagctgatcaaaactgatcaaacagatgaggcaattaatgaaaaaggcattttaaaatgaaatttctaaaatttaatattttaatttttaaggaaattcatttgtccattggcttttcctcatttttctgctgctcattttgttggcattttgtctgtttctgatcagtttgatctgccgacggaaaattcgtcaacgaatcggtcgaacttattatgtgctccaaaaatcggaaccaaaaaatggagggccaacatttgaaggtgtgcaatattcaaataaatttaatggttttgtgacagaaatttttcgagaccgaattttggtccttgagacgagtcgccaaggcttcaaaaattcgagacttgtcgagatctgcatatagactatcgccatcgctaacaggacccttggcaattcgttcaaaaaactcgaaaataaaattttaaaaattcgaaaaaaataaaaaaacaaaaatgaaaatacagttcttaaaacaactggtccaataaagaagcgacggtttgggagcagaaccgattcaatggaacccattcagctggctcaacataaaagtaaaaattatttttttttaacttaaaatttatttttacatttaaattttcaattttttaggattttttcccctggagggctctttttcggccactccaccggtcacgccaacggcaccgctactttttgctgaacaaaagcctatactaaggccaattttacggcatttgcctcctcccaggctaccgtcatcatccattacggtaaaaaaagggaggagaaattaaagaatgggaatattttttaaaatttttgttttgccagaaatcccctaaacacccaattttcttggttttttaagaaatttgtagaaattctaaaattctcaaaaattagtaggaaagtttgtattttttataatttttcgaaaattactatttttttttgttttacagaatatattttcaatacaaatagccatttaagcggataaaatttaataatttttttttcaaaggatgcttctcctcacactcagtcggctaatgaaaatgatggcatcgcaacttcgtcgtcctccacaatttattacacggcgcaagaagaacagtttgcggcggaggaggacaattcgtcaacaacaatttcgtttaaaagcttaggtcacagaaaagaaaggaaatattaaaaattttcaaaaatttccaatttaaattttctcgaaagttttcttcactttttttgatttagttggtgctatgacgttagtcaaaaaccatcaaatgaaaataatttttgatataactttgctcaaaggcaataaaatttttaattcttgatatcattagataggcctaggtgttttctattagcctataaaatttcaaaaagtttcgttaagtttcaagaaagttatgactgaaaatgttcaaaaaaacacggctgagggccaatagggctgactgatgttctcaagagtcttgacaatggattagaaaagtcacggattttttggaatcttgcaacgaaatccgaaaattaaatttttaataattaagcattttcttcataaaaatttgtttatagttttaaaaacattgcctgcagaggcaccttttccaaaaattttctgggatttttgaaaaatttcacaccaaaaaaatcatagaaaaaaccgaaaaatccccaaatgtgcaactttttttacttaagatgaaaagcagacgagcagtggggacgaagattcgacaacaattggccaagcttttgaagagaatgcgcccgaattgatggacgagcgcac

SEQ ID NO: 52848 - DNA, 107 bp, Heterodera glycines
  Genomic contig location: Contig_ID=SeqID_22185; Location=108..214; Strand=+
  SCN-specific regions: Sequence locations=1-107
ccgaattacgcgctgaaggaaatgaagtgctctgtctggagacaccgccgaatttcagtgcagttggactccattaccaacgcttcgatcaaaccagcgacgaagag

SEQ ID NO: 52849 - DNA, 60 bp, Heterodera glycines
  Genomic contig location: Contig_ID=SeqID_22186; Location=41..100; Strand=+
  SCN-specific regions: Sequence locations=1-60
ggattgctggggtcgtgggttcgagtcccaccgggcgagttaccttttatgttctacaaa

SEQ ID NO: 52850 - DNA, 1999 bp, Heterodera glycines
  Genomic contig location: Contig_ID=SeqID_22187; Location=1..1999; Strand=-
  SCN-specific regions: Sequence locations=1-323,345-1036,1065 -1070,1092-1142,1165-1168,1191-1401,1431-1598,1621-1781,1804-1999
  Gene Ontology: Mol. function=ATP binding; Cellular component=integral to membrane; Biological process=adult behavior
caggccattttggcaatgtgttccgtgcccaactgtccgacccattttcgggccaaattgtgccggtggcagtcaaaacgctgaaggctggtgccaacaacatgcacacatttgagcagtttttgcgcgaggcgtcaatcatgaggcgattaagccatcgaaatgtaattaattaattaggcgagaggaagggggggggggggtaattaaaaattggaatttttttaaacagtagtcaattttttcttttctcgaagcaattaaaaaatatccataagattgactaaaaaatgtaattacatcatttgaaaatggtcacaaaaagtcatttcctaataacagttaatttttgtattcattttttcattaaaaaaaattcttagaaattttattcattttttctaaatttcctaaaagttttgtcaaaaagatgctaatttttgattctgcaatttcggttttgagtctttgtaggaaaacaaagagaatttttagtgaagtttattaagaaatttgtcaaaaattttgcaaaactatgaataactgaaaataaaaaatgcaaattttcaagcatcggaaaaattttttacaataattttttaaggatttttggttaaaaattccatttacggaccaaaaattacgggaaaatcgcaaaaatccgtaaccagtaattacgtaattggctcaagtaatgaatgaggtttcatcactcgttcgtttgttcattaagcagagcgattttacactactgtattgattgaatacagtacattatatgcagggaaaatcacccgaaatttgcgtttcgtacggtaaaatacttatcgaattcgggtcgtccgagtccgagttcgagacgagactataaacttcataaaacggacattttcatgcaacagattcttcgcatttatggcgtctcatttttggcccagtcgcccgccgacgacggcgccgctgcgccgtccgttgtgatgccgttcatgcactttggcgaccttcggacattcgtcggcgactcatttcgagtgccaaaagcatttttagaaaacatttagcagtctaagaaatttattattttttcttaatgccatgggggaatcgcccacttttgcgccagccactttggcgccaaacgctataacatttttatttaaaaaagttacggccaaaaaccctcaaaaacttggtttttttggccattttggtgtcgcgcgccataatttgttttgtaacctaaggttattttttgaaattatgcaggctaatcgagaactcttaggcctatcgattgacattaagtttgtcttatttggctgcatatgaaaaaagttagaacattttaaatttggcggcgccaaattgtccggcgccaaagtgacaacccgaccctgggccataataaattttttaaaaatttattttttggacaaaatcttcttaaattagcagaacaataattgtttatgagttgtcagcaatttttgcaaatgtgcacagtacgataaaaacacaatgcaggtgattacggtaatggagttggcatggttcgcccttcaaattgccacgggcatggcctacttggccgaccaaggctttgtgcaccgtgacctggccgcgcgcaattgcatgtactgtattattttgtctaccatatccaagggcaattcagatcaggaaattttaaaaatagaaaattcaaaagactaaaagcccttttgaatttttgttccgaaaaaatccaataatttttttttgttgccaaagccctttttattttaatttacataataaattgttcgctgaatttttttgctttgtttctatagaaaatttatgggtcaagtccatgaaataaaaattcagattaaaaaatggctgctaatattttcattttttttcctgccaactctcattcacaggcttactgaacggggcatcgtcaaagtggccgattttgggcttgccgttgacctcaatgacgcaacgctatggg

SEQ ID NO: 52851 - DNA, 762 bp, Heterodera glycines
  Genomic contig location: Contig_ID=SeqID_22190; Location=1979..2740; Strand=-
  SCN-specific regions: Sequence locations=1-101,270-300,538-762
atggcatgctcagagtcttactgtattgactttatcttgtttactgtatcgaaaaagaaaaaaaggagaaaatttaaagaaaaaactattttctaatttcgtttttaatatatttaaaagaaaattaatatcaaaagattaattttaaatttaaagaaatataataaaaaataataattttttattttaaaagaaaatttaaataccatcacaaaaaaaatattaattttttaatttctattttaaataattaaaagataataaaataacaaaactttagatgaatgatggataaagccgattttttattgtttattaatttagctattttagtattttattgattaattattttgaaaacatacattttttattattaaattattggaataattgcattattttttcttttttcattcttaaattttcattttcaactatttttaaattcttttcacattcgattaatttttttttgtaaattatttaaattaacattaatatttatgttaatttaaattaaatttcttattttttccagggacaattgttgtgtgtgagggtgggctcgcttcattgcattgtccggcccaacatggaattgtcatccatgaagcaaattttggacgctttacactgcttgagtgcaatccgaacagactgaccaacatcacagaccaatgcgcaaacaatcggaccaaagaattgatgcaggccaggtatacggtggaatcaattactaccgtaattataacggaataa

SEQ ID NO: 52852 - DNA, 531 bp, Heterodera glycines
  Genomic contig location: Contig_ID=SeqID_22191; Location=1746..2276; Strand=-
  SCN-specific regions: Sequence locations=1-300,324-324,345-420,445-531
atggcgatgatcagcagggtaggggtgaaaacgaggagcacaaaacaattatgatttgttgttgaaaaacatttgattaaacatgcctaaaaatacgaaataataaaggaacaaactttgggagaataaaatgaatcgtttaaggagtggggaaattgggggggggggggctcattaaggaagcacaaaagtccatcaaaatgaaaaaatgacccgccaaaaattctcttttaaaactcaaatatttgtccaattttgcaggtgggcaaacgtaacgaacggatgagagaaaaaagtgacgggggaggggaaaaagcggggaaaagagagagagagagagagagcagcagagaaggaaagaacaaagataaagtggatgaagagaaaaacagaaaaaatccctcgcggggcgaaagtaacaaattttttaaaatttgaaaaatatgcattaaaatatggatgaaaatttacagtaaaatatgctgaaaatggaccaaaacactgaaatatgactaaagtattacaaataaa

SEQ ID NO: 52853 - DNA, 1432 bp, Heterodera glycines
  Genomic contig location: Contig_ID=SeqID_22193; Location=114..1545; Strand=+
  SCN-specific regions: Sequence locations=1-76,98-472,494-963,986 -1215,1250-1432
atgccactgtcagttacaataatccgatacggtgggcaatgcctttttcaccgtatcagactcactaatcaatcattatttccatttccatctgctgaagacagtctttgttcactttcgacgattgctcctccaaagattgcatttcgaaggcggaggcggcagcggaagcccttaaagtgttttttcctcttttcttttactttttaccttttgtgtttatttttagcgcatttatccccttgttgacgccaagggaattcacatgaaaattccgatgcccggctatccctactcaaaagacggtggattttggagtgggtggggtaaactaaaacccaaattatttttgcaggcaaagcgcaagtggcggaggagtgccgtcgtctcgaggaatgcgtgcgcaattgtgacgtggtgagtgaatgtctgccagattctggcgatttccgtggcatcgttcgcctttctctcagctttttctggtgatggacagtcgcgagtcgcggtggctccccactcttttggctgctgtgcataacaaagtaaagccgaccattttttgattcgcttaatggaaattaagtttgctcttttgacctgttttagttggcctttacagttgccctcggtttttccgaatttgtgatcattcgtcacggtgccaaccctctccatgttgcccattctcgtgctgctggtgaggacaccgaaacttcgtcttccgtcactgatttttcgctctcgaagaggacagaagtgactggtgccgagttgggctgctatttttgtaatgatgtgaccgccccgggcaattcgaccaacggtagttccaatttggcaatcatttgcaattgctccgttcttagacagggcacttgaccagcaatgcaccatttcacgttcgggcatttcaatgattgcttccggtgggttaaatttggcatttcgattatcaattacattatttaatattattttatttgttaggaattgccaccgaactgttggcttctgtccttcaacacgaattgggcgcagaagcgcccgcccttttggccgaagtggacgaaaacgcgagtcaattgggcgccactccgcaccaaatccgcggttttatgtcacgctttcatctgatgatgcccaccgtacgacggtacgaccgatgcacagcgtgtgggcatacggtactgtttggtttggtttactgtctttgtatttttctccatttaatttttaaaaaatgcttcattttatccttacattctctcaggtcaaacagttctaccggactgagggatttgaatttttgaaccgaatcttccaaagtcctgccgagttggagcaaatcaccggattagccgagttacagagacaagcggacgcatttcaatcggaagttatcgaaatggacgacagtgaaagcatttaa

SEQ ID NO: 52854 - DNA, 216 bp, Heterodera glycines
  Genomic contig location: Contig_ID=SeqID_4023; Location=55..270; Strand=+
  SCN-specific regions: Sequence locations=1-216
agacaaagtgatcagagggaagagcacgatgagtttgatcaaccggaaaaagaaactgacgaaatttcgcttatcaatgtcattgattgatggtgatttagcaaaaagaaattggtgatcgacgggagacggacgaagaaaacaatggagaagaagagcaattcgattttgaatagacacagttcgataaaaggtttttcttcgtttttacaggaa

SEQ ID NO: 52855 - DNA, 1315 bp, Heterodera glycines
  Genomic contig location: Contig_ID=SeqID_4023; Location=630..1944; Strand=+
  SCN-specific regions: Sequence locations=1-105,128-145,168-181,205 -939,976-1315
  Gene Ontology: Mol. function=ATP binding; Biological process=protein kinase cascade
acccaacaatcttaatttattttacgggacagaacgttttgctgacggacactgccgaggtgaaattggtcgactttggagtcagcgcacagcttgacaggacagtgggcaaacggaacactttcatcggcacgccttattggatggtggggagagaggggcaaaggatagcatttatggggggagggaggggcaacagatggcatttatgggaaggattgcatggattttaggcccccgaagtgatcgcttgtgacgagaatcccgagtccacctacgactcgcgcagtgatttggttggtttgagacttcccatttgcaattggcaatctttcatttgcttttcagtggtcacttggcatcaccgcgttggaaatggccgaggggcacccgccgttgtgcgacatgcatcccatggcaattcccccccccccccgccgaaatgcccttcctaatttggagcttttccttcagcgcgctcttttcctcattccgcgaaatcctccgcctcgcctcagcagaaaatcgtccaaaaaatggtcgaaaaagttcgaggcattcattgaggtcagttttgattttggcgtttcgcctttcaaagcgttcgaatttttaagtgcgttttggaaaaggactacacgagaaggccattcacagaaaatctgataaagttggcaggccaaaagatgggtttctaatggcgaagaatactttttagacacacattcattagggaccaaatttcggaccgaattgtacgaaatgcaattagagaacacgtggaaaggcatcggaaagtgcagaaaaagggtaaaaggggagaaaaagcgacggacaaaaggacgacggacatttgcagaagtggacgattacttttcgttcagtggaagcgacgaggaagaagtgcaaatcaacaacaatttggacagactaagcgacaacaaaagcaatgccaaaagtgagaaaggaaaagccaaagcgaaggggcgggggagggagacaccaccacctccagtgacaaaggaaggtcctccccaagttgggatcgccaagcgcaaaagactgcaattggaaatcataacttactgcattagttggttggcttttgatcagcctttgtttgattagattctgcgattagtggcgtcgccgtcactcccttcgccgccgcgggcggtggccgtcgcgtcgcagcgaccgccgccggaggggcggaagagacggaaacgatcaaagggggcggcgacctgcgcaaagagttccagcgcattcaggagaacaaccgaagcgcattcgaaaacgagaagccaatgaa

SEQ ID NO: 52856 - DNA, 103 bp, Heterodera glycines
  Genomic contig location: Contig_ID=SeqID_4024; Location=2449..2551; Strand=-
  SCN-specific regions: Sequence locations=22-103
aaaattttaattattttttccgtttgacgcacatccgaccaaactgaccaattattgtagaagatactagccgcaagaaacaaaaaaattaaaaagttaataa

SEQ ID NO: 52857 - DNA, 2840 bp, Heterodera glycines
  Genomic contig location: Contig_ID=SeqID_4025; Location=344..3183; Strand=-
  SCN-specific regions: Sequence locations=1-114,136-352,374-521,544 -950,988-1032,1063-1108,1144-1240,1269-1697,1720-1838,1861-2082,2104 -2258,2280-2338,2361-2448,2470-2538,2561-2818
atgcgatccctaaataataagcttaacgaatttactgcgattatagccctaaaagattttgaattagtttttgtaactgaaacgtgggcaaaagaaaaaatacctttccaaccatttattactaacaattacaaaatatatgaagctagcagaagcggaaaaaatggtggtggagtaatgattttgacaaaaacgagcgtaaattcgttttctgtcttatcctgctctaaattcaattgtgaaatccaaattattcagataaatggagcaaaaaaattaagaatagtattactttacagaccaccgaacacttctgctaatttcacaaaaaagattctgaacctcattggtaactattttgaagaaaattttatattaatgggagactttaacctaaatgcaaaggacataacttggaccagtggaacgccttatgctaagtcggaaaaaggaaatattttttgtgaattttttaataagtatggcttattccttatgactaatggacccactcgtggtagtgcttggcttgatctgattctctcttctaaacctgattttgttaataatgttttaattgaggacatttttagttctgatcatctatccactaatttttcattgtcatttcctcagaataagagtaaggcaaatacatttacagtacgcaattataattctactaaacttaatctattaaatttaaacttatcttcaattttaccctacaaattactacaaaaatttaccattgaagataagtttaaccatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttactaaaaatgaaaataattttctgaataaaggaaaaaatgctatctacaaatatataaataaatttacaaaaaattttgaacaaatccactctcttagttacgagaaccaaattatttttgatgattatttaaaagcagaaacttttgcaaaaattttccaagaatccttttcaaattcagatgttccacaaattagcagttgtccttccaatcccaatggaccatctatttctgatgttgaatttaatgccgatgaaatttctaaaattttaaaaaatttaccgaatcgagaatccacatcccccgatgaaatttcctttagaatcttacgtaattgccaccttactctttctcctgtaatttccgaacttttcagaatatcaatggacacaggcaaaattcctgaaatttggaaaaaatctattgttatacctctctttaaaaaaggtgaccgaaatgatccacataattacagacccatttctcttacttgctgtctatgtagagttatggaaaaaataattgcaaaaagcatttataacttccttcatctgaataatttaatatccgaacatcagttcggttttgttaaacaccgatctactaatactcaactaattacagtattagaagattggtacgacagcatatacggtaagaaaaatattgactgtatctatgtggactttcggaaagcttttgattcccttcctattaatattttaataaataaacttcataacattggcattaggggaaaactgctaagttggttatctgaatttttaaaggatagattttacagagttaaaattaacaacaaattttctaatttatatccgattcagtctggtgttccacagggttctgttcttggccctctgttgtttttaatatacattaatgacctcccgcaggtaatccctccgggagttagcatcaagctttttgctgatgatgtcaaaatttatgtttcttacaaaactcgtgatgaaagaagcaaattaaatgttgctttagacaatattggaaaatgggctaatgcatttggtttaaacatctcccaaaataaaacatttatattatttctcggcaaaaataattcaaaacaacaatataaattttgcaacaatattattaatgaggttgaatctattagtgatttaggcattttaattgataataaattaagattttcaaatcattatactaaaattattaaagctgcttatttaaggattcgcaatattgccaaaattttaaaaacccgctctatacgtatttggaccaaagtattcaagacatacattcgtcctcttttagaatatgcgcccgaaatttggaatcctacatacaaaaaagatataaataaattggaaagatgccaaaaatattttacaaaaattgctttatttaaatgtaggcttccgtatataccttacgaacaaagacttgatttattcaaacttcaaactttagaagaaaggagaaaaacaattgatttagttcaggcattcaaaatcatcaatggtctcactcatcttaaaaaagacatattcccacaattttctggtcacatcccttataatcttagacgtaaagttgtgttaaaaccacaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctgaataaa

SEQ ID NO: 52858 - DNA, 151 bp, Heterodera glycines
  Genomic contig location: Contig_ID=SeqID_4025; Location=3667..3817; Strand=-
  SCN-specific regions: Sequence locations=1-151
actttgtgaggaagaacgccgactccactctgtcgtggtcttgaacctgccggaaagtgaagaaactgtgccctctgctcgtgtcaactccgattttgtggatgctcaatcaatgctcgacacctgtgagatcgaatgccggccatgtcag

SEQ ID NO: 52859 - DNA, 1762 bp, Heterodera glycines
  misc_feature (721)..(721): n is a, c, g, or t
  Genomic contig location: Contig_ID=SeqID_22195; Location=685..2446; Strand=+
  SCN-specific regions: Sequence locations=1-139,315-336,472-696,718 -836,859-1096,1118-1237,1260-1368,1390-1396,1418-1504,1526-1593,1623 -1706,1737-1762
atgttttttgtagagcttgttaatagctttcgaatgataccaagactgttggatctggataacaaagaaaaaagttatagccaaaaacatgctggggtcaaacttgtggggccaaccgtggtaggaagaaaaagaaattgaggaaaagaagcgagcagaggaagagtaagaaagggggagaatgaagagcgggaggaagaggaagaaaagaaaggaggaaaagaagcggagggatggggaagaaaagaagcggaggagcgagaaaggaggatgaagagagggaggaagaggaagaaaaaaagcgaggaaaagaaattacgtagaaagagtaagaacggaggaggatgaagagagggaggaaaaggaagaaaagaaaggaggaaaagaagcggaggagcgagaaaggaggatgaagagagggaggaagaggaagaaaacaaagggaggaaaagaagcggaggaggaagaggaaaaaggaggataatgcagtagggctgtgcgagaagtgatttttaccgggaaccgagaaacgagaccgagaaatgaccccgagaaacgatacgagaacctagaccccaaaaaacccgagaaatttctcgactcgggaatcgagaaccgagaaatctaaagtgacggcatttttttgcttttaaaaacgtttttgctgtttttccaaaaaatttttgtaatttctttctgattgttaacagattttcaccanaaactgataattttttgcgttttgagacaattagcgactatttttacattcaaaatggctttttttgcgcattctttcaaaaactttttttaggcggaggaagtccggcgccagaaaattttttggtatttttagtgcgacttgataacagattttaaccaaaaaggctacgctaattttttcatggcaaattttaggtaaactttgaaatctttggggaattttgtggcacggcggtgccgataggcgccgccgggaaaattttttgggatttttaaggaattttgttaagaaaatttgttcaaaattttggtagggggtcgagtccgttttaggtcgattcttaggggcgtattttttgaattttttggcatcggaaccggaaaatttaaaaaatagttaaatcactaaaagttatgaccaccttggaactgtttatcatttgcagttctcttgttaatggatgtataatgatcataatttttgaaagatattttccttttaccacccattaaaattttattagggaaaattggcttttgaaaatttggaagtttttggaagcagttttaggataaaccagcaaattttctcaaaaagcagcacaaacattggttgtttgtttgactcgaattttttatcgagaatattgaacaatttattttcttaaaaattgataaatcaatgtcaaaataagcaaaaatgtgaaaatttcgatttggtttttttttgctaaaagtaagtaattttcaaaatgatttaaataccatacatattcagcaatttttggcagttttattttttctagtcctaataataatagtaataataatttgtgcgtatgatatgggggaaaaatgccgaaccgagagcggaaatttgaagaaaaatatgggatacaaatttcagtataaattcgaatttttaaagactcgtgaaaacacctcccctgcggtatacatgatcgctgatcactcgggatcggatttttatgtgctaaaaaatgctgaaatatgtgctaaaaagcccaaaaaatgctaa

SEQ ID NO: 52860 - DNA, 920 bp, Heterodera glycines
  Genomic contig location: Contig_ID=SeqID_22196; Location=24..943; Strand=+
  SCN-specific regions: Sequence locations=1-45,81-127,149-274,297 -830,853-920
atggctgaaaacaaaaagcacaatgaaacggatggctgtgctttttctgtttctccctccaaatcattgtctaatcttttgcttgacgacagtccgtcggatgaaagcgccgatgaacgcgatgatcagactgacttttgtgggcagcgtcagcaggtgggataatttgacactgtgattcgcatttggagttcagttcagattggtgacactcacagtcattcgtcatttgttgccgaagttgtcgattcccttcagggggctttggaggacggttttttgagagagaatgaaaaggcgaaactgagtggggatttgctgaacaaaataaaattggaagtcaatgcctccaaattggcctacaatattcccgcagaagaagtgccgggccttctcttcactgcttttcttagtctccctggcgttgtcgacaaattttcggagttcacaaaggtgtcaattactcataattatttatcttgcatttataattatctttctccgttagatgtacaaccattggcgtggactttggaaaatgttttacagaaccacttttgctcaatcacaaatgctttttgctattgaggtaaaaaattaaaaaattgtttttcaaacgatgtaatattttttggtcttttatactacaacaattatgcaaattattttgctctaattataatttgaaaaagatttaggagaaagcgtctgattctgaccgcttccgtcgtgttctgccaaaagtgctttactttttgagtcaggaagttaaggcaatggacgatgctttaattgttgattggtactccaatttggaagaaaagtcgcaactgaagaaagaagagaaactggctgaattggtcacgtggcttcaaaatgcggaggaatccagtgaaacggacgacgaaggagaggattaa

SEQ ID NO: 52861 - DNA, 672 bp, Heterodera glycines
  Genomic contig location: Contig_ID=SeqID_22197; Location=448..1119; Strand=+
  SCN-specific regions: Sequence locations=1-619,641-672
gatatgatggaagcaaagcatgtggttcgtgttgggccatttccgctgcggcggtgctcaccgatcgaatttgcattgaacgactcaaaaagggcattcactcgtacaccaatcacgcgtcgtccttcgcttccgcgcaagacattttggattcgcatttggacaataaatgtccgtcatttaatgttgctttgcttaaaaataaattgataacaaaggttcctgttcgaccgaaagttcgacagcaattgtatggaaatggttcgccgagacgggcgtcgtcacaggcacaaattactcaatgggcttgggctgcaagccgtacatttatcccccaacaaaagaattgcctgtgaaggccaatggttgccgaaaacaatgcgacaagcaattgacgttcaattacagagagggcagagtgttcagtgagtgaaacggggaaaaagcggataattagagtacatatcagggatggcacggaattccgatttccgtttttgaaaaaagcgcgccgtaaaaaacgtgtaaattagtcactccttttcccaaaaatgttctaaaataatgcaaaatgacataaaaaaagattttgataaaatcattgaataatttttcaagcaaaatattcaaataaccaaaaacatttttgaaacaccttttactaggtaataa

SEQ ID NO: 52862 - DNA, 990 bp, Heterodera glycines
  Genomic contig location: Contig_ID=SeqID_22198; Location=111..1100; Strand=+
  SCN-specific regions: Sequence locations=1-240,262-520,542-584,607 -763,785-990
atgaaaaacggaaagtgagcaccggtgcggacggagtttcgttcccaacgggtcaaacaagcgaaatgttacgcagtccgacctttgccgacttttccctgactcctttcacttccggcgacactttggcattcaatttggtcgctaccatcaacgccgaaaatggtattttcgagtgccccatttactctttgttcgcgtcctttgtcagattgttttcttgtcccttctttggacggttccctgtcaaacaatgagaaaaggaacagtcagaggattttttccgttcattggctcaacaacaaagagcaccgcttcatcttgagcactttgcaacttttgatggacgcactgccattttcgggctctgaaaatggcgttagaggtaacactgacagtcgatgttcggactctttgcttggctttctgtaaatttcagatttccaagcgcttcattctctgcactcgtcgacgagcagtgccggaattgccgccgcatctgcggtcgacctgctcgacgtctcccaccaccccccgccccactcagtcacatcgccaaacctttcaaaaacaatcgcagcaacaattgtaaaaacaaaaattaaaacagtaaatggcttgttacaattcaactttttcgttaaggaggaagcatcgtatgcgaaggatttgctcgactacaaattggaaatgcttcttcgtcaatggaataagtccagcgaccttttgtttgccattcatccgttggacggaagtcttatgacttggttcttattctttctcacatccgcagttccttccatgcgtttcttgcttaattcaggactctcgagtggcttgatgacgcgtggaaacagccgaccgtaagtttcgcttcgcgccttcccgacgcctttccgctggccgacgtcgcgtcaatgtcaatttggctgcacatttggcaccccttctctcagcatggctttaacgcgttgtacttttctcagcata

SEQ ID NO: 52863 - DNA, 649 bp, Heterodera glycines
  Genomic contig location: Contig_ID=SeqID_22199; Location=464..1112; Strand=+
  SCN-specific regions: Sequence locations=1-454,477-649
  Gene Ontology: Mol. function=protein binding; Cellular component =hydrogen-transporting ATPase V1 domain; Biological process=vacuolar acidification
actgtcaacgacagcagaatgtacgaattcttccgtgaggattttaaacttgaaaagtggagaaaaggcgctttgaaaaatgccttcgttttgatgagcaaacaacggtttcagcatgcggcggctttctttctgctgggcggctcactgaaagatgcaattcaggtaaaccgaggtcaatgggggtggggacgtgtccggcacttttgtgccatgatttgctcacccatccttaccttttcagaccattctcagccgtattggcgatcttcaattggcattggttgttcttcgtttttacgagtctgatccggaaagacaattcgaattgcttacggaattgctgtgcagagagattttgggctgcgagccgtcgcaattccattcgctggtcaaagaaggcaaagtgcactttccctccgccagcaggtgcaactgacaatgagacggcgaattgaacctttttgttttgttcagagaccctttcaagcggtcgatggctttttggttgataaacgaatacgcactttctgccgccacattgcttgaagagccatcgacggcacaaaacgacggcgaagacgagcagaggaggggcagtcttgtgaaggcacgccctttcctatttgactgtttttgcgttgagtga

SEQ ID NO: 52864 - DNA, 639 bp, Heterodera glycines
  Genomic contig location: Contig_ID=SeqID_22200; Location=627..1265; Strand=-
  SCN-specific regions: Sequence locations=1-204,226-639
atgtctgatagtcaacaaagcgatcagcggaatgaacgtgttactcgccgatcgctgtttggttctgggcgaccaaatgacgcggatgaatggctgaaaagtaatctctttatttttttctcaaattaaaggtgcagggtcgttccttaaaaaccatcataatgggcgttatttaaaaaaccatacattatgaaaatttttgtcgaacaaaatatttataactttgctcgaaagcaacctttcaaaaaagttatagctcgaggaactcaaaaagccttgattttcgtacatttttggccataacttttttaaacttaataaaattttttgaaattttacaggctcataaagaacatttagatctatcgaatgacagcaaggattaaaaatttggtctttttagagcaaagttataagcaaaaattttcattatgatggttttttaagtaacgcccatttatgatggtttttaagtaatgacatagcaccaaattaaattgttcaggcctggaaaataacgcaatggaggagaaagtgcgaaaatggagcttcgatttccgaattggatgtccattgaaaaaggcgggtgccgagtcgccatcatcaagccatgtttacgaagcaatcgacgaacgcgag

SEQ ID NO: 52865 - DNA, 172 bp, Heterodera glycines
  Genomic contig location: Contig_ID=SeqID_22203; Location=192..363; Strand=-
  SCN-specific regions: Sequence locations=1-172
gttgccaaattgccgcaattgtcccaatcgtttgccaaggaattgaagccgttaagtgacgccgattcggtggcatttgcaccgtacggccaattggttgccgactttgtgcaccacgtggaacagtccacggaggtgcaatggccgggcgtgccggagggcgaaatgagcg

SEQ ID NO: 52866 - DNA, 1265 bp, Heterodera glycines
  Genomic contig location: Contig_ID=SeqID_22204; Location=1081..2345; Strand=+
  SCN-specific regions: Sequence locations=1-227,252-300,330-544,574 -603,640-666,688-699,728-822,844-996,1018-1165,1193-1222
atgtgccggttcaccacctgtctgctcaaatttgtcctgttaagtccgttggcaagcgaatcctttcaatcgattggcaccatttactcatttttcatcttcgagcgcaacacaatggcccacgttctgatcattgaacgcgttttggccacggtaacggccaaaagttatgagcgcagacggaagcccttcttcactttgggttggctgatcattgtggtcagcagttaatttttaaataattattttaacattgtttaaaaaagacttttttggagaattccgagatcaacaagcttttgtaactgtttaattttaatttttgtattaaacgaatcaatggccctggagctgatctcatgacaagatccaaatcttcaatctcacattaaaaaactgcgagatgatttactgaacacagatttatatatttttagcattttttgaattttagcacttatttttgtgtgttgcaaaaatgttaagaaagacactaaaacttgaaaatattaatttttcaaggcaattttttgatgagatcacgaaaatttaaaataattaaacaatttttttcacactagtgattaatttgacaaaattgtctaaaaatatatagaattttttttataaataaaaaatccttatttttcgaattataggcagcagaataattttaaaacaaatttaagcatattggagaataatttgatttaaaattttttttaaagcatttttcgtctagtctttagcacattttcataacttaaccgattttttaattttttcagatttccttgggccttttcaatgcaattggctacaaagaaaatggtttttccattgttttgacgaattttgcgctgcttttctccgctggcattgaattgtgtgtgttttcactgcttcgatggcacaatgaaaaagcgtactttcggacattgcacagttcgaacggacacaatttgtcagaacgataccaagtagggaaacggagccaaaaatgaacaaagttttaacagaacaccccgtaaatttaaatggaatttccctatttacgcctccataattgcttttgagcccaatttgggcaaaaacgcattaattatttagggcagctttcatttataattagggataggatttttaagggccaaaaagtcaaaagtttttatataaaataattttaaattaaggcaaacaattattcattgattacagttgcaaataattatatatatttgaaattttgaatacattttttttaa

SEQ ID NO: 52867 - DNA, 357 bp, Heterodera glycines
  Genomic contig location: Contig_ID=SeqID_439; Location=3023..3379; Strand=+
  SCN-specific regions: Sequence locations=1-291,314-357
atggacacacattacgcggacattctgttcaacgaccatttgtcattgtccgatcggtccaatttggcctatcgaataggtggcgcaattgtacatttgaatgttgaacgaagtctcgacttaatgggaaatatgtgccataaaacgggcctgaaaattcaaaacgcttcgcttttaattgtgggattaatgagggaacaatttggccaaatgatcgaagattttggcaaggagcagctgcagaaagacattttctcgcttccacttgtgccttttgtggaaaatggagctgagtttggacaacatgaaaaaattgctgatgagcaaagcaaagctggacaaactgctggaccctga

SEQ ID NO: 52868 - DNA, 275 bp, Heterodera glycines
  Genomic contig location: Contig_ID=SeqID_440; Location=19..293; Strand=-
  SCN-specific regions: Sequence locations=1-110,132-275
atggaaatggggcaattaagcagtgagaaaaaattctccaaatttttacatccttaacagctaatttttatcaagttaattttgaattagtgaaataatatgttaattggacaaaagaaaaagaatttttattgcagagacaaaatcatgcaattatgaatatattttaacctctttcaggctttttctaccgatatctaggttcctatcctatttttgtgcctatttcgcggttatttgttgtaccttttaaaaggcatcttccggagatttaa

SEQ ID NO: 52869 - DNA, 3717 bp, Heterodera glycines
  Genomic contig location: Contig_ID=SeqID_440; Location=532..4248; Strand=+
  SCN-specific regions: Sequence locations=1-6,29-80,112-194,226 -545,567-704,763-853,875-1143,1165-1217,1240-1409,1431-1676,1698 -1988,2010-2014,2036-2075,2098-2178,2210-2363,2385-2416,2438 -2473,2495-2522,2544-2582,...
  SCN-specific regions: Sequence locations=...2605-2812,2834-3060,3084 -3244,3266-3553,3584-3642,3678-3717
atgtttaatttggtcgactttaacaaaaggtaagaccatattttgtcgaaaaacagtacgagttgggtttcgtccgaaaaatatgtatttacataaaaatgggcaattttttgtcaaatttttaaaagtttagtggagttttggggccccaggaaaaatatttggaatttttaagaaaattagctaataacatcattattatttttaatttacatatttttatttgctaattgtaaggttttacgaagaaaattgaattttttcgaaaaattatcgtggctttaatcccgcgggatcccgcgggattggtaaaatggtcgggagggatcccggttcgggatcccgatgaaatcccgatcccgatcaatcccgatgaatttaaaaaatcgctcgggacggatcccgaggtcgggatcccgaatttaatcccgcgggatcccgaagaaatcccgcgggatcccgatcacgtccggtctctaatataggtagaaaaagcctgaaagaggttaaaatatattcataattgcatgattttgtctctgcaataaaaattctttttcttttgtccaattaacatattatttcactaattcaaaattaacttgataaaaattagctgttaaggatgtaaaaatttggagaattttttctcactgcttaattgccccatttccattttgaacccaaaaattgtttcaaatttattaatttaatttaagttggtttatttaatataatttcatttacatttaatttaatttattaagggactcaatcaactgcgatgagctggaaaatgtgctgtcacaagcacaacggaaaggcaacaaaattgaattgccatcatgggccaaagattttggcaattatttttcggatttacatttttacgggttgcatttgtccctaaatgcggaggggaccgaaaaagggttcaaaatgtccgattggctgggccaaaacaaattggacggcgaaacgacaattgcgcattcattacggacaatgcatttgcgcggagaaatgggccgcattaaggagataaagcggcgaatggtgcgccatttgattagccattttcaattggagcggttggagatgattcacccgatcagaatggcagcaggtcagcaaaagggttgcatttgatggcattttggtgccattgagaccgaactctaattggaaagacggcaaagtgttgagagtctcgaccctggggaaaaggcattttcaatgtgtaagcgtctagaccttgacgacataaatgccctttgacttggaaaatgttgatccgcagactgggccaaaaaaaaatttgaataaatgaaaaaaaattggctaaatttaaatgcgccaaagataattataaatttgttctaagaccataaatcagtttttcgtaatgttttaagtttttcaacaaaactctgtaagaatatagtaaatttctttgcctactgatcgattaacgcttaaatttcacattaatattatctatcgtatctcatgcatactgtatcacagacgcatttcagctgtcgcattttccggtcgcattccctcggctcttcccaacgagtccacaaatatatagtttttcgaatcaaaaaacatggccaatttgcggcatttttccaggtcatgttgatgaacaaacaatgagcacatattatgagatgatgttctgccaaaacattcgtctgacagaagagttgttggaatatgccattctgtgcagccaaatttttgcctatttcctccaccaaaagggtgccaaaacggaagagaatgatgccaattggtggcaaaagtttgtacattcgacccgacaaatcattttgttcactaatgacgccggtgccacggagaaactggcaaaaaaagaggacgttttgggcactttgcacgagctttggcacaacataaaagacggagacaattttgacgagaaagcattgcgaaagggcagcaaaatgggacgggaattggtggaaaatttggcaaaatgtttggtggaaatttatgccgggaacgaagagtttaggaaatgttttggagagcaaagagaacggagaagaaagctggaacaaatgcttagaatagccgaaaaggaattgggcggaagaagtgccgtgccggaacaattttggcacatttttgagggtaaagtcaaacataaatttataaattatattgttattattaaggctgggaatttaagtcacgaaaaatatccaaaagtcgaccaaaaaagtcataaaaaatgcaaaaaacttataaaaatcccaaaaagtataaaaagcaaaaaaagtcacaaaaatgcatgttaaaagcttcaaacaaagtgtagaacactgtttaagtcattttaaggttatattcaatgatggggttctaaccgagtaaatacggtattttaattttaaaaattagacagtgaagcagagaaaacgacggagccgacgaaagagcaaaagcagcagctgcaacaggggggaacctttgctgatgattcctcaatgattctgttgaaaattaatgacatttgtcccaacaaaaaaattcccctgaaagaaatagaaactgaacatttgaacaaagaaggtgggcaaaacaatgctcggcttaaacagggttagccgaataccaggctaaactggtgctgggacgttagtcaaaaaccatcaaaatgggtgaaaaaaccatcaaatgaaaaattttgacagaaaatcattcataacttcgcctaaaattaaccaaattttagaatcttcatatcattcgatagccctaagtgttatctattatcttgcaaaatttcaataaaattcattaagttttaaaaaagttatgtcaatttggttgcttttaaaaaattgtttcatttgatggttttttgactaacgtcatagcaccgctaaaacccattttgtgactcagttggaggcttttgccaaaatacgccgagtccggcaaaccccgctttaaaatgccgacccaaacaattaaatttggacaattaaaaattgaaatcatttagagcttttttcctacactctgatgaagcagtatgttgagctgctgctggccgatcgccaatcggtggacaaagagttggaaacgatcgaaagcaaagcgatcattttttattatcgagaacgcgttagggcgctgttcagaaaggcaatcattgcgcaaccaaagatggaaaatgaacaatttatggccgtaattaacaattatttgacccaatgggagtcattaatggacgaatggcaacaaaatgccaaagggacagcaaatgggtggccccaattagtgtgcaaatgttaccaattcacttacaaattggtgacggacaaacagctgaaggaactgaacgcggaatggcacaaattggtgggaatgaatgtgaaggaatggaacggcacaatgctaacagaactgatcagcgagaatatgatgagctggtttggggtcggttgtttgctcatatgtagtgatcgagttttgttcatgggcttccaatttgttattaagcgatgacaagtttttattttaaaatttttcaaaattttaagtccccaaaaatttgaaagtttcgtggtgagccgaaatgacaaaagtatcaataatcggaatatttaagtttaataattattttaattttatttgctaaaaaatcataacttagcttaaacttagtctaattaa

SEQ ID NO: 52870 - DNA, 2187 bp, Heterodera glycines
  misc_feature (2151)..(2151): n is a, c, g, or t
  Genomic contig location: Contig_ID=SeqID_442; Location=1555..3741; Strand=+
  SCN-specific regions: Sequence locations=1-953,975-1062,1097 -1140,1163-1211,1244-1271,1315-1791,1813-2187
atggcggattttacgaaacgacccagcaccgtttttgactaacgtcatagcaccttcgaaaccatcaaattatttatttttagttggatttgttcatttttgtccgatggatcgactcccaagtgaccgcccttctcattttgggcaattcgttttcggcacaacggtgcgccaaattttgggttcgatgcaaagttttgattctccaactgtacgaccgctactttgatgagcaaatggaggaaatgccaagcttacaaatattccaataccattttttgagtcatttgaatttgtattttgaaaaaattttggacagaaaaattggggcgaaaaaaagtgaaaaagcgatgaacgacgaactgagaaaaatcgtgcaaaacagccaaaaagtgtatgaggaggacaaattgatggacagttttgtgtcggaggagagggagcagtacgaacgttttgagatggtattgacggaattgcgcatcaaaacagtgaacgaattggcgaatcgaaacgaagtcttcaaagaggcattgggacattgtgagagagacagagagaaaaagagaaacttaaaataattacctaattaaattatcaataaacaaacttaatgtataattaattagggaagggattccgggatttatgtctaaaaaccccggaataagtaccgaaatttggtaaaaaccctcaaaatatgtgactaactcggacataaaagtgaaaaaatttgtttaatacgggccatttttctccaaaatggttaaattgagcttaaaaattattctattccattcaattacacaaaaaattgagtttttgtggttttgtcagaaaaaaaagttaaaattttctaccacgacaaaatttttcatttttcttaataaaatcttgtccatatgccaaaaatgtacgaactcccgaatttttggcttatgtgccaaaacttcaaaacacttatgtgaatttatgtgttaaaagaaaagtcgttaaagttcaaaaactgtttagagaaaatatattttttgggttcccctgcgataaaaattagagaaaaagataaatttgattttttaaatattttaattattaactctcacaatctctcacattgaatttctcgaaaatgactttttcgcaaacaatgtgttcatttgaatctataatttttttaaaatccttcaaaaaattgctcacaattaaaacggtttaaaatttattttaatttgtttttaaatttgtgatttttttttgcgaattggtaaaacaattattatttatattttaaacatttttatttataaaattttagtcttatcaaaaatgaaagaattgcccgattttgtgggcaaagacacaataatagaaacatggagggcaattgcatcggaacattttgaagaattgggcaaaaaattggaagaaaaatacggcaaaaaaacagcggaaacgaagccgaaaaagaaaaaggcgaaaagaacaaagaacaaaaatggaaaaaacaatgcgaaaaaagaggacggcgaaaaggaaacggaagtagcaatggatacggtatttacggaagagggaaatacagtaagcggagtggggacgaatgaagaagcgaaagaagatgctgaaatgagtactgttgatgtggatacggtaggggacaaaatggaaagtgcaaacaccgaagaagaagcattcaaaaatgaaaatgcttgcgaaatgaatggagcggaaaaagcaattaacaatggacataatgagtcattagcaccggtcggcggcgaagatcaaagaaatgaggaagacaaaagtcaacaagagaacactgatgagggcagcgaatcgactgctgttgctgatagagcgacaaagctcaaagagtttgccgacgatgactttttggcacaaaaatatgccgaatttgtgcacacttttatgatggaagaacaacaaaatggggatggcattggccaactgatcagaatgctcacaatcggagcatttgtcaacgaaatttcccatcgattggatgcgatcgaatggatgggcggtgatcagtggcaaaatgtgaagaaaaaacgcacatttttgtggtggaaaagcattttggctgatcaacaatattcagcagatttagttgatcaactttatgangttttgaaggaaatttggagtgaaagggagaaataa

SEQ ID NO: 52871 - DNA, 1870 bp, Heterodera glycines
  Genomic contig location: Contig_ID=SeqID_443; Location=63..1932; Strand=+
  SCN-specific regions: Sequence locations=1-123,145-271,293-744,766 -826,849-965,994-1060,1085-1139,1174-1297,1348-1548,1570-1751,1773 -1803,1840-1870
atggaagtagcaatggatacggtatttacggaagagggaaatacagtaagcggagtggggacgaaagaagaagcgaaagaggatgctgaaatgagtactgttgatgtggatacggtaggggacaaaatggaaagggcaaacaccgaagaagaagcactcaaaaatgaaaatgcttgcgaaatgaatggagcggaaaatgcaattagcaacggacataatgagtcattagcaccggtcggcggcgacgatcaaagagatgaggaagacaaaagccagcaagagaacactgatgagggcagcgaatcgactgctgttgctgatagagcgtcaaagctcaaagagtttgccgacgatgactttttggcacaaaaatatgccgaatttgtgcacacttttatgatggaagaacaacaaaatggggatggcattggccaactgatcagaatgctcacaatcggagcatttgtcaacgaaatttcgcatcgattggatgcgatcgaatggatgggcggtgatcagtggcaaaatatgaagaaaaaacgcacatttttgtggtggaaaagcattttggctgatcaacaatattcagcagatttagttgaacaactttatgagtttttgagggaaatttggagtgaaaaggagcaaataattgggacaaatttggagaaattaacgggaaacaaaaaggagcaaatggaaagtgatcagagaagaggcattgagttgatcagcagacaaattcacagcagaaaatttggaagagcaatcattggaggaaaagtaaaaaattgggccaaaatgccaaaaaagcagaaggaaaaggcacttttgagcctttttggaagccacgaagatggcactaaaaatgccgaaaatggaaataatattgttggcaattttgagcgaaaattggaattgctggaaaaagcatttgcacagcaaaaattgggtaggagaagatgaattttaaaagataaatttttattattagaccaaatgttatttgaacaatacaaaaacaatgagaatttgtcactttttattgaaatgaaagacaaaataaattttaatggaaaaaatgcgcaaatatttccaaccgaaaattggcaagaattgaaatttacggaagaagaaaatgatggaaaattgaaagaaatcgaaaaagtaattttaaaatttgacaaataacaataataaaattttaagttgaaagacgcattaaaattgagagatggcgagcaaaaagttgcccaaaaactgatgattaaattgaatgaaatttttaacggatgggtaattaaatatttatttaaataaaattttaaaaaaatattcaatatttttctgatcagtcggcggaagcacaatttcaaccttcggctttacattttctgatgaactcagttgcaaaattggagccgatttgcattttgccggacggctttgatcagaaattgatttttggacaagcgacggaatgcgatcagtcgaagcgagagcagtgcagtgatcagtcactgtactgcaccctgtgcaaagttattctttattataattttaaattaagattaatcatttttcgggggggggggggagatttgtccttgaaaatggcgggaaaaggacaattgttgttgtccttatttaaaaaaagattgtttctgagcattttttccaattttgcgtaatcggattcgggattttgataaaattctgaataaatcctgaatttttacttgtaaaaagcaaatctaaatttttaaaataaatcggaacgcagcaaaaatgaaatttttaacgttattttaattttttgaaaaaaattaatttaaatttcagtaaatttttgagctaaacggtagcctaa

SEQ ID NO: 52872 - DNA, 451 bp, Heterodera glycines
  Genomic contig location: Contig_ID=SeqID_443; Location=2506..2956; Strand=+
  SCN-specific regions: Sequence locations=1-171,195-255,322-451
atgcgtttaaaattgttggaattgttattgccaaaaaccgattatttgtcaatgttcagcaacaagcaaaataaattggacggacaatttgctgttggcattttggacaaatttcgaacaatttttgcctttttggagagatgggcacaaagtaaaaaaaaaacaacgcataaattaattttttgggagaattttagccaaaagtctacttggattccgacttttaaatctgagtctttttggcaaaaattctccaaaataaataaataaataaagataattaaaaaattgtacaaattaattttaagataattttatttactgcgaagatttgggctatttgaatggcgaaatgcttttgataatgttgaccaaagtatttcttctgttccccgactcgtcagtgtcttttcttgtcgacaaattctttctcatttactcaaaatggtaa

SEQ ID NO: 52873 - DNA, 715 bp, Heterodera glycines
  Genomic contig location: Contig_ID=SeqID_4026; Location=85..799; Strand=+
  SCN-specific regions: Sequence locations=1-83,110-298,321-635,657-715
atggacagacttggattgtcggactccatcagaaatggtctgaaggacaaattccgaaatgaggcttccaaagagaacggagcgagccaaaagaaaaagaagaaattcttcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgatcccggcaaaaggtgtacaaccgtacaagccggatgaagatgaaaatttgaattttcttcttgacgggtttggtctgaagagagcctcatccggtggatctatcgggaagcacggcagcgatggccgacgagatcaaacgaaagatgatcttcgagaagcttccgactgtggacacaaggcataagaacgccgacctgaggatgcggatgatggacggaggcccggcacttttcaaggggggagatgttagggttgggacccaattgtccggtgcccattttgaccctttgtttcatttgtatttcccttctcccttcgttaagtcacgcccacttttccgcccataaatacccgcgatgttgacccttcctcatcattcttttgcttcttctccatttatttgttccctttgctcccaatcgatatttgaccccgttcgccctgtcccttctttttga

SEQ ID NO: 52874 - DNA, 1044 bp, Heterodera glycines
  Genomic contig location: Contig_ID=SeqID_4027; Location=236..1279; Strand=-
  SCN-specific regions: Sequence locations=1-193,232-260,311-501,538 -1044
atgagtgacgatatttgcacttatttgaatatcacctcggcaaggaaattcgattcaaataatttgactaaaaaattttcggctttggattcatcgaaaaatgtgaccatttttgaatggtttttcagttcaattatccatcaatttgttgccgccaaatgtgctttccagtacaatttgaacaaagttgtggtaattatctttatattaattagtaaaataaaataaattgcaagcgatttaaaggaggcattaaggagttttaattttaaaattaaaatcaattttcttattaatttcttaaattaaagtctgatgattaccgtgacaccatactcgtgttgtccgacaagttcaattgcatttcacaaactgcagcatggattgtgttgcccagtctttttacagccatttccattgtcctcaacatttcgctgatcagtgtcacaattatcaaaaggtgcttattcggttttttaaaaaattcattagtaattgagcaataaaaacaaaaataaattaaaaatgaatttttttggcgatatttcgaagaaagagagcccagagatgcgaaaagttctttcaaatactgtacttagtgaaaagagcccccgggggctctaattttcaaccccctcaagggggggggaggttctaattcagggggttttattttcaaccctaatttttacaaaaatccaaccaaaaagcgaaaaatgaggaccaattccaaaaatggcattaaatgcccatcaaaagggagccaaaataataaccccttttctcagggagcaccacaaagtgtgcaattggttgatcgcctacgacgcactgttccaacttttcgttgtcgcaccgttcgccctcaatttggttgacgtcatttttcagtacagtccaatagactaccgtatctgtctggccactcttatggcatctaccgtagcatcgtatggctcaattttggcattgtatctgatctcaattgaacgattgttgatcgtcctttttccgttgcagtaaaataatttattaccaattaaa

SEQ ID NO: 52875 - DNA, 525 bp, Heterodera glycines
  Genomic contig location: Contig_ID=SeqID_4027; Location=2734..3258; Strand=-
  SCN-specific regions: Sequence locations=1-178,200-423,445-465,518-525
atgctcaaatatgcacataaaaatatgaacgaaatgccaaaatatgcacataaatcgcgaaatatgcacaaatatgcaaaatatgcatatggaagtacggcctagaagctcaaaccaagctaaaaacatgttttcgtgcgtttcaggcctcccgcagttcaggaaaaaatatgcatgtgcatataattttacaccctattcatcagtgtcagcttctcattggtcctcgttcaccaattcaaatggcacaattgacggcgttgacacggcggaattaaagtgaacagtgtaactgacagaagaagcgatggtggcacggagaaatgtctaaaggcaatccaaccaattaattaattagtcagtcgtttaatgaaaacatgatcactagggatgtgaattttaggaacaaaaaatcgcaaaataggcacataaaaggcagaaaaaatctttttattaacactttggttatatatttcaattgtaaattaaaattaattcaatattttaaaaaaattttcgaataaa

SEQ ID NO: 52876 - DNA, 874 bp, Heterodera glycines
  Genomic contig location: Contig_ID=SeqID_4027; Location=5884..6757; Strand=+
  SCN-specific regions: Sequence locations=1-388,423-428,468-576,598 -769,810-813,835-874
atgcctgggtcaaaatttaaaatttggcatactgtaaaatgccggtttggtatgtgtcggactgagactattaatgtatgcacgctattttatttttcgcgctattttaacggcacaggatgtgaaatctcattcatttcggagtcatttgcgcgcaaggccaaccttttgggcaatattgaccgttccaattgtcagacaatatacgtgccggtttttggaggtggcaaattgcttggctggtgagtggtgtcaaaaacagaatcattgctttttaggaggggacggaagtcgaccaggaatggtcccaggatttcatcttggagagggtaccccacccacgaaaattttttttgaaaaattaatgattttttcaaagttttatgaagaactaataagttttttcaaaattttccaaaaaatcgctgaaaatttttaaaataatttttttgtttaattttttttatgaaaaagacatttgcgcctttgtccccccaaatcgtgttcaaaattaacttcttttttttccaagctttgatagcctaaacagctttaagtaagcgatagaaaggattgtaaaaattaaaaaaaatttttcgaaggcatgacttaaaaaattgggcaattaattctcttatttttacacttattttctttgcacgttttgcagggtcaacgatgttgaaattagaattgatgagctcaaattgaaatttgggcaccgtttgggggtgatggaggacaagcatttgccgatgtgagtttggcgtatttttttttattttgtaaaattcaattaattaaaaaatgcccttttttgtttaaacatttttctattttaaggtattgccaggagaaattcgacatgctgtaa

SEQ ID NO: 52877 - DNA, 601 bp, Heterodera glycines
  Genomic contig location: Contig_ID=SeqID_4027; Location=7624..8224; Strand=-
  SCN-specific regions: Sequence locations=1-126,148-165,187-273,295 -335,361-398,433-601
atgtctttttttaaccatttaacaaatgatacatttacagctgatcagggtaattaataaattgggttcaatataattaaatagcaaaatgattttgtcggttaataaattttgatattttaagcaccattttaaaattaaaatttgacgctgaagcattacgactttatatttccatatttttatacatttgtatattgcttttttagcctctacataaaatttttttcatttacctaattaatatttgtatcgtaataaaattttcgtgtgaattttttaaatttattttttccttatcccccaagtcaaattaaaaacaacatagatttctgaaaatttattttaaaataaatataagtcaaagcggctcaaatttatcaaaattatcgaatggcatatttaactatttattaaaaatatatattttttcagtccttcggcttttaattactctaaagaatttttgatttttgttttaattgatttaatgaatttatttttgcaagttctttatctaattgattccacagtttggaacagctttcgccaagcctcaaaattttttttcatttaatctgcgcgtctgtgaggaaataaa

SEQ ID NO: 52878 - DNA, 534 bp, Heterodera glycines
  misc_feature (528)..(528): n is a, c, g, or t
  Genomic contig location: Contig_ID=SeqID_22206; Location=9..542; Strand=-
  SCN-specific regions: Sequence locations=1-13,35-170,192-231,253-534
atggcatcgcccgctaaaaacgagaaaaaactttcctccgccgaccattgcttaatttcatctgccacaattggtgaaaatcagcagcaatcgttgggttcatcatttgagacagcatttggagaacatcaaatgaaaatggaaaagcgaattttgcggaaaatgtgagaaatttaatgaatgtgaattttagggttaaaaccatttcccaaccatgaaaaaatgtactaatggccctacataacatttttgcatatttttagcaaattttcatcaaaaattgcattttgttgattttttggacaaatttagcaaactttttcggaaatcgtcggatttccaacccgaaaaagtcctaaattcttaattctgtgccatacttttacattttaagctggatttgcagcgatgtttggatggacatattccccttatttggacgtgttgaactcggcctcaaattggcaatgctttccgaccgtttcgatgctttggttgacgcgcatttcgatggcaaaagcgaatggnccattt

SEQ ID NO: 52879 - DNA, 1130 bp, Heterodera glycines
  Genomic contig location: Contig_ID=SeqID_22207; Location=679..1808; Strand=-
  SCN-specific regions: Sequence locations=1-11,39-831,859-941,1062-1130
  Gene Ontology: Mol. function=DNA binding; Cellular component=nucleus; Biological process=meiosis
atggaatcgaccagctccaacaacagcagcagcagtcgtccagtttcttcgcatcggccacctccacgacggcacaacaacacccaagcagtgccggcaacagcacggaatggcaccgccaggaaaaggccaccaacggcaacaacggcggcggggacgacacttgaccatcaccagcagcaacagcatcagttgcaacagttgcagaccaaccgacagcaacaggcgcaacatttgttcattgaccccggcggttagtccctccgttcggcggcattcgtttgcttttgtgtgtttttactgtttttgcagatcgactcgtgctcagccaccaccaccaacagtcgtcgtcgtcggcaccgcttttggcccaccatcagcaacagccgccgattgggcccaattcgtcgcctcattcggtgggcattttgtcgtgggcggccgctttcaaagattttgccgacgacttcgcccttccccctcccctaattatcactaaataaaagtgccgtttttaagtctgccaatttgacggggttttggcaattccttcccgccatctccccctaccttccaagaaaaaatctgagaattttttataagaaaatttcatgaatataaatttttcaaaaaattttcttgaaatttttttccggtggggtgtcttggcacacacactgttattccgtggcactcccacattgtttgagactgattcttatcacaattctccaaagggtccacatgtcgtcaattcggcgtccaccagcggcacaaatcggagcggcacttcagcatcctttcggcaacatcaaatggtcggcgtcggcactccgtcctcctcgtcttcctcctcgctgatgatggcatcggcacaacaacagcccctgccgcagtacattctgtccaccgctacggccgcagcagcacaacaccattcccaacaacaacagcagcaagcagttcatcagcaacagcagcaccaactgcaacaattgcaacaccaccaccaacagcaacaacagcaccacgcccagcaacagcagcagcaacaacaacaattgtacgaagtcgagtcggaaatcatcgacctgctcgtccgccacttgggcaacctcaacgacgacgag

SEQ ID NO: 52880 - DNA, 860 bp, Heterodera glycines
  Genomic contig location: Contig_ID=SeqID_22209; Location=1045..1904; Strand=+
  SCN-specific regions: Sequence locations=1-186,208-333,355-684,707-860
atgtgttccccccatggccatggctacgaatgccctgcaaatatgcaatgcatgaaactgtcgttgaaagccaaccaaattggcttctacggcatgtttaacgatttcggtaccattgttggccttcgttaattctacccaattagcacattccgcaatgaaggcttcagtctgtttacggtgtatttggccgcttctcaagagggttgggtgttcgtcctctacgacactttggacacttttccctcctattgcggctttttttatttcctcactttgattttctttttggcttggcttgttaaggtttgtcatcatttgttgtattaaacaacatttcatttgcttttgaacagaatgttttcatcgctgtaattaccgaaacattcgccgaaattcgcgttcagttcagcgaaatgtggcaaagcagagaaatggcgcaggacgaagacgcaaatcaaacggtaaaactcagacaaaacattaatttaaatttcagaattattttcgacagaaattggaacgcgacgacgacggcgagtggcgactgcgcgagttcgacccgaaggtgaacgacttggacaccatcgaccagtgccgcgtgcgccgttggctgtccgcattggtccgctccacttccttccacacattcatgctctgtttagtgtaattaatcaattatttgactttttaaatttaattttttgagtgttttcaatgccctcatcaacgcatcattcgtttatcggcacaacagaagcgatgcgagacgaaagcgcatttatcatgccattgaggtgcagctaaaatgccaagcaaacccatcccaccattctttaattgcttcattaattggttaa

SEQ ID NO: 52881 - DNA, 236 bp, Heterodera glycines
  misc_feature (169)..(169): n is a, c, g, or t
  misc_feature (199)..(199): n is a, c, g, or t
  Genomic contig location: Contig_ID=SeqID_22210; Location=11..246; Strand=-
  SCN-specific regions: Sequence locations=1-200,224-236
atgtttttaatttggtcgaccttaacaaaagttatgacatttttttgtcgaaaaacagtacgagttgaagctgtacgagttgagcagtacgagttggagcagtacgagttggagcagtacgagttggagcagtacgagttggagcagtacgagttggagcagtacgagntggagcagtacgagttggagcagtacgagntggagcagtacgaggtggagcagtacgagttggagca

SEQ ID NO: 52882 - DNA, 329 bp, Heterodera glycines
  Genomic contig location: Contig_ID=SeqID_22210; Location=1383..1711; Strand=-
  SCN-specific regions: Sequence locations=1-329
atggtgccatttgaatttcttaacgaatggacaaaggaaaagctgacattggccaaagcaaaggaattgggcaaccgatggataatgaaacgatgcaaaattattggggagaccgcggcggttcagcagcagaagaaagatgacaattgtaacaaagtggccatttggctttacatttgcaatgattgcattgggtgagcaattaaaaaagcatttgattttgtttaaataattcaaatttcgcttaattaaggccattgtctccgccaccattcgcagaagaatccggacaaagcatcacaaaagggccgtcttctgctgacaaatga

SEQ ID NO: 52883 - DNA, 378 bp, Heterodera glycines
  Genomic contig location: Contig_ID=SeqID_22211; Location=1622..1999; Strand=+
  SCN-specific regions: Sequence locations=1-153,182-331,367-378
atgttggaaaatattttcaaacaaaaaggaatttacttgagagagggaaaacattcgcgaaaagaatggcaagaatttaaagcagaaattaataaaggttttggataatttcaaaatgggtcaagtaatttgacaaaagaaattttaaatgacaatttttgaaaaattttaattaataattgttgtttaaaattcagagagtaaaattttaaaactgccgaaaaatgaagaatgtgaagcaatattggcaaatgaaaaagaaaaaggcaaaaatagcgacagaaaaattgcaaaattttgagcattgacagaaaagtttgaaaagaaaaacaaatataaaatttaatgagaaataattttaaaatactaatttgtaaa

SEQ ID NO: 52884 - DNA, 677 bp, Heterodera glycines
  misc_feature (123)..(123): n is a, c, g, or t
  Genomic contig location: Contig_ID=SeqID_22212; Location=1042..1718; Strand=-
  SCN-specific regions: Sequence locations=1-19,62-677
atgaagtaaatttagggggaaaaatataaaattgtaaattagaatatttagaattttttttctcttgaaaaaattgacgtgagaaatataaaatagtgtataatatttttttagtctactttnaacaatgactaaaattaataataaactcattaaccaaattaaatttttactcataaaaaaattgtaatttcgataaattgcaatgaactagagcttgtcggaaccgggactggttctgaaaaaaacgggtacaactgagtacccagtcccggttttgaccagttttgaccgggaccgggactagtccggttttttcccggttttcccagccaaaaaatcccggcttttcaatccgaaaattcccggtcccggtttttgtcaaaaatcccggtcccgaccagcactacaatgaactcttaagtgccttattaattattacatgataaattaacttttttttaagcatggaatatcggaatgcatttcaaaaagtgttcaagtttcttcaaccaaccaattacaacacaacaatcatcggaacgcaacaacaacaatgggcaattcgcgtagcaacagagaatgttcagaattgaatttatacgattaaatttaatttccaaatttccaatttaaaaattgtttttcatttttatatttttgccatttaaaataaa

SEQ ID NO: 52885 - DNA, 1273 bp, Heterodera glycines
  Genomic contig location: Contig_ID=SeqID_22215; Location=890..2162; Strand=-
  SCN-specific regions: Sequence locations=1-266,288-396,425-630,652 -713,742-823,846-1096,1126-1216,1238-1273
atggcagcatcaattagcaaacaagcaacagtgccacctgccgtgccaagaaagccagtgccgccaactgagaccaaaacagcgccgaaaacaatgccaaactcaacgccgaagacaatgccaaacagccaaaaaatgccaaaaagtgaaacaacgccaaaggaaatgccaaaaagtgaaacagcgccaaaggaaatgccaaaaagtgaaacagcaccaaaggaaatgccaaaaaatgaaacagcgccaaaggaaatgaacgaagcaataaaatcgaaaacaaataaaacaacgcctccggggacaaaaaaggggaataaatcggtggcacctccagtattttgtttgtcatttgttgcaaaatgaaagatgaatgaattatttatattgagaatgaaaaaaaaaattaattttataaattttactcaatgattaattaggcccttgataaaaaaaaaccaaacaaaaatgtcctaaaattcccaaaggcaaccaaaatatgtcacaaaaactgaaaaaaatcatcaaaaaatagtttaagtttcccaaaaagtctcatttttttccatttctctagcataacgcaaatcaaaatctttcaatgctttttggcgtacattttttctcgccttcaaagatttacttattttaacggaatttcttcgtcaaaattcaaattttgccttaaaagcgaaaaactcataaaaaaggtcaaaaaatacaaaaaaaaatttaaaatttcggacattttgccaagaattgggtgccaaaaaagctacttttgtaaaaaattcatttttttccaaaaatcgccaaaatatgtaccaaaaactaccaaaacccccaaactatgttttaatgacccaaaatattacgtacatagaattattggctaattggttgagtaattttgccatgccaatttttgtttactgtgccaaaaaatattttcgcaaaaattatcactttcaaaattaatcgcttgaagtcgaaaaaattgtcgatcgaattcgaaacgattcctgctgctgctcaatatctgtggttatgctgcaccataatgttacggttgcgaataccgtacatttgcgtcggatgctgctgctgttgcagttgctgctgctggcggagttaccgccgttgttccgccggcccatcgtatacggtacgcagtgcgcgacggtagtccgtgctaaaaagcacgtcgtaaaccactttttgttcaaaaaatttaaaacaaagtctatggaatgaaaaagtgcacttcaataaa

SEQ ID NO: 52886 - DNA, 1700 bp, Heterodera glycines
  Genomic contig location: Contig_ID=SeqID_4029; Location=4157..5856; Strand=-
  SCN-specific regions: Sequence locations=1-227,260-298,329-363,385 -389,419-1631,1653-1700
atggccaaaacacagtattatggtcagtcgctgatggacaccggcacagcggcgttcatttttgtgaatgctatcgccgaccatgatggaatggcacgcggacaaagcccacggcagagggcggccaaggcgacaatgtcagtggacgggcggagggtttggaatgccgtggcacaatgccacactgggaaaattattgtgggcatttgtttcatttccttcgacagaaaaatttaaaaaaattttttttttttattttcagtgctttttttgtaaaaatttagaaaaacttgatagttcatcataaaatttttaaaaattgctaaaatctttcaaaaaaaatttgttttcagtaaattttcttacaattagaaaacattttttggactaactaatttaaattattattttgaattttaggcaactgttcgccttccgagtgcccacccttttggcactgtttctgatcggagttggccgttccgtgttcatccgtttcagcggctatggccaagacgtgacggagtacggcgtccactggaacttcttcctcaccctcttttgtgtcagggtccgtccgtttctattgggtttccaaatttgatgattttatctgatatatttgttccccagctgttcgtcatcggtgtgcccaatgcgctgcttatgccgctcggtgtgctgctcggcctcgtctaccaaattgcgcttcggcttacaacgcttgagcaatggattttacggcccgacttcggggagtcacggcacggctttctcgaccagaacagagagggaattttctcgctgttcggctactgcttcatctacgcgctgtcgctgatgtacgcgcggtgcagcgccaaactgacgctaaggcaatgaaagcgactcaattttttgggtggaggggcggcaaaattcttagaagaaacctctggtaaaatggatggtcgtttgatatttctttattcataaccttgaacctccatcatcactccatggattaaagcaaaaaccgaattttcgtatattcacaatttgaacatttgcagagacaagaagctgtccccgctgaatgtcgcgggcgaactcggtttcagcctgtgctgctactgctcgcagagggtgctcgaggcacactttggcttgagcgcctcccgaaggttggccaacttggcctactcgttcgccatggtacgcggcggtcgggaaaagctttttgccaataattgccacccttctcttggcacagttgaccctgttcagcaccacctgtgccctgttccagctcattcagctcgtcgttccgttgccgcaggatgcgcgccggggtggacttgtggcagcaatcagccgaaacgcactgctccattttctgtgtgccaatctgatgactggcttcgtcaatctgttggcaatggcatcgccgcaccttgaaatccatggccaccagattggcgaaactgttgccatgctgacgtactcattgctcacctctttgctcatctacggcattcacttggccaaaaaacagactcgctgatgctcaattattggatgaacgcatgcagtgatttcagaaaaagtgctttacccacgactcgatctctctttcccattttgaaattctgattttaatttttataatttatggttaattaaatgtcttaaatccaacgtttgctttgtgtcctaataaa

SEQ ID NO: 52887 - DNA, 3697 bp, Heterodera glycines
  Genomic contig location: Contig_ID=SeqID_4029; Location=30..3726; Strand=+
  SCN-specific regions: Sequence locations=1-413,435-617,639-698,729 -887,909-1211,1234-1271,1293-1311,1346-1809,1833-1861,1883-1914,1937 -2510,2532-2614,2669-3006,3028-3543,3566-3697
ccaaatgcgtgcggtccatttgtgccatgcccgccacaaaatgtccacctcgccttttccttgcccacaagtccaacagttacatcttcgccgttgagcacaatgccattcaaacgccgctcagtccgtcgccattgtgcgtctccgagctgttcagcgacgactttcgcggctccggcaccaccgggcagctgttgctcatccccggcaaacaacggccccctctgtcagtggaacagatcgaacgctatcgcaacgaggaaaagtggcgcaggaaaaggtcagcaatcaattcggcaatggtaaagaattgtggtccctatttaattttcctgctccaaatcagttttcgagggtgctgttcacgaacctgaactcgggtttgagccaatttcaaatcccggacccgtacaaaaagttgaaattcttccaaataatatgtcgttgagatcaatcaaatctgacgaaaattgtgaaattttatccaattatcaattgacattagtgcagtttgcgcaaatcgtcttccaattttctttccgtttgtctatgtcagattgactttctattcggtgttgtggctcggctggctgttctcgttgatgtttgcccttttgcttgtccatgtccatccaaagtgtgcgccgtcgtcgtccctttcgctggaatggtggaagggcacactgatttatgaggcattgcttaaatttattttctttttaagtgagtaaattttcagatttggactctctccttccatggtaatttattttccgaatgattgaaatggtctttaaaacattggattttgtcatgggagttgatttggattttcggtgaattagacccgaaaaatgcgctaaaatatctaaaaaaatttgtttattaatgaattgtatgaatttttccgagatcccttctaaccagtatcatcttattttaattatctttcccattttcgactcggacggcaacggcgtcggcgatttggccggcattcagctcaaacttggccacttgcgccgaattggcgtgggcgctgtgttccttcgtccaattttgcgcacagaaagcacgggaatgggcgtcattgacttcacggcattgagccaacaaattgacgcgacaatggaccaattcgacgcatttgttgatgcagcgcacagaaaaggcatgggaaatttttaaaactgagcccttgatactcagatatgatcaaaatatttgaattttatgattttttttactcatatgagcgaaaaattcggcggaaattaatttaaaaaaattatcgaaaatagtctttgcccgtgtcattcttttaaatttccattttaaatttccgtcctttatttctttttatggcccttccattctcttcaggcatccgcattctgctcgaccttccgcttgccgtcacttccgttgcccacccgtggttccgtcgcagtgcgttggctgcacgacccgaaaatgcgccgtttgccgacttttaccactggcgacgaagtgccgtcccttccaactcagcgttcgtttcggctttcgacggttccatgcttaaggcactaccgcttctctgctcgaatattaaattaattccttttttagtatttccatgtggccaatcgtgccgatttgccggtactgaactggcaaaacgcaaatgtttcgagtgccgtgcgggcagcgctcagtttttggcttggccacggcgtggacggcttccatttggcgggcattgactatttgcaccggacagctgacggacggagaccgtcgtgggacgaggtcctaaccaaaaccacccaaataatgaaattaatgtacattagtcgaaaaacttgaggaatcagaggtccatcccatctgtcaattaactgataggacgtcaccgaaatcattggaactgattttaaaaattcatttgcttctgttttagattgtcgcgattctcaaatcgtttaaaacgaatgcggaggagcagtggcgcatcagacgaagagacggggaagggaaaatgtaaggggacagaccgatccaagggcgtagccttggaggggctgacaaaggataggtacccaagtaaattttttgagaattttaagcaattctcttaaaaaaatcacaccaaaatcattttttggcgaaaacggctatagattcccctaaaacacaccccctaattaattttggatttccaaaaaaagaaaaaacaaacctaagaatcgaatttttgaattcagccccccccccgaatagtgtttcatattttttcccatgtttcagctttctcttcacttcccatgagcatttgtccgaggcgttaaaggtgcgtctggtggatgaggtcggcctggacgcggtggtgaacacggaactgcgcgacttggcactcggcaaccgcgtctgtgccaacaaaaccgcacacgcagtgccggcgatgagtgtggccgagtgcgccaacgaaattttagcagatttgttgctgttccaccaatcgttcagtgagtgccttcaatttcaataccactcataaaagaaatattcggagcataacttttttttgatctgcgtatactcgggtttttattgactatctaattcaaaaatgaaagcaaaacaaattctaaaaatttggaactccttttttaaaacatttgtccatgcatattttttcgaaattgaaaattttcttaattcctctggataagctcttggctcatcactcattttgtattttttcttaattggccgtttagccaatgtttggcccctttggagtgtcggcggttcgttcgcccgtcggttggcctcgcgcgtggacggcaaagtgtacgcggagttgatcatgctgctccaactcgcgctgcccggcactccgattatttactatggcgacgagttgggactgcatgacgtgttgaacttgaaggcatattttttcatagatttgaaatcaatctaagcatgggtttttcagtttccgcaacgcggcccaatgccttgggattcgtcatcgccttttgacaatcgaacggacggcgcgggcagcattgaaacaaattttgacgttaatttttgaattcaatctttactgtaggatgccattaggatgagttggccgactcgcgcagttttctgcacagtgttcgtgccatggctcgccttcggttgcgcgacgccgcgctgagggcggacggcacgggcgatgtgcgcacatacatcacaaaacgagtggacggacaagcatttgcactctgtcgctatttgtgctgcccagaggaggaaaagaagtggaacggaggggacgagtcgcagcagcagcggatgagcacgacagtttatggcgatgtaattttttgacagtttttccgaacataattttggcacttgggaagtccacagtcaataatgccatacttattggcatgccttcatattaaattgtacgatttccatctttttcccccgttcgcagagtgttgtcgtgctcgtcaacttcggccccgcgccactcactttttctttgtccgatttgccgcccttccatcgccgtggggtctatcggcgtggccgaattgtcgctcgcagtgcgaatgccgcctccaaatttgcgcttggtcttggcattgagttggacggacggcaggtgcacatcggagccgggcagggcatcgttttcaaggcgttcgaa

SEQ ID NO: 52888 - DNA, 616 bp, Heterodera glycines
  Genomic contig location: Contig_ID=SeqID_4029; Location=6063..6678; Strand=-
  SCN-specific regions: Sequence locations=1-97,119-218,240-244,274 -531,558-616
atgtttctcggccaaaccttctgggccgaccatttggcccttctgctgctcgttcagctcgcgctctgtgccgtcattttcgcttgctgtgacagtgcgcgcgcctgcggtgtgacgccgctgcgctcaatgcgtccgctgcgcgtggacgcggcacgcgcccaacgcgacgcgcacacaatgttcaggtgagagagaattcgctgaaaatttttttctttaaattttcctgtgaaaaattcactaattttttttttgaaaaattaaaattttccgggctggagggggggggggaaagaactgcttccgggatgaattgcttcgaccgggggcatcaccccttctcgacacgtacatgaaatgatcagccgagggaattaaatgctattcaaaagaaaattgcacattttaattaggcatttctggggcgtgtttttcggcgtttcttatccgtttttgttttttcgtgaaaagtcgggtacaccccaaaatgtcgccgggacacaacgtcgctgcaaaaaataccaaaatttcaccattttaaaaattattttaaagcttttttcaacctaaggattaatggaaatagatttgctaaattttcagaaaaatttga

SEQ ID NO: 52889 - DNA, 109 bp, Heterodera glycines
  Genomic contig location: Contig_ID=SeqID_22216; Location=1152..1260; Strand=+
  SCN-specific regions: Sequence locations=1-109
atgaagtgcaaaaacggcaggggaagtgaggaagggatgattgaagaaagagaagaggagtactttgaggttggaaaatgtggtgccgttttctgttcagcggataatg

SEQ ID NO: 52890 - DNA, 601 bp, Heterodera glycines
  Genomic contig location: Contig_ID=SeqID_22219; Location=1555..2155; Strand=+
  SCN-specific regions: Sequence locations=1-163,186-476,499-601
  Gene Ontology: Cellular component=nucleolus; Biological process =protein biosynthesis
atgcgtcttgagaagtgttggttttgttcatcaacaatttatccgggccacggaattcaattcgtacgtaacgacgcaacggtgaaaacaatttattgttatagtacataataaattaaaatttttgtttaggttttcaagttttgtaggtcaaaatgcaacaaattatttaaaaagaagaagaacccgcgcaaattgaaatggacgaaggcatcgcggcgaattcggggaaaagttagtgtttgatttttgtttttactcttttacatttattgtaaatttaaatttcttttactctttaggaattggtcaacgatgttactcaagcgatggaaattcgcagaaacgaaccgacaaaatatgatagaaacctttgggaaactgcaggtaaatcgtccatatataccaacaaaccgtaacgacgaaaaaaagtaccggaagggagaatccgcaaaatctttgctctcggacacttaaacatttttcctgttttaaatttttcatggacgaaaaaacatatacagcggttttcgccaaaaaaaaaataaccaatttgggtagacaagtatgtctaataaatcttccatttgaattttgattt

SEQ ID NO: 52891 - DNA, 467 bp, Heterodera glycines
  Genomic contig location: Contig_ID=SeqID_22220; Location=114..580; Strand=-
  SCN-specific regions: Sequence locations=1-467
gagcgacgattctctgggggtagcattcattttgaggtgctttgagtcataacggccgcttttcaaaaaactcattggggtcgtccgctttcggctaaatagtgcacctcagcaaaaggggcggcgtttgagcgacgattctctgggggtagcattcattttgaggtgctttgagtcataacggccgcttttcaaaaaactcattggggtcgtccgctttcggctaaatagtgcacctcagcaaaaagggcggcgtttgagcgacgattctctgggggtagcattcattttgaggtgctttgagtcataacggccgcttttcaaaaaactcattggggtcgtccgctttcggctaaatagtgcacctcagcaaaaggggcggcgtttgagcgacgattctctgggggtagcattcattttgaggtgctttgagtcataacggccgcttttcaaaaaactcattgggg

SEQ ID NO: 52892 - DNA, 558 bp, Heterodera glycines
  Genomic contig location: Contig_ID=SeqID_22223; Location=475..1032; Strand=-
  SCN-specific regions: Sequence locations=1-43,65-127,149-334,356 -359,390-429,453-473,527-558
ttaaacagccaacaaagataaattaattattttgttttatttctgtgataatctttataaaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaatgttttaaagaaggataaaaataattattttattttaccgtcaatagatatgcatatgtattttaaattttttattgttatgtaaacttctaatatatatatatttatatacataatcatatgagttggcggttttaagaaac

SEQ ID NO: 52893 - DNA, 683 bp, Heterodera glycines
  Genomic contig location: Contig_ID=SeqID_22224; Location=50..732; Strand=+
  SCN-specific regions: Sequence locations=1-166,189-219,246-315,337-683
atggagaaaaacaccgaaagcctttccaagttggatcctagcgaaagtaattacaactttctgttccctgtaacaaaaaccacttttagctttgggaaccgatgccctcttacaattgatggaactgatcaaactgaggcctaaacagaagcaggtgacccaggaaaagttttatgttctttatatctcttctgcattttaagggggaagtcgagtcggaaaaaagggaaatggaaaaaccaattgcggactttcaccaccgcaaaacggatcagataaacccggacagcagtgaactgaagaaggaactgcgtgaaaaagggaaattggaaagttacggacgaatcactgatgaaaagggggaggagaaaggtaaaaaagacaaatcaattccaaaatttattttgttgcttttcagattcttggggccatgcgcttcagaaggaattggacgaaaaggtgcgaaaattcagagagctcaaccgaaagaaatgaacgagaatttaattgattttaccggcattttcactttttcacaatgttagaaatttatagcattattcattttgtttgattcgttcattcggcacaacaactcaaaaccagaaaatccagggattatgccacacagaaaattgttattaatataacactttaatatccaattttgtttcctatgacga

SEQ ID NO: 52894 - DNA, 437 bp, Heterodera glycines
  Genomic contig location: Contig_ID=SeqID_22225; Location=1013..1449; Strand=-
  SCN-specific regions: Sequence locations=1-437
  Gene Ontology: Mol. function=calcium/calmodulin-dependent protein kinase activity; Cellular component=cytoplasm; Biological process =development
cgtacgacctgcactttttcgagcgcaattacaagttggggcctgagttaggccgcggagggttcggcgtcgtctattccggttttcgagtcgcggaccgggagccggtggcgatcaaatacgtggccaggcgcaatgttaccgattgggcccagctgcgtggcaaagatgttccgttggaaatcgctctgcttgaaaagtgttccgcctgccctggagtcattctgctgctggattggtttgaacgttacgacggcttcttaatcgtcatggaacgaccttcgccctactgcgacctgttcgactttatcactgtcagaggtgccctcgacgaatcggtcacgcgcttctttttcaaacaaattgtggacacggccatcgcttgtgcgggccgatccgtcgttcatcgagacatcaaagacgaaaatgtgagctga

SEQ ID NO: 52895 - DNA, 504 bp, Heterodera glycines
  Genomic contig location: Contig_ID=SeqID_22226; Location=1863..2366; Strand=-
  SCN-specific regions: Sequence locations=1-198,221-439,461-504
atgcccaccggcagcacagcttccgcctcctctttcgcttcttctcccgccgctgcttcgcctcctttttcgtcgccttcgcttctgaggggcgctgttgccgaaatttgttcccaaattccgttgaatccctccgcacttttccccgttccgtcccaactttcaacttccgccgcgcgtgacaattcggcgccaattgtgccgcagcagcagcagaggagggccgaaacagaggaggaggacgcggaagaattagcctgttttggtcagtcaatcagtcgcaatggacagaacgcaccagggaaaatcccccggggggagggggggtaaaaaacaaaaaattggaatggaatcccggggcaaaaaccctcaaggccaaagtaccaccacccaagtttaattttgcagtgctttgccgaattatcccctaatccttttatccgttcgttcgtgtccaacagtcgcaaaatctcgggagagggcacactctgaacagaaaataaa

SEQ ID NO: 52896 - DNA, 972 bp, Heterodera glycines
  misc_feature (57)..(57): n is a, c, g, or t
  Genomic contig location: Contig_ID=SeqID_22226; Location=1..972; Strand=+
  SCN-specific regions: Sequence locations=1-669,692-771,793-895,919 -936,963-972
attaattttcatttttaaggtgatcgccaatccgaaccctttggccaatgcgccggnaaaattcaaaaatatttaaaacccgaatttgcatcaattacaccgtcagtttccttcgtttgttcagacacgcatttgggcgaaatttgggtgtccagcgggcacaatgccagcgggttcttttcactgttcagtgaagaggcgcatttgcaaacgaatcatttcaacgccaaactgaagacgggtgacaccagcacggcattcgcacgcaccggctatttgggcttcttacggcaaacgcaagcgatcacagcggacggaggtgggcgaagggagagaacgacggggaggggagcaaaaggaatggcaaatgacatgagacatttaaggcgaaacaatatttgaaaattcgcatttttggatcgaaaaatgaaaaataccgtcgattccaagtgtgtttttagcatgctctttcgatttttttctaaatccaatgcttcccctttttcacattgtcagaattacacgacgcaatctttgtggtcggtgctttggaggaagcgctgatgctgcgcggaatgcgcttccatccggtggacattgaactcagtgtttctcgggcacaccgccgaatcgacgaaaggtaagaaatcacgtcgatcaatccccccgttgttaattgcctcattagctgtttccacggcgcttaaaattgccttcgttaagctgcgtgttcacttggacccatctgttggttgtggttgcggaaacgcatgcccccgaggcggaggcgctcgacttggtgccggcgatcacttccgccctgttggaggaccaccatttgatcgtcggcgtggtggtggtgttggacccgggcaccatcccgatcaacagccgaggggagaagcagcgtatgcatttgcgtgaactgttcctcaggaccagctggaccccatttacgtggcgtacaacatg

SEQ ID NO: 52897 - DNA, 273 bp, Heterodera glycines
  Genomic contig location: Contig_ID=SeqID_22226; Location=2455..2727; Strand=-
  SCN-specific regions: Sequence locations=1-9,78-273
atggtgattgaggtggcggaagagatggtgaagcacgaggaggaggaagtggaggaggacgaacggcaggacgaagaacggcacggcacaacggagggacgaagcagcggagggggcgcgcaaatggcagaaccgaccccggcggagggacaaacggatcagcgcgaagacatcaccgcaggtggaggggcgacgaacggcggaagggaaaacggtgggagggacaaaaagggaggggaaggggggacaggggcgaagggagccggggactga

SEQ ID NO: 52898 - DNA, 1048 bp, Heterodera glycines
  Genomic contig location: Contig_ID=SeqID_22228; Location=113..1160; Strand=+
  SCN-specific regions: Sequence locations=1-178,200-266,292-324,366 -376,439-693,732-822,857-863,900-1019,1041-1048
atgaagaacaaaacggaatggaaaagttgcatttatacaaaaagaaggtaaattaatgcatgcgggacgtgagatttgacttggaaattaaaaatagttagattataggttcttaaaaagtggtttattgtttgcgttggggtagtgcgctggtctcaattttttcggtcacaggttctaacccactgcatgcaaaaaccatttaacaatttttatttttgctttttttatgcaaagtcaattatcgaaaatatttttatgaaaccaaatttttattttttattattttaacaccataagatacgcaatgaagaatgttagacaaaatcaatttattttaacttaaaggagatttactgcttctttacctttaatgaattttttgattttaatgaaataaattaaaaataaaggttttattgataaataattttttttgataattgacgttgcataaaaaaagcaaaaataaaaattctgcaaaaataaatgctctatccacccaccaagtttcattcagaaaccccacggatacctggggaccttcctttgttagataaatcctaaaatagagaaatacttattaattttgcaactcagggggctgaaatttttggaagtcggaaatgtgagcccaaaaattctgaagttggaacttagactttatcggagtttacaaaattttattggttcttaaaatttaattttatttaaaaatttattgaaaaattgcctataagcggtatccgttttgagttatttttttaaatatatgagttttggtccactgttaagttgcatagagtgtcattctgaattggcaaaatatatatatatatatatttttttttaatttgaaaaagccgaaaatttaaaaaatttttagaccttttggagaatttggcgttgaagccatcatttctctcgagttcgaacgacaacatttcggagataaaaatcatattgttgaaagcgtacaaacattttaacattacacctgaagaggaaaaccttagtgaatttgaaaaaattacgcaaaattttgcta

SEQ ID NO: 52899 - DNA, 440 bp, Heterodera glycines
  Genomic contig location: Contig_ID=SeqID_22228; Location=1554..1993; Strand=+
  SCN-specific regions: Sequence locations=1-191,218-319,341-377,399-440
actcaaaagtaccgtaaggcgttggaacaaatcaaagctgagatggtaaaggatgcggattactgtaaggattgtgcaattcctaccgttacccaagtcttggcaacaccaattccgcttagtgaacaaaccaaagaattgatgcaaaaaggcgcaaaaaaacttggcacgtttttccaaaatttgcaatttttgccaaaaaacaaacaaaatttaagatgagaaatttaaaacatttactaagcgcgcatgattttcaaaactgtgtcaacaaatgaatgatgggatatgggaacagtgaacggatattgtgtgatgaaatattcattattatttttaatttcaagcatgatgttatattatccaacgaaaaaacatgtttttagatgatattgttaagcttccggtttttatgtcctaaaaataaacatcaatcagtc

SEQ ID NO: 52900 - DNA, 315 bp, Heterodera glycines
  Genomic contig location: Contig_ID=SeqID_22229; Location=6..320; Strand=+
  SCN-specific regions: Sequence locations=1-50,72-137,159-315
tttttgggccccggggtcgtttgggccccaacacaaaaatagaaaaatgtgcttttttgaaaattaagattctaaaaactaagcctgagggatccctcgccacttggcataagttaggtttaattaacattcgctcattttttacaattttacttattccaaatcctattattttttaatagttattgatgtacattctgatttggacatttttcagaaatggctaacccaattgcaaccaaaaaacaaaaagtaaaattgtcttacgaaggccacctttacaccttcgctaaaatgagttctgatgggatgaca

SEQ ID NO: 52901 - DNA, 930 bp, Heterodera glycines
  Genomic contig location: Contig_ID=SeqID_22230; Location=397..1326; Strand=+
  SCN-specific regions: Sequence locations=1-309,331-352,374-545,585 -860,882-930
atggacgagtccaacctcggcctgctcttttcttcctacgtttttccagtccaacaacaggtgaaatcaaatcaaaacggatttttagcaatatttggacacacatacttgatgaaaagggtcgactaattattgttcattgtcaatatccaccaaaatcccccgacataattacaaacgaacaatttattgggaacaaaattcctttaaactcactcacataatttcctaacttgtcatgtcaaaagcaccaattttatttgtgatttacgatcttaaaggcctcaaaaatctttcggtgttactttatttgttttggttttgttgggtattttatgcctaaacccaattcgacaaaaattacttttatttagaaatacgaatcaattgaaaaggcaaaagacgaaattgcgcagttttgtcgtttgtttcccgttttactcaaacattgcgacgcgctgtttaaactgcccgctgagctcgtgcagactttcgacgcttctctaatgaaaagggcccttgagcagcagaattgcggggacctcacatccagcagcactccctcctttccctttctctcctctgttggtcggtcattttgtgttgttttgcattgttttatttgtcatttttcaagccaactccaaatcgaaacacaaaaactccgagaagagacgaagacgacgcgggtgagaattggcagaaaatcgcaactgaaagcatagacaaatttcagaagtcgccattgtgcactcgtgctcaaagagagtggcgacgcccaaccaaaacaccaccgatttggaagtggcgaagttggcggcgaacatcgcatcgatggaggaaggctcggccaggtcgcggctgttgaacaaaatgatgactgtgcagcgccagaaaatgggcattaagaagaagaagtccattctccgg

SEQ ID NO: 52902 - DNA, 328 bp, Heterodera glycines
  Genomic contig location: Contig_ID=SeqID_22230; Location=1630..1957; Strand=+
  SCN-specific regions: Sequence locations=1-328
  Gene Ontology: Mol. function=alpha-L-fucosidase activity; Biological process=fucose metabolism
caaaatgtcttttactgtcgtgccaattcttttttgcttctttttgcctgctctttcgatttataaggtgtccatcctctgattggttttgtattttgtgaatttttttagccaaattgggactcaattgactcgcgccctttgcccaattggtacgacgaagccaaatttggtattttttcgcattggggagtttattcggtgccggcatttgggtcggaatgggtaaggccgaaaacagacccatttgattgttgaagttctttgaagttttggtggtattggaagggacaacgtgacgcaaaattcgaaagatttttcaaaaaca

SEQ ID NO: 52903 - DNA, 195 bp, Heterodera glycines
  Genomic contig location: Contig_ID=SeqID_22231; Location=1534..1728; Strand=+
  SCN-specific regions: Sequence locations=1-7,34-146,189-195
atgcaccaaataattaatttttatttatttattctgttcttcgcacctaattttgctgaaaaacttcggtatgtacagattatttggcgccatggagacagagcgccgctggaaaagccttaccccggcgatttaaatggtcaacctaaaaaagaaaaataaaataaataaattaattaattaattttcagatga

SEQ ID NO: 52904 - DNA, 620 bp, Heterodera glycines
  Genomic contig location: Contig_ID=SeqID_22233; Location=379..998; Strand=-
  SCN-specific regions: Sequence locations=1-333,355-503,526-620
atggtcagcgaattgcccgagcagcgtcacttcgttgccctgcaccactgcgttttgctgctgcccaccgaacaccgcgaggcgctgacgcaattgctccgttttctgggcacagtgacgcgactgtcgcctcgaatgacttcgctgtgcatggccacctgttggatgccgacgctgttcaaaatgccgggggacaacaaaatgggcaagttgatgacgccggacaacaccaaacggagcagaaacagtaaattgacgtaagttacggactgaaaaaattgcggcgaaactgccccccccccaaaaaaattaaaacaaaaacaaactatgcatttttgaaaaattcaagattttaaaacgtttgttgttttttaagccgtcgaaaaaccatttgcacgcccgttttggattctctggacgcagtgaagagacttctgatgacaatgatagaccaatgggagcgtttgttgtacttgccgagtgccttggccaaattggtcgctgaggacaaacggtggaaagtgtgccacgacttggaaatgccaatcaaaaacggacagtttgacttcagcacggaattgcagtacaactttagacagcaattgtcccgattaaaggcg

SEQ ID NO: 52905 - DNA, 1275 bp, Heterodera glycines
  Genomic contig location: Contig_ID=SeqID_22234; Location=1034..2308; Strand=+
  SCN-specific regions: Sequence locations=1-629,682-687,709-820,849 -1060,1082-1084,1106-1275
aatgtaatggtcgacttggctacactcttgttgaggtaatttttatctcccccttttttcccaatttttttagcggtgaaaaaacgcatttttttcaaaatttccttggatgatggcatatttgttgtatttcctagggtgattttcccccgaattttcaggatgattcttcactgttgggtggcatcacttttcgctcaattgtgtccggtgacaaattgccgttgttgcgcgactcaccgcccgagtcgcatgttgagccggtggcgcaactgttgcgatctccacgtgaccacatggacaacatcttcaacccagcggacaacaacattgtggacaacaccaatggcttcgctttggcgccttacaccgaacagcgacgtaattttgccaaaaaactgatattccttacttgagctagacctggacctggatggattcaagctttttttttcctggacttggattttcctggattttgttctaagccatgtgaaaaataaaaccaaaatgattacttggatttaatttcagaatttattgttcagagtgcagtttttttgttttcaagttatcgaacactgattaatagatctaaacgattttattatggatattcctgagcaattagttgacttttttaaacatttgtttgttttttaaaataaatttaaaaaaaatccaggtccatgccatgacaggcctggatttttgtcaggaaacgcgggtgggcccgggcatttttcaaaatatcgcccttttcaggtgcgcccagcggagtgttggcacagcaaacgatgcaacggttcggcaatgcgtatttcatggtttgttttgttttataggtggcatgcttaaattcaaaagtcgaaaattcaaaaaaaaaaaactttttttctttgagtcactattgaatggccatttgaattggtgttgcaatgcgattgttgaaactaattttgcttatttttgaaagatttgtaaacaaaaaggcgtgaaacccgagaaatttttgaattttcgactttttttttgttcgagttcgggtctctggtttcggaatatgtgccaaaatgaaatagtcataatttattctttcttttcagggtaatagtaataatagcactaacaacaccaccacttcctccgcctattcattggcaacaattggcaccaatacgacgacgtacagtggcggggcctgcaacggcagcggcggcacattggtcacaaacgcaactggcacaacaggcggacgtcgtaaagaggtgtaca

SEQ ID NO: 52906 - DNA, 1514 bp, Heterodera glycines
  Genomic contig location: Contig_ID=SeqID_22236; Location=10..1523; Strand=+
  SCN-specific regions: Sequence locations=1-585,607-747,769-861,883 -1110,1148-1416,1438-1514
  Gene Ontology: Mol. function=ubiquitin-specific protease activity; Cellular component=nucleus; Biological process=pathogenesis
gcactccgttgggccgatgaaaaatgtcttcaaaatgccatcgaatgttccgctgagaatcgtcgtgctgcacttggcccggcacttttcaaaattcgtttccctctcatcccatcagatgcatttgtgaagcaaatcggtagaaaatcctttttttgttccttaaaggatttcatttatcgagcgagcatttcccttttcgcagttccttctggtgttctgtccaatgatgaatttgtcggcgttttccaattccattgccatccgaatttttgtgctgtgcccgggctttatccgctgaaatttccaactcaaacccgaatttctgattggaacatagccaaaggcaacagaggcactgtgactttggaaattgagaaattttctgaatttgcgcgagaaaaagagggaaatgagaggagcagtgaaatcgaagtgttgataaagggaattccgtggaaaatatcggcagaaacagcaattaatgaagaaagcaatgaaaaatggctgggattttatctttggtgcactaatccaacagcagaatgtggtcaaaatattaatttggatttaaattaatgacattaattaagatggaaaatggaattgcaaatgttcggcaacctttcgaattgtttcactaaaaagcggcacggaaaatcccattggaaaattttatgatcgcgtttttaacaatgaaagaactatttcgggatttgaaaatttcattgtatttgcagtgagtcgataattaaaattctttttcgaatttaatgaccataattaaggaattgatggacccgtgcaaaggcctttatgacaaaggcggggacaaagtgactttggccattgacaactttgtggaggaagaaaatgaggagaaattcgatttgaatccaaataaatccaacgggacaattgtgatggaaattggcaaattgtcagaatttgcgcgagaaatcattgggagtgaacgcagcagcgaaactgtttttgtaaagggaattccatgtaaaatattggcaataatagaaattgacgaaaaaagcaatgaaaaatggctgggattttatctttggtgcaccgcctcacaatcagaagaaggtgtacaataatattacatttaacaaatatttaatttatttaagatagaaattggagttgcaaatgttcggcgacctttcgaattgtctcattaaaaagtggcacggaaaattccattggaaaattttatgatcgcgtttttaacaatgaaaggactattcggggatttgaaaatttcatcgaatttgcggtaagtcggtaattaaaattcttttttctaataaatgaccataattaaggaattgatggacccgtgcaaaggcctttatgacaaaggcggggacaaagtgactttggccattgacatctttgtggaggaagaaaatgaggagaaattcgatttgaatccaaataaatccaacgggacaattgtgatggaaattggcaaattgtcggaatttgcacgagag

SEQ ID NO: 52907 - DNA, 1146 bp, Heterodera glycines
  Genomic contig location: Contig_ID=SeqID_4032; Location=181..1326; Strand=-
  SCN-specific regions: Sequence locations=1-158,180-313,335-607,630 -905,927-1072,1121-1146
atgccatcaaaaaatcttcgaactcagagcttcgggctcaaaaagctgattttgggattgaataatggtgagaacgagacacgcatcaaagaacacgaaacccgagacaagcaacaacatccctgagatttatgtacatagaaaatgggggggggcaacaggtgccatccaaattttgccataatgttttattctcaaatttcagggctcaattcattctagtcaatttttagtgcacatggtgcggctattgctgataagctttacatatgtttttttgccaatgattatgctttcatttaaaaaaaagcattttaagctgaaaatataaataattaattgccaaaatttgtagaaaaaaaggtgggagtgggatgaagcccgacatacaaacaaaattgatcaatcacattgatcagaagaagagctctagccgaggaggaggaaaggagttgcgcgagatgggaagaagcattatatgcatgcatggatggagatggtctgccaattctcgactttgcgcgagagttgggcgacagagtgaggagcgccccgggggcgggaggggggacgagagagccgagactttcccgcacattggtccttctcctccaacaacaatacattcactaaacacagtgctcagaaagcacaaaatgctgctgatgaggcgagagtcccgagagtccgtcgtcgtcgtcgtaatatgtgtgtacaaacagcagaaaatggcccggcccgttctcaattgtcggcccaccaccacaagaaggtgacgacgacgacacaatgggacagggggagaggggaaattgacggggtaccgggggagaaaatgtggaagaaaatggagcacgaaaaaaagtgattgatcaagaataactgatcaaaattaaaaaaatggtatagtataattattaactgattaaaggggaatttgcaacaaaattcttggtgttggacgggtcgaaacaaaagtataacaaattcttggccggccgccatggtacgaattcatggtaaaatttagcataaattattggctgagttatgggttatcatcgcatttaagtttttaaattaaaaaaataatttaattttgcatttaaaaaaaaaatatcaggtagatcgaaaaatttgaataaa

SEQ ID NO: 52908 - DNA, 531 bp, Heterodera glycines
  Genomic contig location: Contig_ID=SeqID_4033; Location=878..1408; Strand=-
  SCN-specific regions: Sequence locations=1-56,78-78,100-142,164 -166,273-489
atgaatggcatggtcactcttttttgggccggtcgagaaacggaggtcaaacaaataaattatttattattgataagaaaaccattcatgagaactccaaaaatgcagtgcaataaactaaaatgccttcttaaaccccgctaaattaagatattttataaaccagtaatttataaaaatatattttttaattaaaaattcttatttcacaaataataaaataaaaagacaagattaattattagaaattatttgtttttaatgaaaaatttgatttgttagtgtactgtcgaaaagtccttcactgtcgaaaagtcctttacagtcgaaaagtccgctgtcgaaaagtccttctgtcgaaaggtccgctgtcgaaaagtcctagcgccacctgtggacctggatttcctggacaaaacccaggaaatccaagtccatgaaaaatccagcctggatcgaaggtcgaactctaattaaaaattggagccgaaaattttaaagaatttgataattataaaaaatagtaataaa

SEQ ID NO: 52909 - DNA, 1226 bp, Heterodera glycines
  Genomic contig location: Contig_ID=SeqID_4033; Location=1446..2671; Strand=+
  SCN-specific regions: Sequence locations=1-472,496-809,864-956,979 -1124,1147-1226
atgtcttctggttctagtggtcccgaagaaggtgaaattggggccgaactctttgcaaatgaagcctttgaagaagcagaggaaccagctggtcttgtccaattttttcgaccagaaagcaagcgtggccgagagttaatcagaagcggcggttttgaatatgcctttgaagcggacagcggacttcaagaaggtgcaaaacttggaattttttgtccaaaccccaaattagggatcgaattttggcgctgtatcaatcgccccccgtattgtttttgcctatttcggactttttatgcctttttaagtgtctatttagtatgcctaaaaatctaatccctaataataacaattgaatttaaaaaaaattaaatcccatttgagaactggccaaatattttgcaaaaaattggcttggatgccgtcaaatttggcatgaatggaattcgtggtaaaggcatgaaaagaaaagaaatttatgttgaacaagacgaaaatttgctcgcgctttacaacacacgtgaacagcgccatccctaccaatatttaagagctgtggcctatcgaatgccggacccaatttaacttttccataaaaacggaaataatttcgaaacaaaaataattattttgcttactaaatgaaatagcattgtcttttttaaaactaccatttactgtcgaaaagtcctccccttaaacaaaaattttttctgtcgaaaagtcctttctgtcgaaaagtccgctgtcgaaaagtccttctgtcgaaaggtccgctgtcgaaaagtccggcgcccaatattttatcgaaaaattatttttaaaacaaaattagaaaatcattaaaattatttaaaaaaaaagaaatctgaaaattgcacattcgataaaaaaaatggaaattgcacagtaaccaagaaatgaaaaagaacaaaagcgcaaatacggtaatcagggaacagcgaaagaagaggggaatgaaaaggtataagacacaaagtgcgtggatactgtagcgtcaattttggtacaatgtaaccttaatgaaggcattaggtaaaataattaatagtgatagggttataagttgtatgattttgcatattttttctgcgcatatgctatgaagaaaggggggctcaaaaatagcatttctgcgttaaaactttttggtttggagaaggtttttagtgcatataaaagcatactttggtgggtttttgaaa

SEQ ID NO: 52910 - DNA, 752 bp, Heterodera glycines
  Genomic contig location: Contig_ID=SeqID_4034; Location=80..831; Strand=-
  SCN-specific regions: Sequence locations=1-286,311-403,425-460,482-752
gttgaacgcgagttggaccaactggacagcattgtggtgagtgcacagcaacaagcggacgacgtcgaggagaacaaccattacgcgtccgcttctgcgattgatcgccgactctctgtggacaacgtctcctccgcctcctaccgcaacaaattgcccgcctcaatggtcgctgctgcgcaacaattggaaaggtgtggcgttttgccgtggcggtacatttaaaaggggggtggggctaagaaaaaaaatgcattttaatgacattttgagaaaattttacatgcttttttgaaaaattttggaaatacttaattgtttatcattattgtttccccggctttaaagcttttcaaattgtcgtttcaatgagaggatttattataaggaaaagcgcattgacaaaataattatatatattttactcatactgtataattgcaaaatatatcgtaatgaaatgtgaattttccaggcagagcaaatcgctggccgcgctcagcttgttggacacttcgatgacgtcactgccgtcgccgccgcgatgcgatggcacttcggtggtggccgagttgcagcacagaaaccggcacttaccacaacaacaaggacagcctactgctgaaggcggcaatgatgtgcggtccgcagaagttcagcaaaatgagcaacgacggcaccaaaagcagccacctccggcggtgccggccaagccggccattcggtgcgaaacgcgggacagtcttttttaa

SEQ ID NO: 52911 - DNA, 1350 bp, Heterodera glycines
  Genomic contig location: Contig_ID=SeqID_22237; Location=11..1360; Strand=+
  SCN-specific regions: Sequence locations=1-924,949-1267,1290-1350
atgtctgacaatccaaaggaagcggagaaagaaatggaaaaagcgatgtaaataattaatctaaatttgatttccatggctaatcattctgcttttccgttttcagcttcatctctgctgattgttggctcgaagtgttcggtttgcttccgccatctcagcttggccttggcattgcgatgatcagtcaccgatttgactattacgtcgacgaacacttcaaaacgcgcaaatggacattgggcaaaatggaaattcgaagcaaaatacgacgatggagattgggctacttggaaattcgaggcaaaatcggagagaatggcgcaattgaaatggaaattgtcaattccgatggaaaagaattgccaattccgcaaaatccattgccaaaaaaagtcatcggattcgaaagcatttcgatcgagtaaaaaatgaattgaatttgtacatgattttctttccattacattcctctgattttcagcttcatcgaccaaaatgtgctcacttttatcggccattttcaccgtcttttctccgtttgttcagcaaaattgaccattcacgcaagtgttcgcatttcggagttcgttcagttcaccatttggccgatgttcaaggacagcattcgtctgttgtatttgagttcctttgttttacgtcaaatccgtcaattggccccgtcttttctctgcaattggccgtctctccaatttgtcacactcttttgcgactttttgcccgaattgccgcctgatgacagtgccaacacgtcagagggccaagcagtgaccaaatggctgttctcgcctcatcccgacaatttgccaaagctgttttatgtccaaatttgggaagatatggggcaacaatgggcggcaatagtggaacaaatcaaagcggtgatttgttcaatttactttgtttttaattttttttttttttttaggaattttccatcgcttcttctcccgtttctttcaacattactgttgcctttatgccgtttcattcgcttcctgttgttgtgccatttgaaatgaccaacgcattgactggggagaaattgaaattgaaaacatcaattggaactgaggacaatgaagatatttttgagctcatccgttgttcaattggcgaaggaagtgagcaacaaatggaaaaggcattgaatgaattgattgatggacgagagaacaacaaaattgagatttccatcaaacacggcggagtcgacgatgggtgaacaatttttaaaaatatcaatgctaattttttgtgttgtttttaaggcttctcgacgatttgccgtccgggccgagtggtgatcagaaacagcagaagaaatga

SEQ ID NO: 52912 - DNA, 1562 bp, Heterodera glycines
  Genomic contig location: Contig_ID=SeqID_22238; Location=1052..2613; Strand=-
  SCN-specific regions: Sequence locations=1-80,104-208,278-296,324 -791,813-869,891-1180,1203-1295,1338-1456,1478-1562
atgggaaacaaatcatttattaacaaaatttttatggtgtttcgagtggaaattgaggtaattaaaagttcaaatataccaaaaaattaaaattaaataaaatgttgtaattttgattagagacagggaaatttcaaatttgcggatctcgctgcgggattgaaattcaaatttgttgcgggaccggatccggagggattaatcacgcaaataaatctttaaataaaatttattctctttataaattgttttacttttaaagttttaaaaattaaaagtgggaaattcatttcctcatttttatttaataaaaaaaatattttcaacaatttttattcataaaagtctttctcagaacacttcaaccctctttctgctgatggaaaatgtattccaaaatgccaaggatttgacacttttgaactttgatgtgaagggcgtcttttcgcgtcagcccaaattggtcaagattgatcaggaacagcgtttaaacgacgtcgtgctcaaatggtacaattattttggtgccgaaccgccccttgtgccgaaaatagtggagccaatgttcccggaaggcattttgttggacaaaaaaacacatcataatatcgcagaacagctgaaacgtgactttgaggtggtggcattttttgggtgttattcaaacaaggcacggcacctaataaatgaaaaataatttctaattttatggtttagtttacaaaaaatttaatgtcccgctgtgcctataagcgttgcgggaaaaattttcaagattgctccaatttggttaataaatttatgaatattttaggttttggcgaaaaacaacgtaaatgattggagtattatatttggtgtttactttgaacaaaatggagaacatgaaaaaattaccgaaagctcgtaagtttttatattaggattattccccgcccgaccttcagggaaagaaatgtaaggggcgggaaaatttgtgagtgattgcttgaaaaaattaaaaaatatccttgtcaacgccttcttctgctggcgttaatttttttaaattcagtgacgaaattccgtttttcaaagccacctgtaatcagtgcagaaatcatccgaactcagcgacacttttgaatagccaaaaattgcgcctttactttggcattgtggacattttcacgccattcagtgaagaaaggaagaaaagatatattgacggtcttaaaagacacattactgtgcaggaaaaggattctgctaatctgatggcatatgtgaagacgggcagaagatgggtaaagtcgtaaattatttaatcgaaaaataattatattttttattatttaggaaatgtttggaccgattccgccttcaatgtatacagaacgcatgttcgcttttaggtatacattccttataattgatattttcttctgtcaatttctctgactttaaaattgccaacgaaatttataaggttttatttctaaaaaaaacaaagaaaatcttttataaaattgttttcttttcatattgtaattcttgaaaattattcaatcttcgggattaaa

SEQ ID NO: 52913 - DNA, 731 bp, Heterodera glycines
  Genomic contig location: Contig_ID=SeqID_22239; Location=1374..2104; Strand=-
  SCN-specific regions: Sequence locations=1-27,49-59,96-114,137 -227,257-419,453-568,590-601,634-697,725-731
atgttatttcttcatatatttcaaactatattatttgtttatttaataaatggaagcccaattaaaaaagtaaatattaattaattttattatttgtccaaaattttttcagaaaaatgacatttttgaaactgatgaacacaatgaagtgaagcaattgctggagaaaattaaaattgaagcacaaaaaaacttgaaaaaattttctgatgaggtaaaaacgttggaaaattattaaaattaaaatgtttttatagcattttgtgaaattgtcaaaacaaaggccaagcccaaaagacagtgacaaagattcaatattgaatttgaatcacaatttgttggaccaattatttgaaggcgacattttgctgtcagttccacaggccaagaacattttatatcaattggaatacggtaagaaaataaaaattcaaatttaaaatttttttattggattattcaaaaaataaactttagcaaattttggccataaacggacacaaagacaggctaatcctgctcccgactcattttggtcaaatttgacaattccttacacatttcgttcagattacttaaatgattgtatgtttaacacttcatttaattaattaattttttaattattttttagctaagctaattgacacagtgaaaaatggcttaaatcatattgagtatgtttgacaattgtttgttatttaaaaattaaaatttaattttacaataaa

SEQ ID NO: 52914 - DNA, 1056 bp, Heterodera glycines
  Genomic contig location: Contig_ID=SeqID_22239; Location=200..1255; Strand=+
  SCN-specific regions: Sequence locations=1-173,195-229,252-378,408 -408,430-515,537-552,574-653,675-844,868-1056
acccaacatggagtttcactggttcaaccgaaattcgatccatttattcgggggaggcgaaagtctatgatttgaaaaaatttgtgttcaatgccgggacaaccgaattgaattatgccatccatcttaatgaggtttgtgagcagggctgggcgaagctcggcttagcactcgaagccgaagccgaaggcgaagcccaatttttattcgaagccgaagtccgaagctcgaagcccaaaaaacccgaagttttcgaagccgaagccgaagttttttcaaaaaatttttttaattccaaaatttttttcatcacaaaatttcggttaaatatcaaatttatcaattgacagaactgctagagaccaaccaacccctttcgataaataaatataatgaactttttgagcaatatattttgtaatttttataattcttagaatattcacggtttttgagtcaatttaaaaaataaagggaaatttttttaatttgagtgtaatttgttaacagattttcaacaaaaaatgaccaaattttgcgactttgagctacttttttaaataaaatagaggatttttagggtccggcggtgccgataggcgccgccggtaaaaattttgaaatttttagtgcactttgttaacagatttagtccaaaaatgaaaacattttgcgattttaattgttaaattttattgaatttactttgaaaaaaaggaatatttttgaaaaattagaagaaaaacaactaattggatgggaactgacccaaaggaaacataatgaaaagagccgagagcactccactcgaccatgcttctgaacaaacagagaaagcaaaaagtttataaatataattaattttaagtttaccaaaagccaatcactaggggtgcattttcacattgaaaactcaatctttaggggtgtatttttcccgaaacttcgggtaaaatagccgaagccgaagcacgaagttcgaagctcaaaaaacccgaagttttcgaagccgaagccgtttcgcccagccctgtgccggatccagggtcaaatctc

SEQ ID NO: 52915 - DNA, 625 bp, Heterodera glycines
  Genomic contig location: Contig_ID=SeqID_22241; Location=285..909; Strand=+
  SCN-specific regions: Sequence locations=1-201,223-625
atggactcatacacaactatcaataatgagccgtctgttacgggtcccactgaagaggaatccgtcctctccgcaactgcgacaacagcagttcagatctcgtcgccacctccgctgctcatttcccccaatgcaacttcggtgcgtttgtcgagtggactacgccttccgcaaggcggagacgatgaaggttttcagctcaacaaaacatttgtaatttttatacttttgttcatcagggccaagtcgtggaccaaaattgcgtcggctggcgtcttttggagaccaaataacttcgcagtcccaattttctggtcaagtggcgacaacagatttggctgaatttcgcagtccgtctgttgtaagtgcgtcttcggcggccacaaatgttgcagctgcccttgttcatctacaacaacatgcggtacacgctaagcaatattctcgatgactcaagttaaaattttcggtcatactttggtttgttccccctattttcgaaaaatttttttttttaaagttgtgtaaaacgcctttcctggggattttcttggtcgctatcggacatcagtttttgccaattccgaaccccggaccagaattcgaacaagaagtcgaaaattaa

SEQ ID NO: 52916 - DNA, 680 bp, Heterodera glycines
  misc_feature (17)..(17): n is a, c, g, or t
  Genomic contig location: Contig_ID=SeqID_22242; Location=48..727; Strand=+
  SCN-specific regions: Sequence locations=1-61,83-225,255-434,460 -654,677-680
atggtgccattcgaatnggtgacgaaatggcaaatggaaaagctgacattgaccaaagaaaacgaaaatgaatgggacaccatttgcataatgaaacgaagcaaaattattggggagacagcggcggttcattggaacgacggaaattgggacaacaattgtaactgtgtgttcttttggcttgatagtgacactaattgcattgggtgagcaaataaaaaaggcatttaattttgtttaattaattaaaatttcgcttaatttagtccattgtctccgccaccgaaagaagaagacgaagcaggacaaagcagcgaaaaaggggcgtcgtctgctgacaaatgagtgacggagaaaagaacaaaaacagtgatcagccgcagaagtagaaatgaattaattaagaatgatcgatcgaccgatcataattcatccgtgatcaaattattaaaagtaattatttggaacgttttcgccactatttttgccactatttagttaattattttgggatttttgccactaaaaatccaatccctacttctaacatgcatttttttgagactttttttacactttttcggatttttatgacttttttgagtttttgcgacttttgttcgtgatttttttgacttattgaggcaaagtttgagttttacagaagaaaatgccgaaaa

SEQ ID NO: 52917 - DNA, 1162 bp, Heterodera glycines
  Genomic contig location: Contig_ID=SeqID_22243; Location=1030..2191; Strand=-
  SCN-specific regions: Sequence locations=1-89,111-375,397-437,460 -798,820-1162
ccctcatgtttatttaacgggaattctgcatttaatgcttcccccccccgccctcaggccatcatttggcttctcgtcgcggatgccgtcttcatcttcctgctggccattgccgacgtgctcatttgggaattaattaaccctgtcgactttctctaccctgtttttctttgcctttcgatggtacgacacttttcggcattttttttgccgtttttaattttccatttttcagctaattttgcgctctttgctccacgcttgtcggcttcacgggcgcatcacttcgggcccaattttcctttcctggtttctgttcggcatttgcgggctgcccgagctgtacgattgggttctgaccgcaacacatccaaatgtgtggattataattaatgggggcaacagagaaataccgaaattaaattcaataaactttaatttaaaaaaccccacaaaatatcactctctgttgaagttttcgaagaaggacaaaatatcgccgaaacaattaaaaaaatttttttttgtttcatagtctagctctagaatttctttctaagaaaattgggtacttccgggttatgtcgccccccccccctcaaaaaaattccaaaattcgtaatttggggtttccaacttcgctgatcatgaatatgatatttattttaacatcggatgacttttaatcatagatttgacaaaatatctatgattttagaaaaatatttaaaattgacgagattttgcgcaatatcgctgcctttatgccacctgtctgactcttttcatgatttaattgaattttaaatatttttcaaatctatgattaaaagtcatcagatgctaaaataaatatcatattcgtgatcagcgaccttggaaaccccaaattacgaattttggaatttttttgaggggggggcagcataacccggaagtacctaaattgaaatgataaatgtataaaagcaatgctttccataaattcactcaatttaagcagtacgctgtgaccgaccagcgcaaggaggaccagaaaactgttgactcgcaggttatggaagtgatccgcaaacatcccgagaagaaattcttgttcggctaccttggctcacgctttcatctcgccaagggaatgcatccccataaaatggtcttctga

SEQ ID NO: 52918 - DNA, 710 bp, Heterodera glycines
  Genomic contig location: Contig_ID=SeqID_22244; Location=296..1005; Strand=+
  SCN-specific regions: Sequence locations=1-47,88-558,580-710
atggctcctcgtaagcagaatgagcagtttttggacgaaatccagagtaaattttaaaataaaacacaaaatataagcattttatagaagcgaaccacgtggaagaagcacaaaacaatcaaagaaaacataaaatgggtaaaatttttcacaaattttacaaaaattttggattttttctcatttttcagatattgatgatgacgtcatattggttgactcgcagtcatctcacgcagaggaacgtcctgcgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagtttacccaaacattctgccaagactgtgccattgactgcaccgacctgatttcttctaaagccgagacggctctaaaattattcgaaagcggagtcggcacgccaaattcgtcaaaagccgggttggctaaatattaa

SEQ ID NO: 52919 - DNA, 486 bp, Heterodera glycines
  Genomic contig location: Contig_ID=SeqID_22244; Location=1072..1557; Strand=+
  SCN-specific regions: Sequence locations=1-81,119-486
atgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgttgcaattttcgaacaatgcgacgaaaagcatcgcatcaccgaatggctggagcgtttcacttttgccattgactcgtgcgcaccgaacgcggccgatgacataaaagtcaaggcactgatgaacaaactgtcggaaaccgcgttcagcgagtacagcaaatttgttctcccggccaaggtgacggatttcgactttgatgaaacaatttcgaaattggagaagctgtttgccaaaccacaatcaatatttgtggaccgatttgcatgtctgatggccaccaaagacgatggcgaagattttcacaatttgttaacaggcacaaacgacttttga

SEQ ID NO: 52920 - DNA, 874 bp, Heterodera glycines
  Genomic contig location: Contig_ID=SeqID_22245; Location=855..1728; Strand=-
  SCN-specific regions: Sequence locations=1-185,214-420,444-576,639 -810,847-874
atgtggagtgattcgacccatgacggacaccggctgccactgtacaaggacgacgaacggccggacaagccggacaatgcgcaggagggggacttcggaaattaccgattcaaccgggtgagtgagaacaaatgggggcaattggaaaattaaacaatttttgtgggaaaaatggggggcaatggaaaaataataataattttttttttttttgtatatcacatgcattcaaaatttggcaatcgtccagaaggggtcggaaccaaatcgtttccaaattttcaataaccctagtttttcaagaaaaaaaattgaaaaattttaaacctttttttcttaaaataaaagtttcaagaaaattgtcaacgcatttcagaaatgcagggtcgccattgagtacaacgacattttcgtgcagcaatttctcgacaaattcccgcacatctctggcattttccgcgcgcacgagccccaacccaacgggtaccgaataaacgaaggccagactcatctgaccttacactcgtccatcagatacgcaaagccatctgactgtgcttcaatcgctcatgtaaattttttatttatttttttttgcattttttatttgtattctatttttaattttttttttccttaaaattttaactccccctcttttttctcaaagatttcggccgactgtcagaaaattgtgatcatcacgctgaagccaaagggcggcggtggaggacaacgacaacagcagcgaacgacgaccaaggaggagcaggacgagcagcagcaaggaggaagtaatggggggacggacggcggtggtggtggtggtaatgatgttgaagtggactttaccgaactcagcaaaaacacgtga

SEQ ID NO: 52921 - DNA, 1040 bp, Heterodera glycines
  Genomic contig location: Contig_ID=SeqID_22246; Location=239..1278; Strand=-
  SCN-specific regions: Sequence locations=1-102,145-172,194-329,355 -443,466-484,523-570,593-612,634-740,762-1040
atgaaaatgatgggaaagaatgagccatttgtaatcaaaacagaagcaaataaaattgtgtttgctgaggacaacatcactaaaaaacaaaaagaaaaagtcatttaaattaaatttttaaagaatttttaaaattttaattttcaggctcaaaatgaaatcaaagattttttgatgtcccaaaaattacagatggaagccgttttatattggtaaaccgaattattgaaagaatgaagtgaaggaagaacacgaagaaatgcattcttgaagcaaaattttctagaaatttcatagaaaaaaacgggcttccattaacaaaaaaaattttgactttttttaaaagattacccacaaatttttcaagcaaattatggtttttttttcttgtccaatcagtgatacatttttaatgctttttattcatattaaaatttcaattcttttcactgataaaaattatttcttaatatgtctaaactagtatatttttaaaaatataattttgaaaaaaatttttttctcatcattcgataaccacgaatgttttatgtaaattcataacaatttcaattttttaaattcaacattttctagcaaattctttaatactgtagaaaaaattataaaaattatacaccttaattaaaatcaatttcaaattgacttatttaaacaatatttaaacattaattccaaaatttattttttgctgctggctattggtctgctgctgatggcctctttctattaatgcacaaaactttccattgtggcacgagtgggcagccagtgctaactcattttcactttcccgcacatttttattggcaaaatgccctctcccattggccaagtgccgtccgtcgtcattgtgctatgtccactaaagccccccccccgccctcactcaacgcgttgctgctggcaatggccaagcaaatgcattggccattttttttcaactcaaagctggggccatgatgagaaaaagcacaacggcaccaccaccacattggccaacacggcacaaaaataaa

SEQ ID NO: 52922 - DNA, 313 bp, Heterodera glycines
  Genomic contig location: Contig_ID=SeqID_4037; Location=3442..3754; Strand=-
  SCN-specific regions: Sequence locations=1-71,93-313
atgacgacaccaaaaattcctgctgaaattgcgcgtataactgtggaaaaagtgctaccgacgcattttgccaaaagccggggaccgggccgacccgtcttcgaactcgtgccggcaaaaggcggggaaatattggccgattatgtgctttttgaagaaacgatgaaaaagacgaaggtgtgcaaataggaattaattagcatgatcaatcccttttctctttgttttttaggtgtcatggctttgttttgacaaaatgaccagtcagtttttaagctttttctttttgcatttaatcagtcatcccatttga

SEQ ID NO: 52923 - DNA, 1039 bp, Heterodera glycines
  Genomic contig location: Contig_ID=SeqID_22251; Location=423..1461; Strand=-
  SCN-specific regions: Sequence locations=1-214,237-355,377-1039
tcgcttggaaaggggcgaactcagcgacgatgacaaacgcggattggaagcgctgaagacacaggcggagcaaatgcacatcaacctgtccgatttgtggcgtgaggaggtgttttaattctataaacaatttttaatggccgaaggtgtaggataagttaaaaaagtgccagaacccgggacaatcagaatgcttattcagttttaggctttggtttaaaatgggtgttataatgagaggggagaattatttgtgtgtggtacgacgaaagggacagagaacaacactttctcgtcgccatctctggcccattccgtccactatttcgtcatttgtccatctctctttcttgcctttcgttgtttttaatcaattctccactttgagctatttctttgaccgtttctgcttttttaaactcatttaccatgcctttctaacacaatgtccccaactaaaaaactggtcccaaagcgattaccccccgaacttttgtatgaaatttcactttttatcaattcccgaaatgatttgtcttgtatctattcctcctcccgtatattacataaatttgtgtctctgcgggtggctaaattttatcactcagtatgtctttggaggggatttgtcttcagaatcataatttgaccaacacattccatccattttaggctgttgaaaagctcaaaacttcatatgcaaatgcgcgccgaagcactttctgggaagctgtgaagaccgcggcttctagtgctcgtggagctcgtgacccttgtcttgatcagtttttggctgcacttgaggatgctttggtaaacaatgaattacgcaataatgaacaaatattgaatcgattttcagggcaccggacgtcctgccacttacatagttgaggaacgcagcgtaagtaacaaaataatttgtaatgtagttaactattaactctaatttaaggaacgcgtcggcaccggtctcactcacacacagggcggcagcgaaaccagccgcactcacactgtctcgaagacatctgccggc

SEQ ID NO: 52924 - DNA, 1343 bp, Heterodera glycines
  Genomic contig location: Contig_ID=SeqID_22253; Location=517..1859; Strand=+
  SCN-specific regions: Sequence locations=1-44,66-149,173-311,404 -493,582-807,845-849,873-1016,1054-1056,1084-1103,1125-1343
atgttttccattctaatagagaaaaagctgggctatcgagtggtaccaagaatgtaaaatttggttgcttttaagcaaagttatgccatgttctgtcaaaaaatagctaaaatggcggatttaagaaacgacccagcacgtttcaattcaaatttattaacttttttaatttgccagatttcttccatcgatagtgccctgcccgcattgaatctggaagtttgcggtgccgactctgctccatgcgatgccgtgtgtggtggacctggtccaacctgttcacgttgtggcggttcatcgtgtccaggcacattaaatttgaaaaatattaaatattaacgcaacaattaaaaattaattttaatttcccattatttaaattgtattttacattattatattaggctccgtatataaagctgaacaagccaaacattttgcacacgaagctctcgaaaaggtggagacaaagcaaaaagaagctgaagaggtgaattatttttatttatttaaatttttgtttttcattaaatatttaaaatgcgtttattaattaatctaataataattgtttatataaagcttctgaaaaaagtgcgagatgttctgcccaaaacgcaggaggcacgcaaatcaacagaaaaagcattggaaaactccaaaagagaggcaaaattataacaaaaaaaaagacgggaaaatgacaaattttaaaatttagtccgaacgtatcaacaaaacgcatgatgcattggtggcacaaattgagcaaatcaaaaatttccttgaatccgaaaggcataggtcaaatttacaataaacaatttaaaaataatttatttaagcgaattgtttaattttagacctgaagacatcagggccaaggttgaacacattctgaacatcacaattccattcaatgaggaacaaattcgacaactttctgaaaacgtaaaaaatgattgcacctttatttttctaggaaaacccaaaaaaatttatgaaaaattcgccccaattttttttttatttttaaaaatcattttttaattagaacccccccccccccccctctccctcccctgaaataaaggaagcccttttcaagaggtgttgaaaaatagaccatagatgggctctaatccagtaatacggcatttcccccaattttcgtttttccagattcgccaaaaagtttacgaggcaaaagagcccgagaaaattttgactgaaacgcatgccaacaaaacagctgcttcggagttgcaggcaaaggccgagaaagccagccaaagggcagcgtcaatccacagtaaaatgatgaacattgataaaaattgaaa

SEQ ID NO: 52925 - DNA, 146 bp, Heterodera glycines
  Genomic contig location: Contig_ID=SeqID_22254; Location=1492..1637; Strand=+
  SCN-specific regions: Sequence locations=1-146
atgccgaagaatgcgttttccacccgggcaatgccgtttttcacgaagggctcaaatactggtcgtgttgtgggcgcaaaaccaccgattttaccacatttttggaccaattgggttgcactcggggcaaacactgctggaaaaag

SEQ ID NO: 52926 - DNA, 640 bp, Heterodera glycines
  Genomic contig location: Contig_ID=SeqID_22257; Location=1360..1999; Strand=+
  SCN-specific regions: Sequence locations=1-296,354-559,581-640
atgttcgggattgatcgggatcgggattcagtcgggatcccgactcgggatccctccgaccccagttgtccggtctctagtgttcatgcggtggaagttgcgaaaaagggcgagagaatgagtgcacgtggtataccgaaaagaagccagagcatttggcaatagtgtgctgcaaaaacaaatgaaactttctcgctgatctgtcccccattactccctctttttgttggcatccaaatccaacaatcatcgcttacttttttcttttatttgtttcaaacggtacggaacagacgataaaaaaatgtttgtaaaaataatttacaaatttttttgaattaattttattttaactaacgatatacaaggaaatctgccattacttcacttgattctaattagttgaactgatccaacaatttaattttagtccctttattattgtgccgatttttgggccaatgtgccaaagaaaacccatttttcggtcgtttttttggtaatgtttccaattgctgaaaaagggaggaggcctagctttttttattttgttgttattcaccaaaatgccattttcttttccacgcattgagaacagaaacggcgccgcgattttcttatcgcactttgaacaaagaaa

SEQ ID NO: 52927 - DNA, 1006 bp, Heterodera glycines
  Genomic contig location: Contig_ID=SeqID_4040; Location=62..1067; Strand=-
  SCN-specific regions: Sequence locations=1-362,392-393,416-480,511 -1006
atggaccggaggaggccaccaaatcccagtcgttttggtccccgtctcggctgtcacggtcccggcatttcagtcaagacacgggaccgcgacgagccaccaaattacagtcattttggttctcgcgtcatctcggcactcccggtgtcccgacatttcagtcccacgggaccggaaaaaggaaatgcccggctttttcaggcctgcccggcgcttctaacccaatcccaacccatgccaatcactccactctttttttccatgcccttttttcaaatatccttaatatctcttcaaaattttgcgattctttgggaacactttggccccatgaaaacataacaattcaattgtttttgatggaataaataaataaatgaatgaatgaatggctgtgatttgttattattattataatattggttacatttgaaaagtgttttttgttcacatgtcattaaagcttttgaaccaagcaacaaaataataattattatattataatattttctttcacattttcagggcgatgcggtggtaaaaaaacaaaaacggaggagaaaaaacattcgcaatttgtggcaaaaacatcagccaggacactttgatcaatttatggcatccgatcattttggccatcctcagtttcttgagccataattttttttttttcttaattggtcaatgcctacttattcttggtaacaaaaggaagcttaaattttctggaatttataaatgcaagaaaaatgacattatgataataagaaaaaaaaattgaaacgaaaatactcgaaaaatgcaacatttttcgagttttttatctattgtatgagttttatagtccataatttagttatacaaaaaatttctttttaaaccaagaatgaataggcattgacgaagtaagaaaaaagttaatggcctaagaaaaactgaggatgatgatcattgattttgaatcaaaattatccgttccgaaagcgaatatttcttgaaaaataaa

SEQ ID NO: 52928 - DNA, 257 bp, Heterodera glycines
  Genomic contig location: Contig_ID=SeqID_4040; Location=1292..1548; Strand=+
  SCN-specific regions: Sequence locations=1-46,96-257
ccaaagagtgaaaaattcattaattaattgcattatagtcaaactcattaaatttatattttatttgttaaatttcatttttattttattttattcattcaaacattgattctatgctaattttattgttcctcctattaatcgcaatttaatattttcaaattttgttgctaatttccatttgctaattgaccacttttatttgtttaactacacaaaaggacactcgccaagcataataaaaactgtccattcgt

SEQ ID NO: 52929 - DNA, 1642 bp, Heterodera glycines
  Genomic contig location: Contig_ID=SeqID_4040; Location=2624..4265; Strand=-
  SCN-specific regions: Sequence locations=1-215,237-309,392-416,460 -922,944-957,979-1014,1038-1272,1294-1410,1432-1503,1525-1642
gatctgattttgactgtgctgttgaccgttggctggatgatcggcacgctgagtttttcgctttcggcacgtgccatttcagaggcgacgacggaagagaatgtgaacaaaacaatggtggcgcatggcatttgcgatggggtgaagagcggggacgaatgcaggtgggaatcgcatgcgacgcacgcgccactctctgctgttacggtgagcaaagaaaaaggaaataaatgtatgggaaagaaagtgcggacgaatgaaaggagagagagaagagagaacgagaaaagaaaacccaatgccaggggcagagagagagaaaaaaggaagagaaaaagaaaagaaagaagaggagcaaacacaaagagagagagagagagagagagagggaagtacagaaaagagagtgaataagaaaaaggaaaatttaatttaattaactttttccctcacttttttgtagttggccggtgttggtctgttcattttgtttgcctcaaatatttggttcatctataaggtatggtatactgtgtatttgtcctaactacggtaaccaaaaaaaaattctgcgcaggagacgccgtttttccgggaacgtcaggctcggcgcaacacacacaacaatttgccgaccaatgagccgtacactttggaatgagtacggtacggctacagtaccgtccacacttttctcttgactaccatcgtttttatccgtatgatatcatgagtttctcatcaaatttttttattttgacattatttttttctcatctttgcacccttctttctctgccatcctacataattattgatcgtaatttttgagttaccgtctctctcctgtcggattatggtaatccctctccaatcaccggccttatctactctatatttgcagctttgagaatacctttctacttcatttctttccagttttatatgcttttttcaaatttattccaagtaaaaataatgatgtgaaatgtttaaaaaaataaatgcgtcaccaaaaaaatatataattaaaaaatgtgctacaaaccaaaaataataattgttaatgaattgactaaaacatgaaaataatgggaaatgacatttagaaattgaatcagtgttgtgtttacacaataagctgctttcactgtttgttatttttggtaaattttgcgggaaaaaaatatttgaattttggaaatacaaacattgtaggaaattctaaaaaaatgaatgaatggctggtcacaaatgaatgaattattatgtacaacttttgcacatgttcttttactaagaaattgtttggatgaaattttggcaaaaaaattcttattaagtgattgcataatcgaaataattgacaacgtaaataaagacgtaaccatgggaggggggaggggaccgaccattctgctaattaaccaacaaaaaatgagcaattattgcttaattaccctgtcattaatcaatccatcgtttaccgtgatttttttaaaatggcaagaaatgccatattttcagataaatgacccctcggtgcatttggctacgtctttatgtttaaagaagggtcattgtttgattattatacacatttgatcataatcagcacaaatacttatacatcaaaaataaa

SEQ ID NO: 52930 - DNA, 78 bp, Heterodera glycines
  Genomic contig location: Contig_ID=SeqID_22259; Location=1407..1484; Strand=+
  SCN-specific regions: Sequence locations=1-78
atgaccttaaatggaacctatcttttcaacctgagcttgtactgctccaactccatgcgtgaagttcgagctgtacag

SEQ ID NO: 52931 - DNA, 889 bp, Heterodera glycines
  Genomic contig location: Contig_ID=SeqID_22260; Location=203..1091; Strand=+
  SCN-specific regions: Sequence locations=1-161,187-333,374-412,454 -528,578-846
ttccaaaaaatataaaaagtgccatcctcgagacggattttgttgtcaccgaatttaacaatgactctatttcggaactgatgaattgtctagaaaaaagaggagcttcaaaattgctcgataatgatgacttgaaacaccgaattgaaagaggtgaatgcataatttaatattaattaaattaatgcccaatttataatcaatgcgaagttaagctcgataaaaccaccgactccgcttaaaaatttgttaagaaaaaaggattaaaacaaaaaaatatgaaaaatttcgtaagaataaaaaataaatttagctttttcttgacgattactgaatttaaaataatttataattttaataattttttttaaaagtgatttcatgaaaaattgttgttcggttggcaaaaatgaaataaaatatatagtaaaaaaaatttttataaaaaaattacggaccggatcccgcaaaatctcacgcggattccattgcgaagagaccaaactttagataggtcgatcacaaaacattttaaaataaaattattatttgaatttaactgtttttataattttaagattttccaaaaagtctgctgaagttgccgccggattggctgcttttatcacttggccaaattcgctcacaacggcaattaaaagcttttgattattctgcgagaaatttctttgcaacatttgataaaaaagtcataaaattgggaaaatcaacgaaaaagaaatgcgttacttggaggaagaagaggatttatgcagcttatgccaaatgttaatggagaccaagtataatattccaaggaacaggaattaaatgctttcatcccccaaaattaaaattttttaaatttaattttaattaaaaaaatata

SEQ ID NO: 52932 - DNA, 581 bp, Heterodera glycines
  Genomic contig location: Contig_ID=SeqID_22260; Location=1198..1778; Strand=+
  SCN-specific regions: Sequence locations=1-68,90-127,162-199,221 -242,264-341,363-393,426-529,551-581
atggtcgaatggtacaaaaaaggagaatttactgaggaaaagcttataaattatgattatggactaaaatacagcagagaaaaacaaaattctttggatgaagtgagtgagtgcttaatcatttatcaaaaaaaaaaaattaatcaaattaaaaaaaatttgccactgatctaaaaatccgacaatttcaaaattcttctctctaattttaatataattgataaaacagttttttcgaagttaaacatttttacaaaggctaacaaacagttgatttcggacttgggacatgttcgaaacttaaggtggatcaaaaaaatgcacaattggatggttgaagaaaattcaaatggccaaaaatccttctttttcgctgttggaattcgcaattatctattaatacattttaatttcttaatcaaattcctttttcaatgcatattatttctgtggaagacaacttgcaacaacttctcacagaaatgggttatacggtcgaagaagttccacaaaatacggtagtgatcagcaatggaattaaatttaataaggacaaattgccaaaacagtatcataattga

SEQ ID NO: 52933 - DNA, 1354 bp, Heterodera glycines
  Genomic contig location: Contig_ID=SeqID_22261; Location=22..1375; Strand=+
  SCN-specific regions: Sequence locations=1-38,94-437,459-480,505 -660,704-1188,1212-1213,1236-1310,1332-1354
atgagaatgaaatgcaacgaaattcaacatcaaaatggtaattattattttaaatttaaaatccaattttaatttaaatttttagatataattgaaacgggaaataacgatctggttaacaatcttccaaatgacctttttgctgctgataatcaatcttttgatcagcaaaaatttatcaatgaatttttatgccgtagggaaaatgaaatcggaaaaactatttcaaaattggcaaaaaatattttatatgaaaaagcagaaaaaatgcgaaaagatttttgtgaggaattgagaaaaggaaaaagcattgaaaaagcaacacaaaaagtgggaaaagcggcaataaaattggcaaaagaattggaaaatgatgaaaatattaaagaaaatattcaaaaagcattgaaaaataaaaacgaaaaaataaaattggataatgcaaatttaaatgagttgaaagaagaattagccaaaaattattcagaagaaaatatgaataagctcaagagccttttttactcgaaacttcatgaattttttgcatcaattaaaggtaattaataattaattatccattgattaatggaaatagattttttgaatttactgtactttattcaatttaatactgtatgagtctttaagttttatccttttttcaggttcaaaaattgaattctttgaaccccataaaatcaatccgtcgcattttaatggccgaagacaaaagcgtgccaatgtccgtgaattattccaaggcgcattccaacgaatccgtcggcatggcactctaatcgcatgcgttttttatgtttttgtcgcatcgatttcactttttatagtgatttttctgattgcccgtttggttttagtaaatccggcagattatttggcatggcttctgatgctctggcttttttatgtctttttgcactacagcaatgaattcatcaaagaatgcgccgactgccttcgcaacaataataaccaaattcactcaatcgaattggcggagaatggtcccgctgctggtggtgctaatggacaataatgaattgatgtttaattaaggacatgaaactgacgaatgtgtgtgtgatactgtattccttaaatcgtagttgtatgaaactataaatatattgtatcatgtaggtaaacattgtcacatgtatttttagatgatgtatgtgtgtgtgtgtgtgtgtaaaaaatgtaatttttgaaattttaacttatgacacttgaacatcgagatcacgcacttaaacaaatttactcgagaaaaaaagtcatgaaaatacatttcatctataaatattgggtattcaaaaaatgataacataattga

SEQ ID NO: 52934 - DNA, 64 bp, Heterodera glycines
  Genomic contig location: Contig_ID=SeqID_22265; Location=192..255; Strand=+
  SCN-specific regions: Sequence locations=22-64
tagttatatatatgttatataggttttgagtttcgtttcaaaaaacaaaatctcccggccgaag

SEQ ID NO: 52935 - DNA, 202 bp, Heterodera glycines
  Genomic contig location: Contig_ID=SeqID_22267; Location=1066..1267; Strand=+
  SCN-specific regions: Sequence locations=1-26,50-202
atgtcactttcaaatgttcacacaaatttggtacaaaatggaaaaggtagaaaattaaagaaaattttttcactttttttatatttcagaaactaatgacccattcgctttttcggctgctgaccacccacaaaatgttggcaacaacgaatcatcgtcatccattgagcagaaaagggtcagcaaaattgtggaaaaataa

SEQ ID NO: 52936 - DNA, 166 bp, Heterodera glycines
  Genomic contig location: Contig_ID=SeqID_4042; Location=1692..1857; Strand=+
  SCN-specific regions: Sequence locations=1-23,48-166
atgaaccgacggtaagcacaaattcttcatttatttaactaaactgttttcccataatttcagttggatttgcaacgacgtttggatggacattttcccatcctttgaccgtgctcaactcggcctcaaattggcattgctttcaccacgttttgatgaattgtga

SEQ ID NO: 52937 - DNA, 1571 bp, Heterodera glycines
  Genomic contig location: Contig_ID=SeqID_4043; Location=105..1675; Strand=+
  SCN-specific regions: Sequence locations=1-342,376-564,587-604,626 -957,979-1198,1220-1308,1330-1362,1393-1571
atgatgaattccgaattggtaaggatgggcctgcaaatttaaagtcaaacactgagcaattcaatgatcggcaacaaatcaaagttggaaaaaacaaaaatcatataaatgcactctcggggtgtactatagtcaacccccggaaaaaatagcatacctaaatgctataccaatcgattcgtctggagctatgcacgaattcgcaactggagacctactttttcgtgcatagctcctcgagacgaaatgattggtgtatcatttatgccattttttctggggggcttgactaaagtatatcccattctcgagatttcatattaatttgttgttttacagcaagtttgtgaaaagtttataaaaatggaaatggaattgaaggaggcaaagcacttacaaacgattgccaaattggaatttgaaaatgtgagttgataaacagaggaataacaattataaaattaattacaagtttataaattgcgaaaatttgtcataggattttgggttcgattataacgaatctgacatttccaattgaccaatccctaatccaaagtcgacaaaagtcgaaaattcaaatttttagccaccctttgacttttataaaatttaaaaaactccttttttcagtaacgccaattatttaatttaacatttattcaattttgtcaccggtttgaattagaattaaaagcatgctttaatattaagaaaattattaatttgaaactcattaaagcgtaaaagtttaattttcgatttcactgaaattttgattttagaaggcacttcaagaaaagctaaagcagcaggaaatgatgacagatataaatgcactgcaggcgaaagtggccaaattggaaaaagaacaacaaaaggaaaaagaaggaaaatacggtaaaactgaaaatatactgtaaaaatgtctttagcccttatactgtatttttgaacaatttttattaattattttttgtttagttactgtcgagcaattcaacaaaattttggagagaatcagtgaattggagaagcagcagaaaaatgaggagaaacagcggctgacatcaaaaatggcagcagaaaatgcaaatggtaatgagaaaaagagcaaaaatgaaaatgggagaaaatgaaagcacaaagtatcggataaatttaatggagagcataaataatacttaaaaactaagaaattcaaaaaattctatgtttagcaattgtggaaaaaaccgatgcactttttgaaagggtcgctgaaattgagaagcagcagcagcaaaatggcatcacaggagaggaacagcagaagaaattggacaattttattggcattttgaaggatcgatttggaaatggtaaaaataaaatttatttaaaattaaaattgttcaaattttagaacttttaaatgccgttcatcccaaacttcgtcagaatattgctgaggtgtggaaaataaaacacatacataattaatagggatgtcaaaaatttgtcaaaaattggtcaaaatatgtacataaatatgtaaaaaaaaatcccaaaatatgtacgaaaataagtaa

SEQ ID NO: 52938 - DNA, 380 bp, Heterodera glycines
  Genomic contig location: Contig_ID=SeqID_4044; Location=1..380; Strand=-
  SCN-specific regions: Sequence locations=1-380
atgcagcaatttttgctgttgtttctgttgtatctgaatggcattggcaatttgctgggcttggtcaaaaattgtgccggatttgtgagtgatggaagaagctgaggatgaggacgaagaaggcaataataattcattgacacggaacgattggtgcacatggaaagaatcgcgggaaaacggcatacccgtcaggcaaaaaagacgggaagcgggaacgggattcccgttttttcccgcgggattcccgttccagccggactcgtggttggtcgatcgccgaaaagtgcaaaatttgctaaatttttgactatatcaactcataacttttccagacgcaatcaaattacacaatcttggtttcatacgatagcccttga

SEQ ID NO: 52939 - DNA, 1108 bp, Heterodera glycines
  Genomic contig location: Contig_ID=SeqID_4044; Location=1250..2357; Strand=+
  SCN-specific regions: Sequence locations=1-261,293-327,349-382,404 -551,574-636,658-862,890-919,941-1108
atgggtgaatgggactctcctcttcttctgtgtgtgtgtgtgtgctgtggtggtggtgtgatgtcccgtattttcgcgattttgtgttgtccacaatggcggcggacagtggcagcagtggaaaaatccctcccccccctcttcgccattctttttttccacacatatacaatgccataaaagaagagcaacgaaaaaatgttattttcatttacacattcatgtatatgttgtgttgtttatttttggctttacgaaaacatttttacttttataatattttataaattttgctttttttggttttttttttggattttttgagcatttcttaatattcaaaatacggttcaaaaccgcaccaaattgtcacctttaaatgtcctctcttccctcttctttcgacatttttgagcaatcattttttgtttacaaaaaatattcctaccaaaaactgtattgtgtttttacttcagaaacaccttaaaattttaaacataggtattttttgtactcaccttactgatggtgatctcgggtgaaaactgaaaaagtacatttaaaaaatttacattaaatctgaatttcagtcagctaaataaattgccaaattccttctaatgatcactaacaaataagggtgcaaaaagatcctcggaaaatgggatcacccgggcactccgtcccagtttccgtcccgcttttttagtttttccgtttcccgttcttgctaatttttttttgccgaactcacaatttaaaaaccaaataaatgaaaaatttaaaaaaaatcaatagcagaatgccaaaaattttaaatttccatgaaaacgattttttttttttactttaaattaaatgggccatttcttttctttttaaacagaagcgatttaccaaacggaaaaacaaaatcactatgattaaactaatcaatttttagctcaacaaatacttaattacaaaatatttctaatccaacgcgtcaaattcctcctcaccgtcatcagacaaataagggttggcacgcgttgatcttggccgcacctcataagccggagccacgtcgagaatgcttaaattataatccaatacatttatgagtcaa

SEQ ID NO: 52940 - DNA, 1050 bp, Heterodera glycines
  Genomic contig location: Contig_ID=SeqID_22268; Location=739..1788; Strand=-
  SCN-specific regions: Sequence locations=1-110,134-181,204-372,395 -463,485-1050
  Gene Ontology: Mol. function=transcription co-activator activity; Cellular component=nucleus; Biological process=regulation of protein activity, epigenetic
atgccgacagcctctggccaagtttatgccaatggtcagctgggcaactttttaccacagccgacggaggcaaatgggggaccatcgcccgtttattcactgccactcccacaacaacaacagcaacaacaacgtgaaggacaggcagtactagcagaacaaccgcaacaagtgccaatggtaaagaaatgaagttccctttttcaaaatgcatctaaattttcaacctcattagcaaacagcaaagcaagcagtggtttggcagcaaccagtttatgtacagcttccgcaacaagtccaacaacaacaacaaacgcaacaggtgaagaaggaaattattaatagcaacttgcttataaattggtacagtttccacaacaacagcagcaacaggtacagccacaacagccacaaacggtgtatgttcagcaacagcccgcccaacaacaactgcaagcagtacccgcaccactaccaccaccacagcagcaaccacaaattgttgtgcaacgtccggcccaacaatctcaacagcaacaacaatttttgttgcccaacccacaacaacaaccacagcagaatttggtgattttgattctgcgcgaccgcccaatgcgatctttttatttctttaggttgtcgtcgatgccgcggcacccgccgggggaatgcctcgcgcgccgttggtgcagcagcccgcgcgggtgtcgtcgtcgtcatcatcccgtggctcgtacgtaatgttgcgcaaaaatgcaattggcggcggcaacaacattgtggggcccaaatgccgtgattattacccatagtgagtgccaaagtttgttgcttattagtgctgaccaaatggaaaattctcggtaggcttctaatgttgtaaagtttgctaaaatgagaagggcattttaagtgaaattaattggcatttagttgtgaacaaattgtgccccgaggcttttgcatctccgaagtttatccgttgaggatgaagcgagaatattgcccacaaagctgtggtttatgctaactcatgtgttaataattaaa

SEQ ID NO: 52941 - DNA, 467 bp, Heterodera glycines
  Genomic contig location: Contig_ID=SeqID_22269; Location=666..1132; Strand=-
  SCN-specific regions: Sequence locations=1-110,132-467
atgagaactgtgcaaaccgcacgcaaaagcaccgggggaatgccgccaagaaagcaaactgcgcgcaagtcagcaggagggtcagggcagcgactgcaaactgcacgcttgccagcagcaggaggaggggaaccgattctgggcactgcgcgcaggtcagcaggaggggctgcaccgcgattgcaaactgcgcgcaggtcagccggagggtcaggacagcgactgcaaactgcgcgcaggtcagcaggaggtgcagcaccgcgaccgcaaacggcgcgcaggtcagccggagggtcaggacagcgactgcaaactgcacgcaaagcagcagcgggaccctccctacggaatggtagctgaatttttcggggtcgatcaaatcaacgagttctgtgtttatgagccctccaaacttaaaaagtcttttaaaaaaaaattaaagttcactatagaaagtaattaataaa

SEQ ID NO: 52942 - DNA, 1499 bp, Heterodera glycines
  Genomic contig location: Contig_ID=SeqID_22270; Location=300..1798; Strand=-
  SCN-specific regions: Sequence locations=1-286,308-554,576-606,691 -710,738-759,796-928,950-1025,1048-1095,1133-1271,1296-1390,1412-1499
atgacgacactaaatatatttgtgaaacactcactcatatttcttcgccctatctgtattgtgcgattctggctatcattccatcttcaacatgtggtacgacactattgtacattgttatccaattgactgctaaatattagacatctagctctagttcggccattggatgcctatatatcctgtaaacatttattatgtatttgatgaattatcttaacatggaagactattgtttaaatgctccatattatttatatctttcatttctctgtaaaattacattttcatcactgataacttatttgtttgtctacattatactcaaatagcaattcacttcatgtaaaatttcaaacaggagaaagccaaccatatttctcatctggcgacaaaaagatgttatctccagtttatttctcatagatctttgacacccacaactactacgcattcggaatgattttcacgagatataaccatgtctatatgaattcttattatatatataatcatgtcccgataattcatctctttctacccaactgttaccgcatgtcataccagaaaattcaggaaatgagacttttcatgagaaaatctgcgaaattatttgaaaaattttgtttaattttttatattaaagtgatcaataaccaaaattaatttaattaatttgataatttttatgattgcaaaaaatattgttaatttgcttattttttaaattcagatgtcatgattgagatgttattttccatttatttttgattaaataaataatttttaaaaaatcttttggcattttaagcaatggcattgatcaacttttggacattgaactgatcaatgaaatggaaaatcacacagaaatcctgctcaaaaacggtgaaaaaaatgcaattttacatatttcattctatgcatttatttattctttagtgttttcatccaatttgaatgaatttcaaaatgcgtccaattttggtgcctttttggccgattacgattggatggcacagctattttttgctggaaaaatttttgatgcctgctcacaaaatggcacgatgttgtgccaaactaaggcatggaattttaaatgaaatttaaaataatgaaaatgatttaagtgcatttttgacccaacggcatggaccgaggaacagtttggcacagaatttatgaaaattgcctttcctgtggccaaagtttccaaattcgtgctccacatttgggcaacaccctatgaaattgcttgccacaaatacgcaaaaccaatggaaatgtttgaaaaggatcctcctcccagctatgagcatcggcatttcgatggctgtatgaaagtgccgacgacaaaatgccatgagtaatatgcataaaatagcaaatttttgaattcccaaaaaatgagaaattttgaaccgattttgcatcaaaaatggtcaatttttatctttgaagcaaaaaaaaattttgtttaacagaaatacaataaa

SEQ ID NO: 52943 - DNA, 822 bp, Heterodera glycines
  Genomic contig location: Contig_ID=SeqID_22273; Location=130..951; Strand=-
  SCN-specific regions: Sequence locations=1-101,126-418,446-459,482 -585,607-822
atgtttgctcgttgtgtcttccgaccatttttgaagaattcgttggcaccctcaaaaacatgccgtagttttgcttcatttggtgttgcacaaccgtcattgaacaacaacagcagcagcaacacgttcatcgacagagaattgcgttttggggcccacaattataagccattgccggtggtgttgaccaagggaaagggtcggttatttgggatcgttttctgggtcatttccgtaaaaagtgccatcatgggcttttggtaaaagtgccattgtacagatttttcaagaaaaattcgtcatagtttttcttaaacaaaatcaaatgaaatggtctttgtatcctacgatagcaattggcttgctctattagaaagaaaaatttcagataaattttattgagttttcagaaagttatggcaattttttgaacatttgtggtcacagttgtgataactcaatgaaattttctgaaacttttctttctaatagagcaatccaagagctatcgaatgacccaaagattatttaattttcttgtgtttaggaaaagttatgccgattttttcacgaaaaatccctaaaatttggacactttttactagagaccggacaagagggtcggtcggtcggtttcggttaaaaaccgaaaaaaaaccgaaacagaaaaaaaccgaaaaactcaaaaatttgtcggtcggtcggtttcggttaaaaaaccgaaaaaaaccgaaccgaaaaaaaccgaagaaaaattttcggtataccgtttcggtttcggtttttttgaatttttttatcttttcccaaaaaaacaataaa

SEQ ID NO: 52944 - DNA, 254 bp, Heterodera glycines
  Genomic contig location: Contig_ID=SeqID_22273; Location=1232..1485; Strand=-
  SCN-specific regions: Sequence locations=1-254
ctgtttgactgtttggactgggctttgtctgccgacgacgaatgaaacaaattgagggatcaaaggccaagccgaaactttggacggatctttcacccacccgtgtcctcccaaaaaaagccattttttaccccgtaatcgaatttttgtattatttttttgaccgaatgatatcacgcgacacattcatttatttttgcccaatttatcatcctcccaaatccatttttatcgtctcttctctctcactcaat

SEQ ID NO: 52945 - DNA, 405 bp, Heterodera glycines
  Genomic contig location: Contig_ID=SeqID_22274; Location=14..418; Strand=-
  SCN-specific regions: Sequence locations=1-304,335-405
atgaaatatgtcctgttccaaaattctcgacccgaaatttgtggtattttgaccagcgatagttttcttttactcaaatatctttttctctgagattttttacgttttgattataaaatgttcaaaatttaagtttttttttagtttttcgccaatgattttttactgtattcatcgacaaatttccaatttttttttcgcaggacgccgtcaccattttgaaggacagcgaacggccctaccagtgccgcggctttggcaccaaatttctgggcggcggctcttactctgtgtccgccactgaactgatgcagcagcaacagcagcagcaagacgaacagcaggtggccatggaaaaacaatgggggaaattgttgaaaatttggtcgccttttttccaataaa

SEQ ID NO: 52946 - DNA, 915 bp, Heterodera glycines
  Genomic contig location: Contig_ID=SeqID_22275; Location=1212..2126; Strand=-
  SCN-specific regions: Sequence locations=1-193,216-379,402-659,682 -778,800-915
ctcgtctgctgaattggcattgaatgacgagaagagttgggccaattacagacgaagattggcaacctttgatgtgaaatatttggaattactgtttgagaatgttgtaaacattgaccaaatcaaaaggtggccagtcgaattgcgaaaccgaaggaaatttcgcctgttgtgtgcgcacgtcatggatggaaaaatgtgggggaggagtttttgcaatgcgacgactgtggcaaagtgttatacatcaaattgcctggcgacgaagtgtccaatcgcgtgctgaaccattgcattcggtcagtggcgactggattttatggaaactgaaatcttggcagaattgggagttggtttaaattgaaaattcaattcgggatcatcatcaaaaaccacgaacaaatcaaaggagggcacacatactgttgtcgtacaaaattgactcattttcctttctgtttagacacattcaacgcaaattggtcgaagcgcacaccgtcatttgcccatggcgcattagcccggggctgaacacttccgcaacctatgacatcactgcgcgttatcaccaactggtggacagcggccagcccgaacttccgttggcggacaatgtactcgacgaagcgttggccgacaaatttggcgtgcagagccgatttttcttggctttggccatttttggatggcttccaatatcaaagtaagttgaaagagtttgaactgcttgacaaaacccaaaaatggaattaaacgacaggaaatgattattttggggtttagacaagcgacaaatgacgtggagatgaacaaaccgcagccgaactttcactgtcccctctgtggacgacatctttgcgcatcggtgttttccagtgacaatccgctggacccacgcgaacaacaccagcatta

SEQ ID NO: 52947 - DNA, 1868 bp, Heterodera glycines
  Genomic contig location: Contig_ID=SeqID_22276; Location=87..1954; Strand=+
  SCN-specific regions: Sequence locations=1-651,673-728,750-1095,1119 -1701,1737-1868
  Gene Ontology: Biological process=reproduction
tccattcattgcctttctcttcagcactcactccgacgacgctttgccttttcttcgcattagcacttttgacaatgttccgcccaccattctcttctacacaaagggtgcaaaaggtgttgtcctccactttaaagctttccccaacgaaatgcgttcagttaaaaagcctccgccgcactttgcctctcgactcacttggtgcaacaattcccttttggccctcgtcgtccgtcacaggttgaacaactgaccaaacaattagtttcataattgctcttttgttagtttggctgctagccatttcaaattggtggacgaatcgaagaaatggattggctattgggggaagcatttgaagtcaccgcaatatcggacactgaaaccgttccaaaaggtcggtctattatgagaggtgttcttttagttggtttgtttctcacgtcacgcttttccaggtcaatcattttcccggcgcctttcatttgggccgtaaagatcgcctttggctgcacatttacgagtttatgcagcgtttcgaaggggacctcttctgcattatgcccatcacttatgtcctccctcgcgacgctcgaaagctccgactttatttggccggctatacggatcgccatgtcattctgaaacccgtaattattaaatttaaattatgacaaatctttaccattttaaaactcttagcccgcttctgctcgtggcactggcattagcattgtttcgcgttttgatttggttccaccaaaggctgcgcttgtcgcccaacagtaaaatttacgagaaattcatcttttaatttttgtttttaagttatatcgaacggcctttcatcataaatggtgcaaaatttgacttacgaatttacgtttatgtaagtatctttttccaatattttgtcactttctgtgattttaaggtcacttcgtatgatccacttcgtgtgtacgtctacgatgagggattggtcaggtgaacaaattctcagcgaatttctctatttttttttgttttttcaatttaatttcagttttttaatacttttcggagggggttgggggctacgagtgggaagtaatttgcttccttttttcgtaagtattaaaaattgaaaaataaaaaacttgagttttgcaaaattccatttgtccatgtcactcctccatttcccctctccaaaggttcgcaagtgttgcgtacagctcagcgttgtcctcctactccaaccaattcattcacctcaccaattactccatcaacaaacatgcgtccgatgagcccgtccccaaatggcgtctcagcgaattttggtcttttttggaggccaatggccacaattccacgcgacttcgcaacgacattaatttggtggcactcaaagcaattgtcagctgcgagacgcacattcgctcgcacggcgaccattacagtgactttccatttgtcaggtgccaaaagtttatttattttttgtatggaccttaagaattaaagaatcgtgaaaagtggttttgtggcttttttgggtcactaatctcggattttacaaagacttgtcgaattaattctgaaccccggaaccgaattgagacaaaaagtcgtaaatcatttaaaaattcgcatttatgaccaaaaccgggttacacatgagaaccgagccaaaaaatataaagcaagcgaatactgtttttatacattaaaaaatcatataatttaaaattgcaattattctcaaataccattttaagccatgagttgtacggcatggacattctggtggatgccaacctccgtccctggttaattgagatggtctgtcccatcattttacattcattccttttcacaagtga

SEQ ID NO: 52948 - DNA, 1135 bp, Heterodera glycines
  Genomic contig location: Contig_ID=SeqID_22276; Location=392..1526; Strand=-
  SCN-specific regions: Sequence locations=1-322,346-691,713-768,790 -1135
atggtcgccgtgcgagcgaatgtgcgtctcgcagctgacaattgctttgagtgccaccaaattaatgtcgttgcgaagtcgcgtggaattgtggccattggcctccaaaaaagaccaaaattcgctgagacgccatttggggacgggctcatcggacgcatgtttgttgatggagtaattggtgaggtgaatgaattggttggagtaggaggacaacgctgagctgtacgcaacacttgcgaacctttggagaggggaaatggaggagtgacatggacaaatggaattttgcaaaactcaagttttttatttttcaatttttaatacttacgaaaaaaggaagcaaattacttcccactcgtagcccccaaccccctccgaaaagtattaaaaaactgaaattaaattgaaaaaacaaaaaaaaatagagaaattcgctgagaatttgttcacctgaccaatccctcatcgtagacgtacacacgaagtggatcatacgaagtgaccttaaaatcacagaaagtgacaaaatattggaaaaagatacttacataaacgtaaattcgtaagtcaaattttgcaccatttatgatgaaaggccgttcgatataacttaaaaacaaaaattaaaagatgaatttctcgtaaattttactgttgggcgacaagcgcagcctttggtggaaccaaatcaaaacgcgaaacaatgctaatgccagtgccacgagcagaagcgggctaagagttttaaaatggtaaagatttgtcataatttaaatttaataattacgggtttcagaatgacatggcgatccgtatagccggccaaataaagtcggagctttcgagcgtcgcgagggaggacataagtgatgggcataatgcagaagaggtccccttcgaaacgctgcataaactcgtaaatgtgcagccaaaggcgatctttacggcccaaatgaaaggcgccgggaaaatgattgacctggaaaagcgtgacgtgagaaacaaaccaactaaaagaacacctctcataatagaccgaccttttggaacggtttcagtgtccgatattgcggtgacttcaaatgcttcccccaatagccaatccatttcttcgattcgtccaccaatttga

SEQ ID NO: 52949 - DNA, 1023 bp, Heterodera glycines
  Genomic contig location: Contig_ID=SeqID_22277; Location=550..1572; Strand=-
  SCN-specific regions: Sequence locations=1-202,225-384,409-457,479 -911,961-1023
atggacctatcaattgaatgcggcaaaagaagagacctgtgcctgagaaatagaaaaaaacttagctatcgaatggcaccaagaaggtaaaatttggttgtttttaagtaaagttatgccatgcttttcaaaaaactggccgccgtagtcgagtgtgcggcggttttttagcgcaataagcaaattcaatcttttatatttgacgttcttttaccaatttctgactatggtttaaaaatagttttaacgattttgaggaccaattacatgcgtcggttttacatattttgaattttgtcgagaattaatttcctttttttttgttagagtccgggtttcgaatttggtcaaatggatgtcataaccgttttcagcgacctcgaaaacccccaaaaatatgttttcattgtaatttatgaatttcgaatttttgttcgaattcaggttcgagattcggaattttgaaaaataaatgtcatattcgtgatcagcgccccaaattaccctagaaatgactttttatttgaaaatttcagggggggggggttcacaaaaccgaaaagaccctttaaaattgcgggacgaggcgtaaacagccatttggccatccgacgcattggcactgttatcaggcggaaattcggggaaattttttgggtcgaatttccattttgtccaatgtccaattgcgcgtttggaagtgttcgtcaacggaatagtcaaattgttggctgatcagcgcaatgtaaaggccaagctgagagtgtggaagctgcgtcaggatcagccgggacaactcagcctaggacttctcagctgatggacaactcagctttacgagaatttacaaaatgcaactcgtacaatggcttaggcaaggcctaatcggtctacccgatcctgagaacccctaattaaatttatatctgaaaaaaattcttgaaaattttttttttttttgaaaaagggggcccaccatcttaactattaccgccagctttattcagttcaggcgtcaataaa

SEQ ID NO: 52950 - DNA, 242 bp, Heterodera glycines
  Genomic contig location: Contig_ID=SeqID_22277; Location=1..242; Strand=-
  SCN-specific regions: Sequence locations=1-121,143-242
ttgtcaattaatgaatcgattgccaacaggttgatgggtttttcaattcttttacctgttatatttaattttaatttgagattttgtttccgatttgcctatggaagttctgcctgccttttaccctccgccaactttttggatgcctcaaattgaaatcccaccattgagaaaatacgaagtttctaaaaaggaaaggtctaaaatgacatatctttcagtacacattcgaacatgaaaag

SEQ ID NO: 52951 - DNA, 721 bp, Heterodera glycines
  Genomic contig location: Contig_ID=SeqID_4045; Location=37..757; Strand=-
  SCN-specific regions: Sequence locations=1-511,533-721
  Gene Ontology: Mol. function=transcriptional activator activity; Cellular component=nucleus; Biological process=transcription from Pol II promoter
atggctaacgttggtatgggtgcacaagtagctgagacgctggtcgaaaatgtggacatccccgagagcgccgttgggctcggcaagagtttaatatttacagaacctaggcataagaaagatcggatagttaggtttgaatactttgttttagtgattggacgaggtggtgagcaaattcagctcatacaacagcagagcagctgtcgtgtacaaatgtccagcgaaagcaatgtcagtggatttcgtcagtgcactttacaaggcgcacgacataacatcgagtgagaatcctgacataaattttccatgtaccaatttgtttccttttagtaaggcgaaacaacttattcaagaagtactcgaacgcagcaatagaagtgcccctgggccacaaaatggagccaatgcaataacaattgaactgagcattccaggaccaaaatgtggacttatcattgggaagaatggcgaaactatcaagggtttacaggtttcgaaaaaaacattaatttaaaacatcaataaattgtccaggaacaaattggtgtcaaaatgatgttagtgcaagaaagtcatcaaccgaccatgggaacggtaaaaaaaccaaaagtctttaattctggaaattttaatcctcagaagcccttacgagtttctggacctcctgacaaagtcgaaaatgccaaacgcatcattgagcaactgctcgctggagagg

SEQ ID NO: 52952 - DNA, 371 bp, Heterodera glycines
  Genomic contig location: Contig_ID=SeqID_4045; Location=2593..2963; Strand=+
  SCN-specific regions: Sequence locations=1-371
atggcggatcctttgactttgcttcaggaatatacaacaggaaagcgtggattgcgtgagctgaaacacgtaagtatagtttttatacattaatttgactaacttttgactaataccattttaatagtttaaaacaaatttcagaatgggactttgtattacgtgttcgatgatgctgcgtatccccatgattcgaagaccaatttaagtgtctacaacaagccagatgagttttattccatcgagtcgatcttgaatttttggaggatgcgtgaaatgcaacacactgcgtatgttcgggatgtctccggaaagggaatcgcatcgatcacgcgagttcaacggtaattttgctatattgacgaggaata

SEQ ID NO: 52953 - DNA, 1674 bp, Heterodera glycines
  Genomic contig location: Contig_ID=SeqID_4046; Location=81..1754; Strand=+
  SCN-specific regions: Sequence locations=1-483,505-549,572-845,873 -1152,1174-1188,1212-1301,1324-1563,1585-1604,1642-1674
atgtcaacggacggaggagaccaacccgaagtgagaggacttagtaacgaattgccagccgagaaagtagcacaattacgaacactcgtcaagaaaaacttgaagaacaaaccactcgacgacgaaaggtgagtcggttcaattccgacggtcaatgtggaattaaaagcttcgtaccgatctccgatttggctatgccggatgcgagtaacgacgccgtagggaaatttataacggagaaggaacggctgagaaaggatcgcacgacttgccttgaatcacagtccagggacttttcatgcgttttgaccgctttgaaggatattcaagtggttttatccttaattggttaccagtaattttcgaattaggtgcgagaaaatcaagccaaaagccatccccagcatgacttctcactttcttctcaatcgcagtcttcgcgggttcaaaagccgctaatgccgggcgggtacagtcgctacgaccaggagattttccagaaagagacggtggccgactttgaaattgaaaccgatctgagctttcacggtaaaatttctttttctttcttcggattcactacacctgcccataggaaatgctgcgctgaaccaacgcattggcgctgctcaccctcaaaatcgtccaactgcgctaacatcgaacggcgtccaaaaggcggacccacgacgacccatcaccgctggagttgctccgtccgccatgcgacaacaacacggcccgggccaaaaacgtgtgtcacgcgttccaataataattatccctgccggtgcaagttcactcatcacaatttacaatgcgcaggaaattttgcaggtttattcatttaaaaatattataaattaatttatgttaaggatttgcgttacgtaagcacagaagaaaaaaagcaatttagcagtaaacgagagaatgagctgttactgcaaatcccaaagaatggcgtcactgttccgtaccgagtcgtagacaatccaacacgattgaaggacgaggaatgggaccgagtggtcgcagtgtttgtgcaggtgggcgtatggtcatttcaggggatttgcaaaactgctttagggtccggcctggcaatttaaaaattggaaatggaatggcaatccggttgagatatttgccaacattgctgcgtttcacttgcaattcgacgaacttccaaccgatccaaatgtgaaaaagtggaggtttgttcagctgtttattttttggggaagaatcggagcagataaatgccttgaaaacttaatttttgaaagttaaaacaattctttaagtgtgcatgtgttgaaattgtcccgtacgaaaaggcatttggaccgggcggagctgcacaaattttgggaaatgctcgacaggcacatttcgaagagcaacaaaagggaatggctcagatattagcgaagtcggcacattacatttgaaaatttacaaacgattttttgtttgagttttttttttgtataataatttaccaacttccagcatttactcccttaccaaatttggtagtgaaaatttgattggtaaaaagtattagcaaagaccaacatttaaaaaaacatggaatcggcatttataaatatattttttaaatctatttaattttttggcaacttgagataaaaaactggtcacttcaaa

SEQ ID NO: 52954 - DNA, 1650 bp, Heterodera glycines
  Genomic contig location: Contig_ID=SeqID_4048; Location=360..2009; Strand=+
  SCN-specific regions: Sequence locations=1-14,36-105,127-193,216 -542,580-717,739-1293,1315-1650
caatagacaatctgtgcttttgttgaacaatgccaaggtgcgattgcgcccccgaaggaccaaaagagtgcctattcggtttttgccgctttttcaattcattcgatggcaaaaagggaatattttgaactcatttcaatcaattgccgtttttgtattaactaaccttttggaaaaaaatcattttcgcgattttccgttccctgctgctcggtgagctccaacgaacgatggacggtgcccccccccgtcccctttggtgccctacattcacaaacccaccgactctttcttatcaatcatccttcccattcacctattctaaaaataacggatcggatggatgaaggcattcataaaccacaaaagcatttatttatccgattttatagtttctgtggcgaaaagtgagataaaagggaattgggcgggggtcattaaggggctgtggggcgggtgaagctttccttccccagccatgctatttgtgatcgtttggttctatctttcccatgccgacgaccttcaatgctaatccgatcacttcccttttaagggcatttcccttcgaaaatcacagcaattttggcgatacggcacttatgccctcctccccacccccgcccattgtcagcggcggatggtcaaaacttgtctttctttggtatttacgagtgctgccgatttgcgcataatgcgctctccgtgcgcataatgcgggcggtcctccgacttggatttgttcgttctgtgcttcaattagtccgtcctccatttgccatttgtctctcctccatcaatccctcccataatcaatcaaaatcaaattgaatttgtgccatttgtttttgttaagcatcgaaatgcctttgtcggtcctcgcgttggccttcgccctttcctttccgcttctgttgccttttgccaattcagctgctcaatgcaacagcatggaaatgttgggcagttatttgaaatgtttgaagggcgaattggacagagattatgccggttttgagcaggaacttaaagagcacacgcggtcagtggcaccgcccaattaatccattggcaattaattaattgcttgttgtcagacgggcgaccggtgcctgctttgcgcagaatattggcgacgccaatcagaacgagcgctgtgtgttggcattggccgatttggatgccaaggcgtgggaccgcaacggccccctgagggaatgttccatttgccgaacggtggattggacttgcgcatttctgaacattaagcaactccgttcagtttgccaccggtgccatcaaagccatcctttcaacaccagccgatgagcagaagtgcattagggagcaaatctcaaaagccattgggtcagaagcggagacatgtctaaagaagaaggtggccgacttcaggtgagccgcttttctgtatcaatagacaaaattggcagttcagtgggccattggtaatccccgacttggaggagggcgcctttgccatcaaagagcaagtgatcgactccatttccgactacatttggatccattcgcgactcgcattttgtgccgagcggaagcccgagagagccggttctacttcgaagtgtctgaagtcgcctttccttggctattatcagaagcattgccaag

SEQ ID NO: 52955 - DNA, 1714 bp, Heterodera glycines
  Genomic contig location: Contig_ID=SeqID_22278; Location=26..1739; Strand=-
  SCN-specific regions: Sequence locations=1-6,28-364,387-791,814 -1081,1103-1714
  Gene Ontology: Mol. function=oxoglutarate dehydrogenase (lipoamide) activity; Cellular component=mitochondrial matrix; Biological process=embryogenesis and morphogenesis
aaaatctattgccatcacactggcgttgagtacatgcatttgacaaactacgagcagcaggattggatccgaaaacattttgaggcgcccaaagtcacagaattaccaccggagcagaaaaaagtgtgtgaaaaaatggaataatttaaaaattggtcccccattttaggtgcttttcaaacggctgatccgctccacaaagtttgaggactttttggccaagaaatggccaagcgaaaagcgtttcggtctcgagggttgcgaagtgttggtgccggccatcaaacaggtcatcgaccggtcgtctgcgctcggcgttgactccattgtgtgagtctttcgggagggattttgaatgaacttttttaaatttgtaatttcaatacccttccagccttggcatgccgcatcgtggtcgtctgaatgtgctgtccaatgtgtgccgtcaaccattgagcaccattttggcccagttcagcactttggaaccaaaggacgagggctcgggcgatgtcaaataccatttgggcgtgtgcattgaacggctgaatcgccaatcgcagcgcatgatcaaaattgcggtggttgcaaatccgtcacatttggagggttaggcattgaaaatttggattttcgacgaaaatttataaattgtttagctgttgacccggttgttcagggcaaagtccgtgctgaggcattttacagcaacgatttgcactgtgaccgtcacatggtgagtttgatcagcggcaattgtcatttaatgtgtgaaatttccccaaaaatgaatttttgttacccatttcccctccccaaaaaggcattggtgctgcacggggatgcctccttctccggccagggcgtggtgatggagacgttcaacctcaacgacctgccccactactccatctatggcgccatccactttgtggtcaacaaccaaatcggcttcaccacggacccgcgcgcctcgcgctcttcgccttactgcacggatgtcggccgggccatgggcattccgatcttccatgtcaattcggacgacccggaggcggtgatgcatgtaagaaacattttctttaaattaaaaaaattttttgttgttattcatggtttcaccaatttttctcaaacaagaaaaaaaaattttcattgacaatgcgtttcttcgcaatttgtttttttaaaaacataatctttcgaatgcgatttggaacctcaaaaaattcaacaggtgtgcgatgttgcggcccagtggcgcaaggagttcaagaaggacgtgatcattgacttggtgtgctaccgtcgttacgggcacaacgaattggacgagccgatgttcacgcagccgttgatgtaccagcgcattcgacagacaaagccgttgttggaccagtatcagaagaagattttggcggaaggcatcgctgaccaggtttgcgttttgattggaattttaattccattggaaaaatttatcgacactgaattttttttttcggagtaggttgctcaaaccctaacccgaaattctgggacagaattctctgagtggagtgttgccttttccatatttttttttctaaaaattcttattgacccaggaatatgtggacgaagaattgaagaagtacggcgccattctggagaatgcgcacgagagtgccaagcaggtgaccgagctgcgcaaccggaactggctggactcgcc

SEQ ID NO: 52956 - DNA, 918 bp, Heterodera glycines
  Genomic contig location: Contig_ID=SeqID_22281; Location=63..980; Strand=+
  SCN-specific regions: Sequence locations=1-6,28-260,285-333,403 -855,883-918
  Gene Ontology: Mol. function=structural constituent of cuticle; Cellular component=extracellular; Biological process=cuticle biosynthesis (sensu Nematoda)
atgttcgaggtgggggacaagcagcgtcgcattgccacagcgtttgaagcggtgcgcaaccggacaggcggcgccgacgcatcctttgcctccatgccattcccgtcgctgatcgcccacctgcagaaccgacgtgccaagcgccagaccgaggcttgcgagtcgtgctgcattccgggccatcccggccgcgctggcacgccagggccgccgggacagcccggaacgccgggcgcgcccggcagacccggcgcgccaggtaatttaaaaagaaaaattttaaggaattttaggcttacaatgaatttattggtctctgagctccgagttttcaattttaaaatttattttttgataaattcaataaaaaatagataatttaaaaaatagaaaaaaaaatttggacactacggaaaaaataaatagaaattcttagtccaaaaattggccataacaagaattttttttattgtaaattttcatcaattattcaaataattttcgaaaattttttgtgtgtgcctattttttcaaaaattatttttgcgtcttgaatagaataaaaaaaacaaaatctgctatatgaaattaaaattacgtaaaattaaaaaattgtaacaaaaaatgatttttaaaaagatggcgcaaaaaatttccaggacgaccgccaatgatctgtgaggagattgaaattccgccatgcaacccgtgcccgcctggcccacccggcaggcaaggcccaaccggacagcccggcacacctggcagatccggacctcctggccgacctggcaccaacggtgagtggagttaaaaaagtagtttttgttttttaattttacaattttaggcttgcccggacccccgggccctcctggaccgcccggcacgcctggacctactggacccgatggagag

SEQ ID NO: 52957 - DNA, 207 bp, Heterodera glycines
  Genomic contig location: Contig_ID=SeqID_22281; Location=43..249; Strand=-
  SCN-specific regions: Sequence locations=1-160,182-207
cgggatggcccggaatgcagcacgactcgcaagcctcggtctggcgcttggcacgtcggttctgcaggtgggcgatcagcgacgggaatggcatggaggcaaaggatgcgtcggcgccgcctgtccggttgcgcaccgcttcaaacgctgtggcaatgcgacgctgcttgtcccccacctcgaacatgatgtccctagccgaactct

SEQ ID NO: 52958 - DNA, 819 bp, Heterodera glycines
  Genomic contig location: Contig_ID=SeqID_22282; Location=201..1019; Strand=+
  SCN-specific regions: Sequence locations=1-819
atgccgtccactctcagggacaccaacttcttggagccgggtctgttcctctaccgcatttcgggctcccatccgttggacccgcgccagggccaaaagggcgccggcggaagtctaacgggggaagaggaaagcgactacgaatatcagcaggagcagcaggattacgagccgggggaccaaatctgtgagttgatttgacccgttggttcccaatgttcgcgagtgattcagcggaatgtccgcccgaccctttccgcgactcgtgcccacccaactgcaacgtggtgttggacgacaatcattgctccctttgcatttgttcaagtacgtcttcgagacgtcgcgcacccattgccattttcaggtgttatttcggagaatttggccgggtcggcctacgaaaagcactcaaatggtttgcacttaggcaatgttttgccaatgcttcaaaagttttttcagacatttctcccgaccgttcgcttcgtccgttgcccatggccactctctccgcctctcagcgcacttccgacttgagctgtacgcctcggcagggtcggctccaatgccatcccaggtgaccatcactttcggcacttttccaatcctcgcaaattcaattctcttttgttcgcagtgccaattgcatccagcagaacaacggctactgttgccaatgtgacaatggcttcatcggcaacggcgtcgagtgtttggcgaaggacggaccgttgcgaatcaatggaatgtttgaagcggcactgaacggaaagcaaatgcaacggacggaccttttcggtcggagatacccactga

SEQ ID NO: 52959 - DNA, 1171 bp, Heterodera glycines
  Genomic contig location: Contig_ID=SeqID_22284; Location=161..1331; Strand=-
  SCN-specific regions: Sequence locations=1-203,230-531,554-666,694 -775,804-940,962-1063,1086-1147,1169-1171
atgagttggatacccatcagccccaagtggaagttgtgcgctccaaaggcatggagttggccgagtccagcgaaaaagccgtgcggagattgtgcggagtatcaagcgttggatcaaagctggacaaattttcttcagttcatcataaatgcgacgtggcggagagttggatcggtgacaaggaacagaacaccttcccttgaaatccccccggggctttatttttcaactcacctcaaaaggagggctttatttcagagggggctgtattatagtaaatatgatatttaatttgatcattccaaacagccgatggttattcacatttaccaagtaaaattaatgaatttgaataccctccaatcagaaaatattcctcatcgaaaaagttaattttttttgattattttaattcttgatcatcatcgtctttaattctcatcttttttttggtggatggtgtcgccgggggccgaaccacggcaagcgctttcctcaattttgtgggtcacctgccgatggatgaaattataattaattaattgattgattgcgtctatgcgtcagtcgagcgcataattaaagccaattgagagagctactgtaaaaaaattcagagaatatacctttatgaattgaacgccaaaattcattttttttcttgataaaaaattttaggtttaaaaatttccttattgaaagacattataaaattgaattatcaataaatcagcaaaatttagttttttggttagtttttacgtgttttgctccctaaaaatcattaataaaaaaatttaaatgccttttttcatgcctttttcgggatttttgtgccttttttcagtgctattttgcgctttttggtgccgtaattgcgagctcaagccataactttagggccggcggtgctgataagagccgccgggaaatttttttgtaattttaatgctatttgttagtagattttgtctaaaaataccaaaatttgagattttggctaattttttaagaaaagatagctttttggggggtcggcggtgccgataggcgccgccggaggaaaattttaaagaatttttaatgaattttgttacgaaaatggccaactgatttgtcaaaaaagtcggtcgattaattctgaggaaaattattttaaataccaaataaa

SEQ ID NO: 52960 - DNA, 64 bp, Heterodera glycines
  Genomic contig location: Contig_ID=SeqID_22284; Location=818..881; Strand=+
  SCN-specific regions: Sequence locations=1-64
aggtgacccacaaaattgaggaaagcgcttgccgtggttcggcccccggcgacaccatccacca

SEQ ID NO: 52961 - DNA, 87 bp, Heterodera glycines
  Genomic contig location: Contig_ID=SeqID_22286; Location=588..674; Strand=+
  SCN-specific regions: Sequence locations=1-87
atggttgaaatacatcctttctgtaacattggtgtactgcgaaagaccgatgataaatcattaatgaatggacagttggcgttaaag

SEQ ID NO: 52962 - DNA, 206 bp, Heterodera glycines
  Genomic contig location: Contig_ID=SeqID_22288; Location=227..432; Strand=-
  SCN-specific regions: Sequence locations=1-146,170-206
gtgttcatgtgattcaagaggagcaggcgaccgcaaatttaatgtgttggagtctcatcctcgagggggcaaggttggcattgttcattaatttaggacaattaattgcaaatttttacattcatttcaggaatactttgtacgacagtgaaatttttcagttgcaattcagatttgacgaccaatacccattctcatcgccagaa

SEQ ID NO: 52963 - DNA, 386 bp, Heterodera glycines
  Genomic contig location: Contig_ID=SeqID_4051; Location=665..1050; Strand=+
  SCN-specific regions: Sequence locations=1-92,115-386
atgacaaacatccgagagaagtaagtcgagaccgagatttgggaaaaactgaatattaccaaaaaagagtttgaactattttttatggttacctaatttaaattagaaaaatgtttagttgttccttcataacccctaaaattctccttaacctgattagtctattaacaattctaattgctgtttttttaccccacgagctgcgccgaactcgcccaacacgccgttccccatcagattgatgttcaaataatttgccatcattggtgtgacttggaaggtcgccaccctcgacgagaattgcaaaaaatggaaggaaagtggcaaaaatgatgaaaataattgagagaataaggacaaaccgattgtggtccattttagcgaaa

SEQ ID NO: 52964 - DNA, 729 bp, Heterodera glycines
  Genomic contig location: Contig_ID=SeqID_22290; Location=1274..2002; Strand=+
  SCN-specific regions: Sequence locations=1-213,312-379,413-419,442 -622,651-729
atgtttgttggccacgtattaagcgtttttcgaattccattctcattcattttcatatgcattttgacccctgtttttgagcacaggttcactgtgttcatggtgatcagtatgttcgttccacaagttccgctcaatttggtgatcagtaagtgcaaaaatcaatcatttaaaaatttatctaatccaattgcatacgccaccaaaaacaacatattttcaattataaaatctattatttttttaaatgattatagataagttttcaaaaaattattttctgttttataaaataattattttatttttttgccttatttttttgctgatattttaatttttattagtaactttgagatgattaatgcaaaataattcgttaatttaattttcaatattttaattaattattcccccttttaattgcatttgttttgaagagcacaatgaccaatttttgccaattgcgccagaaaatttggcgtgccgcgaggcgaccaatggcagcggtttcaattgcgagctgagcgtcaaccaaatggtggtggacgacgactgtagggacgtgtccatttgggcacggatggacaacgacacgagcacactccaactgttgggcgaacaggtgaagaagaagaagaagttgaagcagttcagggaaaattggataagggtaacactggagaattgaatgatcaaaaattcttggaaaattggcacggattttca

SEQ ID NO: 52965 - DNA, 138 bp, Heterodera glycines; identical to SEQ ID NO: 50950
  Genomic contig location: Contig_ID=SeqID_22292; Location=1713..1850; Strand=+
  SCN-specific regions: Sequence locations=1-138

SEQ ID NO: 52966 - DNA, 1862 bp, Heterodera glycines
  Genomic contig location: Contig_ID=SeqID_22293; Location=80..1941; Strand=-
  SCN-specific regions: Sequence locations=1-136,194-460,483-726,759 -897,921-938,1112-1127,1292-1294,1352-1367,1532-1560,1584-1766,1788 -1836,1858-1862
  Gene Ontology: Biological process=axon guidance
atgaatgacaatgttttgagtttattggcattcgcattggtcgtatttttgttccgtcaaaagtcaaattccgtacttgcgtttgatttggaagaacatggtaaatcgaaattatctttttttgttctcttttatcaaataattttaaaaaagttaattattttatattttttaataaattttttattattttggcaataaaatgaatccaaattaatattttatacttaaatgcaaaattgtgaaaacgattagtcatttaggccctgcttctgctccgtccgcaatttccccaccgatcccttcgcctcccactgaaatttcccaattttttgccccattcggtcggtcttttttattcttttatcgaaatgattttaatgcttttccatttgagaaaatcgtcgaattgtcacgcggttccaagctcgcaaattcatcagtttgctgcttcggcatatttctccaacattttccttttataatttaataccgcccgattcggttaagtcaattaattggcaatttaaagtaatttaatccaaaaacccattttaaaggcattgattcaattggccaaggacagcggaggaataattgtggggcctttcttaagagaaatgcattcaataaaaggccaaattggagaagcgctaattgcttttctgacaaaaatgtcagcaagaagcacaaaactattcgcggaaaatgaagggacaaaggtaagaaaaaagagagaaacaattaaaattaattgaatattcaaagtttaggaggaaaggaattcggcacgcaatttaatcaaagttggcattattttttcgatggcaaaaataattggtgagaagctgcatgactatgaaatcaattgggcaaaagaaatattagaaactcagcaaaaaaggggaaaaatgaggggagaaaattatcagaataaagaggaggatcaaaaagaggaggaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacattgaaaaagaaaaagaggaggagaaagaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacattgaaaaagaaaaagaggaggagaaagaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacacgcaaaacgagcacgaggaacagagagagcaacaccagcagcagcagcaagttgggcatggtcatggacaggccgcagaatcagttgagacacggcatggccaattcgaaatgagtgccgaggaaagggaatgtctcagctttttcggtatgacttttgactttttgactctttaacgaataacggttcatcttttttttttgatcaaattgtcttcaatgcttctgctgatgaggaaggggaaagtgatgatgatcattatcattatcagctgcgcaatgcgccttcgacttctcatagcgtaactttttcattttattcaaattaaa

SEQ ID NO: 52967 - DNA, 964 bp, Heterodera glycines
  Genomic contig location: Contig_ID=SeqID_22295; Location=136..1099; Strand=-
  SCN-specific regions: Sequence locations=1-128,150-363,385-459,498-964
atgggccaacacaccgatggagtgaggtgcatggagttttgtgccactatgcgtgttgcagtttcgggtggatgggacaatctaatgaaggtcctttacaccccttcaccccaatatctctaatttattttaacagttgtgggacattcgcgctttgatgccagtcggtgccatggaatgtggagacaaagtgtatgcactggacgttgtagacaacagagctgttgttggaacaaaagatcggcgagtgattgtttgggatgttcggaatatgaaagccccattgcagacaagagaatcgccactgaaagtttgaaaagcaaaattacagttttctgattcaggcatttagttccaaacccgttctatcaaatgtttcccctctggcgaagcgtttgttttgtcttcaattgaaggccgcgtggctgttgaatacttcgaccaggacccggaagtacagaaaggaaaggtaaattctttttgttttgttttgtgatgacaacttctcacaacagtatgcattcaaatgccatcgcgtgaaggaggaattcggagagcttatttacccggtcaacgctgttgccttccacccggtccaccgaactttcgccacgggagggagcgattacatcgttaacatgtgggacccgttcaaccggaagcgcttatgccaatttaggaagtattagcgcttttttttgcttcactaaattacctcttttcaaggttcccaagctctgttgtaagcctctcattctctcctgatggtggaatgctcgcaattgcttctacttatatgtacgaggaggaacgcgatccgaatcccatccccgagagttcattaacgattcgccgtatgacagagctagaagtccgtccaaagtaaaatttgtttttttctcatcttgttatctcattccgaacaaagctcaggttcaatattatttttatatttgcaaataaa

SEQ ID NO: 52968 - DNA, 1655 bp, Heterodera glycines
  Genomic contig location: Contig_ID=SeqID_22296; Location=445..2099; Strand=+
  SCN-specific regions: Sequence locations=1-141,164-430,452-611,703 -1432,1454-1459,1496-1655
atggagaaaattgcggccagccgcaacccgcagttggccgcttcgctctccacacagccgtcaaattcagttagtgtgtgtgtgtgccgtatgtgccaccatcttttgaaaaatttgtttcggaaatattggactgcaactcttttttgtacaaaaattgttttaacttatcaatgagctgggcaatgtcttggtgtgcgaggcatttctctagtaggcaaatgcaagttttacccgtctattggagacattacttttgcatcaaaacggaaaatgccatatttttgtgtgttttagaaggactcgttgtcccacctgagctcgatgaccagcgccagtcttcgccttgactttggcgacacgcccaagtcgatcagcagcattagtcaacacgggaccatcaccaaggcatcaaaaaatactaaacgaatcaattatacattttaattgcacagccaaagcttgggttgtctggcacgacgcgcaagcgacgaagtgacgcgtcaaccgcggctggcggcacgacgcctcggtccacggcgccgtcggccaaaaagccacggacagcgaccaggcgaaagcggtcaaaacgcgggaggagggcagccagtgatgaggacgatgatgatgaggaggaaatagaagtagaggaggaggaagaggcggaaaaagaggacgacgttcagcaacagggggagcagggtgaccaaagtttgcgcatggaagtggacggtgaagggtcgacgagcggacgtggccgaaagcgcggcacaacgcccaaggcgccggcagatgcgggcgttccaaagacgccggaacgcggcagtttgaggcgtactgctgggtagggaatggggcatcgacaccattttcataggggttgacaaactggacataatataaatattcgcagccaatttacccgtttttgctagctgtatcgtacattgaggaatttaatttcattttaagacatacaaacccaaatttagtattcatttatttgctagagttatggataacaaatttccaggcttgactcgtcccggaaatcggagcagaaacagaaggaggagttgttgtaccaagtgccggaactgtcacctgccgaacagttgggcgtggactgtcctcgggacgcgcatttgttcatgggcgtcggtgcgcgcgtgcttgccctttggggcaacgattattactcggcgaacatttgcgggtttgaaacttttttttattacctattaatggtattttaatggccattcgaatgataaaagcggtgtcatggaaatgttttttccgccaaccgacctttacaaaatttacttccatatttcagtcgtgaagcattgggccgttactatgtgcacttcgtggaggacaatctgaaccgtatgctgccacccactggcgttattcctatctctgcgttgaagccgggaacaaaggtacatcgactaatttcaaattaaacaattttattttattcgttttagatttcatttattgacattgtgaatgacgaagagattggcaaagtttgtgaggttgttgagcagccaccaacagacgacgctggtggatgggcacggggagagttcaaactgtgcgagttggacgaggaagggaaccgaaccgacgttatcaaaacgtaa

SEQ ID NO: 52969 - DNA, 181 bp, Heterodera glycines
  Genomic contig location: Contig_ID=SeqID_22297; Location=761..941; Strand=-
  SCN-specific regions: Sequence locations=1-3,27-181
aagcaattaaaaaattttttaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaa

SEQ ID NO: 52970 - DNA, 441 bp, Heterodera glycines
  Genomic contig location: Contig_ID=SeqID_22298; Location=654..1094; Strand=-
  SCN-specific regions: Sequence locations=1-95,131-169,191-217,239-441
atgcgtcaggacatttgtgctctccaaacgaaagtgggtacggttgagcacaatttgaagcgagctctcgcaaagctgcaaactgaagtttcagcgattaaggtttttgtttctttaaacttatgttttagttttttttagacgcaagtgggtacgattgaagtggactttaaagccaaaatggacgcaatgaacgtaattatacactttaatattttgcatgtaaattaaatgtattctttccaggaaaaaattgcagttctcgacaatactatgaagctggcgtccgtcaagattcaggatgttgtgaagaaatgagggttcgaacaaagattttattgcttgttttctttattcacttgctctgtttcgctataattttgacagttacagagtaagtggtcaccgcccttctgaaacttatttttcttgcttaataaa

SEQ ID NO: 52971 - DNA, 1192 bp, Heterodera glycines
  Genomic contig location: Contig_ID=SeqID_22299; Location=1..1192; Strand=-
  SCN-specific regions: Sequence locations=1-91,140-275,298-1192
  Gene Ontology: Mol. function=mannose-1-phosphate guanylyltransferase activity; Cellular component=cytoplasm; Biological process=protein modification
tacatttaaacccgtcggtgctgcagctaatcccgcgtcagccatgctcaattgagaaagaggtgagcggcggtcatccttaagaatttggaaataagtattttaaaaatttttagattttcccaaaaatgtgttctgtgagtaatttgtacgcctttatattggtcggtttttggatggacgttggacagccgaaggattttcttaggggtacttaatttcaatcattttttgcaataatttttcgtacattttttggtgttcgtctttatcttgcccatcaacagcagcaaaaagttgtgaaaagtgctcttgaaaatggcgttaattcgtcgtcaacgacaatcggcgaaggctgcacaattaatcaacccgtaactgcataaatgaagctcaaatgccatagaaattgcaatcaaatttgctttcattcaaaatcccaactattaattttaggtcctaaaaaagccaaaaataggcattaaaaatgtaaaataggaactaaaaagcctcaaatctaggggtaactcgaaaaatagctttacagccaccaaaaaaaaacttgctttcttgaattttggccgctgggagctcaggaaaaaatggggaaaaatccaaaaatatatccctttatctttggcatttgaataatttataaaaccaaatccgtttatcttccctcatgcctctccctccaaaaggtgatgattgacccgtcggcatcgatcggtgccaactgcatcatcgggcccaacgtgtgcatcggtgccgcggttcggctcctcgacggggtgtgcattcgcgactctaccattctgtccggcacagtcattcgacgcagcacactcatccattccagcattgtggggcgcaaatgcgtaattggtacgtgaaattccattaattttggtggaggagggatatccgaatggttttctttgatccgttaaacggatttttttgtgattttgccatgagttttggaatttattctttgaaatctttttcaatgatttttttcactggttcactttttggcacttttctcgacctgttcaggcagtcacgtgcacatggtgaacaccagcgtgttgggcgaagacgtggtcatcaaggacgagctgtacctgagtggtgcccgtgtgttgccccacgaaatccattggcgaaagtgtgcccgaaccggccatca

SEQ ID NO: 52972 - DNA, 728 bp, Heterodera glycines
  Genomic contig location: Contig_ID=SeqID_4052; Location=478..1205; Strand=+
  SCN-specific regions: Sequence locations=1-81,442-525,547-577,609-728
  Gene Ontology: Mol. function=DNA binding; Cellular component=nucleus; Biological process=sex differentiation
atggctgtcctcaaaaaagtggtcaacgaccctttttacgacaaagcccgcgcattttggcgcagttggaaccgacgacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacaacacccgcaacatcaacagcaacgtcaagaacagtgacaacgccgacaacaactacgacaaagccaaggaacaaaaaggcagagttgcctaaggcaaatggtgctatgcaatggcctcaacttttattgtgcggagcccttctgccatttttggcatttgtttggcggcaccaaaggggtttgtttaagtttataggaaatttggtcaaaaaatttttgaatcctcctcaatcaaaaaagggaaattttgtgaatttcaatcaaaacatttttcgtttatttcaagatttgagtttttgagaacttatagaaagtatttcatgcttcctagggattttttcaaaaaaa

SEQ ID NO: 52973 - DNA, 2081 bp, Heterodera glycines
  Genomic contig location: Contig_ID=SeqID_4052; Location=1504..3584; Strand=+
  SCN-specific regions: Sequence locations=1-449,511-831,859-983,1027 -2081
atggcacaacagcggaagccaactcttgaaccaatggcacccactgggacggcacatcactcgccgattggcacaactttgttggaccaaccggcaacatgggcgctgatgtcgggaacaatccgtccacaatgccacccactggggcgccacttcactcgagcagcagccgattggagattggtgaaagggccgaccgaaagaagaaccaaaagcgccgtgtctttttgtgagtttggccgacaaatttcaaccgaaggactaattaggaaaattcgttttgaaattgccgacgcattgggaagaagtattattaattaatctaatcaatcattgtttgggaatttaactggcaatttgaaaaaggaaccgaatggacgcgctaaaaaaagtggtcaaggaccctttttatgatgatgtgcgcgccttttgactcaattggaggccgtcaacaacataagcaacaacatacaacaacgacaacaagaacaacgacaaagacaacagcaaacaagcaaacttgccgaaggcacatgcagctttgccattgcctcaactttgttgtccgccacccttctgccatttttggcatttgtttggaagcaccagaggggtttgtttaagtttatagataatttggacaaaaagttttttgaatcctcttcaatcaaaaaatggtcttgcgtttgttatttgttgtaatgatccctttctctttgctctccgttcaattgttcgtcattatcgttgcttctgtgctcacactcgtcacccaatgctgtgcttgttgtaagaaaaaggtgaataaatgattcattcattatttatcaaatgaattaatttaatttgttttttattgacagaaaaagccaccgacaacaaacttcgttgatcgtaagtctgtttactcaagtgttttgtgtctccgaacagctccaaaacccttacattttcagcagccgattcgcgctattcgacgcttgccaccgatataaacaaggaaattttcgttcaaaaaaggccatcgcagcaacagcggtcacaaactgtaccctatggaccttttgtatgttggagtgttttgtttgctttttttaaatggcactaattgcgttttttggtttcagcaagtgcgacgcccgtaaagccggcacttttggacgagtacaaattcttgccgacattgcgcgtagacccgcccgcttttccagcgcaggccgcaccgccaacttctgtattggcctcaccgaccatctcggcaaaaccgaccactccagcagcatcggcaccgacaacttcggctaaaatgatcacttcaacaaaaccgaccacttcagcaccatcggactcaccgagcacctcaggaaaatcatccacttcagcagcaccgaaggacatggcttcgtcgatgagtgcgccaatcattgcagaggcgacgggtaaagattttttttggaaaatgttgccaggttccagttctaaaactcatggtttcatcaaatttttgattaggttttccaaaggggaatctgccgagaatttagcgcttgtttcattttcattcaaagtctaatgattcaatttgcggtgttttgtgtcatacacaattgcttttccaacatgacattcattaaagtttttcaacagccgactcgggatactcacaaatggatcaatttggtcaggacatgtccattcgagtgctaacgccggaggaggcgaagaaccgaagtgagagagtgcggaaaagcattgcattgattctgatcactcatttcagcgccagagacgggccaatccatcttgatttttgtgctggtcagcagcagcagtaagaagggggacaagcgccgctgagatcgtcgacggtcagtcaaacaaacgaataaatatgtttttcattggataattatcatttttcagcactcgatcggattatttgtgtgatgctgttggccaattggaccgttaatttaccctttgaaagcgttcgctgtgttcagatgaaatgtgacctttcgataacctttgtttatcatgtgattgctgtcttattattcccactgtttctgcccccttaa

SEQ ID NO: 52974 - DNA, 2833 bp, Heterodera glycines
  Genomic contig location: Contig_ID=SeqID_4053; Location=123..2955; Strand=+
  SCN-specific regions: Sequence locations=1-186,208-210,233-514,553 -783,807-1556,1578-1717,1744-2508,2546-2712,2734-2833
atgccggtgccatcaaaggcggctgctgacgaatgccgcccacctagcccagagaacatcccactcccgacccaattccgcagttttgtggtaaaaaaaaactgatttacccgattctttttactattgacattctaatccaatccgtactaatatttccattaaattaaagtaatttactgattgaaaaaagctttgtaattctgttccaaattttaattaatttttttttgcccactcatttccaagttattccttttcaatcataccgaccttcctcaaaccggacagaaaactggagagataagggcccggtcgggatttttgggatcctgtcccaagtgcttgatcccgaaaaattgaagtcgggatcccgctcctcgacattttctcgagatatcattttcttaagactttaattataattggcaaaatttatttttaattagctgaaattttaattttaggctatttaaagagaataaatattggattactctctgttggttagccattttttgacatttggatttttcaattctacagtaagaaatccctggccggggtcttattttagtttcaaagccacacatccctaaaccagcaaatcatttcatttctaaatctgaacctgcccttacatatcccttatcccaattttaaaggcgaatgacggaattagtgcgcacaacaatggtttagtctgatgatgttcatcttttacctgctgatgttattaatattgttactaattaccattcgctgtgtgaaattttcattttcaaacaaattttatacacatttttatgcacgtaaagtatttatctttaattttaccagtatccaattgaattgaatgtttttcattgtacactttcttttattgtaatgccttttctcccccattgaattcacacgaattggcccttttctcatttcattattttgtcattcaaaaaaaggatttgtcaacagcagcagaggaagaacaccgaacaccccctttatctgctgctgatctctctcactttttgttattgttttgctctttctttcccactttttttttggtccgtcctttgtgcccaatgttttcgtttcgtttcgctttttctgtcatcccccccccgcgccctcccaaatccaacatttttccattttcaaaaggttttgagcattttgataaacactcgaaaaacattttaaacaaaacgatttaagcttctcatttgcgtcatcgccatccctttctaatgttccttttttatcataaaggttaataattagtcagaaattgcattgttgatggacaattccttaacaaggattgataggcggagatagggaagaatcttacaaattaataaagttaaataagattcacgatttaaaaaattttgatcctacaatagaataaacatggaaaaatacgaatactgacgatttgataaaaaaaaacccggacgaatatttttcacttataaatattataatacctgttttttttactttaatgggcttaggcttaacttccttcctcttttccttgagcactttcacaaatacacattttgttgaccaacaacttgttttcttaaccccccccccatttcaaacggagaaaacgtcgacatttatttatttgagaggaaagggacacataagtaaacattttcattttccaccggaggaatgaataattaaaatgccaatttagattcattttgcttttttgtttcttcctacatatattccatgtaatgtgtttctctactaaaaaaacaatgacaagttttctcgcaaaaacgaaggcaatgtttgccaattcttccgattgtttttctgcgtccgaaattggcgcgtttgaggcggagcattgctgtgcatgcggcacaacgcatctttgggccgacaaattttggaaggtcaatcatttttttctttttgactcaaatcaaatttaattgatgcctaattaaaggttgcatgttctgtggactctgaaaagttggcatttcgcggacaggcgacgacagccatcggcgccgcctattggcatccgatgttctttaaggaaactcgtgggtttttgaattttaaagaaatttttattactcaatcgcatctaaatgcatttcttgggatatggtaggggcggagtttgtcactcacaaatcagagcagcagttcagcaggagggttagggtcagcgtcgggttagccatcggtcggtgggtccgagtttagctctttttagtttaattttttgcctttgccctacagtttaaaccccgcctacatccaggaaagaaagtcataaaaaaagaaagcttagcagtataaaagttgccgccgggttggaacgcttttccttaaaattggctgagcctaattgccccctccctaccttttcaaatcagttgcaattaaccctaggattggtttttcgttaatttagtagggcttttgaggccttgggtgagaagagttcaaacaaatgtcattcccaccacatgtacaacgttttgtgtttgtttcaggtcgttcacgcagtgcggtccaagcacatttaaaatgtgcctcttgcgggaaggaagtaaacaaagtttacgaagggacggacgacgccggcggggggtcgcgcagcgcttttggccattacaccgacacggaaaagcggacggagctcagcggtttgggtggcgtcgcttatgcggacattgagcgggcatttgccgtcggcggcatgcggtcggggcacaggcggaatgccgaagatttggtccgttgtctccgtgattatgccaaagagaaggaagaggcggcactttga

SEQ ID NO: 52975 - DNA, 1967 bp, Heterodera glycines
  Genomic contig location: Contig_ID=SeqID_22300; Location=26..1992; Strand=+
  SCN-specific regions: Sequence locations=1-915,937-1489,1511 -1772,1802-1967
atgttcagtgatttcgatggcacggcggtatacggtaagcgtaacggcgggttcgggaatctgaggaaggtcagattcaaaacaaagattcacagtgaacaacaaaacattttagcagaggaggtgcggttctattgcactttatgagtccaatcgacttttatgagtccaatcaattgacaatacctggtttttatacaataactttgaacaaaccctatctttttggtatcattagaaagcagtctaaagaagctaaaatatataaaatttcagcgtttaggcaattgccataaaagatttgattaacttagtaattgttgattaggtattttcgtttataactttgtttaaatgttagaattctgttgttttctcgtattattacattcttcagacttgcgctttcgaatgaaaaaatatagggtttgttagaacattgaacaaagttattgtgtaaaaccaggtattgtcaattgattggactcaaagtgcaagagccgtgagcgcgggtcaatgccaactcttagacaggcaagtcgtacaatagaagcttaggccttgacctaaagcttaggcctaagtctgtgcacgagttgcctttttatgaaaaaattaaaaaacggcattcaaatgcaaaagtacggccatgaaaatttgtttaggaaaattctgcgactcacgagttgaatttggaagaattggcacaatgccaattcgtttctgtagcggtcgattaccgatctgaaaccaatcgatgtcagttccattttgcagttctggtaataatccatgaatttaaggacgtccagcattacttccactgtccttaaaaatctctctattgcattgttcgattggccatgcattttaaacgtcttacaattagaggtttaattaatgaaatttgaggataaaaaatactaaacaaataactcagtttttgattactattttcgatcattcaaatcccgttaaaatataattattacaataacaaaatcacatggaatcaatcgaaatgatggaaaaaacaacgaaacaatgtgtcacgaagggaaacattcagtcagccatggtcataattatggttgttttacgcataaatttgccacgcacaatgcaacactcatgacgaagcggaaactgccaactttcgcaggtgttccatgaacacttgcatggaaacgtcgtccgtgaacacgggggcaccgccctcctgaaattgtaatttcttcaaatgggctgaatattattcattcattcacctgagaatacgggttgttgtgtgtcaacgacggggttcactttggaaagcaaaaagcgagcctaaaaggaagattggatgaagatggatgcagctgtatccgcttctgaaaacctgtgagccttcatattccgtcacaatgtatcgaggcactggaaaacggtcttggatgatggccgtggcatcctgcacgggggcgtcgagcagctgcttgaacgaagcatattgggggtcattttggtaattggcttttcgccaagcagcaattgtcttaaaaaaggtattttactcattggaatcacttgcaaaagaagaaaggacctgtccatggtaaattaacacatggaagaaatcgtccattagcaaaatgcggtcaggcaaaatactcgacgagtccaaaaggacgggttcaggaggtccattgaaagaataggagaacagctgaggctgtatcatcgtcgtactttcaaaaacattttcacccatcaaaatatggctgaaaaagatatataaaatacattaataaaaataaaacacaaaccggtagtatacagtttcatcaggagaattgttaaacacttgcagaaattgggaacggcgcaaatgaaacataaattgggggaacagagaaaatttgtcggtaagtttcagtgaagcagggtcttctttgtggtaatctccaaatctttgtaccttaaca

SEQ ID NO: 52976 - DNA, 989 bp, Heterodera glycines
  misc_feature (44)..(44): n is a, c, g, or t
  misc_feature (73)..(73): n is a, c, g, or t
  Genomic contig location: Contig_ID=SeqID_22301; Location=20..1008; Strand=-
  SCN-specific regions: Sequence locations=1-989
atgttcgtttcgaacagtgtttttctgcctgtctcccgcttttnccattgtcgcgcgttgtccgctgtgaatntggtggttcatccgtttgttgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatggtgagtgaggacaacgtttatggaaaaggctctaatgcactttatgagtccaatcaattgacaatcctgggtttttatacaataactttgttcatgttcgaacaaaccctatctttttggtatcattcgaaagcacaaaataacgaagctaaaatatataaaatcgcagcgttcaggcaattaccaaaaaagatttgattaattaagtaattgctgattttcgtttgtaactttcttggaatgttagaattctcggtaatagtttagatggtatcacaccttttttgaaaaatttttcaaaattttcaaaagtcttaaaaacatgtttctaggggtttataggtacgctgagcacgaatctgacatccatttcgaccaattccgaaccccggacccgaattcgaacaaaaagtcgaaaattcatttttcatcaaaattcacattcatgcaactaaagcaatacaaatgcacgaaaagacgcataaagaaaataagacagactattcgcatgggtaaaactcagaaatatgcaaccaaagattgtaaaacatattttcgcaatcgccgaaacgttggcgccaaatgaattcagggatgcgatttttaggtaagaaaaatcccagaataggtacttaaataggtaaaaaaaatctcaaaataggtattaaataggtacaaaaattccaaaataggtaaataaa

SEQ ID NO: 52977 - DNA, 288 bp, Heterodera glycines
  misc_feature (44)..(44): n is a, c, g, or t
  misc_feature (73)..(73): n is a, c, g, or t
  Genomic contig location: Contig_ID=SeqID_22301; Location=721..1008; Strand=-
  SCN-specific regions: Sequence locations=1-288
atgttcgtttcgaacagtgtttttctgcctgtctcccgcttttnccattgtcgcgcgttgtccgctgtgaatntggtggttcatccgtttgttgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatg

SEQ ID NO: 52978 - DNA, 49 bp, Heterodera glycines; identical to SEQ ID NO: 51181
  Genomic contig location: Contig_ID=SeqID_22304; Location=639..687; Strand=-
  SCN-specific regions: Sequence locations=1-49

SEQ ID NO: 52979 - DNA, 204 bp, Heterodera glycines
  Genomic contig location: Contig_ID=SeqID_22304; Location=571..774; Strand=+
  SCN-specific regions: Sequence locations=1-204
tgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataatgtttgagtaccccaacggacacttgaaaaatcgatttttt

SEQ ID NO: 52980 - DNA, 119 bp, Heterodera glycines
  Genomic contig location: Contig_ID=SeqID_22305; Location=700..818; Strand=-
  SCN-specific regions: Sequence locations=1-119
atgcgcctgccggcaacggataagcagggtcacacaatcatttgcgccggggctggctacccatcgcctaccgcggcatgtccgtccggctatcggtgcacaatgttggcgcacatggg

SEQ ID NO: 52981 - DNA, 651 bp, Heterodera glycines
  Genomic contig location: Contig_ID=SeqID_22306; Location=1326..1976; Strand=-
  SCN-specific regions: Sequence locations=1-651
atggcacctgtgctggacctcgacccaatcactgccgcactcgcagagcaagaacgccaacgcacattggtgttcatcggcctcccagaaagcaatgccatccgcccatcggagcgtgttcaggatgacagggaagccaccacaaaaatcttggatcatctcgaagttgaggctggaccaaccgccatctttcgtgttggccggttcgactctcagcgaactacaccacgcccactcaaagtggtcatgccaacatccgcgcaccaacacattgcactcggaggatggaagcgcgagcgtgttcgactccgttctcagaaaaaccttgcccgcctgttcgtccgccctgcgctcaccaaagaacaactcaaggaggaatacgaagcgcgggtccgaaaacgtcaacaagacccagtcccagtggcaccaccgatgcaacccgcacagacaaaagacccgactcccgtcaacgaaaatgggccagaaccgaaggaagccagtcatggacgtgggccagaaccgaaggaggccagtgaagacacttcaaaaccatcgcaggttgacaaagcaatccaaaacgaaattgacagagctctcctccaaattcaatcacttcaaaatgaactcacccatcttgtcaaaagaaaatag

SEQ ID NO: 52982 - DNA, 597 bp, Heterodera glycines
  Genomic contig location: Contig_ID=SeqID_22308; Location=31..627; Strand=-
  SCN-specific regions: Sequence locations=1-87,110-269,295-473,511-597
atggcatcaattaataccagctcaaatgacccggtaaaaacaaaggatttaactattttaagttatttttggaaaaattaaaccaagatttatttaaataaataaaaatgttttcatttatttctagctttatttggcctaccgtttcgccggtccgtccgccgatttgattgtgccggccgttgcgctgtatttggttgttttggttggcattgtgttgaacggcacagttttggcagtcactgtcaaatccaggcaaatgccgtggcatttttaaatttaattttaaattttcccatttaaatttttcagttccctccgcggctccgccaattttctgatggcattgatttgtctttgtgaattggtccaccaaattgggcacactttttttgtggttgttgtcattttgggcacaaattttgtcagtttgctcactgctgacttaattatgacggtaaattctgaatttcaaattatttttattttgatttaatttttcaatttttagccaatgatttttgctttgaattgtggcttaatggcaatgttttgtgctgcttttgaccgactttttgctgttgtgtcgccatttaa

SEQ ID NO: 52983 - DNA, 371 bp, Heterodera glycines
  Genomic contig location: Contig_ID=SeqID_22310; Location=310..680; Strand=-
  SCN-specific regions: Sequence locations=1-70,93-141,163-371
atgggcggctgttgcgcatgcctaagggaaattctgttggaggacgaagcggccgacatcagaattaacggtttgtaaaagaaacagaaaagggagacattggctaaattaaattcaaagcatccgaaaacttttgaggcaccgaattgggggaataaaaaacgagaaaaggaaggaatgatggcacttttgcagtggttgaacccacaacagtcgccaaggaaagagacggcacttcgaacgtggcacatggcggacaaatgtacggcacacaattggacgtgccaaaaaccgattaaacgattcagaacaatttatttcgctttagataaaaattacagaatagagatgccaaatgcaaatgtaataaa

SEQ ID NO: 52984 - DNA, 324 bp, Heterodera glycines
  Genomic contig location: Contig_ID=SeqID_22311; Location=1370..1693; Strand=-
  SCN-specific regions: Sequence locations=1-203,225-324
atgtggagacgcgccaggaacaacacggtcggcgccctcggaacggggaaagctgagggaggtggcaaagaagcgcaacatgaagatgaaggtggcacaactgccaatcgtcaaacattttactgggctctagaacattttattcacatttttccccttttaaaatcatatgtcatagattcatattttccgatcagctttactattttcttttaatcatttataatgaaaatggtttaccctttataatggaattctgatttatttgaatagttggcatttttttgcttttttccttaacctttcttagtacattttaataaa

SEQ ID NO: 52985 - DNA, 2137 bp, Heterodera glycines
  Genomic contig location: Contig_ID=SeqID_445; Location=1138..3274; Strand=+
  SCN-specific regions: Sequence locations=1-1088,1122-1765,1787-2137
atgcccggacaaaatgccagcaacagttgccaaacccagcagaatttggctgccgaagtgtcctcttctgtgctggtgatgagcagagtgaagcgcgtgcaaaattttgcctccataaaaggggccgcccaattggtggaaaggtgaggcaattcacacaaaaaagggacggaaaatgcaaattaattaataaggaaagcgggaattttatgacaaattaaactgtacaaattgtttattggttgtgagacagagaaggactttccctcgaggattataatggaggagagaattgcccctaaacgatcccattattgattcagttttgccaaatggttggtcgaaatgctgcaccgatgcccggttgagttgcgcgacatgtgagtgttcgcggtttcaatgaatggcaaaataatttgtcgttaattttattcattttccaggcttttggtttgcaccgcttgtaacagagtgagaaatgcgcgcgtaacaaatgacttttaaattaattaattggtctagggaatgatcagagaaagggacaagcaaattatgacgcgtgccattgttggcgaattggtggcagcgctaaaattcaaatgcgaattggtcgagcccaaccacttggccatcgtacggctcgttctccaagactttggggaaccattggacagcgattggactgcaagtcaatgcggacaaacggtcgagacgacagaaggcaatgggctaaaagaggaaggacggagcacaaccgacggagcggaactgatcggcggaaccggcggcggcaacggaagcggcggtgatcagttcaacacgggcgcagcagaagcaattcgaccgcatgtgccggaactgctcgaattcatcgccgacttgcacgttttggccaagatgaaggtgaaatggatggcaagacaaaggaagaaacaaaatcgatttacagaagcaaacgctgagcagcagcgatcggatgggcggtgatctgaaggcgggacttgccgaactgatcgcactggaaatgagtcgcccgtcagtgcgcgactctcggacggtaagagaatttaagccgttctgcagatcaatcattttatttgtattttcattgttaaacttattccatcgttttatcagtatcactttatgttaattaccttaatgagctcctccatctgttcctttaggtgatgcgcttcattccatggctttactcgccgccttcgctttcccaggcgttgcccggcgcattcgccgaatcggtggccaatgtccgcgtgctgtcctggattttgttgggcacgttgcatgcccgtggcaatggcactgtcaacgcaatttgcagctccgtttcgggcccaaaccaatgtttgcccgtgccgatcgcttgttcgggtcagatggccgattacatccattttgtgttggccgggttcgcagatcagtcgaaagtccgccggaacttttgttcgctattggtcaatgttttgcttttctcagcaatccgtcgttcatatgtccgcccttttccatgcgtttcatttatgccaactttggacaatttactgtgaacagaccgccgccacttgtcgctcggaagagacccttcaaaggacgatgcaacaaattttggacttttgggcacgcgtcaccccggccattcttcagctgctgtcccactccaaagtggtcagttttctgcttctaattaccttcctgatcaatctttttaattccgctcattcgtttggttaatgcttttctccttttcatcctatttttggtcttattaatgcctgccttggtttcccataataatgccattttcactgcgttggtgccatggtgccattctctttttccatgcatttctctttttctatgccattctctttttccatgcattttcgcttaatatttctttctctatcgcttttttctcttttatgccaattcctcactctttcagctcgccgacatggtcaacctgcactttgtcaacactctccaggcccttcagcaggtcaattcggccgtcctctgccaactttaccccatgtgggagcccgtgctgaccgcgcaccacgcgcacatcccacgccaacttcggatgaagttggacgcagttgaagcgcag

SEQ ID NO: 52986 - DNA, 507 bp, Heterodera glycines
  Genomic contig location: Contig_ID=SeqID_446; Location=433..939; Strand=+
  SCN-specific regions: Sequence locations=1-507
atggacaattacaccggaaggccgtggttcaatggtggtttgacagtgccacggttcgcaccggaagaatggagtgtgcatcaacggacgttggatggaggagacagaaccaacaattacgcagaagcattccatagaaaacttcaacaggcatttgattgtacccatccaagtgtcttccacttcatcaacacaattcgatgtgagcaaaagtcaattgatgctgacatctcacgatgcgtcgctggtgaactccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgtttctcgaaattatgaaatgcgcccgtaatttttcaatgctttgttatttttttttgttgttaacacattggataaatatgttttgata

SEQ ID NO: 52987 - DNA, 1314 bp, Heterodera glycines
  Genomic contig location: Contig_ID=SeqID_448; Location=307..1620; Strand=-
  SCN-specific regions: Sequence locations=1-767,791-931,954-958,982 -1228,1254-1314
  Gene Ontology: Cellular component=extracellular space; Biological process=synaptic transmission
accacttcagaaactgttcaaaccaccacttctgcccctactcccgaccccaccacaattgtgcccgctccccgtcgctttttgtccccgattcgccagcatccgtcggttactcccgagccgaacattccgtccagctttgtgccccgtccggcagattattcagtcgaaattgagggaccattcgccggactatgcgacgacggcacttgcggaacgcacggcgaatgcgaagaagtgaatgggacgcacgtgatgtgcgagtgtcgagactattatgtgggacagcggtgcgaagaatgtgcgttttaattgcctttggcattttgccatcgtttaaattactccgagttattttttcagttcggcccattgaatacgccgcaaaattcgacgggagtgcttttgtggtaaagatcaatcaattgttgctttgccttcaattagtgccgtacaatggctccgcttgccttttcttcgtcaatttgcctttccctttttggcattttcctccccttaaggtgttctcctcggatgagtttccccatctgagcagtgagcaggaggaagtggtcgagttcaaagtgcggacgactgccacatacggactgatcatttggcaagggcaaccagccgaattcagcggagggcacagaagaggacgacgaatggacgggcgaggattacttgtccattggcctgttggacgggcatttgagcttctccttcgaattgggcggtggcgcggcgcaaattctcagcgaaagtccggtggacgacggcaaaacgcattcggtggagtgaaatggaaatttcatattgaattctaaaccatttatattgcttagataagggcaattcgtcggggtcgggacggatggctttttgttgacgatgtcgcgccaacgtcgggacgtaagccgagacgataatttaaatgccaaaatcagtttaaatagtttttaatacattttacaaattaaggaagcagcggcattttggcgatgcttaacgtcgaagggcatgtctttgtcggtcagtttttggcatttgcgcagaaaaattaccattggccatttaggcggagtgccggaccttcacgaaatgacctttggccttcatacgcaaaactttgttggctgtttggccgaattgaaactgaacggccaaaagatggacatgatggcaaatgccatcgatgggaggtttttcagattttcttttcaacaagaagaaaatgaaataaaaaggaatgttcgcccatgccggtcgtggcaacccaaccgaatgcgaaggcggagaaagtggatgaga

SEQ ID NO: 52988 - DNA, 614 bp, Heterodera glycines
  Genomic contig location: Contig_ID=SeqID_450; Location=247..860; Strand=-
  SCN-specific regions: Sequence locations=1-540,562-614
atggcacgcggaaaattcgcacttccgccatttcagcggcacaacggcgatggcagtgccatcggagagagcaatgcgtctggacgcgttgaatctggagcttcaagtgagttttgctagtgcaagcagcacttttggcagctgaacgcttcctctccttaccattaatcaatccactaattaccctattagcccaatcattcgctgaatttgtcatacatcacacagctgatccctatccctttcccatgccctctttaatctactgttttcccctttccctcagattcgtcctcagtctcccaatggcattattctttttgcttccgctgctgatcaaagacgggcgggagacgaacgaccgtttatgcacagcgtggagcttcaaaatggaattgtcatttataaattttcattgggcggagatcgatttggttggatgtcttgttattaaaacgttaaacaataattaagtaattgtagaaacaattaaaagccgagacaaagtgccattgaacgaaccgacaaccattcgcgtgcaaaatgatggacagggcaaaggtgggcaaattaagagacgagcgatgggagtggccatttgtttttggcactga

SEQ ID NO: 52989 - DNA, 2998 bp, Heterodera glycines
  Genomic contig location: Contig_ID=SeqID_450; Location=1845..4842; Strand=-
  SCN-specific regions: Sequence locations=1-550,573-631,660-697,722 -827,849-1023,1045-1106,1128-1440,1507-1986,2008-2203,2225-2351,2432 -2583,2626-2998
  Gene Ontology: Cellular component=extracellular space; Biological process=cell adhesion
tggttgaacgcgtcgagtggaagagggccggcggggacgcgttgccttcggatgccagcgacgaggaacaccgcggggtgctccgattcgacccgttcaaagtaaaactgtcgcgggaatgaataattgaagggtgatgttggttggttaattaggataattaattaattgggccaaccatttactatttctcaaaagtgatcgggtgcttttgttcagcctgctgatcacgcgggtgagtacgagtgcaacgcgtaccgtaacgaggaagtgatcgccaccagcaaagtggaagtgcaccccgagggcgacacgcggcccgaccttttgcacgtggacatttcaccgccgcaagtgcgcatggtgaacgcgggcgactcaattgtgttggactgtgtggtgcacggtcagtttgtagtgggaggaaaacagcgagcaatgattgggaaattacgaggcaattaaggggataattagcagtaataattttgcttattaaagtgattttggttttttaatgaaatgcatttttgttcaagtgcttacggacatttaataatggtttttcttttattggtgatggaaaatgaccggaagtcccaaatgtccgttttcctaaaaatgacaacgactttttgtccctccctttccctcccttcaaaaatgcttttcctcatttgctttatcccaccttggttttttgactttggcttttcctcccagtgcccctcggcactttcccttcccatcgtcgtcctttgatctccttcacttggctttggggtgatcttccgctccgtctttcgcccctccgctggtgccttattccgttgcttcatctccaaaatgttcgaccttcccaatccggcatttacaccgtccaggcgaaggtggagaacggcacagtgatgctcagccgtgccatttatcttatcgttttgcgacggggttaccttattttgatgcctttggcttttttctgttgcttcttttgttcgtttattttttgcttttgctctaacaaatggatggacagaattatgccaatgcttatccacaatccttttgtatccttttttgcgttttcccattttccttgtgcttttgaggggatttccatagtaatgggccctcacaaaatgccatttgcacgcgaatgccttaggccgttctgcggatgagttcacttattcctggtcactcgcgcgtggcggagcactgatccgtgagttgggcaggcaaagtcagctgctggtcaagtcggcggatccgagcaacgattacggcatttaccggtgcgaagtggagagcgaggacggcgagacggtcggacaggcacaggcggcagtttctgtcggatttgactcggaaaacagtcagtttaaagattgggagaaaaacggagagtcggaagaggcaaaagggcgagtaatataatgggagagagagagaaactagagagaggaagaaaaggagagagaaaagagagagagtgagatagacagaaatgagaaaagaaacaaaaaaatgcttcaagcaaatgtcctttgtctgtttttcgtgatttgctaacattttgtttcttcattattttaactatttgaaccatatcgtaacctaccgtacgtttagatgcagttgaagcaaagttcgacggtgattcgcaggcggtgctgaactgtcccgtctttgttgtgcccggctccaccgtcgattggcagcgcgagaatggcgagtcgttgccggagaattcgaaccaatcgggcgacaaactgctgtaaaaattcaaatttcgaatatctgttcaaattaatgattactttgccattgaagaatcgagaaattcgacgactcaaccgcgggcatttatcgctgcacagttcaccacggacagagcagtgtgtccggctttgtgaatgccaaaatatttggtcggtgccattagaatttgaataatttttaaatgctaattgggttcagtgcccgacacaattatcaaagtgttgctgaatgtttcctccgagtcggtccaagttggtgaccaggcgtggttggactgtgtggtcatcggagacccgagtgcacgtgtaaacttctccaaggacggggacgcgttgccagcgaatgcccaagtgggcgtttggccacaaatggcacggcactccactaattaattaccctacaggtcaccgccaatcgcctcctcttcacttccatttctgttgaacacacgggccgatatcggtgccaagcgcagacgaaagacggagtgttggagacgtcggcacttttgaacgtggaaggcggcgaagagacggaggcggaaaagcggcggcgcagcttccatcaacagaagcagcagcaaaagacggaacaggaggaggaggatggaacaccggcggaagaagaagcggaagaggaagagaaggggccgcagtacactttggcggaagggcaaagcgcggcggagagcgacgcggacactgtccaagcggtagagatcggacgacccgagccggaccatcctcaacggatgcgccgactgaggcggctgagacagcagagacgcagggcgacgagtcaccggaagagaacacagcacaaagaggaagaggaggagggcaaaaagaagcagcggaagcggaagaggacggaacacgcacagcacaagcggaagaagagcatcgcggaagtgcgcaaggaaaacttgcggaggagggcggaacggtcagtggacggacgaacgaggggactgtagtgtatactgtacgagactactgtatgcgcagttcaagcgaatggtcattaaaatcttacaattagcaaaaagcgagagtcccgaacagactaacgaacgaacctgtgatggacaaacaaacactggtttaggtaccgaaatggccgcactcagttccaaaagtattaccaccattacgaaatccgcaacgacgcaccgcctgcggcgctgcaccgtgccagactgttcgggtcttggttc

SEQ ID NO: 52990 - DNA, 2384 bp, Heterodera glycines
  misc_feature (2377)..(2377): n is a, c, g, or t
  Genomic contig location: Contig_ID=SeqID_451; Location=26..2409; Strand=-
  SCN-specific regions: Sequence locations=1-468,491-768,790-807,829 -2109,2131-2384
  Gene Ontology: Mol. function=transmembrane receptor protein tyrosine kinase activity; Cellular component=extracellular space; Biological process=signal transduction
atgccggcgattatatttgcacagcctatgacccgcacgacgacccgcgcgaagaacggacggtcgactcgacgccagtccgggtcagtaccgaacaattatctcagtgatttgtttttatatgatgttgctcctcagctcgatgtccgtcgtccttcaccaccaccacccgctcgtgctcgaaatccgccccaagttgagcctccctaccaacgcgttgacctcggtcagccggcgcgcttccgctgttgggtgccgggcgagccaaacgcccatttgagttgggcgccggcccgcggcgggtcgcttccatcgggcgcagtggacagaagcggacatttgttgttcgatgcggtggcacgtgaacatgccgactcatacatttgctcgtcgattgacccggagacgggacaggtccttcagtcgccgcctgttcgacttgacgtcaatgaacgtgggtcattagcataattaattaattaatcagttagataatcattacattgatttcaagcgtcaaagagaccattggttgagccgactgagcaaaccgtgcagcagggacacccatcgcgcattcactgttgggttccggatgagccacgcgcgactctacgctggaccgcccgcgggggaaggccgttgccttcgggtgccgtcgatgatgggagaggcaatctgaacattgcgcagacgctgccgcatcaccagggagattacgaatgtatttacgaaccacgagagccaagccgaggaccacaggtaagaaaagtggaagaaaagcgcaaagggaaggaaagaggggcggatgaagcattcattgccataataaggcatttacccaaaaaccatttgttatgcaaaaggtgtccgagcccgctcgaatatacgttagtccaccaccggtcggtccgctggcgcgaaaacctggcgagccgccccgccccgtggccacgcccccgcagcaaactgttccccgcggagaccctgcgcggtttcattgcgagccgaacagcaaaacacccgcgcaaatccattggggtgagtgagctgctgaagttgggcctaaaaagggcgcgattcattcggtggcttttttcaaaggctttgagtcgcccaacggagcattgcccagcggagtcagcgtggacggggaggacattctgattgcagcagcggacgaggccaccattggcgagtaccactgcacggcgaccaacaagttcggacggggacacgccgacccggtcaaattggacataacggacggtagggacggggacagcgcggagggtgggggtaatgaatgggttaatgatcgtaattaatacttactgatactggaaactgtgcacgaaattggggagagtaggagaacacacggcttccggaaaatcaccgacgcattttctgtcattcaattcactcccccccccctcccattcactaaatattttagtttatttgttaattaaaatattcagaggaagagccaccgacagcacgtgtcgagccgaaagtgtggaacggccaacccggcgaatcgaaacagttcaaatgttacgtgacgggcaacccacacccatcgattaaagtgagcaattaggagagcaaagtgagcgaaaagcggacaattaattcagtggagcggaccaaatggggacgaattaccggaggatgttgtcgacttgggggacggagtgttggagatcaaagacgccaagaaggaactgcacgacggagaatatgtaaaggggggggggatggcacaacatttaaaactggcaaatgggggaaggaaggaatctgatcagtctgttcctttgattaatcctctagccattccatccaattcttgattgccatccaatcaatgtagtcaacaatcctttgtcctcaattgccagacttgcactgccaccaatccgctgggcgaagcatcggacagcggcaaagtcgagatcggtccgtccattggtatcaacattatcaaggaggaaaaacccgcgcctgcccggctgaagatgattgtcggcgaaccgttggagatcaaatgcgaagcggagggtgagccggatccggacgtagaatggcttcagtgagttttttcttcacggtgggggagggaaatttgcaaatttggccgattatcgtcaaattaaagtgacccgggccccgaacgtggcgaccttcccgatgactacgtgccaatcaccatctccgagcagttcctgcgccatccgagcattggcctcggcaattccggctgttacacttgccgggccagcaatgacttcgcctccgtcactaagggaatttgcattgaaggtaccgatcgagttcagctaagttttcaaattactgtgataattgccanaaagtga

SEQ ID NO: 52991 - DNA, 1347 bp, Heterodera glycines
  Genomic contig location: Contig_ID=SeqID_4054; Location=97..1443; Strand=+
  SCN-specific regions: Sequence locations=1-739,761-829,866-1347
atgtcgataaatggttccgggttgagcgctttccaacggatttggcatgggtttctctcaaagaaaaaaaaagtttctcgcgccgaagtgatgagtttggctgaacagattgcttcggaagtgaacgacaatgagctttttgacgaaattacggcgctgaatgaaatacttgaaagtatttctgacgagaaatttggtgaaatgaacgcagaacagaagtggatgaaggttttcgaggcggaattacccaatcttgtgttgctcgtcagcaaaattctttcaatttcggtttccaatgcatgcgtggagcgcgtcttctctctttgttcagctcagtggactgatgtgcgcaatttattgaaagttgaaaccgtgaaaagtctggcccaaatcaaatcgaattatgatctcacttgcactgaaatatacgatttgctcatttcctcaccaaaattgttaaaaatgatcatgggaggtgaaaaatataatatttaatacatttttgatcgaataaattgtaaaaataacgatttgaagcaattttgcaaaatgtccttattttggacccaaaaatcttattttttggccttgatgttcttattttgaaaaattttcgatccgaaccctgccttaaacatctaaagaaatcaaaatttggcataaactcgcaaaaaatgttttgcattccgaaaattaccaattgaagacgccaatcgccaataagttgttgagggagttgaaatacagagcattttgaagtgagaaggcagtacgcaatcagaaaaacccagttaggttagcctaaaaagaaaaaatgaaacaaactcagatttataatatattcgtttttttaattaaaatttatcagcagggctgtaaattttatgcaaatgcatttttttttcctggattctacgtagtccaaatagtacgaaagacaccttctttttggtatttgcttataaaaatcgggacttttatttgcatatttttgcatatttctggttttttatgcatattttggctttatgcatattttgccattttttatacttattttcagattttttgcatatttgccattttttgtcaaatattttccaatttgaatatctcttaggaaaaatttttgattatgccctaaaattaaatccaaatttgaatggatgcgcgaatggatcaacagcagggcgcggatctgtcctgatttaatataagatttgtggcaatcggcactgccggacccctcccctcgcccgttcaccagaattttttggaaaatgcgccgaaaaaaattgctaaattcaataatggaggcgaaaaatataatatttaatacatttttga

SEQ ID NO: 52992 - DNA, 462 bp, Heterodera glycines
  Genomic contig location: Contig_ID=SeqID_4056; Location=1957..2418; Strand=-
  SCN-specific regions: Sequence locations=1-166,188-370,392-416,438-462
  Gene Ontology: Cellular component=integral to membrane; Biological process=vesicle-mediated transport
atggtggaagagttgagcaacaaagtgtcccaactgaagagggtgaccatcgcaattggggatgatgttcgtgggcagaatagactgatcgacgaaatggcaagtcttttctggtggcactcagttcaaaaaataatggaaatttttatgatttgattggctacacatttaattaaaaatagaatgatccaggaataaaaatacactaaatcggtcaaatttcgagcgaattcatattgaagatttgaaattcgcttttgtaggacaccaaattcgacagcacacgaggccttttgggttccacaatgaaaaagcttggcattgtgtctaaggccggaggttagtggaaatgtgtaaatttttgctagcctttttaaattttcatttttaaggtaagaatgtgctctgctatttggtcttgttctcctttttcgtcttcctcatcatctactttttgatgcg

SEQ ID NO: 52993 - DNA, 100 bp, Heterodera glycines; identical to SEQ ID NO: 51845
  Genomic contig location: Contig_ID=SeqID_22314; Location=262..361; Strand=+
  SCN-specific regions: Sequence locations=1-100

SEQ ID NO: 52994 - DNA, 84 bp, Heterodera glycines
  Genomic contig location: Contig_ID=SeqID_22315; Location=449..532; Strand=-
  SCN-specific regions: Sequence locations=1-84
ttaattaagtgctaatgagacggattaattgattggcaatgagctctgctgaaattgggttttcattttgacttccgtcgttcg

SEQ ID NO: 52995 - DNA, 1114 bp, Heterodera glycines
  misc_feature (998)..(998): n is a, c, g, or t
  misc_feature (1019)..(1019): n is a, c, g, or t
  misc_feature (1035)..(1035): n is a, c, g, or t
  Genomic contig location: Contig_ID=SeqID_22316; Location=169..1282; Strand=+
  SCN-specific regions: Sequence locations=1-213,235-570,608-657,722 -796,825-945,1095-1114
atggcgatcaatcccgatgattttggaaaaacgatcggaacggatcccgagtcagggtccagaccaaatcccgaccaaatcccgatgattttggaaaaacgatcggaacggatcccgagtcgggatcccgaccaaatggcgatcaatcatattattattttgaattttccattgaaaaaaattgttttgaaaaattagagaaaaaacaatttcttaaatatattaaattttttagaaaaagctaataatgtgaaaaatccgagatcgagactcgagaccgaaaaaacccaagacttttctcgagtcgagactcgatcgagactctcgagtagcactaaggggcgggggcataatgcacgcacacccatccaatataatttttgttgaaattctcaccaaaaatatgttccaatgttcgggccgaaagccgcgtgccgcgtactgcacgtgccgttcaccgatggcgagcagagacggcttcaaacactcctccatgtggtagagatttttggcagcataagcgattgtctgctgatgggaaggcggacacccaattaaaaggttaattggataaaatactaattaataattaatttatcatttaatagcaagtgaattttaatgtagggaaaagccaaaaaaatatacaaacaaatgttttaattaatttttaaattcatttatttatgagaaaaattgaaaagttttaaatttttattttcgaaatattctattttttcagctgatattccaaatggtttccttcttttttctttagcctaaacaaattttagttttaattaattaattaaattaattaattattgcctggacaaatttgagggcctgggagcgaaagtcggccgattggcgccactcgtcgccatgccgatgaattttggggaataattgctttgcttgaggattgtgctcaaaaatatactgaaaaattataatttatataaaaaatttaatatatttattaaataattttttanattaatttaatttcatattanattaaaaaagacgaanaatttaagtcaaatttttaaatttgataacattaaaaacaataatttgtttattttttaccaatttcaaaatttttaaa

SEQ ID NO: 52996 - DNA, 891 bp, Heterodera glycines
  Genomic contig location: Contig_ID=SeqID_22317; Location=1..891; Strand=+
  SCN-specific regions: Sequence locations=1-135,157-809,833-891
gctttttctttatataggaaaatccattaagtgttataagttgttgagggggttaaaaatgtgaaagagaaagtgaggaaatattgcccttttccccttttctatgttttctctgctgcaccactgtttcgcttctctttgatttctttgaattagaatttgcgggctccctgcgcgatggaacttcaaatttttcattaccggtaatcccaaaaaatcccgcaatttccaagagagggatagctgattagggtcaagcaaaatcccacgcgggattcccgcgccgtgctctattcaaaaggcaccgaaatccggcattgatcagcgtaattagtcagctggactaaatcagactaaaatattttattttaaagatgttttaagttttcggagaaggcgtcgtccattttattcggccatttcatcatcgattgttccggcttcaccttcgtcgactgtatgggcgtaaatgcactcaaagaaatacttattttgttcaattacaattacactaatggaccctaattattctaatgagtgtaattattagaaaagtcattaatagccgaaaaaataacaacagattttcaccgaaatgcgcgagcaaagagttcttgtgtattttgcagcggcaaaaggtgggcgttatttaaaacaaattgtcgaaacaaaatgccaaaataatttagcgcccgtgcgcgatctgttcgaaaagtgcggctttttccgctacgtgcaaaagcacaacttttacccgacaattcgcgacgcggtggcaatcgcgcggaagcggcgaaatgcgtaagcggaaaaataaataaataattaaaatgtgaaataatggtaaaggagggagagggaagcttaaaaataatgaaacattccactaat

SEQ ID NO: 52997 - DNA, 69 bp, Heterodera glycines
  Genomic contig location: Contig_ID=SeqID_22318; Location=960..1028; Strand=+
  SCN-specific regions: Sequence locations=1-38,60-69
atgacaagcgcactaccgatacaccaatggacaattcgaaaagaagcaaataattatttaatggccaaa

SEQ ID NO: 52998 - DNA, 114 bp, Heterodera glycines
  Genomic contig location: Contig_ID=SeqID_22319; Location=38..151; Strand=-
  SCN-specific regions: Sequence locations=1-114
atgttggacgaaacgatgaaagtggctgaactgatgtgcatcaaaacggcactgaacgaattcattgcttaccaacgattggctcaaatggtggccaacggcacacttaatggg

SEQ ID NO: 52999 - DNA, 1859 bp, Heterodera glycines
  Genomic contig location: Contig_ID=SeqID_22320; Location=333..2191; Strand=-
  SCN-specific regions: Sequence locations=1-99,198-270,317-358,533 -652,687-735,759-824,860-931,1173-1789,1811-1859
atgccagtgatcaaacatgatccagagcttaaatctgtggaccaaactgtggccaaattcaacacaaccgcaatacaaacagtgaacaattcaaaaatgtaaaaatttttcaaatttattaattatttttaatattaaaaattaaatcatttcattttttgactatgatcaattattaattaattaactttttaattgggcagagaacatggctcaaagcaatttgcgggagcgccaaaatttgataaaaattcccaggattatggaaggtaatatatattgtttaaattaaaaatatatattattctttttattagacctttaatcggcacaaaatcacaggcccgcggcgttagagtaatttatttttattaaaataaacaataaattttatattataataatttttcttttttttaaatgaacattatttgccagcaacttctattttaaaattgtttaaattagattaaaaaaatattttaattaaataaataaattaattaattttgtttaaaaaaaaacaaaaaatcatgaatttgaagggcggcgagcatgtgatgcgtgaagtgatgtttctatgcgaaatgattgaacaaaatggtgaaggcacaccgcccgattgctacatgaagtatggcattttgggaggaaattaaaatataaagtttaaatttaatttttaagatttggcccattgttttacatgtacagtcgcatttcagaaacagtaagatccaaaatataagtttgaagtttattcagttatatttatagttagttggcatgctgatcagagcaagaaaatacggattggcaagtactttaaatcattttttaattaaaaatatatataaatgcatagtgatcttttaataaaaaaattgatcaaatattcatcgtttaattttatataaaactaccattttcgaaataatattatttataattatttttaatataagaatttaatgaaactatttttttaattggaaaatataaaaatattttgatgtaaagattaatttatatattcatttttgccttttatatttcatgtagaactatcatttttgaaataataaattttataatattttaattaaaaccctaattaaaatttatatatttttttaaaatacaaaatatcttaattaaaaaataaaattttagattgattttgaaggagaaatgctgtatcaacgtcaggatgaccataaaaaaattcgtttactgatgtcatccgaagaaattaatcagtcaattgaatacacaggtgggcacagtaattaatgtaattaactgtcaaattaaaattatttcgaccctcaggcgacccagtgaatatcatcaaattcaacaacggcaaaatggtaccaccgccggcgccacgagctcaattaatgccaaatgcaccgcctcctcccgttttctcattaagccttgcaaaaacaaagggtggaaaattgccggaggggaaaactgacgatcaaataaatgagcaaacaatgcctatggcaaaaatggcagcatcaattagcaaacaagcaacagtgccacctgccgtgccaagaaagccagtggcgccaactgaggacaaaacagcgccgaaaacaatgccaaactcaacgccgaagacaatgccaaacagccaaaaaatgccaaaaagtgaaacaacgccaaaggaaatgccaaaaagtgaaacagcgccaaaggaaatgccaaaaagtgaaacagcgccaaaggaaatgccaaaaaatgaaacagcgccaaaggaaatgaacgaagcaataaaatcgaaaacaaataaaacaacgcctccggggacaaaaaaggggaataaatcggtggcacctcca

SEQ ID NO: 53000 - DNA, 687 bp, Heterodera glycines
  Genomic contig location: Contig_ID=SeqID_22321; Location=1100..1786; Strand=-
  SCN-specific regions: Sequence locations=1-192,219-431,455-565,599-687
  Gene Ontology: Mol. function=calcium-transporting ATPase activity; Cellular component=smooth endoplasmic reticulum; Biological process =transport
attgtcgaatatttgcaatcgcatggcgaaatcactgcgatgaccggcgacggagtgaacgatgcgccggcactgaaaaaggccgaaattggcattgctatgggcagtggcacggcggtggcaaaaagtgccgcggaaatggtgttggcggatgacaatttctcaacaattgtggcagcggtggaggaaggccgtgccatttacaacaacatgaaacaattgtatggatgggaggggaagaatttgaaattgggttcattataattacattaatgatgtttaaatgagttcttcgcttttcagcattcgctatctcatctcgtcaaacattggtgaagtcgtctccattttccttgtcgctgcgcttggtttgtcactttcattcgttgttttgtcgtgtcctgactgattgtgaacacgcttcaggcattcccgaagctctgatccccgtccaattgctttgggtcaatttggtcaccgatggtcttcccgccactgcgctcggcttcaatccgcccgacttggacattatggaccgactgccgcgttccgcctccgaatcgctcatttccaaatggcttttcttcagatacatggcaatcggaagtgaacaccacatttttgtccatgctgcattttccccctttttcagcttccgtcggcgtcgactacggctaccacttgtga

SEQ ID NO: 53001 - DNA, 880 bp, Heterodera glycines
  Genomic contig location: Contig_ID=SeqID_22323; Location=620..1499; Strand=-
  SCN-specific regions: Sequence locations=1-211,233-629,652-787,810-880
atgtcagcgccgttgcccataattatatttcatacaatttctgtggacattcgatccgcccctggaccaataattacacgcttaccatcgaaggctcttactgcccaaaacattagcacatttttacgaattttggccccaattgtgcataaaaagacacatgccgaccacatttatgacgaaaaagtgcgcaatactgtactaagatggcataatgatgaattgaaaaagtgtataaaaagaactgtcgaagaataaagcacgcaaagttatgccaaaaaaaacaaattaaaaattatgccattatgatatgccagcaaagtctcgacccaaaaagcctagttcaaacaaataaaaccaccactcaaactatccgaactctcaaggaggctagggctataactctttggggtgagaaaagtcaggcgggatcagttaaagtcgggtggatcaaatcaatctgggtcggattagggatttatgatttacctctcgatcccgactcaagctgcgttcaggggtcggggtgcatagcgcagggtcgatgaataacccgaaaaataatcttaattttcggggtcgggggcccgaacctactctcaagttagtgtttgatttcttacgtcaaacaatgatttttaaattttttattgggcccggtccataatgattgatgtttaattgaaattgtgtctggttcgatcgatatttggccagataatatgcagtataattcaaaaaaatcgggccttattaattataccaatttaggaaataatgagcaaatagaaattaatgatcacatcaatgcgttaattgcacaacgcgatatgcttcttagagatcagagaaagtttatcagagatgctcaaataataaa

SEQ ID NO: 53002 - DNA, 1224 bp, Heterodera glycines
  Genomic contig location: Contig_ID=SeqID_22324; Location=128..1351; Strand=-
  SCN-specific regions: Sequence locations=1-223,246-247,281-1044,1066 -1168,1193-1224
  Gene Ontology: Mol. function=microfilament motor activity; Cellular component=actin filament; Biological process=signal transduction
aggactgtacacgcgtctctttgacttccttggtaccgtaccctaccatagttgcttgtttgacaacactgtgtgtttttagtggcctctgtaaattgtgcactgaacgtggatgccaaccgcaattcgtttgacatttcgttggccgtgttggacatttacggcttcgaagtgttcgaacggaacggatttgaacagttttggtgcgaaagtgccgcttttctgtgcccattgcattcccttttcagcatcaatttcgttaatgaaaaactccagcaaattttcatcgaattgacgctgaaggcggaacaggaggagtaccaatcggagggactgaagtggactccgatcgaatttttcaacaataaaattgtctgcgaactgatcgaggcgaaacggccgcgtccgggtgagcagcgtcaatggcggtggtggggatgagttagtccaagggcggctaacgatgctcaagaccctcgtgaaattgttcagtcttgagcatggatgggagggactaatccccaacaaaacgcatcgattctaaggcataatgttcctcttggacgacacctctctccagctgcacgggcaaaacgaaggagcggacaaaaagtttctgagtgatctgaaaaaacaacacgaagaccacgagcatttccgttctggtgccgacagtttcgtcgtacgacactacgcgggcgaggcactctttttttgcattttcataggttgactggccattttttaggtggtctaccaaattgagggcttttgcgaccggaacatggacatattgcacgtcgacttggtccaactaatgcaaaacagtgagaagtgtgtggaaacaccaagaaaaaaaaaatagcaaatggtttcatcgcatattttcagtgagttcatgcgtcagttgttcgctgccgactgcgtgtcgaatgaaaacggcaacaacaaaaagccaactagtgcctccaccaaaatcagagtccgtcgtccgactcaatgattttttttcgaattcgaaccctaaattagaaatttacaaatccaaatttcatttcctcttccattcattcgtttgctgaattggcaaaacacattccgcacttcccattcacagagtcaggccaaccatctgatggactcgctgatgcgctgtgtgccgcattacgtccgctgcataaaacccaacgaacggaagagagcgttggaattcaacgagcaaag

SEQ ID NO: 53003 - DNA, 1321 bp, Heterodera glycines
  Genomic contig location: Contig_ID=SeqID_4057; Location=351..1671; Strand=-
  SCN-specific regions: Sequence locations=1-108,130-710,886-1321
atgtgcgatgagtgtcgtggcgaaaatttccggcagggaaagagcagtttcaaactcatcaatcagaatggcgagcaacagcagcgacttgtgttcgcccaatcgttttgccaagactgtgcaaagctgaactttgactgcaccgatctgatcatgaagcacaaaaagaaggatgagtcggcaacgacaacgatggcaaagagtttccgatggaccaaggatgaagaaaatgaaccgagttggcacaccacatataaggacttttttgaaaattttatacttgttgatcaaatgacaaactttttctttgtaattctgccgagcaatacgccaggctttgttggaaataaaacaaacaaattcaaggtacacttgactaagaagttggtgttcgatagggccgggtagatggttggactgtcaggcataatttgcccaaacaggctggggaaaaacatggctttggggtcctttttgtgttaagttggctacatggaacccacaatatgtaatagttcacctatacagcagcaggaaataccgtttccgtgtaccaaaaggtaagctttctgtcgccacaattgcatgagaggggcaaacagacacaagaagagtgaaggcaaaatgaagagcagcaagaaaactaagagaaaaatgaacgtaaacagctcgaggaatatgagaagtggcgcatggcagaataggacattgaaggcagaagaaaaaacggcaagggaaaagaaggcatgggatgagaagttggcaaggcaaaagacggcaggggatgaggctagggaaaagaaggcaggggatgagaaattggctagggaaaagaaggcaggggatgagaaattggctagtgaaaagaaggaagtgagaaagaagccttgggaaaaaagcctgaggttgcgagaatggcaaaggttgaagagtagagagtggcaaaggcagatgaaaaacacatttaaagtgacacattttatttttttctcaataattttcatttatttgtttttccccaaacttagcgtccaattagtgatgaaaaacggctcgaaaagggtttggacagtttctcaaatgtgggcgaaaaaactcagcgtaggttagaatgaaggcaaaatcagcgagcagtccgtcatttttctgtctaaggatggttgtgtccaaggccgctgagaaggcacaactgttcgttggtgctgacaaaatggtgtcggtacttctcgcgcagggccccaagcttcgcgatggggtcaagaaagtgaatggcctggaaaatttgaggaaaatataattaaatagcaagggtacgaataaa

SEQ ID NO: 53004 - DNA, 555 bp, Heterodera glycines
  Genomic contig location: Contig_ID=SeqID_4057; Location=2415..2969; Strand=+
  SCN-specific regions: Sequence locations=1-405,430-555
atggtactccctctgactgccgccctatccaaattgctaagctgtaaacccgaaaatttagcagaatatttgaacaaccccgaggcggtgaacaaagcgaacgcctacctgtgtggcaaaaaactcaaaacaacctatcagggtcgtgattgcaagaccaaagatgtcaaatttggcacattttcgctgaaacctgccgctgaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttttgtccgaaaaaaataaaataaataaataaacccccttaagagttgttggccattgaggagggctgtgagagtgcacccatcgaaaaacctgccgctgaaacggactatctggactacttgaactttcgcagtgggtggcaatcagcactctactga

SEQ ID NO: 53005 - DNA, 405 bp, Heterodera glycines
  Genomic contig location: Contig_ID=SeqID_4057; Location=4087..4491; Strand=+
  SCN-specific regions: Sequence locations=1-209,262-273,295-296,318 -346,368-405
atgtacggcctgtggctaagcgacaacgccaccggtaaggacgagtacaagatcaagctgcgagggaacacccaggacttggggtgatcaggaataactgacaaagaaatttgtatgatgaataccccaggcgcatgtatttgtctgtacaaccctgacctcgatatgaacctgctctcagaagaagagcacgaccccgaaattattccataatttaatttttatttttcaattcatttcattaattttgtaatattttaacataattcctacttttgtcacctaatttttcccaaaatacaataatttcattaatatttttttgaaatctctctcgttctttgtacttcttttcatttttggtatcgtatttgcatccccttgtacgtagtttaattctggcaa

SEQ ID NO: 53006 - DNA, 417 bp, Heterodera glycines
  Genomic contig location: Contig_ID=SeqID_22326; Location=357..773; Strand=+
  SCN-specific regions: Sequence locations=1-113,135-195,217-417
atgttttgttatagaaagtcaagaaaaattgttatggagtttttttgggtaaggaacataaatcaaatattcattgagaacaatatagaatgccggaactcgcattcagaacaacatttcaaaaacaaaacttcataaatttattatttttgttagcaaaatggatcaaaattcgtgttaacctcaaccagaaatataacaaaatcatatttgcaggatatggcatttatgtactccattttgcaaattgatgcataacatttgcgatttatacgcaaatgccatatattttaatcctaattattccttaatgctttttgtccttttccttatccattgctcttttcttttgtcactgtttttttctttaattttctgcccaccgtttatcaaacaaatgcaattagcatatgataa

SEQ ID NO: 53007 - DNA, 1496 bp, Heterodera glycines
  Genomic contig location: Contig_ID=SeqID_22327; Location=1..1496; Strand=-
  SCN-specific regions: Sequence locations=1-23,45-1204,1234-1245,1276 -1429,1452-1496
  Gene Ontology: Mol. function=structural molecule activity; Cellular component=mitochondrion; Biological process=carbohydrate metabolism
cactcaaattttccgtaaaacggccaaaattgggtccttttttagtgaaaaggtggtacccagcagcgggaaaaagttgttttttaagcagcagccgccgacgaccaaacaatagaaaagtctacaagtggaaaattgtagttatttgcagatcgtaaacaacttttatcaattttattcagaaaaaaaaattatggataaatttgaaaaaaaagaagaaaaaaaaaggtcaggtcttcggaccggacccctccctttccccccccccccccgaaaattttacctggctacgggcttgggtgtcacacacaaaaatttaaaaaaatctacaaaagttcacataatccatattccaagctgatccataagacgatatttaatcaaaaatttgttgcgtttatgtcttcaaaagtaatgttgtacattttttgaatttgcacacattttggttcatttttttaatttttctcttatttttttttacattatttcttagaaaatttctaggttaacttttttcatttttggccttttcagatccgcgcccttctcactggtggaatgaccgatgggcgcccctttcggctgctggtcgactcaatgcacggcgtcaccgggccctatgtgtccaccatttttgtggaccgactcggcgcgccggcacaaagttgtctacggatagtgccgaaaccagactttggaggtttggccaaattgccatggccagagagggggccattaaggacactcccaggactttggcttggcttgggataaaggatgccatgggcgaaatttgtatggtatttgcaccaaacattgccaattttgttggtttttggaaaaatgagcgaatttggtgggaaatttgggcgaagaaacttggaggggcaccaataagaaaatgtcgaaaatttcagccaaaatactagccaggcgattctaaccccctgaaattaaacattacggtgccaataaaatggatgaattcttaggggtttatccaacaaaaacaacatccaatcttttcttaggtggtcatcctgatccgaatttgacctatgccaagggccttgttgaccaaatggcactcggtgaacatgacattggcgccgcgttcgatggtgatggggtacggcattttacaggggcgtattttttatgacccagcatttgcctccaaattattgttgccaaataggttatcgatgtcatcaaagatgatataattttctaattttgttgcaaatttctttcatttcatattttaaatccaatttctatagctttttaaaatgtaaaaaaaaaatcaacaaaaatatgtaataaaattttggcacctttaccaataactccaaaaattatataaaattgcgacaattggtatcatttatacggacggagagaaggtcgttccccccctccaccgaaattttttaaaatatttttttgttcgttttaggatcgtaatatgatcattggacgcaatgccttct

SEQ ID NO: 53008 - DNA, 653 bp, Heterodera glycines
  Genomic contig location: Contig_ID=SeqID_22328; Location=317..969; Strand=+
  SCN-specific regions: Sequence locations=1-474,499-653
  Gene Ontology: Mol. function=voltage-gated calcium channel activity; Cellular component=apical plasma membrane; Biological process =epithelial fluid transport
atgcaggtgtttggcggacggttcaactacaacccaatgcaacaggtactatcactactccacctctgctgctgattgggattttgggtttatccccctcccccactctcgaatcctatgacaatttaagaaccagaaacaataagttattgaaaagattaaagggccatgatcggccattcatccgcgaaagtcccaattctcgataaaaaaaagaaaatatgagaaaacaacgaaagcaattcgatctagcttcgggagtctcggatttacggttcgcttcaaaatcccggcaattactcccatttttagaagccccgtgccaacttcgacacgttcatccaatcgctgctgacggtgttccaagtgttgacgggcgaagactggaacactgtaatgtacaacggtatcgaaagttacggtggcatcggctcgctgggaatgcttgtctccgtttatttgtaaaattttggcacattttcttttggaatttcctttccgccctccgcccatttctctctttgtttagcattgtgctgttcatctgcggcaactacattctgctcaacgtgttcttggccatttgcgtggacaatttggccgaggctgatcaggcaagtgatcagtcaggcaacggtctgctgaatggctga

SEQ ID NO: 53009 - DNA, 457 bp, Heterodera glycines
  Genomic contig location: Contig_ID=SeqID_22329; Location=543..999; Strand=+
  SCN-specific regions: Sequence locations=1-14,129-457
atgaacgcaaagccggaagaggaagaggacgaaatggaggtggaaggcgagtacgaggacgacgacaagtacgaccatggcgaggaggaagatgaagcggacgagggcgacgccgatgacgatgacgagattgagggcgagccggaggaagtggtggtcggcgcgaggccgcgacgggtgagcaatcgatcagatcagcgggggcattcgatcggccgatcgatttaacacattattaataggaccaattttcctgatcagaggcatgatcgctacatttatagatgaggataaccgattggattaatgcgtcatcgatagataaggaccaccaatcgggttaattttcgatcataggaatatgatcgatgcatcattgataggtaaggaccaccaatcgggtcaatttgctgatcagagtgaccatttttcgttttttttatcacactaattacaa

SEQ ID NO: 53010 - DNA, 621 bp, Heterodera glycines
  Genomic contig location: Contig_ID=SeqID_22330; Location=389..1009; Strand=-
  SCN-specific regions: Sequence locations=1-234,256-401,437-494,541 -593,616-621
atggactttttcgaagcacacaaagcctttcagaagctgagcaatcagttaggaagtgcggcatttgaagtggcaatggtaaaaatgaaatttgaaatttgactttttagccggcctctccgccgccgactcagtcccattccttccgacaatggcacaaccggcgggcggcatgaacaacaacccatttgtgcagcaattggccacactttcgccctttctgatggcactgcaacaccaatcccagcaattcatgcaggttgggagacaatggcaatggcaaatgggggaataataatattcttgcccacttattaaggcccatcaaaatcaattcgatgcggcgacttttctgtccattccgtccaataataattgtaattaaattcattttttcatcgtaatttttattttaattaaaatatgaatttaaaaagtttcagcctccgaaaatttgttccaacaaatcgcttcttcgccgatgggttacgtgaaggacgaggaggaagaggaggaggaggaagaagacgaggagaggagcaattccggacaaaaccaagcgatgggggaacccgaggatttgagcttaaagtgagccaaacggatggaggggaaaataaa

SEQ ID NO: 53011 - DNA, 733 bp, Heterodera glycines
  Genomic contig location: Contig_ID=SeqID_22332; Location=443..1175; Strand=+
  SCN-specific regions: Sequence locations=1-87,109-233,255-433,456 -667,689-733
atgtcaatttcttatcgtcagcttctgttcattgctgcttttctcttcatcggttgtcatgcgcatgctggcgttgatcacacgcatctggcgagcttcacttgtgccacggcgaaggacggtgaaatcaatggcttcagagcggttgacgatggtctgctgtgagttgtgcaaaacccttccatttgaaacaaccaatcatcccaaaatcccatttcagaattggttccgacgccactaatgccactggtgctatgatcctctttggtttccagacgaacaaaaaggaggatttgtacttcaaagtctttgtgccaacatcatcatcatgcctctcatcagtgaacaacttcgtcgtcagcggtcgattttgtgaactcggagcgttggagacagaggtgagtgaaaaacactcaatttgtcacataaacaatcagttttttgtggtttcagactgaatcggctaactgtccggatggaggcggcgctggcaacggctgcaactcccgcagtgtcacctgccaaatcaaaaccgtcaaggaagtagcggaattgcctgacggtcgagtgttcaaagtcaacttgggaaatctcacacaagtgacggcactgtgcacgaagtggaaggcgtacttcgtgagtttgacgtttttacaggtgaatcatctatttatgctttgttgtttcagaccaatgttcgtcaagtgatggaatcaggcggaggcggagaacc

SEQ ID NO: 53012 - DNA, 1055 bp, Heterodera glycines
  Genomic contig location: Contig_ID=SeqID_22334; Location=1033..2087; Strand=+
  SCN-specific regions: Sequence locations=1-778,800-811,833-934,966 -1055
atggcaaacaacccgagtgtggagttactgcacgaacttgccttcatggacaattcgaaacttcaatttttgctgtcgcttggcactggcgttgcaccaacagtcgaactggcgacaactgaatcgacattcccaactgcgacaattgaaggacttgggaacacctacagaattttgatgtcacaggtgcaaacttaaagaattggtttcttatatttaaaccgggagttcgttcggctctattgcggtttacaaggctaaaaaaagaccattgaataattagaaaattttagtgctcatgaatcctaaaagaaacagatcttgccttcttggtatcatccgatagctctgcgagcctattagtctgcaaaatttcaaagaatttctttctcaaaaaaagatggccagaaaatctcataaaactagttttctcaaaatttttggcgataacttttgaaatttaacgaaaaatatattctgattagtttttcttgttgtaaacaattttattagagccgagcaatagtgaaatttgagttttaactttttgttctaactcgcgttcggggttcggaattaatagaaatggatgtcagattcattatcagcgacctcgaaaacacacaaaaagtcgttttacacgactttttaaatttttgttattttttcgaaaaatggagggcgggggggggggagggggacaaaacacacaattaccgattgcttgtcaaaaaattttacgtaactcatgtaacatgaataagagataaaaacgaacatcatattcatgttcatctcaaaacatttccctcgaaaaacaaaaattatttttagggggtcacaaaaaggaaaagtaacctccggcgcacatgtatgaactggtccttaatttatatgtatttgtctaaaaaaattttttttgatggtggggatgaaaaaaaaacaaaattttttaaatttattaacagaataggaagcaaaaaacataaaataatttttgatgatttttttccaattacagggtaaaaattatgagtaattaaattttagtttga

SEQ ID NO: 53013 - DNA, 874 bp, Heterodera glycines
  Genomic contig location: Contig_ID=SeqID_22336; Location=1..874; Strand=-
  SCN-specific regions: Sequence locations=1-4,26-342,392-577,599 -739,770-874
  Gene Ontology: Mol. function=DNA topoisomerase activity; Cellular component=nucleus; Biological process=chromosome organization and biogenesis (sensu Eukarya)
gcccctttttatttaaattaaatttggcacaaatttgggcaggttgagccaacccgtcgccgattgatgcccacaacattgggcattgcgcttgtgcatggctaccaacgcgtggaccccgacttgattttgccaacaatgcgtgctaatgttgagcgccaattggacctaattgccaagggaaaagcggactatcagacggtggacaaatcattaattaactaactaattgcgctataactaatttaattaccaatttcaagacggataaaaatcactaattgactaatgaattatctgactaatgttgtattattaatgagttaaggcattttctttcagaataataaataaaataattagtcaattaaatttttaaaatttaaaaaatctcaaaatatttaactattgaaattgcgtaaaatatatttgtacttattttttctaaatttaatttcagatcaagaaccaaacacttgagatttttcggcagaaatttctcaattttgtgcagaacataaatttggttgacgcactttttggaggtgaatgtcgcccattaaccaattaattaggcccattaaacaatttttaaattcaccattttaccccattagattcatttacatcgctggccgactcgggcaaaccgttcagcaaatgtggcaaatgccggcgctacatgaagctggtcgagacgcggccccaacgattgtattgcccgatttgcgatgtgaatttttggcacaaaatttttaaaaaatttggcgattcggtcgcataaaatggaaaatgcgatcagtgaaagactatgttatttttaggtgaaaaagcacattaataatgtgataacttatgggttcaaataattttg

SEQ ID NO: 53014 - DNA, 418 bp, Heterodera glycines
  Genomic contig location: Contig_ID=SeqID_22337; Location=811..1228; Strand=+
  SCN-specific regions: Sequence locations=1-2,30-32,155-206,236 -236,320-325,358-418
atgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaacca

SEQ ID NO: 53015 - DNA, 1354 bp, Heterodera glycines
  Genomic contig location: Contig_ID=SeqID_22337; Location=344..1697; Strand=-
  SCN-specific regions: Sequence locations=1-46,82-85,111-146,168 -178,225-238,272-530,563-568,652-652,682-733,856-858,886-893,969 -1040,1108-1243,1279-1354
agggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 53016 - DNA, 2208 bp, Heterodera glycines
  misc_feature (2177)..(2177): n is a, c, g, or t
  Genomic contig location: Contig_ID=SeqID_22346; Location=194..2401; Strand=+
  SCN-specific regions: Sequence locations=1-261,283-360,391-671,765 -979,1002-1155,1178-1391,1415-1593,1615-1688,1713-1853,1875-1912,1948- 2208
  Gene Ontology: Mol. function=chaperone activity; Cellular component =mitochondrion; Biological process=protein folding
tgtcagtgacgtcgtgtccagttggtcgtcgggcaccggcggtgccggcattttcggcgcgttggcatttgccgtgctcaccgaccgtcggctgttggcgctgcagccgcagaacgcactgctcgccatgctcgtggtcccgctgctactcatgtggaccttttggcgcctgctccactttccgtccagcgcgtacagcgggtaaaattcagttttatgggggaggaggaaacgaaaaatgtacaatttttgtaacattcctttaaatatttcaaaaaattttccggcttggactttattaattgttgcaattctcaagattatcccaaactcaaaaactctctaataattttacacttttaaaagggaagcaaattaaaatgaaattaaggcgcatattattgcaagaaatgcacgcccaaattatttcggaggaataaatgccacatttcgagataacaatagattttttcaaatgcgcctattcattaatttatgcaatggaaacgaatggtttttttacaattttatgcgccctctgttcatttttcaaaattcaaatcctggtccccaaacagaaaagtacccaaagtttgtcagcaggaaagaaaattggactattcgaaggtttgatttacgggtacaccccaaaatctcgccgcccgccgtagaaattttttaaaaaaattcaagtttagaaattttcaagaaaaaaaatcttattagaaaattttttataagaaaatttcaagaaaaaaatttttgaagtttttttttgaaaaaaactacctaaattatcataaaattagaaagaaaatcgctgaaaattttcaaaaatttttttcttgaaaaagttctgccattgttttccagttcagtgtctccgccgtattccaacacgggcacagtcgtcgtccctactaatgccaacagcaggagggacccaatcgtcgccaatcgcagtgccgccaacactgtccaccattccttgccctcctctctgttgccgttttccaccgctgtcgccaccgacgcattcgacgattatggcacagcaaatgccgacgccatcactgaaccgttgctgaacaccaccaccaccaccaacaatagcagcagtggcaacgcattgacaacaaccactgtcattctgccggcctcccaaattttttgttggaacggcggccgacggacggcgtacaaaattcgagtgggttgttattattatccggtaaagggaaactgacaatgagctatttaaaaaaaatacccaatttttcttaacaaaatgccttaaaaattaaaatttctctcggcggcgcctgtcgacaccgccggacccccattttaccttattttttttaattttaactcaaaaaattgcaaaaattatgccttttttggccaaaggcggctgcatattgctattttttgctctccggcgtcgaccagttttgaataactttttggcccgaagagcaaaaaaaacataaacttttcggctgcccctcccgaaaaatttttttctggttacgggcctggggcgacctctcctgcctcgaaaatacacatctcagggttttcagcgactccgattttcccccctttggaaatgcgtttatttaatgcaatttttgcgttagccgctgctcaagtacatggtgccgttgtgcgtcgtctacttctccgagtacttcatcaaccagggcctgctcgaactgttggtgttcgactgtgcccattcgtttgcactgtcgcccaccagtcagtaccggtggttccaagtgctttaccaggcgagtcggaccgggaatataagggttgaatatgccaatggcggtagaataaccgtcggaaaatttaaaagttttttgacgtgattcaatagaattagccccaaaacattgcaacctaaatttatataacaattgaaaatttaataaaattgctaaccgaaagtgccgaatatgaggcgaagtggcaaatttacattttaaagagctactagtctactatgttgaacaaaaggccattaaaaaaaatttccgggaagggagccccgacttttgcgcctatgtcaaaaatcggcttctaagttaagttttttcaagatctgttagcctaaacagcattaaaattaagaattatagtcttctagtttactaaagaggactaanttatgtagtttgaataattaatgattttttc

SEQ ID NO: 53017 - DNA, 712 bp, Heterodera glycines
  Genomic contig location: Contig_ID=SeqID_22347; Location=453..1164; Strand=-
  SCN-specific regions: Sequence locations=1-257,280-312,334-448,470 -647,669-712
atggcagctttggcaataaaacgtggtaatgagaaaatacttgaactgagagatactgaaaaaagtgatgaaaagaatccaacagaaccgattaataatatggactgtccttctagttctggaataggtttaagatgtactgatactcttgcctgggcaagggttaaaccagaaagcgatgaatatcaaaaaagacaaaaaagggataaaaatagtgatgatcagctaaggatgattattttccagagaatgggtgagtgtgcaatggctgttcggctgggtaaggaggacaaatggccatattttgcattggtttacccaaatgtaaaactgaatgagtattcacgcttaggcagtacaatttcagtaccaaaagtggaaaagcttgaatattttagttcttcgaattctgagttatactcaccaaacccaaacgaggaaagtgggactatttataatattataaaaagtgtaagaaatgagataaaagcaattgatgtcgattttaatgtatatgatgatgagagtgatgataacatataccagcgattctttccgcatcaaattggaccggatgtagaaaatcttgaccttgtagatgaagcatgcgcgcagatacaataactggagctaggaaaaacacagactattggatttttgcacttataactttaagtggagtgaagaatatagaacacgtttttagaataaa

SEQ ID NO: 53018 - DNA, 525 bp, Heterodera glycines
  Genomic contig location: Contig_ID=SeqID_22349; Location=510..1034; Strand=-
  SCN-specific regions: Sequence locations=1-60,82-128,154-347,369 -399,425-482,504-525
atggtcgctaagcagaccggcacgtgcaaaaatctcatcatggtcgcaaagcagaccgataagattttgaaacaaataaatgtgagtctcaaatggggataaggacagaaatctttacaattgacttcaataatatttataaaataattttaagtatacatttaagtttcagtcaagcgtaaagacttcttaaattctatttaggagcttatgcgtgccaaagtgtacgaaacttattcctaaccaacctcagatttgggttagtataactattcacttagtatacactttgccataatttttcatatattacatctaaaaatttttccttgttctattcagttcatcagagatagataaattttaaagatttaaccggccaaacggcaattgcctgtgagaattttttaatttcacaaaaaattaactggatggaatggttttagcccatcaatgttgagattttcaaaaaatcacaataattgattttcataaaaattaaattgctagtttttttaaaataaa

SEQ ID NO: 53019 - DNA, 97 bp, Heterodera glycines
  Genomic contig location: Contig_ID=SeqID_22349; Location=347..443; Strand=-
  SCN-specific regions: Sequence locations=1-32,59-97
taagcctaaactttttggcctgtttaaaaaggaattaaaaatttttaaaaattttattcatctccctttttgatagaaaaagcatcagagtgcctaa

SEQ ID NO: 53020 - DNA, 917 bp, Heterodera glycines
  Genomic contig location: Contig_ID=SeqID_22350; Location=654..1570; Strand=-
  SCN-specific regions: Sequence locations=1-32,57-89,117-195,224 -456,489-551,588-589,611-634,657-724,746-859,881-917
atgcaccgccattcgccgatcgtttggccttccgccgtcgtcgtcgccgccgccggtgcgtccgtttggctctcacttttcactcatttgccgccaccgcctccaccgccacacattcacatttaattttcgctcccatcagttttcattcatttggcacaagcatctcaatctcagattttgaaaccccttttgttttaaatatttttttttcatttttttagtcagtcgatttatgcttagttcagccaaccatatgggggttcggtgaaaaattttttcatttaaaaatttgtttgaaattttgaaaaattgtcttatttttaaaggaaaaccataggaaaagcatcgacaaaaatttaaatattttaactatgtctaggccaaaatttcattttgaaaaaatttaaaaatttaacgaaaatgaaatgaataaaatttttgttgaaaattttggcagaggagagatgttttttagttttatattttaatggacattttgtcatttgatgaacaatttattttaattgctttttttggatatttgattctaaaaaaaacaattttatttttaaatacaattaaatgatattcattttaccaaaattccgaattaaccaattcaaaactttaacaaaatttcacaaaatttttgccatgactaaaacaatttttttgcgtattttaagattttgttgatcgacaaaaagcggcttttgcgccatcagaagcagaaatgtcacaggacgaggatccgtacgcggtcagctccgactccgaggacgagaaaggtccgccgccgaaaatcgccatcgaacgcgagacggacatcagccaaattgtgaggcaacagtccaataattacctaattaattaattacctaatgagttcgtaatttgcgtgatacactattaaa

SEQ ID NO: 53021 - DNA, 2732 bp, Heterodera glycines; identical to SEQ ID NO: 4059
  Genomic contig location: Contig_ID=SeqID_4059; Location=1..2732; Strand=+
  SCN-specific regions: Sequence locations=1-225,247-482,513-525,561 -580,605-841,863-1285,1307-1315,1353-1800,1823-1881,1905-2186,2208 -2420,2444-2494,2517-2696,2726-2732

SEQ ID NO: 53022 - DNA, 913 bp, Heterodera glycines
  Genomic contig location: Contig_ID=SeqID_4060; Location=231..1143; Strand=+
  SCN-specific regions: Sequence locations=1-271,293-913
atgaccggcacatttccttctgagcccacttttgctgctgcctcctcaaatgccgttgttgacgatggtggcgagtcgcatcaaacggaacgaccgaccgaaactgaagacacttcggccgccttccttccccataacagttcgttacgttctgttatcgaacggtttggggaggaaaatgtgttgaaagaatggacggaggaagactgtgccggacttcttgtccaattgctcaagtcattggatgcctttctttgttcattatttgccctttcaaatttaagaaatttttgcgactacgaaggagcaaaacgaattgtgcgctgtttccgagaaacatcggttgacgaggtgggcaagcagtacggggagcagttgttacctgttatgttcctgggcttaaggttttaggtaattttattacagtttttggagagggaattagacacacaaatttatgacgggagggattgaatcgggaaaataggacaatttcatcattgcaacatttgatatttaagctgctgatacagcattaccttcctgttgtaccaaatagatacgaaatattcgttttcagattaacgactgtttcaacctttgcaaagaattgaataaacgtgccgcgaatgagcgagttcgaatgggaaattgcgtgagttgtgcgccgctgccccaagagagtctgccgacttttccgaattggtcatcggtgttggcacaggcgaaaaaatcacggggaatccctgacgactcttccgctgtcgttgccaaaatgctctcggaaatttccgccaaatataatgatgacaatttcgcgcccgattcccccaactataagttcatttatgagcatctcgcctcactcgtgcggggatacgccatgagagatgcacgaaggtggggacagtga

SEQ ID NO: 53023 - DNA, 1061 bp, Heterodera glycines
  Genomic contig location: Contig_ID=SeqID_4061; Location=374..1434; Strand=-
  SCN-specific regions: Sequence locations=1-57,80-448,470-873,895 -919,941-1028,1050-1061
  Gene Ontology: Mol. function=tRNA methyltransferase activity; Cellular component=cytoplasm; Biological process=tRNA modification
atggcgccattaccgggagttattcagctacaaggggacatcaccgaggtttgacgattccgtttatttccctttaattttatatggaatctaattttgtgtagtacaattaatcaaatgttgtttgcttaggttggcacagctcaacaaatcatttcttattttgatggttccctggcccaacttgtagtttgtgatggagctccggatggtaaggaaaggttgacggacttcccagattttatttacatattttagtcaccggtcttcacgcctttgatgaatacatgcaaagtcaactcgtttattcggttcaccaattcgttatcttctttttgaccttgacaaaacacccattttaaggccttcagcattacttctcatattctccaaaatggcggcacttttgtttcaaaggcatgcagaacataagtttttgtcccccttgtatttaattttttaagatttttcgggctaaaaatgtgaatttgctctacgcccaaatgaaatgctttttcaaggaggtgtcgtgttgcaagcccaagagcagtcgactgagcagttgtgaggcgttcatcgtctgcaaaaactattcgcctcctgagggttacaaaccgaccctcgtcaacccaatcttggcatcagactacagtcagtttagctggcttttgttttcgatttagatgccattttcagatgaatgcttggctcagttggagggtccaatgaatgctgctcttgtccctttcatggcttgcggtgacctctccggattcgactcagaccgaacttacccacttaacttggaggagctgtccaacgaattcaagcaattcgactacaaatacagtcacaaagatgtgttgcaaccacccacagagccagcatataaaaaggcatgcgaaatgaagaggaactcggagttggagacaaacttggaccagcaacggcaaagaacgcaatcaaaaaaaccagcgaagaatagagaagcaaaggaagagttgcaaaatgatgtgattgccgaattagaagagggatgttttgaaagactgttgttgtga

SEQ ID NO: 53024 - DNA, 1634 bp, Heterodera glycines
  Genomic contig location: Contig_ID=SeqID_4061; Location=2003..3636; Strand=-
  SCN-specific regions: Sequence locations=1-215,237-308,330-746,769 -1002,1025-1120,1142-1452,1475-1560,1582-1634
atggatgccagttcattgtcctctttggtcggataccaagactcgcctctcaacaagacagtttcgagtgttcactcgcgttcacaactcaatcatcttctggagaatgaaacgtaaatttacattggttttaatggattttgttatttaaactaataaaacaaaatgtatattcagttgcgactcaatcattgatccaacggattgctctgcttacttcagttttaatttgcctggtccaagtcatttttaccagcctggcacccctcaatatctgctgacggaagaggacacagcctttaatggtaattcaaaagtttaaattttttcaaaagagcgatgctcaataatttgtcgataaaatttagccatttattcagggattcgatcgttcattgatgagcacaaattgtcaaaatattcacgaaggccggacaaacgattgttccaacattctcgtgctgatgattcaccaaaagtgcaccttttatcagagcttaaggaggtttttaagcgcccaattttagacaggtgacaatgagacattttaggttttggaaacgtacggattgcgtgaacaagatatggaaatgtatgaagtgaaattgcgcatttggctttgcaacaccatccttcgaccactcgttgccaaaattgatgaagttaacgcggaattgtgcgaaaagtgcccgtcttcgcatctgaaagttggcacttcctccatggaaatgctgttgacgcacaaacagcacttttccgacacatttctgccttttgtgttgccctatttgcgtgttcatagcaaccagcaatacgttgtgagccgactgcgcacgctttgccaaaacattgcacttgaagaattcaaatgggacggtggaggcgaacagacagtgcgcgatgagagcgactgtaagtgtatgaacaaatgcattgtttctccgtcgaaccgaggaaatgctaacaataagatatgagtcgagccaaaaacgattgctttgagggtaaattggaaaaaggggggatggccctgcagaaaagtgaaagttgctaagaaattgcgtttaaaatgatgactcgagcattcatttcccttttacttggggaagcggtgtgttatttttgctttgctttagcatttgaccgcttcatcggttggggtccgcaattaccgaccgacactgagctcatttggcatttgttttgcacttatttggactttcacatttcgccttcctccgatggcgtctctgaactcagcaaaccattttccaatgtgtttttcgttaattcgtctgatggaaagttcccattggctctgatgcatgccaccattcaaccgacaaaacagcaaattgtgccggatgaattggctgatgagaaatatttcattcgtttggtaaatgatttttttcccataatattcttggtttccgttttaggcttccgctcgtccgccaactttcgaaattgtcgttgatggcggagaaaccgttattttaccttgtaaaaatcagccgcaaaatttttggtatgtgctcattttgttccttgcccatgttacaaaaatgtctcattctcgcattggtcacattcatctcacttcgctttcgttgaacatttttgatgcgtaa

SEQ ID NO: 53025 - DNA, 523 bp, Heterodera glycines
  Genomic contig location: Contig_ID=SeqID_22351; Location=504..1026; Strand=-
  SCN-specific regions: Sequence locations=1-21,43-233,268-523
atgaaatttgcccatacggtaccaaggggttttgcgaaatttagccatacggtaagaaaaattattatgatttgagtaatagaaaacgcaaatagcgaaaaagtctaattttgaacttaaaattgttgaaataaatttcagaaagtgaatattgcaaaaaataatgaatagcagcttaatcaaaagataattggaaaataaaaataatacatcttttaatttataattgtcccataaatttttgtaaaatttttaaaataaaaatatgaaatttgccctaagatgtcagttttcgagaattctgaaattccagcactacatgccgaaaacattgctccaattgacatttgtcggccttttaagcccaaatggggacttattttgtaattcttctgtaccgttttcagttctcactaagatgtcagttttcgagaattctgaaattccagcactacatgccgaaaacattgctccaattgacatttgtcggcattttaaacccaaatggggacttattttgtaa

SEQ ID NO: 53026 - DNA, 1597 bp, Heterodera glycines
  misc_feature (1568)..(1568): n is a, c, g, or t
  misc_feature (1592)..(1592): n is a, c, g, or t
  Genomic contig location: Contig_ID=SeqID_22352; Location=135..1731; Strand=+
  SCN-specific regions: Sequence locations=1-112,134-185,208-251,277 -278,308-308,330-355,378-425,471-925,948-975,1023-1180,1216-1366,1482- 1597
tgggcaaaaccgggaccgggaccttttcgggttgaaaacccgggaatttttggctgggaaaaccgggaaaaaatcgggactagtcccggtcaaaaccgggacctcggtactcagttgtactcagttgtctgtgttttggtcccggtcccgctctactctaacaaatagtgacataattttcagccaaaaattgagcaaaaataatttttattcactgattgcagttgcaaatgaataggactgggatttttaagaccaaaaaacccaaaatagttacctaaaaaaattttttaaattaaaaatttttgccaagaaagtaaatttttgagaaaattttttttcatttcataggagtatattttgaaaaattttagctcgattcttaggggtgtatttgtttgaaatttttttaagtcgattcttaggggtgtattttttggttttattgcatttttgttaaggaattttccaaaaaaaatcgaaatagtgaaaaatagtgacgatacgccaaaatagtgatttttaactattttagtgacggagtcgtaaaataatgatttctagtgactgataatgacgtccctacttatgaaccataaaatgtctaaattttcatttaaaaaagcgaaatttaaatcatgtccaccattgtggagcatattcattatgtgcctgattttgtgactgaagaggaggagcgtcagctgttggagcgtgtgtatggcgtgccgaaaccgaaatggcgcgaattggcacggcgtcgactccaaaattggggcggcactttggttggcggtggcggcactgttgggacggaggaggaagacggcaacaagcaccagtacctgttgcaagacgaacagttgccggaggtgcgaactcggcacaatggccaaaatctggggcacccaaaatctctctgccgaaatttaaaaaaaaaataaattcaaacttggatatttttcaaaaaacctgaaaatttttttgaaaattttctaaattaaatttttttttttaattttgggaggcgaattgtcacgttcccaaaatctgttaaaaaatcaccaaaatttcaaattttctgatttgctgcataaatatggaaatctgaattttttaattttcgacattggttcaagtcagggttcggggttcgacagagccttaatcatcaaatatgtaaaatttaaaaataatttatttaaaaataattttctttcagtggttggagcattgcattgataaaatcatggcgttcaattcgggctccccaatgacaacatttgctacagaacacaggcccaaccatgtgctggtcaacgaatatttacctggacaaggcattatggcgagttttattcttgccaaaaatataaatttattaatataatttttcaattatttttaaaattaaattagtaaaaaaaattttccattatttttaatattaattaattaataaattttattattattattttcagcctcacacggatggaccagcattttacccactgatctccacaatttcacttggctctcacacagttttggactgttacgaccanagtaagtcatgtctagggctccanatttt

SEQ ID NO: 53027 - DNA, 190 bp, Heterodera glycines
  Genomic contig location: Contig_ID=SeqID_22353; Location=640..829; Strand=-
  SCN-specific regions: Sequence locations=1-190
gcggcactctgttgcgctacgtcgcctcctggctccagtcgctggtgacctttgagctgcccggcgcgtactccgccgacgatcggctcgacctgagcagatacgagccctacgagttgttggcccgctgccgacactttgtgcagcagaaagacttgctgaacgctgtccgagtggccaatctgatcag

SEQ ID NO: 53028 - DNA, 615 bp, Heterodera glycines
  misc_feature (24)..(24): n is a, c, g, or t
  Genomic contig location: Contig_ID=SeqID_22357; Location=351..965; Strand=-
  SCN-specific regions: Sequence locations=1-168,192-532,554-615
actgtattttagcaccatataatnagagaaattaacatttataatgaacaaattttaaaaagatttcaaggaagagaatatgtttttaaaagtgttgacgatgccgaaagtaaaggaccacctattcttcctgaggtgctaaataaacttcaaacaaatagccttcctgatcatgaacttaaacttaaaattaattgtgttacaaaattaatcaggaatttaaatgtgaatatgggcttatgcaacggaacgcgtttacagattcttgatatagaaaaaaatgtattaagggtaatgattttgacgggtgataggacaggagaaattgattttattccacgaataacattaatagaagataaaaaacttccttatgtacttaagcgtcaccaatatcctttaaaattagctttttgtatgacgattaatggtgcacaaggacaaaccttcgaaaaaattggaattgatttaacaagagatgtgttctcacacggtcagttgtatgttgctttatcaagaactcggagctgggataaaattaaaataaaatattcaaaagaaaattcagaaaagaaaacccaaaatatcgtttggttggaagcattttaatgtttt

SEQ ID NO: 53029 - DNA, 123 bp, Heterodera glycines
  Genomic contig location: Contig_ID=SeqID_22360; Location=234..356; Strand=+
  SCN-specific regions: Sequence locations=1-123
atgagcaacaacaatgatgaaggcatggcaaatggtggaaaaggcaattatcaacaatatgtaaaacttgaaaaaacagtgaatcagtgccgtgttaagacatttgcggtccggacatttgcg

SEQ ID NO: 53030 - DNA, 91 bp, Heterodera glycines
  Genomic contig location: Contig_ID=SeqID_22361; Location=980..1070; Strand=+
  SCN-specific regions: Sequence locations=1-91
ggattatttttcaaaacacctcgtagactgggggataattggagactgcgggattaatagagactgggctataattagagcatatacggta

SEQ ID NO: 53031 - DNA, 465 bp, Heterodera glycines
  Genomic contig location: Contig_ID=SeqID_22362; Location=183..647; Strand=+
  SCN-specific regions: Sequence locations=1-9,32-465
atggccaatacgctgaagagaaagcgaagaaaggccgaagaacactctccaaaggagaacatccgctcttccgtccctttgaaacattccgtctcttttgccgtcgattcctctggcggaagtcagctgttcattgaggacaccgacttcggattggtcactttggaagacgcgcaaaaggcgccgtttcagtcgaaggcattcgaatggaacggcgaaggaatggacaaacgacagcaaagaaaagtggcacgaggggagggagggcaaatgacgaagattaaagccgattaagagtattgttaaatgagtgctttttcagtgttcagtcctttccaatggctttgtctcttttccttcggctcaccagcaacacttcccatccgaattgaatgctcataactctgatcacttccacagccaccagttggacaacgaggcctttcaatatggtaattttaatta

SEQ ID NO: 53032 - DNA, 553 bp, Heterodera glycines
  Genomic contig location: Contig_ID=SeqID_4062; Location=1..553; Strand=+
  SCN-specific regions: Sequence locations=1-90,112-242,275-457,479-553
  Gene Ontology: Mol. function=apoptosis inhibitor activity; Cellular component=cytoplasm; Biological process=chromatin modification
ccgagtgccgttgttttgcagtgcggcgccgattctcttaacggagaccgacttggcccattcaatttgacgctgaagggtcttttctgtttccatctttaattttgtttatttcaaaacaggacatggaaaatgcgtgaaatttttccgtgattgcaatttgccgttgatgttattaggcggcggcgggtaatactgcgatttttgtttgacagtttgctttttgaaaaaggtacactcctcggaatgttgctcgatgttggacgtatgagacgtcgttggccgtggacattgacatatccgacggttgttctttgacattcgttcacattaatcataaaacataacgacctttaaaataatcacagtcgcatgaattataattttttctaattaccttagcaattttgaagataattagaaccctttcaatctttcagaacttccttacaacgattattttgaatattttgctccaaattatcgcctccatatcgacgcctctaatgaaaccaatcacaacacagaagagtatttaaggacggttcagtat

SEQ ID NO: 53033 - DNA, 981 bp, Heterodera glycines
  Genomic contig location: Contig_ID=SeqID_4063; Location=90..1070; Strand=+
  SCN-specific regions: Sequence locations=1-234,256-614,637-981
atgcaaatcgatgagtcagtggagcacgacagagcaaacccggacaggagacttccaggtgggacttgtcctgaaatatttccatttaaaatctgattaagccgaagtcagtgaccacatgacagcacatcctggagaattctacgaaggtgaaaatgaaggtgaagaccgcaggaacaggcaagaatacaagcggagaggagggaatacgacgggcgaaccgagcgattcgagggaggacaaacaggacaattcgaagcggatcaaaattgaaaaacaaccgaaggcagagcagcaagaagacggcgaactgcttgaggaagatgctaacaccaactgacgatcagcaggaggaggaaaagcccttttaagcatcaattcgacttattttctcgtctgcgctttgaatttgtcgtccaccgtttcttattgtttcgacaatattattactcataccttttcacagcttatcaatagcgtacctccttcaaattccgaatcctcttccccgtttaaattgcttgggataaaaaaatccgattcattggatagtttattaattgacaattagtaatcatccaacggtcagcttttatttctaattcaagttttggcttttttctaatacaagagaaagtgctttgctgattttttttcagttgaattttccattataaatccactaatggtcaatttgtcttctgattcttccgtcgattattcggaggatccatgtcccggcgaacatttgcaccatggcattttctacgatggaaatgcgtaagtttcagcgaatggaacgcgtaattaatgttcgcctttttcaggaaattttgtttagtttcggggactgaccttttgtcgtttgattcggagaatgggcaacgcttaggaatcagaaggcactccgaccgtgtcgtcggcgtacactttcaccagggaatggtcagtccatcgatagttctaatccgttgttgcaaa

SEQ ID NO: 53034 - DNA, 2108 bp, Heterodera glycines
  Genomic contig location: Contig_ID=SeqID_4064; Location=755..2862; Strand=+
  SCN-specific regions: Sequence locations=1-1719,1741-1783,1816 -1871,1893-2108
atggaaaattgcgtcgtcgtccctcgtcggatttcgtttgttcggtcgaccctcgaccaattttgggactgctcggcattgactgttcccatgacaaatggacaagagtttttggtcatttactcaaatggtgaaatggaagtgtacatccaaagtgaaaatagagggtaatttggtttggatttctgtcgattgttccattgtttttccattagttccctttggcattgcgatttaaaaaggcattaccaaaattggcatcaatttgtggtgaagcattgctcaacaattgccagcacaagtggacgttttgccactgtcaattcccttgcggacaattcccgtgttttcctatggcatttggccactctttcgattgtcaaaatgatcgacactttggtcaatccttcacaggtccctccccccccccctccctttgattccattcgaatgttccgtcaggttgaatgggctacaacaccctccgttttgctcatcgcctgtcaatttggcgtcgtttcgttcgactccgatgccaacactttcccttgggccatccatcacccaaacctttcaatcgcttctaatcatttggccactttcgcatacgatggacactttggttggtctcccaaaacagtaaaacctttactaattggtccatttgttcctcttaagttttcgttatcaatgctttcaatgggacattgaaaactgaacctttgcgtttttcggaacgacaaaaggaagtcgttgccgtgggcgaaggagggaatgttttgttcgttggcatctccgaacgggtgggcgtgtccttctgaatttgccgtcctcatgacttctttcagggcgctctttccgtgcttacgccaaactcaccccaaacaattggtcactctgccgaactccccaaacagaagggcaccgccttttcacatttaatggcagctaatgggcggacaacaaaaaggagcggagaacaatcggaagaaaggggaggacggacgaaccacgcggttgttctgctggaaatgccgtccataaaacaattcattgatggccccgcgcattcgcttccgccaatcgcacaattaacgcgacagtttttggacgcttgtttggccaggagaagcgacgccaactgacaaagaagggtcgggtcgatttgttggtgcctttttcattttcattctcttgtccgtatgtttcatttgctttttcattcataaatttgtgtttccaactttaatttggctattagccccggtcagacttttcttttgtcttctaatacgtttttggagtgcgtccgcaagttttggcccactcatcggccattttcttttggaaatgcaattcaatttccgcccgtccgctgtctcttcgcccctcccccatttttcgctgtgccaactttcatttccaacttctcccaatcaattgccatgcttttcctcccccttttccgactgtttgtccccctctcttttttgctttttccctcccatttttcctccgtccctccgattcctttcggccaatgcgtccgccctttgcgtgtcgaagaatcgcattcgctttttgtttgtgttttggacaaataaatgcatacaaaaatgattggttcattaggaaacaaagcacggccattacttttcaaatgggtcaaaggcacgcttttcagtgcatttgccatcgtcgggctttgtcgcctccgatgggtgagatgggagctgaacatggcacaattagcttttgaacaacaacacaattgcagaaaataggggcagggggaggaggaacatagggaggactaatgaacacggcacaatttgtgccgaagcgacatttaagccgcgaagtgaaactaatgaataataataatattaagatttcggtaattttagctatccgaatgggtacgagaatcagaagtgttctttggagttggtcgccactccctccaggcacaaaggcccttttggctttcggttaattttttttcagcggtttggtggtccatctttcgttcgtcgatttggatttggaagccgcttactcccgatcagagcagtgccttcgggattacattgtggtcacaattatcg

SEQ ID NO: 53035 - DNA, 863 bp, Heterodera glycines
  Genomic contig location: Contig_ID=SeqID_4065; Location=2785..3647; Strand=-
  SCN-specific regions: Sequence locations=1-863
taaggcatataattcccctcccttttaattagtcttattattcatccgtttgtgatttatttcttggttatgtcggtccatagtgaattggctcggtccaaaattttgacctgcagaaatcgtttggcggtgcgtcggttggctctgctcgaacaatacttcgagctgaacaaatccgttcaatgtcttcttgacgattatcggctcaacataatgaaagcaaagttcgctgcattttgtaaagtttaaaattcgtcggaatgcttttcagaagcacttcccccggcttcgtcgttgggtcagtgaccgcccttttgtcctctcagagggaactgagcccgacaatttggttggccaaaaggcactcgcaaagggtgttgctaatctctttttctcatattggggcgatgaattatttttgttcctcaaaaatgtcctgtttttgtctccttttttacgcaacatccccggcactttttctcatcgcattttgccattttaagggttgaaactgcgaaaagcgattgcggttctttcctcgcattgaattggccttcaaaatgtgcgggggaaaaaggaaatgatttgcgaaggaggggaggagaaacattcgatggaaaaggggcggaagaagcggaagggaacggagggcactcaacggatttccacccctttggcgttttggagagtcaaagcgtaaaagcggcgaggaaaaacattcaaaaagtgagacgatttcgaaattctgtcccaaatgttcccgatcagctgcttctgattctttgcgacttggcgaacattcaaagacaaatcctttcgctggggaaagaggcggacgaaacgaaattggccgagttttagcg

SEQ ID NO: 53036 - DNA, 2099 bp, Heterodera glycines
  Genomic contig location: Contig_ID=SeqID_4065; Location=1439..3537; Strand=+
  SCN-specific regions: Sequence locations=1-354,399-486,582-618,640 -710,732-758,796-834,861-2099
atgggaggagaaaagggaggaaaatgcgggagaaaagaggcggaagggacggaaaggaaaagagacggaaagagtcggcggaacaacgaagtcgcagcgaaaccgcacggaggacgaaatgcctttcgcaattttaccgactcaaaaaatactccgagaaatgggtgagttcttactagagttgagcgggaccggggcgggaaatcccgggtttttcaggtcccggtcccggtttttggaaaaacagaaatcccggtcccggttttgccagtcccggtcccggcgggactaaataagcactggtaagaatgggggtctgggtgagaaaagagaagggaattggtgagggaccagaaatttttgataaaaataaaataaattatttattttcatttatagcatgtgttgacatgtataagtggtcaagtgtctaagcctttttactttcattattcgtctcttcggttcaattctctgatggaacagaaaatttttttatattttctttaccattattttaattgaatttaattaataaaaactattttaatttaaaattattatttttttcatttttaatagtctaaaaacccataaattaaccgaatatttggtcatttttgacaaattctgttaataaatctcgctcaaaatttttccgggggggcgcttttcggcacgggcgggacccaaccccctcccactgttccaaaaaagttttttgaaaaaacattgccacaaaaacagcgatttaaagcaaaaatttaaaagattgtaaatttatttaaaaaaataccgaattttgggactcagaaaattccaagaacccccctgaaaacaaaatttttaaaaattttcctcgaactcgtcccccaaaacgtaaatacaaaattttattggtacatttttgaatattggcaattttcgtaacaaagtgtactttcaatttttttcaaaaaaattttcacttgggaaaagtcccggttggtcccggtcccgggttttttcgctgtcccagtcccggtcgaaaaacttggtcccggtcccgacttttctggtcccggtttttgtcaaatttcccggtcccgctcaactctagttcttacaaacgaacgaatgacttttcaatttctttttatttagtcaccccaattttgcgaccaatgaaaagggccattggccgtccattggtccgaacgaatcgcaaggaattttcagagacagcgaagtgtggacaaaaagaacattcggtggcaaaatttgtcagtgcaacggcacggcttgtgaataaaagctctaaagttcattattgaactttacccaatttgtcaatttcgaaagcgcaccgctaaaactcggccaatttcgtttcgtccgcctctttccccagcgaaaggatttgtctttgaatgttcgccaagtcgcaaagaatcagaagcagctgatcgggaacatttgggacagaatttcgaaatcgtctcactttttgaatgtttttcctcgccgcttttacgctttgactctccaaaacgccaaaggggtggaaatccgttgagtgccctccgttcccttccgcttcttccgccccttttccatcgaatgtttctcctcccctccttcgcaaatcatttcctttttcccccgcacattttgaaggccaattcaatgcgaggaaagaaccgcaatcgcttttcgcagtttcaacccttaaaatggcaaaatgcgatgagaaaaagtgccggggatgttgcgtaaaaaaggagacaaaaacaggacatttttgaggaacaaaaataattcatcgccccaatatgagaaaaagagattagcaacaccctttgcgagtgccttttggccaaccaaattgtcgggctcagttccctctgagaggacaaaagggcggtcactgacccaacgacgaagccgggggaagtgcttctgaaaagcattccgacgaattttaaactttacaaaatgcagcgaactttgctttcattatgttgagccgataatcgtcaagaagacattgaacggatttgttcagctcgaagtattgttcgagcagagccaaccgacgcaccgccaaacgatttctgcag

SEQ ID NO: 53037 - DNA, 763 bp, Heterodera glycines
  misc_feature (733)..(733): n is a, c, g, or t
  Genomic contig location: Contig_ID=SeqID_22366; Location=560..1322; Strand=+
  SCN-specific regions: Sequence locations=1-304,326-431,468-763
  Gene Ontology: Mol. function=pre-mRNA splicing factor activity; Cellular component=spliceosome complex; Biological process=mRNA splicing
atgtttgttctgcagagtctgattaccggtaccatctcgaaggcatcggctaaacaaagagctgaaagagcggggcgcacgcaggacggagtgtgctatcggttgtacagcgaacttgcatttgccaatcaaatgcttgagcacacaccgcccgaggtaaaaggaaaaggccaatacggtggtgaattgttggaagaagttctgctcaattgtctagaattgaagatcgagtaaagaaagatccgggcttttggacttcgcgagtcttgattctcatatttcataatttttctctaaatgttttgggcaaatgagatcaaaaattaaaattacattatcaaattggccagagctttactttcatgaacatttaaaaaatgcggtcgataatacagttcagtttagtgaggcatacatttgagaaatttccgtatatttatatatatatatatatatatatatatataaatttatgtctgaatcgggttaacgactaattttcacccaaaaattttattttggaattcactttacaaagtagttaaaattgaatccagaataactgggttgtatgccgacttatatttaataagctgaaatgctttttagattctttggtccgatctgacttcaatggtccttaaaatgaagtccattcccagtatttctgagcaccttggcgacctccgcttccgcgatcagccaccgaaagcggctattgtaagcgcattanaaaatctttattttctgggagcaatcgatg

SEQ ID NO: 53038 - DNA, 970 bp, Heterodera glycines
  Genomic contig location: Contig_ID=SeqID_22367; Location=35..1004; Strand=+
  SCN-specific regions: Sequence locations=1-970
  Gene Ontology: Mol. function=structural molecule activity; Cellular component=synaptic junction; Biological process=cell adhesion
atggtgtccgaattggcccagtgcagtgatcagttgcgctcaaacggcgcttccactgcaatgtcagtggaggagtcggtgatggctgtcggcaacgaacttctcgtggccgcaaattccgtggaggccgtttcttacaaattggcacaaatgcgtccaagggaaattcatgcaagtttttggcttggaatttatttcaattttaattgataaattgctactggactgataattaacgacgcttttgcggcggaggagggcccggctctgatatgtcttgtattcttgggtcggtgcttccacgaggaacccatcgtgcagggcatatcagagtcggcacccttcgcatgttccgttgcccccgtcaaatgccgtgccattcctgcgcttctattccttcgacacttcaacattttaaatgaaattttttttgcaataatattgaaataaatacaataattttgctttttcaattttatcatttttcttttcagaaacctgatgagaacctaacgtacgatgagcaaattctttcgtccgctaagtcaatcactcaggccgtccaaacactcgtcaaagtaatctttggtttgtctaaatttgtttttcattcccatcggaaaaggccgcttcgtctgcgcagcaggaattggtggcccaggggcgagtggccgacccgggcccagcaaatggcagcgaagagcagcaatggactgcaggtggagaagccaaaactccgcagcataagctaacaaataagctaatcactcttttgccttaggtttggtctccgccgctaaactcgtcgccgctgcgactaaccaactttgtgaagctgccaacggattggttcagggccattcgacggaggaaaagctaatcgcagcggcgaaacaggtgaagaagacaaaggaggaaaatcaggggatttatcacggcaattattggacaaattatcgccataaatccg

SEQ ID NO: 53039 - DNA, 659 bp, Heterodera glycines
  Genomic contig location: Contig_ID=SeqID_22372; Location=849..1507; Strand=+
  SCN-specific regions: Sequence locations=1-313,344-534,577-659
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaactttttttatgaaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtga

SEQ ID NO: 53040 - DNA, 1470 bp, Heterodera glycines
  Genomic contig location: Contig_ID=SeqID_22373; Location=407..1876; Strand=-
  SCN-specific regions: Sequence locations=1-252,274-616,638-858,880 -912,934-1329,1357-1470
atggggaaattaagcgctaaaagtgtaaacattattattcatacttttgtatatattcggttttttttggggggggggcttggacattaataagaccttaaggcaattaagtttaagaattgaatatcgttctgattatttctaaatctgttcctagcactaggaattggattttgaagcaaatgcttaaatttttgcgaactttgaacaagctaagaatcatgaaaaactcatttcaagcttagctcttagaaaaaaaaaaattaatattttgagcatatacttttgagcacaaaaatttatgagttcaaaattttcagaatggaagaataatttaattgtcacgttttatgattaaaagccggtcgatacctgtcacaataaaaatactttatacccgtaactttagaattttccgattttttttctatattttgcctttaaaagcactaaattataaattattttcaatttttccacaactttcgtttttacgaattgccatttttcagtctcaaaaatacctaaaatgaaatttttcttgcatttccttcactgaagtgaaaataatgcacttaattcgcaaaaatctccatcaattatttaattaagcgtctattcattaattatttttctgattttcccccaataaaatcatccaatccttgttcattttcattaccctcgcgctgctctttgcacacaaattgcagtcccgagtaggccgccttcaactcggacacctgtttgctgcgcgactcgcagcggaccatgcactcgtccaccccgcgataagcactgattttaaacaaaaagcccaatttttataaagtttatctcatccaaagcacttgaaaacaattttagcaagcaaaattcaaaaaaaattactgccaaaagtactcaaaaactcatctttatggcttttatgcacctcatgaagaaacttttgcagctgcacgaatcatttgatttgtgcagcaattctacagtagagctttgaattgataccggcaaagcttaaactaatttaaatggggtaaatctattagcggtaaatattttccaattaaaataaaattctaagaagatatttatcgtgatcacttttaaaatttctgttttatcattccaaataatgtatttttttttaaatattcagttgtgtaaatgataaaattcatgaaactgactcgcacactcgtgaaaagaatttgtgcatgaagttttggcctgcactgtacacaaatgggttcacacttagccccgttgaggagggcgttgcctcaattagcttaattgaaatgacgtattttactgagagcggccaaaataataaataaatttaattaatttgagaatatactgtaattatctttttatagccctttaaaaaaatttgcttgacggaaaacgagaaaattaaaaattgagcgttccttttttccgctcccgtaattcggcaataaa

SEQ ID NO: 53041 - DNA, 2036 bp, Heterodera glycines
  Genomic contig location: Contig_ID=SeqID_4066; Location=481..2516; Strand=-
  SCN-specific regions: Sequence locations=1-12,34-1066,1110-1423,1445 -1551,1574-1990,2012-2036
atgattcgtaataaacttgaaagtctacaaaaaagtcggaaaaagcgttatttgtccgacattttgaacacaactgaggaggccgtgaatttgggagtggaactcgtcgaaccgaatgatgtgagaacttctgacagcgttgaacaaccgaatttgaaagaggctgaggtctcaacagtgcttttgagcgcggaaaaaccaattttgggggagattgcctatggttgaacggtatgtttgaagtgccgcaaaaaattaatttttaaactattcagggtttcgattcacacaccactcaggaaatcgctggagatgcacaaatcgcagttgctcagcttatgtaaacatcacaaacaatggcgaaaccggaactagtggaaccttgggtcaaaaagaatacaaccacctcccagcgcctcagaaacaacaagtttgtttaaattcaacgttacgcgaaaaggtcggtgaggacatcgtcttgtatgacagtcgcaatgtcaggcaaggcgaaaaggacgtggtccttattttcggcagcgttaaggtacattttttggctataaaaattctgtttttcaatggttttattttttaagactctggacattttgcgccagtgcggcacatggcaccttgacggcacttttaaatgtgctccagcaatgtgggagcagtgcttcgtcattggtgcatcagtgcatcagaggatgtgcatctgtttgtggtgccttctgcctggaaaacaacgacgctactacgaagaagcactgaattttctccgtggacgtatctctactgaagtcccaagcaaaagttaacccattgtaattataaaaaatgaaaatttcgaattttagtcatgtgtgattttgaaaaggccgaaattgcggcggtgcgtacggcattccccacagcgcagatcaaatgctgcatgttccattacgggcaaagcctgttcagaaatttcaagcggcttggtcttgtgcatttgtacggtgagaagacagaacgtggggaggcagttcgcaacacgttccggttaaaaaaatttttggtgaaattcgaattatttttcagaagtgttctttctttgccacttttgcctcccagcgttgtcagaatggctttctcaattattgtggcgtctgctcctgcaggaatgcatgagtttttcctttacttctctcgaacatacatcggcttgacacagcgccagttgttggatggtgctaatgcatttggggccactcaaatcagttttttgtccagcaccgaccattgtttgttttcgtatttttgcatcgattttcaaagtttaattatttttaagctgaactagtgacaacaatttcgaccatcaactcagaacacagctacgcggctactccaatacagttcggcatcggctcaccggcgccatcaactcttacatggccaaccactgtgactccacaagaacagcttgttcaattagttgactcgctatcgacttcaacagcctcttcaggcatatattttttcacaaaactcgttgttttcacgaatctttcgtttatatttaataaaaaatttagttcgcgtgtgggaggaagaaatctttcgggcgccccatttcccaattccgctttggaacatgcactcacaggcggcttctgcactcgctcgtacaaacaatggactggaggctactcatctacattttatggtctttttaatttagtaaaaaaaaattgaaaaagagtatttagaagggtctctgtcatcacccggcactctcggacttcatctgtggagtcaatgaaagcatcgacagacaggtggacgctgcccgatctgctcgccatttcattcacaagcgacaaaagcgatacatcctgcaggacgcgctcattatgcgaattttagcggacgcgtcgtacaacaacaacggtgaaattcatgaccttatgacggccctcggtctacaaattgaaggatacgcaggaaaattaaaagatttcgaaaattttgatgattcgattgttcatgttccatga

SEQ ID NO: 53042 - DNA, 332 bp, Heterodera glycines
  Genomic contig location: Contig_ID=SeqID_4067; Location=1327..1658; Strand=+
  SCN-specific regions: Sequence locations=1-54,95-332
atggcgacttttacgttacgtcaaggcattgacattgcgaaaaaattggagcctactggggaaaaccaggttttttcttgggggttggggattttccaacaatttttgtaacaaatttcccccaatttttttttcagtttcttctgcttggacgacaaagtgccatcaaagcggcgcagaatggcaccgactgggccaagtcggtggatgccaaattgggcacaatggttgacgagcacattctgaaacgggcgctggaaaaggtggaaaagtccgccggctctgtgccgctgtacatggatttggccaaggtttttaaattcattttttaa

SEQ ID NO: 53043 - DNA, 2072 bp, Heterodera glycines; identical to SEQ ID NO: 4068
  Genomic contig location: Contig_ID=SeqID_4068; Location=1..2072; Strand=+
  SCN-specific regions: Sequence locations=1-1195,1217-2072
  Gene Ontology: Mol. function=structural constituent of muscle; Cellular component=sarcomere; Biological process=nerve ensheathment

SEQ ID NO: 53044 - DNA, 1898 bp, Heterodera glycines
  Genomic contig location: Contig_ID=SeqID_22374; Location=595..2492; Strand=-
  SCN-specific regions: Sequence locations=1-231,253-297,336-393,419 -578,600-1067,1126-1154,1198-1276,1385-1435,1457-1580,1613-1627,1650 -1690,1712-1757,1797-1870
atgggcctttattttttgaacgtgctgaagttgagcagcggtcagacaacggtgctgatcaatgtgaagaaaatcattggcgcctttttcgctttgctcggctcggcggtggcggatggttacattggcaaattcaggcttgttctcaaaattttttattcatacatatgtttctaatcatctgaattagacaaatcaaatttacaatttaatggagaacaaattttttcctcgctaatttcaaaataaattcggggaacattaggcgacgcggcactgccgttaggccgcagggagaaaatttttacaatttttaattaattgtttaaattaatgccttcattagagagaaggatcaaaaaagtgaagagtaaatatcgtatactttgtgcaatttttaaattattttccattttcaggacaattctttatggcaccattatttacggagttggcaaaatcattctcagcggtacgattaaaaaacatttcaatttgcttaatcatttttgcttaattagctgtcgcatttgagcctggcggtgaatcggcctttttccatccgtgggtatgccgcaaaatattgtttatatttacaattaggcatcagttgggaattgtcgggctcagggttatttaagcacggctcagaattcttaagtttatcctttttttctggtttttggataggttgaaaaagatttttaaaagagaggattaaattcttgaaaactttttacattttttgttaggcaaaaaatttcaaaaattataattttggacaaaaaaaatttctgagcggatgagaaaaatgtgctcttcggattctttctattcgctaattactgaattccaagccctgtttttaaattttaatttgttataatttgttttttcctttgcactttcccagttggattatattggcattctgatcattttggtcggcaacggtttcatcgtgccgtgcgtcgcttcgtttggcggcgatcagttcgagccgcaccaggagcggatgatctccgtgtttttctccattttttacgctgccattaatgcggggtgagaaaaaaaaagaaaaaaatatatctttaaaaataaaatagtatttttaaaacaatatttctctgtgctctgtgtgacctcgccatttctttaaaaatctatttataaaaaagtttaaactaaattatatttggcagcgctacccgcaattccttcgcctaattaatcaagtcgtaataattgaaaaatgcccaaaatgtgcgactaattgaataatttttttttaaatatattattttcgattgatagtatttttctttttgttttttattgaacaaataataaatgaattaaaaaatgcaaaataaaaataaattttgcataaatattttcattagaagcaatcaaatacattaattcttgtcaatggtaagcatttaaaaactacaaaaatgctcataaaacaaataatcattaaaaaaaattgtttgtttttcagtgcactcatttccacttttttgttgccgattttacgctcaaagccttgccttggccaagattcatgtgagcaagacttatttaataaattaattttattgttaattttgattttgatttctccaggttatcctctgtcatttgccgtttccgctgttttcatgttagtcgcaacgggtaacaaaaattctaaaaattcaatttatttacattttttcagtaattttcttcgctgggagtggacggtaaatggcattaatttttaataaattttaaaatatttatcttttttaggtacaataaaaatccaccaaaaggcaatgtgtttgctgatgtttatgacactgttgtggtagcattctttgacaattaaattaaatattaattaaaataaa

SEQ ID NO: 53045 - DNA, 1035 bp, Heterodera glycines
  Genomic contig location: Contig_ID=SeqID_22375; Location=1268..2302; Strand=+
  SCN-specific regions: Sequence locations=1-1035
atgaccatcagccccgcggtgaccaggcttcgtcagcatgcgaccactgccgaaaatgccctggacgaagatgaaatggaccaggaagcgttggacacgctcagacaggagcaccaacacatcactcggattctcactcgcttggaatacgatctcaacgaatggaacgaggtcatacatcgactccaggggcctgcgcgagatgcagaagaagccatcttcacagccttcatcagagatgaccggcatttcacggaatggatggaagatgcccgagaagtgctggcgcatattgaagacgagctcaatggtccgcccgtcgccgcacaagcacatttggccgggggaggacaactgccaggagccagttgcaatgcacatattccgttgcctgcggccaaccagcaatttcagccagtcatagccgctaatgcacaaggagtcgtaaatgtcccaccacctccagccctgaatcagtttggcgcttggcgcgctgccagcctttgcagctaggcttcctcaactaagtcttccgaactttgatggagaccctcttgagtggcccgcattttggcagagtttcgagagtgctgttgaccgcctaccactcgaaccggttgacaagttcaattacttgcatgtatgcctacgaggaaaagcagctcgtgccgtaacctcctatcgtggcggagagaattatgcccatgccgttgctgctctcaaacgacttttcggtgatccatggaaaattgccgaagcgctccaatcagagttgatgaatctacggccagtggatgacgatgtccgatcactccaggattttctggagacatttgaacgagtgtgccggcaactctcaaatttggaaatgcctgacgatagcccattaatgtaccaagtcgtccgtagtaaattgcccgcaactgtgctctcagaattggtcaagatggagcgaagtgccggtgtcaaattgcacaccccacaactcagaactgggcttgccaaagtcataagcatacgtgaagaggttgagcg

SEQ ID NO: 53046 - DNA, 208 bp, Heterodera glycines
  Genomic contig location: Contig_ID=SeqID_22377; Location=2016..2223; Strand=-
  SCN-specific regions: Sequence locations=1-105,128-208
ccgtcctgaggctgcgatgaattgctaaattacatcaatttctagcgacgcggtgaagccgcgtccctgagcgcgaagcgctttccccacagcaacagaactcaattgataatgttttgtatgttttaaaataacaaatgagggccatatattaccaagccacgcatgcacaccatagccaactgtccaccctagtttatatatacat

SEQ ID NO: 53047 - DNA, 835 bp, Heterodera glycines
  Genomic contig location: Contig_ID=SeqID_22378; Location=1..835; Strand=+
  SCN-specific regions: Sequence locations=1-240,262-328,352-596,618-835
cagaaaaacacgatcctgaggatattgtggaatcggaagaagttcaccatgaagttgaagcagtaccggctccaattccaacagaaagacatgaactggatgacactgtggaaacggaagaagttgtacaagaagttgaagcagtatcggcaccaattccatctgaaagacgggaatctgatgatattgtggaatcagaagaagtccggcatgaaattgaaggagtaccggcatcaattccaacagaaatacatgaatctgatgatattgtggaatcggaagaagttcgccatgaagttgaagcagtaccggcgtcaattccaacagaaagacacgagcctgaggatattgtggaatcggaagaagttcgccatgaagttgaagcagtaccggctccaattccaacagaaagacatgaactggatgacactgtggaaacggaagaagttgtacaagaagttgaagcagtatcggcaccagaaacaatggcatcagaagaatgggctcgaccagcagcagcggaagaagttattgaatttggtgatttgtcaccaaaaagtgatcattttggtgatcagaaggatgaggaggaggcattggtcgagtcggaagacgtaaagccagacgaacaccgagataaagccgttgatgatcattttaaaactgctcaagaaactgatcagcaacgacctgattctttaatggtgcgctgggccggggatgagcagcgcgacgcggaagaaactcgcgcactttacaccgtcacggaacaacaagcaaatcagctggtcgaagaagcgctggagcgagtgctcagcgatgagtcatcgttgcg

SEQ ID NO: 53048 - DNA, 1142 bp, Heterodera glycines
  Genomic contig location: Contig_ID=SeqID_22378; Location=1..1142; Strand=-
  SCN-specific regions: Sequence locations=1-127,177-253,303-525,547 -791,815-881,903-1142
  Gene Ontology: Mol. function=glucosidase activity; Cellular component= cell wall (sensu Fungi); Biological process=cell organization and biogenesis
ttaattaatttgagaatttggcatttttttatagctactcccttaacgagtgattaaatgggatgcactacgttccctccctcctcgccttcccgctcccctccgattttttaaatttcaaacttggaaaattttcaaaaaaaattttttttagaaaatttcaagaaataaaaatagcgattttttgataaactttttgaaaacacttttaaggagatacaaaatttaaaaaggcaaaataattagccaattcaaataaataaaatttagaaaaattaatataaattattaaaatttaattacttaccgcaacgatgactcatcgctgagcactcgctccagcgcttcttcgaccagctgatttgcttgttgttccgtgacggtgtaaagtgcgcgagtttcttccgcgtcgcgctgctcatccccggcccagcgcaccattaaagaatcaggtcgttgctgatcagtttcttgagcagttttaaaatgatcatcaacggctttatctcggtgttcgtctggctttacgtcttccgactcgaccaatgcctcctcctcatccttctgatcaccaaaatgatcactttttggtgacaaatcaccaaattcaataacttcttccgctgctgctggtcgagcccattcttctgatgccattgtttctggtgccgatactgcttcaacttcttgtacaacttcttccgtttccacagtgtcatccagttcatgtctttctgttggaattggagccggtactgcttcaacttcatggcgaacttcttccgattccacaatatcctcaggctcgtgtctttctgttggaattgacgccggtactgcttcaacttcatggcgaacttcttccgattccacaatatcatcagattcatgtatttctgttggaattgatgccggtactccttcaatttcatgccggacttcttctgattccacaatatcatcagattcccgtctttcagatggaattggtgccgatactgcttcaacttcttgtacaacttcttccgtttccacagtgtcatccagttcatgtctttctgttggaattggagccggtactgcttcaacttcatggtgaacttcttccgattccacaatatcctcaggatcgtgtttttctg

SEQ ID NO: 53049 - DNA, 948 bp, Heterodera glycines
  Genomic contig location: Contig_ID=SeqID_22379; Location=779..1726; Strand=-
  SCN-specific regions: Sequence locations=1-101,136-173,208-361,383 -541,573-835,857-948
atgagcgaaatgataactcacaatcagcatcagttgatcaaatgggtgaagaaatggggacagacccaaatgatcaacaaaaaagagaaatcattcgaaaatttgaagtaattaaagaaaaattggatgaattttaggcatatatcgcgaaaaaatatacaaatggaaaaatgaattaaatttaaataaaattaaattcaaaataatgaaacatagttttttatgaagagaaaaagaaagaattcattgaacgatttgatgaatttaaaaggttgtataaaggcaaacaaaaagaatttgcgaaggaattgggcatttctaaagaaacattacgaagatggaaaaaagaattgatgccaaaatatcataaaagtgagagaatttgttttttaattagtttatctttatttttaagtacaagttaaacattcaaatgaggacaaattaaaaaagatgaaaaaatattttaaaatcaaagaaagaaacctaaaaattagcgatgcaaaaattgcaaacataataaaaaaaggagcgaaaatgagagaaaagagaggggaaagaaagcaaaatgttggggtggcacaatctttgactcaaggatgggaggaatgaaaatatcaatgaaaattaatttataaggccaaatagctatgcttacagaagggattgcattttagttacaatatttaacatttttgctgctttgtttcgctgagaaatgcgcgaaaaactcatttttagcctagacattctcattttaatagtattgttcgtaattaggaatcattaattatttttagagatcgacattttgaaaaaagcctggacctggattccatgttggacctggacctggattttctggacaaaaatctaggaaaatccaggtccaggaaaaatccaggctcctcgagacctggatccaggcctggacctggatttttttaa

SEQ ID NO: 53050 - DNA, 1146 bp, Heterodera glycines
  Genomic contig location: Contig_ID=SeqID_22380; Location=311..1456; Strand=-
  SCN-specific regions: Sequence locations=1-285,308-445,467-634,656 -1146
atgcacccgagtgagcccggcccttcttcgtccaattccgaaattcacccaacttcccttccgcctccctcaaccaccgcccttaactaccaatgcaattacaataacatcgatgatgctcagcatcgtcagttgcaccgaatttgggagacctcaccggagggcgaactgctgatccttcagaacaccacctcaatcggaagcggagaaacaaaaaatgccgtcccttccgaccactccacggtcattcgtcccatgttcctcgacatttacctgcccaacggtgtgctgctgccaattcaatgcccggcacagagggcactcgcactgctcaagcaggacgtgttcatccaggccaggaagtgagtggaggcggtgattgttggcattgttttaatgggtttcaaattggccattaggtaccctctcgcctatcaacttaacgacatttccaattacattttttccaccattggacttgacggaacgcatgtcgaagttggttggaaaagcgctttctctgagtgctgcgtttattaatttgccattcacttttttaagctttatgacgaacgcaaacccatcgcgagtttgcaatttctgttcctccctttgcttattctgatagagccaagcggaaacaaaacggagaaggaattaaaccaaagcatcggattggtcatgggcatttcgctgaacgaattggaactgtcgatgagcgaagagttgcatcagtacaggcgagaaaaagacccaattagaaaatttaacacccaatttgttaacattcatcaaccattttcagacttcaattgttcgaaacatgtcgtgaggcagaacgacagcggggcacttgctcatttggccattatgcattcccagaaaacccacttttgatggttcaccccgtctcaatgaatggcgcgacggtcgtcagccacggccaattcggtgagcggtgacacaacatgacgaaaccgacatttatgaggtcaattaagtttaggacctatagaaattaacgagacggatttggactatgcccaattcccggaacagcccggagaggttgagcaacgcgcgatggaaaaacttagacggaaagtgcaattctctgatgcatatttggaggcatggcaccattag

SEQ ID NO: 53051 - DNA, 871 bp, Heterodera glycines
  Genomic contig location: Contig_ID=SeqID_22381; Location=523..1393; Strand=+
  SCN-specific regions: Sequence locations=1-310,332-459,502-653,675-871
atgccgtgttcaaagtgccgaacaaatcacccgcacaaccaactcactcgacatcgaatgagagaatgtcgagcagcagcacattcgggcccaacggcttcagcgttagtgagcgaggctttggaaggacgaaatgcgaaaagtgtgcaggtgaaaacagccctcggcaaagcattgcttttgaggccgaatttggacatgttgggcctcgtggttgaacacattgactaaagggagagagggcgaatagacggacggaaagcattcatttgatcactgatcagaggctaatgaatgctaatgagttttgagtcaaaagttttaaatatttgttagttagcaagtagcaagtaagaaaactgttgtattttgaaattaaaggctgttcaaaactcgtacagaatagccgagacgtctcctcaaagattggtggattgaatcgggcctgttcaaaaagtcaaataaatttagaaaattcataattaattatttataatttaagcaaataaagcttagaattggactcggatcctatcagaattttcacaggattctacttcttactcagcttttttttgaaaagtgcaccaagattaggtagggtccagaaaaaaattcgagaaaggcaaccgaagagctttttttgcatctccagtgttattgtttttaatttttcagcccaggggcgaaaaagcaggattttgtaggggtcaaattttcaaaaaattattgtttcaataggttttggcgggtgccgacaggcgccgtcgggaaaaatttttttgaattttaattgaatatgagaagaaaattagcaaaattttcaaaaattttgctcataggagtccagaaaaatcctgaacattttata

SEQ ID NO: 53052 - DNA, 1218 bp, Heterodera glycines
  Genomic contig location: Contig_ID=SeqID_22382; Location=107..1324; Strand=-
  SCN-specific regions: Sequence locations=1-174,196-519,558-784,806 -944,966-978,1005-1218
atgagtgaactcttgcgaatcacaatcgcgccgattgtgaagcgtctcaagttgtacattgagacggctcaggaaaatctgacaaaagatttgactgaggaaatcaaaacagatttgctcgcagagagacaaaatctctgtagagcagtgtcattgttggagaaaaacaatgacaagtgggaggcagtcttccacagagttaaaggtcctgctcttcaggaggaagagcagaactacaaggactacaaacctgaaggaaaagccttcatggaatgggccgaccaagcccgagggcttgtcgataccattgatagggctttaggcctctcagagcaaggggacgatgtcgttcaccatgctcaggttcaacaacctgctcaaaacattcagccacaagttgttgtggctccgcagcgtcatgaagtgatgctgccgcccatttcccttccaaagttctcgggtgagccccgagaatggcctttgttttggaagttgtttgagacttcagttgaaagtcttcaaattgaagacttcaaaaaacacatttatctcttgggatgtcttcccgagaagtcagttgctcgtagagcaattgatttgtacccgccttcagatgaaaactacccgcgagtggtagaaatcctcaagaaaagatttggggatgagaagtcaattgtggagacactccaatcagagttgctccatcttccaaaaccttcagattcggttcaatctctgaggcagttctcagagtccattgaaaggatttgtcagcagctgtcagattttggagaaaatgaacaaaataagttcatggcctccacgataaagtccaaattgccataccatctcctcactcaagtggtggagaaggaaatgcgttcaggtggaacatttgattgttccgacctacacaaggcaaacacttccattgttgaagtgaaggaagaagtacaaagatgtacacaagtcttccgtggggaagaaaaaccccgaaattttcctcctcaaatgcagaggaacaatttccaagggagaggaacaaatttctctcccaaccaatttcgtcagggtcattggcgacccaacaacagaaatgagtctgtggggatgatgtctccccaaatacacagatcatttaacactgtcaatccgagggtgttgtgtccgacaacagtttatatataattttatttggagcaaacaattatcattaaa

SEQ ID NO: 53053 - DNA, 966 bp, Heterodera glycines
  Genomic contig location: Contig_ID=SeqID_4069; Location=615..1580; Strand=+
  SCN-specific regions: Sequence locations=1-57,212-544,567-731,753 -873,896-966
atgcattccatgaacatttatatttgcatgacagaaattataaaacacgagcgtcatcgtaacgaaattgaacagcaacgaaacgccagtgaaaatcatcgtaacgaaattgaacaacaacgaaacgccagtgaaaatcatcgtaacgaaattgaacagcaacgaaacgccagtgaaaatcatcgtaacgaaattgaacagcaacgaaacgccagtgaaaatcttcgtaatcaaattgaacaacaacgaaacgccagtgaaaatcatcgtaacgaaattgaacagcaacgaaacgccagtgaaaatcatcgtaacgaaattgaacagcaacgaaacgccagtgaaaatcttcgtaatcaaattgaacgcaaccacaaagatgaaatgaccaaactcatcaatgagctcatcaaccgcattgctgagcttgaagagcaaaatggccagctcaaacaacaagtggcggagcacgagcgccagcaacggggtatctacattaatattgggatggcccattccctgttcattctaggcaaaaactaccagcaaattaatttttaaagcaaaaaagtgtcagacatttcaccaaaataccctttttcagccgctggtcgtggtgcccatcggcacgccccgtacccaataagaggcgataagtcaacaaatgttgaccaaggccaacgcggtacagcatcagccgctcctagtgctgttcattaatttaaaattaccttatttgtacaaatgcaatttccagatattaatttcgaagcacaaccaccgaatgccaccgattccgcacaaccggagttgacggcgccagcaatggcaacaaatgacggcactaattatgattttgccgaactttcaccgacttccgctccgacacagtctttggcacgtaatgacggcacgggtggccaactcatgagccactcttcttctggtctttttaataccttttag

SEQ ID NO: 53054 - DNA, 854 bp, Heterodera glycines
  Genomic contig location: Contig_ID=SeqID_22385; Location=575..1428; Strand=+
  SCN-specific regions: Sequence locations=1-20,89-107,155-172,379 -420,455-503,563-676,700-731,788-788
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 53055 - DNA, 226 bp, Heterodera glycines
  Genomic contig location: Contig_ID=SeqID_22386; Location=94..319; Strand=-
  SCN-specific regions: Sequence locations=1-226
atggcatgcggcgtattggacaaattgcctgagataattgggcatcgaagcgtgctcagcacttggtaccgggttggcatggctcaactgttcgccaaacgcttgttggttcaaatgccacgctgtggaccacgagacacgccatggctgttctgtttgctgtgccggtcgagcgcggaacggacggcactccgcgctcacttggccatgaatggcattgagacga

SEQ ID NO: 53056 - DNA, 1299 bp, Heterodera glycines
  Genomic contig location: Contig_ID=SeqID_22386; Location=447..1745; Strand=+
  SCN-specific regions: Sequence locations=1-123,146-157,210-322,364 -436,458-657,710-753,808-986,1009-1181,1204-1299
atgacctcaaaatgtataaactgtaagctccttgtgtacccatggtttgccaaactttgcagatgtgaaccaacgcaagagtctcgtgcaagtacaaatccaccatcgccagcatggacaatcggaaaaaggatttatttgttttggtaggacttggatttaattatttaattaatatttaagaattatttgattttttttttattaaaccttatttgagtttaagctagcgcaagtgtaatcaccaaatgtaccgagcaatttttcttcaccaactgatgatagtgtggtaatgccaacacattccgagatgtcttctatctaatttattatttttaatgtttaaaatttgaaaaaaattttgcatgggtctaagattataattgaaagtgtgctaaaccgaacccgaatttctggatccaggaagactgaaaatgggagttctcgtctttattttactaaaatcccggactcggatcaggaataattcttgtatctaaaaactctaatattcacgaattccctacgggctaaatttatgtttgaaaatattactaatatccatccatgctttttgcatccggccgcaattaattcaatgtcaccagctgggcatccatatgaatgtgtgacaatcactgctctgtacaaatagccaaaataattatttaataattatttattattaattatttattgttttaattatcactgaaaataatcggtcgtaattaatgataattctgattcagctttataaattttatatttgtttaaaattaaatgttttatgaaaaagtttattttgataacaaaaaatgcataattaaaggggcataaattaaaatggaaaattcattttccaatttgtaccctccaaaatcattgaaaatctacaaaattcttttgcaatttttctctcaatttttgaattgtttttcacttgatattttcctttttcttctttttttaattgcttcaaatgttctaattattctcttttttgttcagtatttggtcccatttttgtgttttgatcacttttggtaatattttgatcattttgcatttgatcaattaattcggttccattttctgtattttctttgccgaatattttattaaaatttggtcggattttgcaggattcaatttcaaaagcaaagaaaatattgtataaaaaatattatatgtcataaattcattttggaatatcgaatttattgcattaaatgaatttgtttaattttttgtccgctttttaatactaatattaattttatttgtattttctcttca

SEQ ID NO: 53057 - DNA, 76 bp, Heterodera glycines; identical to SEQ ID NO: 51705
  Genomic contig location: Contig_ID=SeqID_22389; Location=909..984; Strand=+
  SCN-specific regions: Sequence locations=1-76

SEQ ID NO: 53058 - DNA, 702 bp, Heterodera glycines
  Genomic contig location: Contig_ID=SeqID_22391; Location=811..1512; Strand=-
  SCN-specific regions: Sequence locations=1-702
  Gene Ontology: Biological process=growth
ttatcagacagaggcaaccgaccgatggtttaagggatggcaggagcagtgctggacaagcagaagtccaaatacaacgagttagaagggcaatatctgctcgagtggataaacgaaaaggtgaaagactcgcagatttccactgccggacagcgcacgaatttttgggagcaattgaaagatgggactttgctgtgcaggtgaatggaatggcagtgaccagcggacattgaaaatttggcaggtttttgaatgcagtggagcccggaattgtgaagaaagttatgaagccgatttcaaatttcaagtgattttgctggtcatttccctccctttgctcaattccctcccgttcagttgtatggagaacatcaaccaatttgtcagctttctctttatttatatttctttaacccataattcaattaatgggtcggcataagttttgtcctattttgagagaggcttttttcttaggtaagcgaggcccgtaaaatgggagtcatcgaccaagagactttccaatccgtggatttgcttgaaggtcgggaccttttctctgtttgtgtgaccctccaatcgctggccagaaaggtatgaaaaaaaaaaattgaatttctgctgaaatgaacgtttcagatggaaaaatcacatggaattgcgcttccgaagcaagtgccaaaggataaaatatgaagggaa

SEQ ID NO: 53059 - DNA, 988 bp, Heterodera glycines
  misc_feature (411)..(411): n is a, c, g, or t
  misc_feature (467)..(467): n is a, c, g, or t
  Genomic contig location: Contig_ID=SeqID_22394; Location=316..1303; Strand=-
  SCN-specific regions: Sequence locations=1-191,214-249,333-343,379 -712,734-988
ggggggggaaagcatcgaataaatgccaaagccattggtcgaatgaatggcatccaaatgacccggcacttacggtcagaaacattgttcagattgccgcatgtgcaggatgcaatcagatggacgcgtggggcacaattgtgacgggggtcggcgccgggcttatttacatggcactttcaggacttatgctaaggcaagtaaatgcaaaaacatcaaaataatgactttttatatctctttgctccgtctctctctctctctctcttttctccctctctctttccctttctctcattatctctcttttttctcttgagtttctctctctcatttttacactttgtctcttttttctttcatttgtccgctcagattgcgcatcgatgatccattggacgcgttcgcgtnccattcgggaggcggtctctggggattggtttccgtctgtttggtcagcacttccnctggccgtggcgtcgtgccgtctttggccaccggcgatggattggccatcgttcgttctctggcggtaatcgaatgcttttcccccgcctaattaccctccgccgatgaagcaactcggctggaacattctctcctccttggccattatcgtttggtcctccgccgtcgttctccccgtctttggactcctcaaaataattggcaaatttcgagttgcgcccgaaattgagcagaagggaatcgacatttggaagcacggggaagaagcgtatccgctcgtggcttatgggcacggatgggacgaagcagaaaaagtaaaacaaaaaaagagaaacgaattgcgtgcggaggaattttaaggatctggaagaagaaattgcatggcatcccatcgcgacaatttaccacgacccaaacaaatatagggagacggacggaagccgaaaggtgagcgaaaggagggaaatggggacaaaatgaacggaaagcgattaattggtcttacagaggaccaatggaa

SEQ ID NO: 53060 - DNA, 203 bp, Heterodera glycines
  Genomic contig location: Contig_ID=SeqID_4073; Location=291..493; Strand=-
  SCN-specific regions: Sequence locations=1-203
tcgacctttaccaagtgctgatgcccctcatcggtggaggcgttggccgtgactgtattgtgcacgtggacatcgacgtggactcggagatgcgctacccgaagggggcggcacgcatttgcttcagtcgctacgacgcattcgtgacggcaattaggaagcaattcgtcaacattccggacggagacggaggcgtgaaacgc

SEQ ID NO: 53061 - DNA, 394 bp, Heterodera glycines
  Genomic contig location: Contig_ID=SeqID_4074; Location=512..905; Strand=-
  SCN-specific regions: Sequence locations=1-394
atgcccaatctttgtattgttaaatctaaccgcaggggtcgttttgtgctgatttcgaattctgatgaaagcgacaaggagaactgcccctctacctccactgccatcccacaaaataatgaagttgtcaaatggctggtgttggcggacaaaaagtcgacgattcgttgcagcgaatattcgcgaaaaacagcttggggaccgtgtgacggagccgacggaccggtggaaggctgcaaagaaaattggaagaaatggggccgggtccaatttctgcgagcggtgagaccaattgtattaggaatgtgacaatgaaacatgaaatgaaagaaattgatttcaggttcgttccaaatgcagtgattactttggggagaagacgaactctgtttga

SEQ ID NO: 53062 - DNA, 142 bp, Heterodera glycines
  Genomic contig location: Contig_ID=SeqID_4075; Location=116..257; Strand=-
  SCN-specific regions: Sequence locations=1-5,27-142
atggtaaaaacaacaaaactttcacatttgaaaaagtcgcgcaaacgactaaaacccttaactggtcaagcaacttcatcattagcatcttcatcatcgactatttctacaacttcagctcacaaacagccgtttgactgtg

SEQ ID NO: 53063 - DNA, 1997 bp, Heterodera glycines
  Genomic contig location: Contig_ID=SeqID_4075; Location=613..2609; Strand=+
  SCN-specific regions: Sequence locations=1-125,152-340,362-417,441 -865,889-1019,1043-1185,1210-1514,1536-1799,1832-1997
atgaacaaaaaggcggttttttacaattattcgttctactcgagggttatcggggccgctgatcacgaatatgacatcaggttatcgtatgacataatctaatctatgattttttgtcaagtctatgatttacctttttaaaattttgaggtgtaggcccaaaacctacaaataccggaaagtgttatattaaaaaaccccggactgtcgtccaattgtcccccttttcgtaaatgccacagtttttgaaaattagtaaagtttcgaatgccgtttttcgcggtggaattcgttggttttatgctaccccatgaaaaacacttacaattagtaatttcataagggaatagtaaaatataaaatggtaatccgcactcattaaagcccttgaaattttcattttctttggaaaatccgaaataaaaaaaaaatttttttttctcacaaaggtccgccaacatttcaagcagaattcgcggattttcttcgccaaaaacaatttgatggccgtggcgttgggcaaatcggcacaggacgaacaggttggagagggaaaccaacctaaaaactgtgacttttacaagccatggcaaaacgctcaatttcaacccaaccccggacacactgacaaaaaaaaaattccaaaattttttggtttgaacaactcataatttgggagtcaattttatgcagccataaaaggcttttattggcagattttttttttttttggtttatctgacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttgacacatgccagaaaaaattaattagcattttgtttaaaattcgtgcctctcccgccctccctctaaactaatggtcgtgcatctgtttaatgccaaaatttttcaaaataaattacgcaaaaaattcccactttctcttaaggacattttcatattgagcaataaattgaaagttgtaacaaaaagagtgatttttgaatgataaaaaaaaataatagcaattttcagaaatttcctcccccccccccccttcggaagtaatttaaatttaaaaaaaaataacgcactccccaatttaggcaaacgaattgcacaaagtgagcgcacttttgcggggccaaagtggactgatgttcaccaatgcgaaggcaaacgaagtgcaaaggtcggcgggggacaattccaattttttcgtaaatttatttttggtcgttcgggagcacattttgagtggaaattcgaggatggcacgaattcgaagccctttcatttttcgtttttttttcgtaaatttatttctttccttttttggcgggtgctcatttggtggaaaatttttttaaaggttctacgaattcgaagcacctcccttttttccattttgtttgcatttgccgtcccaatttttaaaacagaaaattttttcacttttttttttactttgcgacgctttttttaattcattttttttaatttcaaaggcacttacacagaagagacagtaaatttatagtcagtcgtatgtcctcataattctatgattattcatcttgtagcaaaatttaaaaaatttctgagtaaaaaattttcaaattttttagttttccattttcgttccggcgaatggaatgcttttgggcccaaaaagcggcaaaaattaaaaaaatcttataaattaaattttctaaggtttttcgccgagcacaccgaggctgagtttgcccaggcgggcgccgtcgcctcggcggacatttcgctgccggccgggccaatgccggcggaattgcacttgcacggcgccatggaaccgcagctgcgcaagttgggcatgcccacacggctggaaaatg

SEQ ID NO: 53064 - DNA, 88 bp, Heterodera glycines
  Genomic contig location: Contig_ID=SeqID_22398; Location=236..323; Strand=+
  SCN-specific regions: Sequence locations=1-24,46-88
atgaaaggaccatttgattggtacattgtatcaaaaatgcaaaaaccgataatcgtaaatataattgctctcgctaatctcggtaccg

SEQ ID NO: 53065 - DNA, 705 bp, Heterodera glycines
  Genomic contig location: Contig_ID=SeqID_22399; Location=1581..2285; Strand=+
  SCN-specific regions: Sequence locations=1-271,295-586,618-705
atgtccgtcattgcttgccatgaattgatgcacgcgcttggctttcatcatgagcaaagccgaagtgatgcccggaattacatcattttatgggaaaaggacggagtaattaacaaatattttcaataatttttcatctggttctttatatgtaaagcaatcggaaattgacccatacacccaaaactttggcttcccttacgatttcggttcggtaatgcattatccatctgggggcgatcatgaagagtaagaaaaaatttaattttaatgaagtaaaattggaattaaagaggcttatacgacctgatcactttgccacggttttaccaacaaacgattggccaaaatgaacgaatctctttcaaagacgcggccataattaaccaaatttattgcaaaggcacataaatttaaataaatttcagaaaattatcatttgttcagactcatgcaaaggccatgaggacaagtgccaaaacgggggctatttgaatccgaatgattgcacaaaatgccattgtccggacggatacggtggcaaatactgtaaagaactcgaagagagtgagcaattaatcaattcaattaaaaataaattataaataaataaatttgaagatttgaattgcgaggatttgagtggaattccgagagaattggtggccaatcattcagcagtgttattgaagacgaaggccaaat

SEQ ID NO: 53066 - DNA, 645 bp, Heterodera glycines
  Genomic contig location: Contig_ID=SeqID_22400; Location=752..1396; Strand=+
  SCN-specific regions: Sequence locations=1-21,388-390,613-645
  Gene Ontology: Mol. function=ribosome receptor activity; Cellular component=integral to endoplasmic reticulum membrane; Biological process=signal transduction
atggggcaaaggaaggaagtagggaagggaagggaagggaaaggaagggaagggaaaggaaaggaagggaaaggaagggaagggaaaggaagggaaaggaagggaagggaatggaagggaagggaaaggaaaggaagggaagggaatggaagggaagggaaaggaaaggaaaggaagggaatggaagggaaaggaagggaaagaaaaggaagggaagggaagggaatggaagggaagggaaaggaaaggaagggaaagaaaaggaagggaatggaaaggaagggaaaggaaaggaagggaaaggaagggaagggaagggaagggaagggaatggaaaggaagggaaaggaaaggaagggaaagggaagggaaaggaagggaagggaaaaaaaagaaaaggaagggaagggaatggaaaggaagggaaaggaaaggaagggaagggaagggaaaggaaaggaaaggaagggaaaggaagggaaaggaaaggaagggaagggaagggaaaggaaaggaagggaaaggaagggaacggaaaggaagggaaaggaaaggaagggaagggaagggaagggaagggaaaggaaaggaagggaatggaagggaagggaaggagcgagtttcaaaacaacccgcctgtagaga

SEQ ID NO: 53067 - DNA, 980 bp, Heterodera glycines
  Genomic contig location: Contig_ID=SeqID_22405; Location=146..1125; Strand=+
  SCN-specific regions: Sequence locations=1-275,299-343,380-594,617-980
atgaaaatggaaatggaggtggcggtgtgccgcaaccgccaagcgcaggaggaggtggcacttgcacggacaaaggcaccggatgtgagccaggcttttgtagcagcacagactttgctcgggcgcactgtgccggcacatgcaaacacgttttgcaagagtgcagtcatttggcttcggtgcccgacccaggtgggtgatgaaattttaagcatagaaatctggtttctgttatatttttttgtccccgaaaagcaaattcaaaaacaaaaaagaataaatatatatatatatatatgtcgagaattgcgattgagggacagaaaagtctcgaacttggtggtattttacaaaaatattaattaattaattaatttttgacatagtaatgttcttgcctattcagccaaatcatgcaccgaaacggccgagaactgtggcactataccggacatttgcaccgtatgttttttgtcgtttttttaatttattggtttagtcagctagactatgttccctggtctctcttgaaaattaaaaaaacgacaaaatctcgcccggtgggactcgaacccacggcctttcctcaccttggaatgctctaacagactgagctacgggcgctcccttttttaggatgacactttggccgtttgtggttgtgctcacacgtgcaatcgttgccatcaccaggcttcatatatggcacaaggaaggtgcaagaatgtgcagtaatgggatcaattggcacacagattacagtaatggtctgaaagcattggccctatcgtttcccatcatgtaattctaccggacatacaacaaaaataattcatttttaaatctatttttctccaagcttgtcattagggtgtttatttataaagacatattttataaaatatgaaaagatttctaagtaacagaatcatataaaattcaagcccagaagcttattaaaaggcgattagacattaaca

SEQ ID NO: 53068 - DNA, 925 bp, Heterodera glycines
  Genomic contig location: Contig_ID=SeqID_4076; Location=560..1484; Strand=-
  SCN-specific regions: Sequence locations=1-99,123-202,238-471,504 -839,906-925
atgaatattggccccgtatttatttcaactgaagtttctttccctctaagagacaccacaggaaccgtcatgtcaggggttagtgtgcacccactgctctattaataaaaaattaaacatattgaacattaaaggcataatgaataccccttaattctccgctgactgtaaaaaatggctgcatattggagcaatgttcttgaaaaatattttgtatttaaaaaaaatttaaatatacccaatgccgttgcatctgcattcgtagtatttaattgtagggaaatatacccaatgccgttgaatctgcattcgtagtatttaattgtagggaaatatacccaatgccgttgcatctgcattcgtagtatttaattgtagggaaatatacccaatgccgttgcatctgcattcgtagtattgtagggaattattgttcggcagaagtcgacacattgagaaggaacaaatttcaataaatttatttaattaattttattaaaattctactcaaaaccattggttgaaaaaattaaaaacgcaacaattcgtctcttctcaaacatgtttttatggtaattaatataaaatttttggtctttcaggtgtacgtccttcaattttttatttttgcgaatttagccttggggcatatttttataacctttgatggaaacgcggaatcgtttttttgtattaaactttagtctggtatttattatgtgacacaacaaacatattattttttgtttttatacgcgtcaaacgtccttgagacattgcatgttccttaaaaattgttcatcaaattatttactaagttatcctaatgcaaaggtatgataattaatactataacaaatatgataattattttgattaaaataattatggaatttatattaaaacacaattgaaacgtaataaa

SEQ ID NO: 53069 - DNA, 1556 bp, Heterodera glycines
  Genomic contig location: Contig_ID=SeqID_4076; Location=1795..3350; Strand=-
  SCN-specific regions: Sequence locations=1-499,521-717,739-891,935 -1111,1135-1311,1364-1476,1498-1556
atgagtcatatttattctacattgggtttgaacaaacattcaacatccgctgaaattaactccgcatataaacgtcttgcacttcaaaatcacccggataaggggggcaatcccgaacaatttaaatcaataaaagatgctttcgaattactcactgacaaaaaagcccgtgattttttggacaccttcggtgaagcatcggctagggcatatttatggtcccaaacaaatattattgaattctcatcggactccgacacggagagtaatataccgggaaattctgactacaacaccaattttgcgggccgaacaccaccatctcggtccgaaaactggagcaattcttcatcagcgaattgtgaagctgcgaatcaaccggaatttgactttccgagtcccgacaacaacgattttctcgaccaactaataagtgggattgtgcattcagacacggaagattatcaacaaccgcatcagcaacaacaaggtcatcttcataatcatcatcattcccatcgtattttgttatagatggagaatcaaatttcactgggaatgatggacaacacagccaacagcaagaccaagaggaaccaaccatccgaaatctacgaccgcgtaagccgcaacaacaaaaagaatataaaaaaaccggggttcgagcaagacgccagcgaaaacatcatcgtcgtggaacggataaaagcgttagggtaataaatacaaaaataaatcctttgaacttttaaagattgacgcaaacccacgtccaaaaaatgtacaagcggacaaaaaccagaaatattgtgtaaaaaatatcttggcattatttacaacgcttgataaacacggtcacacaaggcacgcattttacatcgattggaaaggtattaaaatgattatttttaaaaaattaatatttagaaattaaggtcatgcagatcgtgaaagctggaccttgtctgaggatttggacgcgctagacactgcaatggattttgcagcaaatgcgcatcaaaatgccacagtggaggccttaaatggcctaagcgtgccccaatttgtgctgtcaaggctcaccgcaaatcccgaatttatcaaatgtttgttaataaaattaaaaattaaaatccaaattttagtgtgccgacgccttaataccaaaattgcgccacctgctcctaagaatattctattctcatcgaattcttcagttcgccaaaaaaataaggtaaggaaatatgaccttagggattgttttaaaaatgcttaaaatagataaggtatacttttctctaaaagttcgggtttatttaaaatttatttacaaacaataaataaagattttataagataatttcatgatcaattcatattcttcttttcatctaatgcttatttaattcttaaggccatcaatcagcttgattcttttattgttgagtgcatgactaatgctttatggcaaggagaattagatgattcagatgatgaataatatatgttttaatcgatatcaacaatttagtgttttctggtaattcttcaataaa

SEQ ID NO: 53070 - DNA, 531 bp, Heterodera glycines
  Genomic contig location: Contig_ID=SeqID_4076; Location=3480..4010; Strand=+
  SCN-specific regions: Sequence locations=1-53,152-288,406-531
atgccggccgtaaaaatgaatttaaattaacacggacaaattatacttttgcgaataattgtattttttattaattttattaaattttattataatatttttagtttttaataattaattaattaatttatttatctaatatgtattaaaagagatatgatatggatgtatttgtagttagggactgagctaaatttataactcagttaatccttcgtacaaacacgacgctctaaaggtctgagctatttaataataactcagattttcttaagagaaataaaagacaaataaattattttttattaattagtattaatttaaaaaataaaaatatacttttcttaattaacattaaattagtatttaataaattcattttatttaatcaaataatattttttagctgatcagagttcgtttcagcgttaaacgatttatcatgttttttcgacccgattcattgcttaaataatgaatccaagccttgccatttgggtggtcttgtttatttagcctttctagaactca

SEQ ID NO: 53071 - DNA, 2293 bp, Heterodera glycines
  Genomic contig location: Contig_ID=SeqID_4076; Location=4287..6579; Strand=-
  SCN-specific regions: Sequence locations=1-65,128-391,427-463,486 -508,533-646,670-1067,1097-1495,1517-1611,1646-1659,1681-1757,1780 -1916,1938-1967,2027-2165,2188-2256,2278-2293
atgctcgcctccgtctctaacaatgcgtggccggccacctgcggtgctaccaaaacagaaacatgtaaaaattaattatgtttttaattaaatttattttatttactaatgtttattaatttatattcatcattgtttagctttttatgtgcgaaggcaaacgtcgctcctttgttgcatttttttaaaatttggccctgtgtacgcataaccgaaaagtacccaaaaaaactccatcatcatgaattgtgcagaataagatcataatggaaaataatcttatgttagcgcccaaacagtaattaaattcgtaatttaattggtgttttatgaatttcttcattattatcttgaaaatcattcttatggaaaataatcttatggtttttgcattttttttattttaatgattaaaaataaaaaaatgaattgtttgaaattgcaaaattagttgttaagatttgcatcatccaacttaatggcaaacaaataaaatgtcatatttaagttgagaattttgtaataattttaactcaaaaatatttttctaaaaatcagcgcctaaaaaatcggtagaagcaattgaaaagaaaattattaaaccaaaaataaatttggaaaatgaattgggtggacaaaacgccacagtttcaaacatttttcaaatgccctctcaacgaatatttgcccgctgttgtggcttatcacggcttttatcacaaagtgcaatcgaaaacaatcgcaaaaattgcactgaatttgattttgccgttttgacctcacaaaattggtccataaaaaagcagcagaattctaatgagccaatttttgatggcattttgacatttgatcatttttcggtgattcgccaaaatgaatttgaatttgacgacgaacaattggcgggaaatttgaaaattgaatttaacgaaatggtggaaaaggtcaaagacccaagggaaaggacactcccatcagaatagagacaaaaaaagcagatgaattggctgaaagatgtgctgtttatgagcccagaacaaatcataacccatttaattatccaaatcaaataaatattcataaattaaataaaattcaggataacagaagcacaacattggggaaagacttggtgtgattcgtcggtttgctgctctaccgaatgttgttcaacaacaaacatcccatggacaattgggagccaaagcgccgtttggacatggaatttatggcaagatgggcttctccaagttgaaccagttcaatggcatgtacaaaacggacgattttgtgccgggagactttggcatcgttccattgaagccgaaaactcggtggatttggatgccggagagtgggcgagacgaaactggggaaatggcactggtggaggaacggattggcatggaacaggtggctgccaattaaaatgtctaaatggtgtaattaattaatgattattatttaggattatatcgtcaaattgagaagcattgtcagtgaatttctgcagaataaccaaaaaatgcaattcaattactcaagatttgctgctgatgaagagaataatgcacctcagaaaaaattgtttgatctgaccaaagtaattagaattaattattcaattatttatttaaattaatttcaccttaaaatactaaaactaactaaaaaattattcgtttgaaagaagaaaaaaaaataatgcaaaaatgaaagcagaaaagcataaaaaaatgaactaaaagacattaaaaaatcatttttactttttactcagtgttgaaaaatgagcaaaattgcactccaaatcggtgttggtgtctttaatgagatttaaatttttttaatttcagaattctgttagcttttacttttatgaaaaacaattcatttattgatgaatttaactgcaatttttaaaatttaccatttatgattcccgaaaatttgtaaaaaacatttccatttatttttctaatttttaaaatagtattcaaattaatttacttgataaattaaaaaagaacttttacacgaaaatccctgaattttcacgaatatttaagctgtaccactatgttgtcgatcaaacattcccaaattttccaatgcgtaaacatgccgactcttgaggatttctgtcagcagcagatgacaaatctataaaaaacaaaatctgaaacaaataggaaattttttcaaacagcaaccgtcaagaataataattttcattccctccggctgggcgagttataaataagaaattaattacaacgacgaggaaaataaa

SEQ ID NO: 53072 - DNA, 780 bp, Heterodera glycines
  Genomic contig location: Contig_ID=SeqID_22406; Location=200..979; Strand=-
  SCN-specific regions: Sequence locations=1-144,168-310,332-780
agcagtgctggttcgtttcatcacggcaccgaaccttttggctagtcagcaatcgttgcttacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgatttttt

SEQ ID NO: 53073 - DNA, 916 bp, Heterodera glycines
  Genomic contig location: Contig_ID=SeqID_22407; Location=111..1026; Strand=+
  SCN-specific regions: Sequence locations=1-411,433-492,514-778,821-916
atggggatggcactgttgatcatgctcatcaaccttgccggaacgatcagcggccaaccacccattcgagcatcgggaatggacccgaaccttccatttcgagagggcccaagagtcccatgcaccaaggagtgtgcagaacgagttcaacacaacgaggcgcaatgccaatcggaaaacgggttcgaaaacccgttgctacaactcatggacacacgcttcggagcttcaactgtcaaggggcgccgcgggcaatgtcgccaattttttcattggcgacgagaaggcgggtcaatccccgcctattgcacaaatgaacgggacgggactcaatcgaagcaaaaagaatgagggatgttcttggagaagatcggggcgagtcccgattcatcaattcattcaaaattgatcattcctaatttttgccccttttccatccaatttctcatatgcatttctccatttcgtaccattcacattttgcccgttcctttgtcccatttttgccccatcgcatcccttcacaattcaaatcttttctcatcggttggctcatcttcggccaactttgtgctcagcaaatttcctttcacaatttctcacttttcacatctgccaattcacattcaatttttgtgcacccatttcctttgttcgcaattcgcttctagaattttctgtccattttttgtccctctcacaatttgtccacgtgcattgccttttgcccgcccccttcgaaaattgtctatttaagcgcccccggccaaggggtcgctctcctctcttctcttctcttgcttccactccccttcgcttcatattcggtctgcctgtgaccaattcctccaattcccccgtcccatcgcccaattcgatcaattcgtcgcttttattcattattcgttttgcttta

SEQ ID NO: 53074 - DNA, 3146 bp, Heterodera glycines
  Genomic contig location: Contig_ID=SeqID_22409; Location=146..3291; Strand=+
  SCN-specific regions: Sequence locations=1-166,199-227,249-304,326 -442,478-570,592-600,622-735,945-980,1002-1048,1095-1165,1187 -1245,1304-1427,1451-1501,1523-1707,1730-1743,1766-1859,1886 -1998,2055-2272,2300-2403,...
  SCN-specific regions: Sequence locations=...2426-2629,2652-2684,2721 -2846,2896-3043
cagtcaatctttacaaaattgatcacttgcactgtgaacaaagccaacaaacaccatggcacaacaaatgatgactttttgtccaaattgcattttgacgttttggcacaaatctgtgaagcggatgatcaaatgaaagaaaatgtgttgaaaaacagtaagccgcaaaaaatttaaaaataaaaatttagtaatttagaaattcatttgaaggattttttaaacgcaaattggtacaaaaaatttttggatttacttgagaaggtaagaattattttttcttcatttgttaatttgttgttacattttggcaaatgctttttccaaaaatacttattttgaatagcaacgaaaatgccaatagaaaagtctaaattttcgcgatttatgttaaaacgttatggccaaaaactatcaaaaaaattataaaaatcctcaaacgtaataaagaataaaaaaatttatcttttttatttaggaggatgaatatttttctgtatccgaaagttttaacgaatctgacggttcagaaaatgaaatatttgatgacccatcagaaacaatcattgaggaaaatgaaaattcaaagaatttaatggaaaaacattcaattaaaaatatgaattttgaatttggtgaaaaaagtgcagaaaaatgtgaaaacaaaaatttcaaaaacaatttaacaacaacaaaaatggatgaaaaaaacagtgacgacgaatttttggcattaaatacagaaaatgaagaacaatggacaaagaaaaaagagcagcagaacaaaaaagcaaaaaatattaatgtaagaaaaaataaaaataataataattcggagaaagaaatgacggaacaaaaaaggaaaggaaaaaatggcaaaaataaattggaagaaaatgatgagaatttaaatttaaataaaaaaaattatggtaaaaagaaaatgatggaaaattttaatgctgaaaatgaacagttaattgagaagaaaaatggaaaaatttgcaagaaaatttttagtgaaattggcgtcaataaattaggaggcaatatttttttcaatttatttttcgtttttttaaattttttattttgtttcaattttaggtataaatttttcaattattaacgctaaattttcttggggtttttgggaaagaaattgtcaaaataaatttttgtttttgcagaaaataaaagtgtcgcttatttttatatttttaacgcttattgcttttttcaatgatttaaaattaaaataatttttattttttaaagaaacatattttaatttatttttttagatttgctggatgaatcaattttcaaaaagatttttcaaaattttttggaaaaacattgggaacctcaaagcatggagaagcaatgcttggaatatttaggcacaattgcattatttgccagagcaattcaagcaaaaatgaattttattgaacaaatgtcgaaacattgggcaaataaatcggtgaatggaattgccaaaaaatgggaacattttatttttaatgaagaaattatattcgaattacaacagcaaaatcaatttgtacaaatcaaattgtattttctgcacaatcagcttgatgaatatgcttttgagtaaatatattactaattcacaaattaattcataaatttgttgcacataaaaaaatggcatttttcgtttccttttagataatagttttgaaattttaatttaataagcacctgtaacacgaaatttgatattttttaacaattaattagcgggaaaatttttaatttgaaagcgtcttttgagggttttcataaagcatcgatgaagaattgttatttattatttgaaactcattatgaaaatatatttaaaaaaattaatttagtctaatatttgtttcaggcaattaataaattttcttgaaaaattttttcatttttcattttgttgggtagggcggggaattcctcccaatttcccccttgacttcgggcctgattataataatttattttagtctattctaaatttttatttatttatttattttattcaggcaatcaataaattttcttgaaaattttattcaaataattgatgaaaatgagacagacaaaatcaaaaattatgggaattattcacctcaatcaccaaataatcaccaaacaacccaatttggcacatataattctgatgaattcaatgcaatttttgccacattggaaatgcatgaatgttcgatgctaattgcaaaaggagtgatcaattttgaaatgatcaaacaaataaaattggcccattatttaaacggtgaaacattttcaaatgcgggaaatccgccgtcaaaaaaatgcttatgtgttgatgctaaaattgagcagcaatatgtcgacaagctaaagaaaatgctaaatcagaaaaaattgggtattttttttaagtttcactaatttaatgttttttgatagttattcaaaatcaaaatttttatattataacttttgtggcaaataattgccaattatgtaattactcgaaactttttattattcatttttaaagtatctatttttagatttatatttacaaacccaaaatttttctgatcccgaatttggtcattacagtatgataagaacaaagatgaaaaatcgcgaaatagaaaaacaaatttctaaggaggttaatttaaattgaaaataataatttttaaatatttgcatttttagattcaaaattttgtgtcacccaaaattaatccgattaaaaaagaagcaataaatatattaaaactaaatatcaaaacatcagtagagaagtggacagctcaatttacagcaattagtaataattattaattaaaattaactaattgatatttcaatttattatttgttttagaacctcgattgcttgttggtggttcacttttaatgaatggctttgtggatggatctgacatggatttgctctgtgttttaccagacgaaattaaatttgaccaattatttaatgaagaggataattgcttatacaaatttcttaaaaaagtaaatttaaaaaaatattataaaaacactacagaaataaattaatttaaatttttaaatatattggctaaaaataatttgaaaattatatttaa

SEQ ID NO: 53075 - DNA, 1138 bp, Heterodera glycines
  Genomic contig location: Contig_ID=SeqID_22412; Location=936..2073; Strand=+
  SCN-specific regions: Sequence locations=1-194,217-573,595-644,673 -1101,1127-1138
atggggcagaagggtcgtgtaagtagttaacatcccgtacttgtcgtcagtgcgcgaaatgtttttcgcgcacaaacgccagggtgtcgggcggttttgtgtttgaagttgccgcttttggcatgtgttcgggattggtgggggcgggattctctttgaaggggccgacatcccgagggtattggcgggtttcgggaagtgattgattgattgatttatggtcgggagagggggagggggtgctaattgcgcgaaattttgattgatttatggactcgaaaaagggagggtggtggtagggggaatggggaatgcagcgcgagttatcgcaatgcgcgaaaacaatagggaagaaattaaagagggggaggggggggggattaattaatgaaatttgatggtgactgtacgatggattagaaagaatggaaataagcaattctctcattttttttgctcaaacaatttctttttctggggggggggatagattttgaggtcaatgagtgaccattggacgcctttaactattctccaattgattttcgttgcgtaatgccgtccaatggtcatccattggagtcaaaaatctcaccaaaaactttatttatttttttgcttcttttttgttttttgattctcacataattaattgaaataaaaaatttttttcttttacagacaaattgtcggtggcttcaaaacggacctgcgcttccaaccaaatgcgacaacaattttttctacaacgactggggcgggaaattacaccgccaggcgatttgccagcaccaaaaagaaggaagacaacggcatcgcaacggggctgttccgattacatctgcattggtctcagaccaaattgttcaacgaagatcggcaattgtataataaactttacgacaaccgcaccaccgaatatgacgacatcgaaccaacaaatctgcggcgccgttgtccaacatgtcaccaaacataccgatttgtcctggcccgcttctcttccttccgcttccaaacaccttggttgccgaagatgcagaaacaccagtcccgaaaagccggctggattttgttggatgtgtcttttttggtgggttcgattattattattatttgtttttgaaaatttcatgaa

SEQ ID NO: 53076 - DNA, 1186 bp, Heterodera glycines
  Genomic contig location: Contig_ID=SeqID_22413; Location=120..1305; Strand=+
  SCN-specific regions: Sequence locations=1-189,211-445,467-725,747 -838,861-885,924-1186
  Gene Ontology: Mol. function=protein serine/threonine kinase activity; Cellular component=cytoplasm; Biological process=signal transduction
atgtttcaagaattcattgcaatttgcttggtgaagaacccagatgatcgggcagatgccgattcccttttaaaggttcgagtaagaaagacttttctagcgagttttacattttagcacctatttatccaaagcgctaaaggcccaaaagttgtgcgggaaatgatagcaaatgctcaggacattgcggcacagtatttgctgcaaaacgcggtgagcatttgtatattgtaaatttgacgagaaaagattttcagcattatgccaaggcagctaaaggcattgattattacgcgcaactgaacgaggcggcggagggccaaattgagcgggacgcggaggagagaacaatttcgacaaagacgggcctaatgacttatgacggagggacactaatccaacacggagaacagtcgctgaaggcaacggcaggtcgaataacgaataaaataaaaccaaaaaggcaattcagaaaattgtggggtttcggtctctcaaaaggcattccatccgtcggcactctctcagccaattgatgacaatgttagtccaatgaaatcgcattcaaacagaagttaaatgttcattcaggcagaaatgactcaaacggaagccgcaaaaatgaacgttttgtcggcggaattgtcaatggttaaattaacggtggaccaaaagataccaaacactttggacagtcgtcacggagacggcacagttgaattttgggaccagtcgccaagcgcaacatgggaaacgagcggttataacagtgccatggacacggcgtttagacgggcgatgaacggccaaagcgactacagttttgtgagtgttcattatttgggcgggaggggttaatggacgagtttactattgtggggtaactttttaaaaggaagcccccctttccctgagaaagaaaaaacgcgtaattagcaacccgaaacctctgggaatactatgtttattagtttcaaaacaaaattgtcgatgatattaccatctttttatgattgtaaaatttaagctgagggacctttcaacagaagaattggtgaaacggaaggagattttggagaaagagatggagacagaactgaacgagttgcaagcacggtaccacgccaaacgcaaggcgattctcgacgcgatagcactcaaaaggaatgggactgttcagttctga

SEQ ID NO: 53077 - DNA, 191 bp, Heterodera glycines
  Genomic contig location: Contig_ID=SeqID_22413; Location=1531..1721; Strand=-
  SCN-specific regions: Sequence locations=1-152,178-191
ctttgcaattgattgaaattaattagaatagtccatgctttttgttttcgtcttgctcattcacatcgcgtgtgctaattaataagtgagttggatcgctagatatgcttcatttatttcacaccattgttttatgtattactaataaatgcatttaaataatgaaaaataaatttgtacaataatttaaa

SEQ ID NO: 53078 - DNA, 159 bp, Heterodera glycines
  Genomic contig location: Contig_ID=SeqID_22414; Location=1041..1199; Strand=-
  SCN-specific regions: Sequence locations=1-14,52-159
tcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacg

SEQ ID NO: 53079 - DNA, 5069 bp, Heterodera glycines
  Genomic contig location: Contig_ID=SeqID_4077; Location=1034..6102; Strand=-
  SCN-specific regions: Sequence locations=1-88,110-183,208-923,945 -1277,1303-3315,3353-3402,3433-4103,4126-4290,4312-4479,4501 -4723,4745-5069
  Gene Ontology: Mol. function=ATP citrate synthase activity; Cellular component=citrate lyase complex; Biological process=ATP catabolism
atgtcggctaaagcagtgaatgaatattcgggcaaagagcttctttaccgctcactgaaccatgtccaagcactcgtcaagccaaatgctgtccaattggatgagaacacaaatttccaagatgccataattaattgcgattggatcagcaaagagggggtgggcacaacataaaacgattggaattaatttatatattttattattgatgtaattgttaaacaaactaaaagtctttaattagaggcctattttcgaatttttcccattaaattagactttggtttagcaaggtgttctcaagcccgatcaattgatcaagcgcaggggaaagcacggattagtcaaaatcggaacgagcgacgaactcgccaaatggttcgatgaaaaaaaggggcaaaatgttcaggtaagggaaatggacacgtgaaaagaggttttgcccttaaattttcagatcggaaagaccacggggcgtctttcgaaattcattttggagccgctttgcaaacacggggccaaagatgagctttacatcgccatttatagcaaaatgaatgaggatgtgattctgttttacgaggagggcggcgttgaggttggggacgtcgacgccaaggtgttaaatgcgaagccaaacttggtaaaattctgaactatttgaaggcacgtcaattggtggtgcccgttcaacttaaagacgaagaaatggcacttggagagcagtccatcgaccaactaattgggagcaaagtcgaagagacgaagaaaaggcacatattcttggtcaatgcttttaaacttttggtgaatttcagtcttgtcaaacaattcgtctgcgagttgtatgagacttacaagaaaaaccatttcacctatttggagattaaccctttgggtatgctcaatgattttaatggagaaatgatgactttcacttttctcaagttgttcgagacggaaaaatattcattttggatttggctgccaaattggacgaaaccgccgcctttctctgttctgaaaattggaagacgcggtccgggagcgaagtggaattccctgctcgttttggaagagacctcaccacagaggtgggcaccatttgaccaaatttccatatattcttcgcataatcagtggttcattcgctcaggagaaatacatcgccgatttggacgcaaaaacgggcgcatctctcaaacttacgatactgaaccggaaaggccgagtttggacgatggtggccggtggaggcgcatccgttgttttcacgtgagataaataaataaaagaaattaattggattttcagaaatattgccaccccctctaaatgaaaattaaatgctcttctctttcatttttaaatctttgttttggtgcccaaactctgtagccttttcgttggcatttccaattttcttccttttaattgcatttatcaattcgtttaaccttttcagggacactgtttgtgacctcggcggtgcttctgagttggccaattacggagaatattcgggagacccaaacgagacgcaaacttttgagtacgccaaaacaattctcacaattatgacggaaggagaggcccacccaaagggcaaagtgctcataattggcggctcaattgccaacttcactaatgtttccgccacttttaaggttggtattcatttgctgacgcatttggttcttcaccatttaattttagggaataattcgtgcgcttgaaatgtttgccgaaaaacttcgactgcataaagtaacaatttacgtccgtcgcggtggcccaaattaccaaggcggtcttcgtaaattcaaagaagccggttatattggtgcttaatttttatttgagtttgccttattgatagccaccaaattggacttgccaattcacgtgtttggtcctgaaactcacatgaccagcattgtgggcgctgctttgggcgttcgtccccttcctgaagcttctctgactcctcacacgacggggcaatttctgttggccccggagaggggggtgagttcggcatttgcattagccttctgtgagtgtggtttttctggttaagagtgccgctgtttctgctgggaacgaatcggccagtcagcagaaagtcgcaaatggttacccgaaaagcaatgggacgaccccggaaaaaaaggcgaaggccgaaacgatggaagagcagtcaaaggaagctatacgaagcctttttgaaagggacacgaaagccatcatctggggacagcagcagcgggcaattcaggtgacttacgggggaagggatttagaggggcattcttagcctgattcaaaagttactcaaaattcgaaataatattaacaaaatttgatctatttaaacaccattttaccaaaaaaaaaattctttgaaactgaaaacgtttcttataataaaatttattctgaaaaatttgtttgatatatttttaaaaactttccaaataataaaaaaggagtaaagtatcaaattcaatggatgtttgacttatccaattcagggaatgcttgattttgactacgtttgcaagcgaagcgctccttcggtggtcgcctcgacttacccattcaccggagaccacaagcagaaatattactttggacagaaagaaatgcttatcccagcgtataagtcaatggaaaaggccttcaaaagtcaccccgatgcgtccgtaatggtcacttttgcgtcaatgcgttcggtgtttcaaacggtgctcgaggcattggaataccctcagataaaagtgattgccatcatcgccgaaggagttcctgaaaatcagacgcgaaaactgataaaagtttgttcgactgtttgccggctaatgctggttttcaggtggctcgacaaaagggggttactgtcattgggccagcaactgtcggggggataaaacccggatgtttcaaaattggcaacactggcggaatgatggataatattctcgcgtcgaaactctacagatcaggaaggtgggagggaatttgtttccctaacgctttttactagcaaaaatttcagcgtcgcttatgtctcgcgttccggaggaatgtccaatgaggtcgttttgaagtctaattttgaattacgaaatagtttagctgaacaacatcatttcccacaacaccgacggagtgtttgagggtgttgccatcggtggggatcgctaccccggctccacttacactgaccacattcttcgttatcaagatgatccgaggtgttttgtctcgtccttttcctttttcagttttccattagagtcaaaatgatggttcttcttggcgaagtgggaggcgaagaagagtacaaaatcgtccaggcgttaaaagaaaaacgcataaataagcccctaatctcctggtgcattggcacttgtgccgatcacatcacttccgaggtccaatttggccatgccggggcctcggccaacgccgtcaaagaaactgcggcacataaaaacgctgctttgaagtctgctggtgctcacgtgcccgactctttcgatgactttggtgttatgatctcgaaagtttacaagcaattggtcgagaatggttctatcgttccacgtgccgaagaacccccgccaccggtgccgatggattacgcatgggcaaaggtattcacatcgttttttagagcattccgaactcatcgcttaatcagcaaaaagaatgcccttcttcaggaattaggactgatcaggaagcccgcttccttcatgacttccatctgcgacgagagaggggaggagttgctttacgccggcgtgccaatcacgcgagtgcttgaggacaacgtcggtgtcggcggagtgctcggccttctttggttccaagtcgctttcccttcctttctactcactctcgacccttcatttttcagaaacgattgcccgaatatgcaaatcgttttttcgaaatttgtttgatgcttaccgccgaccacgggcccgccgttagcggtgcccacaatacaattgtttgtgcaagggctggcaaggacttgatctcgtcgctggtttccggattattgaccattgtgagtgtggggcagtgggctgaccatttgaaaatccgccatgggataataaaaagagattatgaaattcttttaatcaaccaaatttaacgctttggtatcattcgaatgaaattctgaaatctctatttttgaaattaatattctgatgagaataaaagctattgagaataatgataccaatttgtttaatttggttgactttaagcaattttattttattttattatcccatgtcggaatttaggaatgtcctagcaccgggttgtcgtaaaagtagaggaggctgaaaacagtgacggatttacaattgacattttcagggtgaccgttttggcggtgctttggacggggccgcgaagagtttcagtgaagcaatggacacgggactgagtgccatgcaatttgtgaatgagcagaagcggctgggcaaactcattccggggattgggcacagagtaaaatcggtgagactggggggggggcacagcgacgaaagaaatggcggcgattgttcagataaacaacccggacaaaagagtggaaatactgaaagagatagcgaagaacaagaccttcttcaagcaggagacgcctctttttgactacgcactcaaagtggagcaaatcacaacttcgaaagtgacagcaaacccagacgccctcctcatcagaaaatttgtttagaagcccaacttaattttgaacgtcgatggggcaattgcgacaattttcgtggacattcttcgccattcgggaatgttcacaccgcaagaggcgcgggaaaccattgagattgggtctctgaatggactgttcgtgctcggccgcagtttgggattcatcggttgtttacccagctatgtttatttgttcatcgtccgtttaaggccattatttggaccaacgtcgtctgaagcagccgttgtaccgccacccgtgggatgacatcagttacattatgcctgagcatgaatttgcggaacag

SEQ ID NO: 53080 - DNA, 77 bp, Heterodera glycines
  Genomic contig location: Contig_ID=SeqID_22416; Location=54..130; Strand=-
  SCN-specific regions: Sequence locations=1-77
atgagccaaaaccgtgacgaaaactcgcagccacctgtactcgatggaccgtacaggctggcacaagagcgcaatga

SEQ ID NO: 53081 - DNA, 213 bp, Heterodera glycines
  Genomic contig location: Contig_ID=SeqID_22416; Location=1192..1404; Strand=+
  SCN-specific regions: Sequence locations=1-213
atggcccgcgctcacctggcggcgctcaaatggctggcgctcagttggccatacacccctcccacacctatggggggctaccgtaatccggtgaaatggtcgcctctaactactcgcagttatcaaatgtacaagcccgatcaaagccaccgcattattatgggaatccgggaaaatgatatgtctggggacaaaaagtctgatagactgtga

SEQ ID NO: 53082 - DNA, 384 bp, Heterodera glycines
  Genomic contig location: Contig_ID=SeqID_22417; Location=526..909; Strand=-
  SCN-specific regions: Sequence locations=1-14,36-130,282-384
atgcctatatatcgctgttaccatcatcattttgctggttcgacaagccgagctacggtaagtgtgccggcgattactgtagcaaatgaaaattgactcattaatccaaatatcacataatttctttatgtaaaatttttattaaaaatttccgaaaaaatcataaaaatgaaagttttcaaaataatttttataaactttctttaaaatgaaaaaataaatattttataaaaccatttttataaaataaatattttctaaaaaccatttttataaatattctcgtactaaaagaagtcaaggattacaaaaaaacttgctcgacttctgatgcttttatttttgaatttcacaacagatatgagtctgatgaatcatacatga

SEQ ID NO: 53083 - DNA, 628 bp, Heterodera glycines
  Genomic contig location: Contig_ID=SeqID_22417; Location=1166..1793; Strand=+
  SCN-specific regions: Sequence locations=1-99,121-628
atgtgccaaatttcagccggtcgcagccagttgaacgccgccgtttgggcgccgtataaatttgaaaagagaaagctgagttgggcggttaaaatgccgacaaatttgctggactgggtacgacccattgaagaaacaaagagttgttagtgagctttggtttttaaccttgtttgaatcaacttttgaacaataattatcgagaattagggcgaaagggctgcaatttaacggtaggggtcaactccgtctggccaactccgtcacagcaatgttcaaaaagctataacttttttctttgttggccaaactttacaatcataatatcattcgaaagccctagatgtttagaagatatttataagctatttttcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccggcaatttaa

SEQ ID NO: 53084 - DNA, 1015 bp, Heterodera glycines
  Genomic contig location: Contig_ID=SeqID_22418; Location=97..1111; Strand=+
  SCN-specific regions: Sequence locations=1-309,333-389,413-580,602 -877,902-1015
atggcaagcctaatccagaagggcatcacattcacactcaaggcgctggataatgccagaacaaccacggcactttcactacatccagacgccgacctctcaaactgggaaaacgcagtcaaattggaggctcaatgcacacgcgtcagcagagaagtccaaacaattgaagcacaactggacaatctacgcgacctctccaacaattggattgacctactaaaccgcctcgaaggatcagaaaaagacaaaggcgagaaagaatacgtcaaattcgacacgtatgagaaaattgctgaacgccatgacgcagccacaaccaaacttcgggatctgcgggatctcgaagcaacgctcagtgccgatgccaaactttaccgaggcagagcagaaagagaagcaagagcggatcagcaagcaaatccgccaccacaaattgcaacgccaccaatggcagctcctacattcacggcaccgctctatcaattccagccaatccagctggacaaattcttcggtcaaaagcgaaaatggcccgaattctacgagtccttcaaatcggccatcggcagccaatcaatcagcaaagcacagaagctgaacttgctccgcaatcttctgggcggagaagcacgggaactcatcgctgggttccgcctggaggaccaaaactacgagacggtccttcagttgctgaaggacacttacggcgcacctgaagagcacatcagggcgctacactttgagctggccaatctcaagacgtgccgaagtctccgagacacaaaagacttcctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgtacttaacgaagcagtccgcaaggaagtccaaattcaagaggtgatgg

SEQ ID NO: 53085 - DNA, 1875 bp, Heterodera glycines
  misc_feature (1244)..(1244): n is a, c, g, or t
  misc_feature (1339)..(1340): n is a, c, g, or t
  misc_feature (1343)..(1343): n is a, c, g, or t
  misc_feature (1506)..(1506): n is a, c, g, or t
  misc_feature (1512)..(1512): n is a, c, g, or t
  Genomic contig location: Contig_ID=SeqID_22420; Location=307..2181; Strand=-
  SCN-specific regions: Sequence locations=1-150,172-721,746-858,880 -930,953-1643,1665-1875
atggcggacgacccgtcgttgcacgaggtgaatgaactgtccgatcacttttcaaatggtggtccaattgcattttaaatcatcagagtgccgtcctttctgtgctttggtggaccaattcggtgtcacttccggtatcaattcagtgcaaatatttgcatttaaagtcattgtccattcctttgggttatcgccactgtcggcctcctttgcaacggactcaaccttttggttttggctacgtcggaggctcggcggatgccgtcctggtcagtcggtgccatgagtttgcttctgatcagctgatcacttctttctttgtccatgccatggcaataatcagttccgccaatcatcgcccctttaggcatctgttggtctctttggctttgttcgactcactttttctgctcttcgccgtcctcgagctcactccgacctcccttttgcccactctttcgccccatttgatcgccgtccacacgcgtgtcgttctgatcattcgaatgttcgcctccactttttacaaggcgtccattttgtccgtccaatttcaaattaaaaaatgaaataaattgcctaataataattcactttcctcgtcagaattgtggtcgcttttaatgtggagcgctatctgtgcgtttgtcgtccgctttgggcccaccgcgcgcgcattttggtgggagggggaaaagcgttggccgtcgtcggcggggcattggccttgggaatgatttgcagtgtgcaatggtaagagagtggagagagtgattttgaattgaaattcaattttaaatgcttttggccattggcatggactgtggtccaatgtgagggcgaagggaatgagcagccgggggaagagcagcagcagcacttttcggtgagactgaaaagcgaaacggacagaacttgttgatgtcggaacaattcaattcaattcccttcttctataaggtggtaaccattcgacagtcgcaaacactccaagtcagtgaagggaggaaggtcgattgaaaaggggcgaatggaagtggaaaattaaaaggctaacgattgttttgaaattgtgccgaaagtgccacggcatcccaaacgagtgcattgtgaatgaccaatactccatctattgactatgctgaaacccttccattttgatggcatttcaattcccttatggcccacaattctccccttgtgaattgtccctccctctaattacttctcccttaattaccccnctctgttttcccccggttaaaggcttattaccgtctgatggattggttgtcccttgtgctgttcaacttggctccccatccttctcctctccgtnnccntcaactttcagctcgttttcaccctccgtcgcatcgttcggcgcgactcttccgcctccgctggcactgcaacaacagtcgcagttgcggaagaacggagcggcggagtcgtcgttacaaatgtactttttcaacccatgaatgatttcgtaaagaaatcccnccttgngcattgagttcgcttccgggcactcccccccatcattgaattttcatgccattttttcttcgtgtgtagccagcggtgccggcagttaatcctccgtcaattttccgagtttcaattcaacgtacaaatggggaggagcattgcccccttgcgtcgtccttccttctttcccattcgcttcgtcactttccccggcttttccttcagattattctcgaggatggccatgcccagcagcagcagcaaagactgaacgcaaatgcgatgctttttgcggttgtgcttctgctgtttgtctgcattggcccacaagtgccggctcgcctcctttacgaatggtgggacggaatgccaaatttttaa

SEQ ID NO: 53086 - DNA, 150 bp, Heterodera glycines
  Genomic contig location: Contig_ID=SeqID_22425; Location=1456..1605; Strand=+
  SCN-specific regions: Sequence locations=1-150
atggaaaaggaattattagctaccatgaaaacaaaagggcgtgaacagctgagaaaggacatcggcgccatgtttgaccaactgcaaaatgttgtgggagaggaaattgccggcctatgggctaaaattgagccatgtctgactgagcag

SEQ ID NO: 53087 - DNA, 1210 bp, Heterodera glycines
  Genomic contig location: Contig_ID=SeqID_22425; Location=1..1210; Strand=+
  SCN-specific regions: Sequence locations=1-153,175-220,250-289,312 -403,425-548,572-1033,1055-1133,1155-1210
ctttatcgagagttccgataaaatgggaccaagtagagttaaagagtaaggaagatgtgccttttttgttaacaattgacgaagatcagagaattgacaagcaaatgttggaaaaggagactgtggtggacccaattttggcccaagttattagtaaagtgaaggataattgggcggaaccagtgaatgaagatttaaatccgtttttcagggaaagagcaaatttatttttggaaggaaatttaatccggaaaaggccgggaatgcaaattgtaattccccacagaatgcaaaaccaaattctaaaattaattcatagggcccattttggtattgtgcgaagcaaggcaagggcaagaggcattgtatggtggccgaatttagcgaatgagatggaaaattatgtaaaaagttgtgaaatttgccaaagaaatgcgccaagcgcaccgagaacagacccggagtacaaatggccagaagccagatatccgttcgagcgggtacatatggaccttgcagggccaatttggggaacgaatttcctaattttggttgactcatattcaaaatatccatttgtatgccaaatgcaatcaactcactcaacatcagtaataaattaccttagggaaatatttggaatgtttggctctcctaaatgtttggtcaccgacaatggtcggcaatttgtgtcagaagagtttgagagttttatgactaatgagggagttaggcatttgacgacagcaacatatcacccagcatcaaatggggaagccgaaagatttgtgagaacatttaaagagagtatggttaaattgctggcagagggaatgaatataaaggtcgcccaattcacgtttttgcaagaatatagagcgaccccgtcggcagtaaatgaaggggaaagtccggcacatcaatttttgggcaaagagttgcgtaccgcgctggataaaataagaatgcctcaaatgcctgaggcgaatagggatggaactcatactggagaaccaatccaaaagggggagcaaatgcaacagcagggaaatttgaaaaattttgaccctggagaccctatatggtacaaggaaccgaatggaaaatgggtacgggctgtacttatacaaccgttgggggagaggatgtgggagatccaaacagaaggaagcaccatgaccagaagggtccatttggaccaaataaaagg

SEQ ID NO: 53088 - DNA, 5790 bp, Heterodera glycines
  Genomic contig location: Contig_ID=SeqID_452; Location=60..5849; Strand=-
  SCN-specific regions: Sequence locations=1-130,168-303,327-394,416 -554,576-588,615-2321,2343-2381,2403-3608,3630-3653,3676-3871,3896 -4324,4346-4450,4473-5225,5249-5266,5289-5365,5397-5605,5628 -5631,5655-5758,5780-5790
ccacaagtggttgtggctccgcagcgacatgaagtgatgttgccgcccatttcgcttccaaaattttcgggtgaaccccgagaatggcctttattttggaagctgtttgagacttcagttgaaagtcttcaaattgaaaacttcaaaaaacacatttatctcttgggatgtcttcccgagaagtcagttgctcgaagagcaattgatttgtacccgccttcaaatgaaaactacccgcgagtggtagaaatcctcaagaaaagatttggggatgagaagtcaattgtggagacactccaatcagagttgctccatctttcaaaaccgtcagattcggttcaatctctgaggcagttctcagagtccattgaaaggatttgtcagcagttgtcagattttggagaaaatgaacaaaataagttcatggcctccacgataaaatccaaattgccataccatctcctcactcaagtggtggagaaggaaatgcgttcaggtggaacatttgattgttccgacctacgcaaggcaatcacttccattgttgaagtgaaggaagaagtacaaagatgtacacaagtcttccgtggggaagaaaaaccccgaaattttcctcctcaaatgcagaggaacaatttccaagggagaggaacaaatttccctcccaaccaatttcgtcagggtcattggcgacccaataacagaaatgagtctgtggggatgatgtctccccaaataaacagatcatttaacactgtcaatcagagggaacaaacacacttttctcctcgagaacgaggaacgaacccactttgttctctttgtagtgacatgggacacgcaccaagcaagtgtccaaaatatccaacacctggagcacgcagaaggcggcttgcagatcaacaacgatgttttttgccttatgcaagggcacaattctcaacaatgcacaatgcagctcatcaaagaggtgcccaaaatgtggtgaaaaacaccacttcatgatttgctattctgagggagacgctccgagaggaagcactcctaaacatacgaccaaaggagggactgttcaaaagaaacagtcctccaacatacgagaaccacctcgtccaacacaaaatcatttttcgacaacaaacgaacccttaagaataagggagaaaccgtctgaaatagcaatttctgacggaacaacaaatgttttaacaaacgttgtgacaaagaagtcacatgcgtttttgatgacacgacgattgagggtcaggtcaagtcgtgaccctcggcggatgatcaaagctatgtttctttttgcccagcgagccagacatcatatatgtctgaccgcctaatcgaaaaactgaagccacataaagtaacttcagaagagatggaagtctacggtttcggtggtgaaaggaatggaccaatacggttccattcacctgtctactccgttcaaattcaacggagtgacaataagtgggaggaaatcctcctcaatcgaaccgagcaaatttccactccattcaaaatggtggagtggaactcaaatgattataacggaagagcaggatgttttccaagctctgaccctctccgaagacgagcctgagattctgataagtgctcgacacttttggaaatttttccaaagcaaaaaggaagttttgcctgggttgtttgtcattcaaacaactctgggccctctagtcaatggagaatcagacttcggaccaaaagttcaaaatccaggattgtcaatgatgaccattgacgagtccaatcaaaagcagatgccagctactaaagaaattgaatatttctttaatttggaatcattagggataaaggaagaccctaacgaagatgatgatcaaacagcaatacagctgtttgacaaatcaatccgtcgtgaaaacggcggacgatattcagttaaatggccgtggaaggaagagacaccaaatcttccttccaattacagaatggccttctcaaggttaatgtcgactttgaataagctcagacattctcctgaacttctacaacaatataacaacacaatccacgaccaactatcaaaaggcatcattgaagaggccagggaagcgcctggcactcttgagcactacattccgcatcaaggagtgttggctaagggcaaaaaactacgcgtcgtttacgatgcgagtgctcacacaagggagacaaacagtttgaatgactgtttgtacagaggtccggtacttttacctgatctcatcggaatgctcttgcgattccgatgccctgcatttcctcttctcgcggatatccaagctgctttcttgcagatttccttggaaccagaggatagagaagtcactaagtttttgtggctcaaagacatggaaaagccactttcgtcggataatctgatcatatacagattctgccgagtcgcatttggtgtgatcagttcacctttcatcctagcagctactctacaatatcatctaaaaaattgtcgttcgattttggctaaggaattagccgaatcgctatacgtggataatgcgctcatggagtgtgaaactccagaggaagcattaacaaaatataaggaagcgaaggctatccttaaagaaggctgtttcaaccttcgggaatttattacaaattccaaggaggtgatggaagccatccctccggaggatcgactcgagaaagctaaagtgaaagtgctgggacttatttgggacattgatcaagacgaaatcgtctttgaattcccatctgtcgattcattaaagatagtgaatcgacgtctcgtcctaagttttttggcctctttattcgatcctttgggattgatgagcccatgcatccagcctttaaaacttttcttccaaagcttatgggaggaaaagaaaggctgggatgatgccctctcagaagaggactcgactcgctggagtgctttccaagattcttggaaagacaagcgaatccgagttccacgaaggacaatggtaaagggcgaatgctcccttcaattgcatgcatttgtggatgcttcgatccacacatttgcaactgcaatttatctccgagtggagagttcaaacaaaattcaaaattggctgattttctcaaaaaatcgccttaagccaaagagcgcttcgaaagcactcactattccaagaatggagctgatggccattcttattggaatccgaggcttaaaatttatacaaactcaattgcgtcgagcaattgaacattcctatttgtggagtgattcacaaattgccttaaattgggtggcttcaaaagaagtccaaccaaaattcattgaacggcgaatcaaagaaattcgcagcataacgaagtgttcgtttcacttcgttcgaacagctgaaaacccagctgatctggcaacacgaggagcaacaccagaagagctctcaaccaattcttcgtggtggaatgggcccaattggctcacaaaggaccaaaattgttggcctcatgaactcttctttgatataaaagaggaagagttatatgatccaccgaaggaagatgaaaaagtatttttggctcatacatgtgcagagccaaaacagcaattatttaatgcaaagagacaccattcctggaccaagttggtccggacagttatctttgtaataccttctccatttgaaattattaaatggaagagacccttcagagctcacaaaaaggcaccggaaggaaatcgtcaagatttctaaaaacagagcattcacagcagaagatgttctgctagctgaataccttataattcgtttggatcaattgaatgatccagatgaattcacaaaatttccctcactaatcgatagtgaagggattctgagactgaaaacgagattggcaaggagtgatcaaccttatgggttttcacatcccatacttcttggaaagaactcggaaatccgggatcttatcattttgcaatgtcaccagaaacgacatcacctaggggtggacagcaccattacggaatttctcaacatttattggactcctcagtctcgaacggcagtaaaaagagttataaaaaactgccgtcgatgccgaaggatgaaggcatatcaatttgccttaccaaaaatgcgtccactgccggaggaacgagtctgccgacaaatgccctttaagtcaatgggcattgactttttggggccaacagagacacgattggcaggagagaaggtcaaagcatggattattatagtaacttgcctcacaacgagagcagtttacttagaagccatgcttgacagaacggccgaatctttcttaaatgtcctccgacgattcattagtcggagggggaaaccagatttcatttggagtgacaatgccacttcatttaaattatctcaaaaaacgattgagcaattgacaactccaaagggagttgagcaaaacaaaaatgaatttcttgcacttaataagattaagtggaaatttattgctcaaattagtccatgggcaggtggcgtttacgaacgcctcgtgcaattatgcaaaaattgctttaaacggacattggggagaaaaatcctcaattacgatgagcttaacacttttgtggccgaagttgaggctactctcaaccatcggccaatcactgtggtatcagagggagcgtatggcattcagccactccgccccatcgacttacttcaacccgatttacagataaattgggagacaacgacggaagaaaccgatcccaacgataagcaaatttcatcctcggagaaattggctgctttatttaaagcaaccagagaagcccatgaaagcttctggaataaatggcataatgagtaccttctccttcttagagaaaggtctaagtgggatcataaaggtactcatctccaagacaaaggagagccaaaagaaggaatgatagtcctgattcatgaggaattcactcctcggaatcagtggactttgggaaaaataattgagctcaatggtaaaccaggtgccattagaagcgttcaattggaaatgccaattcatggcattaaatcaaagaggtatggaaccatgcctcggaaagtcgttattacacgaccagtcaacaaaatttttccattagaggtaggatttgaaaatcctaccgaagatggcaaagaaaatttgaaggttatcaaagacgaaactgcaaacagttcaacagaaaaaacaattcttcatttggaaaataaattgccaaatgaggaggagaaaaatgaggacaaaaattctcatttggttgaaccaaaagccaaccaaaacaaacatggaatgattactcgcagcaaagcaaaagtgatgacagttcttaactgtctcactattttctgcatttttggattggcaggagcctatccaacaaatcaatgcaatgagtgtaaactcatttgctcaaacaaaggtgttttggcaaagattccgaaagaaattcggaaagtggaactttgctgctcggagaattgttacattcatgagaatgtacacaaactcacatatgaattgccaaaggaaatcctcctgaatgactatcaatgtcaaggtcatttttggatggattcaaagcacatgtttaaaaaggacattttatgtccagcagtcgatgagtgtgtactcatcgaatgctatttatgcatggaacaattggcaaacccaacgtgttatccgttggtatcctctatgttagctggaggacttttcctttccttaatgagcataagctttatg

SEQ ID NO: 53089 - DNA, 777 bp, Heterodera glycines
  Genomic contig location: Contig_ID=SeqID_453; Location=10..786; Strand=-
  SCN-specific regions: Sequence locations=1-174,196-519,558-777
atgagtgaactcttgcgaatcacaatcgcgccgattgtgaagcgtctcaagttgtacattgagacggctcaggaaaatctgacaaaagatttgactgaggaaatcaaaacagatttgctcgcagagagacaaaatctctgtagagcagtgtcattgttggagaaaaacaatgacaagtgggaggcagtcttccaccgagttaaaggtcatgctcttcaggaggaagagcagaactacaaggactacaaacctgaaggaaaagccttcatggaatgggccgaccaagcccgagggcttgtcgataccattgatggggctttaggcctctcagagcaaggggacgatgtcgttcaccctgctcaggttcaacaacctgctcaaaacattcagccacaagttgttgtggctccgcagcgccatgaagtgatgctgccgcccatttcccttccaaagttctcgggtgagccctgagaatggcctttgttttggaagttgtttgagacttcagttgaaagtcttcaaattgaagacttcaaaaaacacatttatctcttgggatgtcttcccgagaagtcagttgctcgtagagcaattgatttgtacccgccttcagatgaaaactacccgcgagtggtagaaatcctcaagaaaagatttggggatgagaagtcaattgtggagacactccaatcagagttgctccatcttccaaaaccgtcagattcggttcaatctctgaggcagttctcagagtccattgaaaggattgtcagcagt

SEQ ID NO: 53090 - DNA, 785 bp, Heterodera glycines
  Genomic contig location: Contig_ID=SeqID_453; Location=2572..3356; Strand=-
  SCN-specific regions: Sequence locations=1-117,140-318,455-489,534 -565,603-645,690-785
atgccggagattgagtcccagagattgaattgctggtgggttgagtcccagcgattggaaagcctgagaattgagtctcagagattgaaatgctggtgggttgagtcccagagattggagaaaaagccaagaaaatgatgcgaggccgcgaagcggccgagccagtcgattttatcattcttaattctataacacaatcgtactgccttgcgggggatgcgccgaaggcgctgaccacgctagtatttcactaaaacttcatttcatgtaaggtcaaaaaaaaagaatgcaacgccaaaaaatcacatttctattaactttttaaatttttattataaaaattatttaatagacctataaattaattcaaaacttctatagttggaatttaaaattaatttatttttaaatgatgaattatgtaatctaattcaaatattaataaattaaaattccagcaaatgaaattaaattttgtagaataacaagtaatatttaaaattaaaaaccattattttaattgaaaaattaaactaacctacctatttgatgattaaaatccaagtttaaattaattaatttcttaaaaaattaaattaaatgcaaatgcaaattgtagtgattatttttgaaacttaaaaatcgaatatttattttgaaaatttgaatttataaaaagtaatttaaaagaatttccttatattaattctattttgaaaaatatcagacaattaagtaattacttatacttgattagttgtttttaccaaatgcattaaaataaa

SEQ ID NO: 53091 - DNA, 643 bp, Heterodera glycines
  Genomic contig location: Contig_ID=SeqID_453; Location=3365..4007; Strand=+
  SCN-specific regions: Sequence locations=1-607,630-643
atgggactcaaatctccggcattccaaacactgggactcaaaacaccaactttcaatgacattccaatctctgggactcaacccaccagcatttcaatctctgagctcaattctcaggctttccaatcgctgggactcaacccaccagcaattcaatctctgggactcaatctccggcattccaaacaatgggactcaaatctccggcattccaaacactgggactcaaaacaccaactttcaatgacattccaatctctgggactcaacccaccagcatttcaatccctgggactcaaatctccggccttccaaacaatgggactcaaatctccggcattctaaacactgggactcaacacaccaactttcaatgacattccaatctctgggactcaacccaccagcatttcaatccctgggactcaaatctccggcattctaaacactgggactcaaatctccggcattctaaacactgggactcaacccaccaactttcaatgacattccaaacgctgagactcaacccaccagcatttcaatctctgggactcgaatctccgacatttaaatttcgagtttagtcatcaaataggtaggtttgtttaatttatttaattatttttgcttgaatatttaa

SEQ ID NO: 53092 - DNA, 962 bp, Heterodera glycines
  Genomic contig location: Contig_ID=SeqID_454; Location=68..1029; Strand=-
  SCN-specific regions: Sequence locations=1-607,629-656,697-962
atgggagacgcagcaatccaacgattgacggatattttgcagcagttgttggctgctcaacagcaaaacacgccaccggcacagaacgcctcacaattgccaacactcccggacgtggaatgttttgatgctagtcagcatagtggctgtgaaattgaggactggctcaagcgatttatgttcgttcttgactgtgcaacgccgaaccttcaggacgagttgaaggtgaagctgttattcaactgtatggttttgctaatttctttgaaatcgccgaagaatgctactctacggtcacgaattttggccaagttggcagcggatggtgacactgtcaagtatgacggtgtggtagacgacctgaagatctacatgtcgaccatcgccgaagccaaggcattggagcagccacacatttcgaagcttttgttgacagcaaaattgaagggccaaaagaagaggaagaactcggaccattcgtcgaatgcgagcatcatttcgacagggacacggcgcagaaatcgatcgcaacgcgaatgttggcgatgcggttggaaccattcgtcgaggaaatgccgacaccaagaaacggtttgccgaaagtgcaagaagaatggccacttggaaaggatgtgtgccaagcaccaggcatggttaaagaagaatggaggaaagaaggaaaaagcggtgaacaacgtccgcgttggaaaaattttcctggttaagggcgaaaaccagaggaagaatggaatgatcgatgttccgattgatgtgaatggcaccaaagtggaattcattgctgatttcggcaccgaaggaactgttcttcatgaggacacggtgcgcaaaatcggagctttgaaattgagccgttgtgaagaacgtgctctgtaccacgatgggacaacacgtccatttgttggcaaaggaaaagctgcattttcgtttggagaacattcagc

SEQ ID NO: 53093 - DNA, 442 bp, Heterodera glycines
  Genomic contig location: Contig_ID=SeqID_455; Location=1..442; Strand=+
  SCN-specific regions: Sequence locations=1-147,184-311,337-442
caagtgtccgtttggggtactcaaacaactatggggagcaaaaatccaacgcagaattaaagtacaggctatagggaaggtattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaagaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaat

SEQ ID NO: 53094 - DNA, 153 bp, Heterodera glycines
  Genomic contig location: Contig_ID=SeqID_455; Location=442..594; Strand=-
  SCN-specific regions: Sequence locations=1-108,142-153
tgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggta

SEQ ID NO: 53095 - DNA, 475 bp, Heterodera glycines
  Genomic contig location: Contig_ID=SeqID_4078; Location=508..982; Strand=-
  SCN-specific regions: Sequence locations=1-117,140-449
atgggtgccggattcgctgcaaacaaagtgctggacacattaaggctgctaaatttcccgacacgaggaccaagactgagaatcccgagcagaattactggacatttgcaatgttaaattcatttcaaaaaattattttcgaatatacttttaattaaccacaacttttaaaaaaccaggtatatttaggctgcggtaggctgcgaagtaaaagaatttttactttttttctaaattagttattgattttaaaaaatttgagtccaaaaatatttgagacggaaccggccctttgagtactaagacggaactggcgagacggaactggcccaagacggaaccggccccagacggaactggcgagacggaactggccagatggaactgacccctactgtccctggattagggcgtcgacgattgaaaaattgaaaatttccaagatgtccttggaaaacaaaatttgaaaaataaa

SEQ ID NO: 53096 - DNA, 480 bp, Heterodera glycines
  Genomic contig location: Contig_ID=SeqID_4079; Location=221..700; Strand=-
  SCN-specific regions: Sequence locations=1-160,183-284,306-480
atggcaatgaaaaaagttaaaaacttgggcttgcggtcaggcagtgccgataggcgatgcaaggtatgagggcaatttttaagatttttaccaagatttttgctattttaacccaatttttcaagaaaaattaaggatttttataggcgatgcaagggaaaaagtttggcattttttaaaaatccggcggtgcctataggtgctgcccggaaaatttgttttgtagacttcaccttcatttttaaaattttcacaaaaaaattgctaaattcagtgaccttttggaaaaaatttttcatgaaaaaacttcgaattttttaaaattcaaaaacgctagcagttcaattttttccccttgatttaaaaaaaaattataactctttcaatttttttcactttaaaatttcgattcccttggccacatgccgctacccggtacaccccaaaacacagccgagacataacacagccgggaataaa

SEQ ID NO: 53097 - DNA, 120 bp, Heterodera glycines
  Genomic contig location: Contig_ID=SeqID_4079; Location=745..864; Strand=+
  SCN-specific regions: Sequence locations=1-7,30-120
gccgttcaacatcaccaagcagcacccgcagcccaaccggctgctgcagcgatgcccgggggcgctggtgccgcgccggccgccgctatcattccgttggcaccgccgccgtccccataa

SEQ ID NO: 53098 - DNA, 534 bp, Heterodera glycines
  Genomic contig location: Contig_ID=SeqID_4079; Location=2557..3090; Strand=+
  SCN-specific regions: Sequence locations=1-534
atgcgcataaatagcagtacgcacaactgctttgctcttgtcagtaaggcgttcgtccagctgcgacatcagctttttcatctgctttcgtgcatcggcagcgtttggtccataaagttctccatcgccgttgtttttttgaaacaaattcgtttagcagcatttaaatgtccagtaacgtccatccatgcgaatgttgcggtgctttggcagtgcagggagccacggcgtctcgactccagtgttcgggaaccgcgctaggacgaactcaaatttctccgaacacacggcgcatttgtggacgaggtgacgggctcgctcaagatggctgaagtagttctcgcggctgtcgtcgaacagaagtcgatacatggcgttgtttgctgctccaacagtgtctgcgatgcgtgcccgtgctcccccgggcaattgtcgtacacttgcggtgctgcctgattccaaaaaaaaatccaaaaattaatacaatcattaccattttcattttaattaaaaaatccaaaaaattcagcataa

SEQ ID NO: 53099 - DNA, 756 bp, Heterodera glycines
  Genomic contig location: Contig_ID=SeqID_4080; Location=626..1381; Strand=+
  SCN-specific regions: Sequence locations=1-254,295-393,415-756
atgaatgacccaatgccttttgtgtactgtttggagacgttactttatgaaaatgtgaaatttgatgacgcaacgaaactttgcttcaatttgatcaatcctggaaaatttgtgcttgatcggatcacgtattatgaaattcggtatattatatttatttcttcttatctttttaaaggcaatgttttgacggatcggaaggcatccttttgcaaaatttagctgcagataaaacgaaaacaatttggccaaataaggtcagtgacagatttaaaattttcttttttgttataagcctgaaaattcaaataaatcgtttcaaaaaagttatgccaaaaattcaaaaaattttcatttcacaaacttagaaaattatcatctatttttttaaaggcaaaagccaatttattttttggcttctggctaattgagtttgtcctgcacttccgaaaaatttcaacaattccaaactttggcaaatatttcagcatcaatttgtgccgtggattttggtgaataatgtcatcattgaaacaatgcaatttttgcgctattcattgccctcattgatctgcgagcaacgggctgagggtgaatatatggccgaatgtgaaagttggtaaatcggaaaaaaacaatgacaaatttcaactgttgaatgatgttgtttagcacattaaacatcacgcaaatttaatgaattgatcaagaaaaaaagaatggaaagttttattaaatccgccaagggataaaata

SEQ ID NO: 53100 - DNA, 460 bp, Heterodera glycines
  Genomic contig location: Contig_ID=SeqID_22426; Location=872..1331; Strand=-
  SCN-specific regions: Sequence locations=1-113,137-340,368-460
atggcccgaccgcggagtgccccacagcgaccttgctccactgcgcctgctgtaccatgtgatcggcgtcccccgagcggttgtgcactgttcagctggtgagttaacggaaacaaaaacattgaaaaattaatcatttttcccattgcaggcatcggacgcactggaacgctcgtggcggtgtacttggccaaccaaacgctgcacctcggccagcctctcaacatcttcgctctcatccgtgacctccggcgccaacgatcgcaaagcatacagacgctcgaccagtacctctacatttacttcgtgattcttcggtgggttttcaaatttgcatcaacaaaaatgaaattttaattttttcagttatgcacaaaacaaggcgtcaaagctgaacatcaacgtgaacgcgctcaacgccctcgtgcaggcactgaactccaccatgcgacggggctga

SEQ ID NO: 53101 - DNA, 1355 bp, Heterodera glycines
  Genomic contig location: Contig_ID=SeqID_22429; Location=414..1768; Strand=-
  SCN-specific regions: Sequence locations=1-112,135-1144,1166-1355
acatttgaatagtagtgtgtcgtttgcttcaatgaatccgttgagatatagatatccaaataaccgaggtccgtattgcttccgcatttacggtcagatttaccatagaatgaatttagctttgaatccagaagatggcgatgatcctgcttatgggcagattttcatcgtagatactgagcatgcaatgagagcaatgaggcatgccaatgtcgatattgaccctcaattgctgagaactgcttatgaagtgattagaaatgtgaatccgtttgctgaagcatatatgatgatgaaagaagaagaagatgaagaagttgaaagagcaagaaatgagaacagagagccagccgagatcaagcttttgtttgagaccggaaggcaattggacagacgcttggggtacaatgtacctcgagcgaatgaagttgctgcagtttatgtacctggggctgacggtgaagtacctaatgccaagattgtggtgagagaacgtggaaaggaatttaagattttgaagagtacagattcaatggtgactccaatgacttacccactgttttatccgcgtggtacgcttggttggcaccctgaaatgaagcatagaaatagtaatagaagagtaacgagattacaatatgtttcctatacagtcgcaattagagaaagagagtttaacccaattttgtacggtggaaagctctttcaacagtattgtgttgatgaatatgttaagattgaaggagacagaatgaattggataaagtgtaatcagaaaaagattttggctgatgcatataagaatgttgataatatgttaatgagatgagcacaagaacaaggtttgccactgggaaggaaggtcattcttcctccaagtgtaacaaacagtccaaggtatgttgagaagcattttcaggatgctatggccgttgtccgacggtttggtaagcctgatatgtttttgactatgacgtgtaacccgcattgggatgagatttctgagaatttgtttcatgaacagacttcatgtgatagacctgatttggttgttagagtttttaacttgaaagttaaagttatgatgaatgaaattgttaaggcaagttttttggagaagttattgcatggatgtacccggtggagaaccaaggaaggggactgccgcacatccatttgcttttgactttgacagagcaagataaaatgattaatggtgaagatgttgagaaaaaagggattagtgcgagaataccagacaaagaattagaaactgatttgtatgctttggttaaaaggtttatgatccatggaccatgtggcgatttgaacccaaattgcccatgcatggaata

SEQ ID NO: 53102 - DNA, 370 bp, Heterodera glycines
  Genomic contig location: Contig_ID=SeqID_22432; Location=417..786; Strand=+
  SCN-specific regions: Sequence locations=1-125,169-196,222-370
atggttaggagagccggtgatctgacggatgcgtttgttgtggaggtcggaccgggcccaggtggcatcacccgaggtttgtttttatttctccaatttttttttgtatttaaatcttgcctcagaaatttaaaaaaatttctaaatttgaaattaaaaaaaaattttctgtggcgatactttgtctcggcgagatttggtcccgtcccccttttttccgtcacccaaaagtgccatgccataatatcctattttgtgccatgctcttccccttcaaatttgccgctttcccgtttcagcaattcttgagcagccgtgcaaacgattggacgtggtcgaaattgacaaacaatttttgatgcctttgcag

SEQ ID NO: 53103 - DNA, 580 bp, Heterodera glycines
  Genomic contig location: Contig_ID=SeqID_22434; Location=288..867; Strand=-
  SCN-specific regions: Sequence locations=1-3,35-43,65-214,236-359,383- 580
atgcttttcctctcttttccttccttcgtcctccgccaaattcgcccctctttctgtcgctgcttttcctttctgctgatgttagccatgctttttgatctgatcagcatcggtcgatcacttccactaggctcaaccaacgacagaatttacttctccaacgcattacggtaggaattttagtttttacagtatactgtaatagaatccctacaaaaatttacaactttttattttagtgaccccaaagatattgtgcttcaattggtcactgttccaccgccaatgtttaaatttgccgacttttccaataaatttgttcggttggaaaagcgtcggcgacaatttggtcctgttcaggccaaaaaatatgaaagaaattgtaagttactttttttcatttaaagaattaattaattttcaaattcctaggctttttctctcctgttcagtgcatgttggttttcagagacggctccaagctttacggacagtaaaatgattgaacgatattaatatttcgataaacacttaacattaacatccgaatgttaaaagatacgctgctataaagaataaa

SEQ ID NO: 53104 - DNA, 2187 bp, Heterodera glycines
  Genomic contig location: Contig_ID=SeqID_4082; Location=513..2699; Strand=+
  SCN-specific regions: Sequence locations=1-193,215-968,990-1103,1125 -1725,1777-1855,1884-2024,2064-2187
atggcatcaaattttggcacattcttaatcaccttcgctagtcttctattcgtcatttacgtgatttcacctaccgtatatgctctaattatagcccagtctctattaatcccgcagtcttcaattatcccccagtctacgaggtgttttgaaaaataatccctctatcataatcccccagtctctaattatcccccctttctgaggaggttgaaaaataatcccccatgggctataattagagcatatacggtaatttgttgtataatattaattcagactgaaaatctaccgcacttactacacaatttctcactgcactgtttcatatttggtgaacgaattgtgtgccgtaccgtcttgtatttaactgttttttatgtatctacggaaagggccgaaatacacatttaatagagaattttcatcatttaggtttattttttagcaaagtccgtactgacgaggcccgctttgctaaaaaaataaataagtcattcatccactaatgcatttagttcttaatgttgatcaatttgcaggaaccgatcactgattggacggcggcaccgatggatgacggcagagatttacagtgcgttggagatgaacattgcgatttgtaccgcaacaaccgcgagcagttcaacagaaatgcccgtgaatggacgcagaagcatgccttttctttttccatgtcttttatttttcgtttcccattttttgatattttttttttgctctcatcatttttcctaggatttgtaattgtttttctttttgccaattatggaatggccagcgacaaccaacagttattttttggaaagtaatcaacgaaccggtctattgcctttattaaagtcgccaaaaaatcgtgaaaagtcagaaaaacgctaaagatacgaaaaaaatacaaaaattcctgcaaaaactgaagtgatagagttttatttcctaaatataaaatggcagggaaatggggagaagccactaatcagtcactaaacaaaaaaatttcaacaaaaaaaggttcctggcgtcgcatataggcgcgcggtggaacaatgtgaaaattttgctcgatttgacaggaaaattatcccaaaaaagccaattccgacagaaatatcacaaataaatggaataaagaatgggacagcgccatcaattagatatttaaatcatttttccaatcaaattttatcaactttttaatcaaaaaataaatgaaattaaaacaaaatgaaaaaaagaaaaccgcccggacggtgtaaaatatgagtaaaatacaaccgcatccgggtgcggagggaggccaaatgaaaaatggaataaagaatgggacagcgccactgctcgcgtaccctcgacctaggccgatcggcaccgaatagcattgctgttcccacgcataaaaagcaattatgcataattctttctctttccagtccttgtccttcattcgttttcctctggctgggatcgcctcaaagtcgactcggttccattcgggcagcaccaggtactgcatgcgcgcgtcacaggcggcctttgtcttctcagcgattccgctgactttcacaattgctccatacagtgccacttgacctgtgattgcacagtttggtcggatttttgctcctcttgccagtgagacgaaggccaccccccccccccccccgccaagccccggatggcccagatttgttggcactttccttcaaaaaaacatttaaattcttaaatattatattacttaaataaataaaaattcaggttaagaggcatgaaaccagggaggtcccaggattttattttttggcagggggaagaaaagaatacagccctgaccgattagcaaataaaaagagagaaaaagatatcgaatggctttcatgatttctttgaatacgggcctgtgagttttatggtccaaaaattcgtccgacgacgtttcggccgaagacgttttgtcctactccgggagaaagacagtggaagacaagcgcgtaaccagggtcgggagggggtgggggtggtattcaaatgaaaaattaaatttaaatgaaattgatgcttttttctggcgacgggattcttgccgattaatccggtgccagcttttcttttgacaatatcctgagacaacaggagtcccgccctgttcgattctcaggttccgaa

SEQ ID NO: 53105 - DNA, 91 bp, Heterodera glycines
  Genomic contig location: Contig_ID=SeqID_4082; Location=584..674; Strand=-
  SCN-specific regions: Sequence locations=1-91
ggattatttttcaaaacacctcgtagactgggggataattgaagactgcgggattaatagagactgggctataattagagcatatacggta

SEQ ID NO: 53106 - DNA, 298 bp, Heterodera glycines
  Genomic contig location: Contig_ID=SeqID_4082; Location=3148..3445; Strand=-
  SCN-specific regions: Sequence locations=1-38,83-90,112-298
atgtcagacaaccgaaaagaagcggatgaaaagatggcaaaagcaatgtaaaattaaaaatgccaaatttcaatttcaattatgcttttcttttttcttcagtttcatctccggcgacggttggctgtcggtgttcgatttgcttgcgccttctcaacttggcctcggaattgctctaatcagccaccgttttgactgttacgtggacgaacaaacgcagtgccaacacattcaccaactcatcaatttttttcgtcgacaaaccgctgaggaaaaagcgcatggaaatgtaaattga

SEQ ID NO: 53107 - DNA, 139 bp, Heterodera glycines
  Genomic contig location: Contig_ID=SeqID_4083; Location=2300..2438; Strand=+
  SCN-specific regions: Sequence locations=1-139
gtgtacgagtcgttggagtgtgtgcatgtgttttgcgctcgcgcacattttgtatcggcccatcattgtgtgttggtggacaccattctgcgcaatgcgaaggccgaagaattggcaacgattccgttcggcggcattt

SEQ ID NO: 53108 - DNA, 343 bp, Heterodera glycines
  Genomic contig location: Contig_ID=SeqID_22437; Location=294..636; Strand=-
  SCN-specific regions: Sequence locations=1-39,81-343
atggacttactcaccgcgttggcggacaaaatgaaaaatgaggagcaagatgaagtgggggaggaagaggaggaggacgaattcccacacattgcaaatggcacggcagcacacctgccgacaatcattgaggacgaggcggaggacgaactgaacgccatgctggctaaagctcgtcggctgaagcagacggagacggacaaaatgcatttcgtcaagtcagagcagtacaacaatgatggcaccagcagcgacgacgaggagacaacgcccgctaccctagcgggcggacacagcacttccgttgtgttcgactccacctctgagaagtacaagtccatcg

SEQ ID NO: 53109 - DNA, 1085 bp, Heterodera glycines
  Genomic contig location: Contig_ID=SeqID_22438; Location=359..1443; Strand=+
  SCN-specific regions: Sequence locations=1-337,360-404,449-698,720 -724,746-861,930-1085
  Gene Ontology: Mol. function=hydrogen-transporting ATPase activity, rotational mechanism; Cellular component=integral to membrane; Biological process=negative regulation of locomotion
aacaaatttggcggaagtgttaagcccgtgctaaatgttgtgcacacagcagaaccgccgcccacatacaacagaacgaacaaattcacctccgtgttccagggcattgttgattcgtacggcattgccagctatttggaattaaatccaggcaacaaatatttatttatttgtttaatgaaaatctcattatttgatttatttaaaaggattgaatcattctcacctagaaaaacctgataaaattgttaaaatgagcttaaatttctcaaaaaattctccattattttaaaaatttgtcaagaaaaatgaattaaaatataaacaaatttttgtcgaaccaaaatttttataattttcttaaagtgaccaaaaaaactcaattttttttttgtacctttttgaaaaatttattataaaactttcataaaatttttttaaaaaattaggaaaaaatccatcttttatggatttgtaaatagggatgggattcttaggtttttatttattttttctgcggctttaactcgacgaaaaatgcacgaaaaacacatattcttcgttttaacgcccctatccgaccctaggaatccctattttgagtgttcgccctaaaataagttcttactcctattttggcgtttcgcccttattttcgcccttatttcgcgattttttaaatttttttatagaaattcacaaattctttaacaaaaatgcaatgaaaaaaaattaatttttttttgacgcgatcacattcgcgaattttttgcccctatttaggtccctattttggacttttagcccctaaaaatcccatccctatttacaaacaggcgagtattttcaaaatcattgcagaaaaaaaagatatatttgtaaaatttttaaaatttaaaaataatttttctttatttcttttaatttttgttttagccccctacacaatcatcactttcccatttctattctccattatgttcggtgatttgggtcatggaattttgatgttcttttgcggactgtttttggtgcttcgtgagaaaaatttggaggctcgccaaattaaggatgaggtgaaatat

SEQ ID NO: 53110 - DNA, 367 bp, Heterodera glycines
  Genomic contig location: Contig_ID=SeqID_22439; Location=846..1212; Strand=+
  SCN-specific regions: Sequence locations=1-367
atgaaccgacggtaatgaattttaaaagtcacaaattcgtcgtttatttgactaaactgttttcccatttcagttggatttgcaacgacgtttggatggacattttcccctcttttgaccgtcctcaactcggcctcaaattggcacttctttcgccacgtttcaatgcgttggtggacaaacattttgatggcaaaagcgaattgacaatttggagaacgatcgaaattcgtcgcaaggacaaaggaccaggaccgaagctgtctgtacaaatggatgacaaatctttgccggaccgtccgttgcccagcaaaatccgttttaaatggcttcggattgagtaattcggaatcagagatttatggca

SEQ ID NO: 53111 - DNA, 183 bp, Heterodera glycines
  misc_feature (122)..(122): n is a, c, g, or t
  Genomic contig location: Contig_ID=SeqID_22440; Location=2192..2374; Strand=+
  SCN-specific regions: Sequence locations=1-183
atgtccaacgaattttgtccgtcaaattggccaattcttccgacgactgttcagcccgactcggagcagttcaaacagaatgaagccgaaatggcagaatcggtgcggaaattaaatctgtnaaccgggaaattaattcattatattcagataagcgaatcaaaaatgtggtcgatgcggtga

SEQ ID NO: 53112 - DNA, 1597 bp, Heterodera glycines
  Genomic contig location: Contig_ID=SeqID_22441; Location=137..1733; Strand=+
  SCN-specific regions: Sequence locations=1-19,41-550,572-782,804 -1102,1124-1597
gtatttgcgaggcgaagatattcgggaggcgcagaaaggcatcaattgtttggattggaattttaatgattcgtcacgactctgtgcagcctatgaaaggtaaatgcaaactgtgaattcagagttgggagaaatggggcgatgtacagttggtgatgggggggatgtggccaagtagggtaacgcgactgacgaaatcactattttccattttataatttgtgatctcatcatcaggaaacacgtccttttcccaagttaaaatattcgtttaattccatgtttaggaatcgtggtactgatcatgccgtcgttgtgtacgatttgaatcggacgacgcgcaatgtgcgagaagtgccaatgtcaattttcgaggctaattttgctgaaaaagtgctcagtgtctgttggttcaggttcctccccatgcttctgtttccaattctctcctcttccattggcttgccctttttagagacgacccaaatttgctgctgatcaacgcaagtcgcggaattcgaattgcggacattcgcgagcacggcaatttccacagcactttgagtgtccaaaatccgatgatgggcctttgcagtgagcccaactttggctttcggttccgaaaaatgaattcattcactcagtcatccattttcaatttagttttgcttgtttcgctcacaatttggtttttgtttacgatcggcgttctttgggctctgcgccattgcacgaaattgaagcttgtgtaagtaaatgggtgttgttttgtttttaaatgcattttaaataatatttttattgaataatgggagtcggctaatataaacaaaagatggggaagcgacagccatgaagtaatggtttttggattatttagagttattctgttctttcactgcatttttcgcccttttagtcaaattccaaaatgttaaacaaattggcgtggcacaaccgccgtctcttccatctgacagctttggccaaagattgtggcaatctcttcaatttttccatttcatcctccgccttttctgaccgtcaaaaaaatttgactggcgctgccgacccatcgtcgaacatttacagtcaattggacccatcacaacggaagggactcgacattgatggtcactcatacggagttcatttttactcggtttggattgttttttgatttaacttattgttgtaaatcattctttgaattcagctgcccggaatgtcgtctttgacctccttcgactggcacccgaccatcagtgatcggttggcacttttacctgcccaagaaaagccaatagcttttgcccattcggtcgcctctacaaaacgaattgccataattaaagtatgtcttgcttcttatttttttcactagttttctgttgtgtttagcttcgtgatgacgtcaattccgtcatcggtccttccggtgacttttgcatttcggcggggccgcagctgaactttgaaaacggcgagaaattgttggccaaacccaactgcacttctgacattgacactgaaacactgttcaaacgacgggtgctcgtcggctacggctacggaaattcactgaacgcattggcaa

SEQ ID NO: 53113 - DNA, 54 bp, Heterodera glycines
  Genomic contig location: Contig_ID=SeqID_22442; Location=209..262; Strand=-
  SCN-specific regions: Sequence locations=1-54
atgcgcacccgtccgatctggcaagttaagcaacgattgctgactagccaaaag

SEQ ID NO: 53114 - DNA, 878 bp, Heterodera glycines
  Genomic contig location: Contig_ID=SeqID_22444; Location=1..878; Strand=-
  SCN-specific regions: Sequence locations=1-47,69-72,95-105,127 -139,161-409,431-490,512-564,595-878
  Gene Ontology: Mol. function=amino acid transporter activity; Cellular component=integral to plasma membrane; Biological process =synaptic transmission
agtcgcttatttcactgccactgtcccttatgccatcattgtcgttctgttccttcgtggtttgaccttttcctcagtttttccatttgtcttgtccatttcccccctttccacaggaatttccttggacggtgctcagttgggcttggacttttatcttttccggcccaattttagcgtcattttcgaccccgcggtcagtcccacgggcaatcacaaacttttccgattaattcgccattcctttggaggatcattcattttggcctatgttttgacagtgatttgctgccaaactctccccccccccacccgaaaacactttaaagcgacgccccttcccaaaaaaagacttggcgtgccgctgccacccacgtgtgcttttcgctgtccgtcggcttcggtggcattttgtctttgtcctctttcaattcgcattcccacaactgtttcactgatgcgctgattatcactgctgctgatggtaccaaaatgaaggacagacaaaaacgaatattctttttctttttttccatttgttttccgacttttttctttccacggattaattaattaattaggtaattaattaatcttttaatcattgccatttaaatctttcccaggttttatgtcggtttttggtgggacagcagtgttcagtgtgcttggcttcatggccaaacagttggaccagcccattgaccaagtggtccaaagtggcaccggtttggccttcgtcgcttaccccgaggcatttctgtccgaattgcaattccaaagtatcggtggcttttcaggcgatgagtcgcatgcctttgtcgtcactttggtctttccttttcttctctatgcttttcattctcggcatcagctcc

SEQ ID NO: 53115 - DNA, 337 bp, Heterodera glycines
  Genomic contig location: Contig_ID=SeqID_22445; Location=791..1127; Strand=-
  SCN-specific regions: Sequence locations=1-3,26-54,90-178,201-235,299- 337
atgcctgcaaaatgtcagtgttaaaatttcaaattgccaactcaaatctcagagaaaattattaataattttaaaataagtaaattttacagtaacttattaccagggaacggatttatttttaatgcgctcaaattttgccatacaaatcgactgataggattaaaaaacacaaattatttaaataggagttttattttcaattaggcaaaaatgaaaagaggaatttttcaagaaaaaaattaaaattaaaaaaaattaaattattttttctagttaaaatttttatattattaaacaattcaaaggcaagagcaatattaaatggtttaataaa

SEQ ID NO: 53116 - DNA, 725 bp, Heterodera glycines
  Genomic contig location: Contig_ID=SeqID_4084; Location=4377..5101; Strand=-
  SCN-specific regions: Sequence locations=1-725
gtgactcggtgccgaacgccggagggtattggtcaacgcctgcagcaaaagaagtgcggaaactcgtgccataattatgccggattttcaattttcctcccccactaattttggcacaaaaattactaaacgccgctccgagtgagtgctgcgcattgtggtgctggtcgatgctggacgggtgccgaaagtccgccaaatgtgccaaggacggagtcatgggcctgagttggtgcagcggtgagccgtccgacggacgcggcgacgaggagacactgttccgcgcgaagggagggcgcgagcggcgccggaagtcgtccagcgttttctgagaacggaccgatcgaatgaaaatgagggcaatcattttgagctgatcaaaagaagcgattgtcctacgtaaactgttcatgatcagaatacggaagcattctcgaatatatcaattggtctttgaattattatcaaaatgttgaacattatcagttgctcaactgatatctgagtttgaaacattgggccacaggccgtagccagaaaaatttcggaggaggaatttttctctcttttttttgctcttcggtcaaaagttttttttctcctatgttatttttaaattttcagcgccgagaaaaaaaagcaagaatatgtagtttttcgataaaaaaggaccaattttgccatttgttaggctccgtcgggttaagaaaagcgcttagatcttc

SEQ ID NO: 53117 - DNA, 1014 bp, Heterodera glycines
  Genomic contig location: Contig_ID=SeqID_4084; Location=3963..4976; Strand=+
  SCN-specific regions: Sequence locations=1-1014
atgaagctgatcagaggtggtctgatcgaatcactgatggcattggaatcggaattcattttcgtgccattgcttttacagttttgggtggacagacagtgcacgctgaacaggacgaacagccgcacagaagcgccgaacagcgtaacagcagcacaaacggtcagatcagctagtcattatcagtagaaataccactttaaattaaacacagcaacagtctgatcaagtttactgatgcattaagtcagaaaaataggagcgacatcgccttttctgaccaatttgataagctgatcaagttgatcacggcacagcagatccgtagccagggatggaagacggaggaattcccgcccccttccgaaatgaaaaatgaaacattttgaagaaaaacgggcaattttttttttggaagatctaagcgcttttcttaacccgacggagcctaacaaatggcaaaattggtccttttttatcgaaaaactacatattcttgcttttttttctcggcgctgaaaatttaaaaataacataggagaaaaaaaacttttgaccgaagagcaaaaaaaagagagaaaaattcctcctccgaaatttttctggctacggcctgtggcccaatgtttcaaactcagatatcagttgagcaactgataatgttcaacattttgataataattcaaagaccaattgatatattcgagaatgcttccgtattctgatcatgaacagtttacgtaggacaatcgcttcttttgatcagctcaaaatgattgccctcattttcattcgatcggtccgttctcagaaaacgctggacgacttccggcgccgctcgcgccctcccttcgcgcggaacagtgtctcctcgtcgccgcgtccgtcggacggctcaccgctgcaccaactcaggcccatgactccgtccttggcacatttggcggactttcggcacccgtccagcatcgaccagcaccacaatgcgcagcactcactcggagcggcgtttag

SEQ ID NO: 53118 - DNA, 501 bp, Heterodera glycines
  Genomic contig location: Contig_ID=SeqID_4085; Location=187..687; Strand=-
  SCN-specific regions: Sequence locations=1-46,90-214,247-372,439-501
atgctgcagtatttgtgctgtttgaaggtggtgggaatcaatttccacttttttaaataattacaaattccctttccccaggaaaaggacggacagaattcggagtgccgggaccgcgcctttggctacttcaaatgccgcatggacaacggactgatggaccgggacgaatggccaaagttgggcttcaaagacctcgcagaacaacaacagcagcggaaagcggaggagaaggcggtggtggcgacggaattacagcgatagaaactgctcaattattatttcatccatttttctgttttgaagacgaatcatagaaaaaaattgttttaacatctattcaaattatgatataaattaagtgcccgaaacaatttttgtaatttaaaaattaggaataattgaaattaattttaaaatataaacaaaaaaaattttgaagccggccttttttttcgattcgatgactgatcgatcgcttttgatagtcaagcaaataaa

SEQ ID NO: 53119 - DNA, 625 bp, Heterodera glycines
  Genomic contig location: Contig_ID=SeqID_22446; Location=338..962; Strand=+
  SCN-specific regions: Sequence locations=1-109,131-244,301-473,526-625
ctggttatccgttgccttttaagcgcccctcgggatgggaggagccctatcggagagataaaatgggggggggggaagggtaaaggccatttccggtcccggccttacacctccggccctccaaaagaccgtccctggtcgttaaaatttaaataatttccaaatttgaatgaagtcctcagacttttctttcttttgatttgttttacgatgagaaatttgttttgattttaagccaaaactgaaaataaaataattcaaatatttatttaattactcaaaataaaaatggaaaatgccgagcctctaatgggaatgaacccattcctccaaccaatccacagaagctctgtcattgagctactaaaagaaatccgccctttttaaattaattttcttgaaattctgattcaattggatttgaattaaattggcattgcttttcaaattatgagacaagagaaaatctgatgaaatttaaaacttttaaaattatataaatttaataattgttttatttaatttccaatcgactaaaatttggatttttgatataatttggtgtgactgtatgactatacctccccttcatatctgaggatcgtccctgatccaagaacttaaa

SEQ ID NO: 53120 - DNA, 213 bp, Heterodera glycines
  Genomic contig location: Contig_ID=SeqID_22447; Location=1293..1505; Strand=-
  SCN-specific regions: Sequence locations=1-119,154-213
gccatgccactgaatacgctaaatttaaacattcagagatttcgtcagggaattcatccgccaaaagagtatgactttggccagagttcagcacgtctttctgacaatgaacaacatgcaaaagacgacgacgaagaagaagacgaaaaagaattgaaattagttgataacgacgcccaattaaatacaaaatcacaaactgcgagcaaatga

SEQ ID NO: 53121 - DNA, 1026 bp, Heterodera glycines
  Genomic contig location: Contig_ID=SeqID_22448; Location=891..1916; Strand=+
  SCN-specific regions: Sequence locations=1-45,186-190,219-519,541 -606,644-772,811-922
atgaaaacagtatgtctaagtgtgtctttatgtcaatttgcattcatttttatattttgtaattaataattttttattaagaattgaaaattatattaatttattttaaaaaagctttcataaattcaaaaaaatgttcaattttctttttaaaatataaaaaaattaaaaacatattaatatttcctgcattattttattttaatattgttttttttcttcatatgagaattctttgtatttttttgcctgaaaacacatacaatgccttttttgtttttttaaccttacaatgcgcgcattgtttatgcgtggcggattttcgagaaaacccattcgtcatctcgagtcccagtacaccctcgctcaaacactattcgcgaatagatataaatatcttcttcaatgataacaaagctttacgaagtgaatataatgtgaattattcaaaaaagttggttccttatttaatacctaatttaatgttgagtcattttctttcttggaaggaatagttctaaatttttatttatgtctttaatcgaaacgataaaaattttaattctttgtgagataaaatagagaagaggtacgcctttttgccagtaaaataaataatttattattaatttctattttttatgtgtttgttttatccaattgctattttaactgatttaggtacatcttgtactccttgtttcatttgttccatggagtatgaagaatattaaataaatcgattttgaatgatgaattaatactttctcactaatatttgttttatagattttataaattttattttaagccaattatgcgacatacgaagtgaagcaaactataggagatgatagtgtatattaatttatcgcagcacatcgaaatttattgcattgccgacattcatattttttcaatgaaaataattaaattggtattttgaattttttaatatttctttttttaaaatatgctattttggaattgtaaatttatttctttcatttaatatataataattaa

SEQ ID NO: 53122 - DNA, 405 bp, Heterodera glycines
  Genomic contig location: Contig_ID=SeqID_22448; Location=1240..1644; Strand=-
  SCN-specific regions: Sequence locations=1-111,149-214,236-405
atcattcaaaatcgatttatttaatattcttcatactccatggaacaaatgaaacaaggagtacaagatgtacctaaatcagttaaaatagcaattggataaaacaaacacataaaaaatagaaattaataataaattatttattttactggcaaaaaggcgtacctcttctctattttatctcacaaagaattaaaatttttatcgtttcgattaaagacataaataaaaatttagaactattccttccaagaaagaaaatgactcaacattaaattaggtattaaataaggaaccaacttttttgaataattcacattatattcacttcgtaaagctttgttatcattgaagaagatatttatatctattcgcgaatagtgtttgagcgagggtgtactggga

SEQ ID NO: 53123 - DNA, 249 bp, Heterodera glycines
  Genomic contig location: Contig_ID=SeqID_22451; Location=53..301; Strand=-
  SCN-specific regions: Sequence locations=1-107,134-249
atggagaaggcctgcaaaatttggagagattatatcgattttagtgcgctaggttagatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaaatttatgaattaattttgcaaaaataaa

SEQ ID NO: 53124 - DNA, 310 bp, Heterodera glycines
  Genomic contig location: Contig_ID=SeqID_22451; Location=694..1003; Strand=-
  SCN-specific regions: Sequence locations=1-310
tttcaagtgtcgtttggggtactcaacaatttatgggagcaaaatccaacgcagaataaagtacaggctatagggaagctctcccgaaggattcggtctccccataaatctggggcgcatcgggtcggggggactgccccgaaaacaaaaaaatcgattttttcaagtgtccgtttggggtactcaaacaattatggggagcataaatccaacgcagaattaaagtacaggctatagggaagctattcccgaaggattcggtctccccataaatctgggcgcatcggttcagggggactgccccgaaaac

SEQ ID NO: 53125 - DNA, 1555 bp, Heterodera glycines
  Genomic contig location: Contig_ID=SeqID_22454; Location=1..1555; Strand=-
  SCN-specific regions: Sequence locations=1-290,314-449,471-1069,1091 -1152,1174-1555
aaaaaatattaatttttttgcgaaaaaaggcgaaaaattatgttaaatacaccccctaattcgggatttcaaaaaagcaaaaatacacccctaaaaatcgactgaaaaaaatacaccctaaaaatcgaatttttgatttcagcccccccccaaagccaagggtctggctacgcccttgactggggggggggggggagggcggcaataaaaaggacttattatgttttttttatttccggtaaatgaaatgtcaagtagtataataaatggtattgtttacccaccatattttttaagttatttgttttccaaaaatcatgaacatttgtttccctgaatgatgctttaactgaaaatttgagaatggaatccttaaaccgttttgtgctttgctaggcgttttttcaatgcgctgctccgctcgagtcacgccatcagccattgcctcctttctcagtttattctctctgaacatggctctcttttctgtgaattagtcactttgttgcgcttttatgttcgttttgaaattgacgacgtaaatgggcagcaactgaccgcggctgaagtttgtttggaaatgcctttatcatttattcttatctgtttgaaggtcactaaacgtcactacgattcgatttccgatctccaaaaagcgacttttaaatttttgaaggacaaattgggcgagttttgtcttctgccaattgcatccgttgacaccagcaaatttttgcgtgagcatctcggcacattacggtaaaaaaggattgaaatagcaaacttaagtattttagtttggaggaacttcaacacattgccaaatatttacgactaatccctgacaaaaatcacgacgaaattaacggagatgaaagtgctcgtcaattggtttctcatttggaccaaaattacggtcgttttgacgatccgacatttttacgagaagcgatcattttccaatgcgaacgtcacccttctcaactgcaaaaactaaacgcagaacctttgtatcccaccgaagcaatcctttgggatgaaaaggtcgggcgaaatggaaaacatcccgtaaatgcaaaatgagttttgtgagtttagtccgttccttacgaacattacgacggcaaaaatgtgctgccactcaacaaactcaatctgcaatttttgactttgcatgattacttattgaggaatttcaatttgttccgcatggagtccatttgtcggtgaatttctcaggcgatcgctcatttgggtgttttaagatgaaattcgccaggacattgaggatgttctgttcagaatgaagccgtggcgtcatgagtttaatgagcaggaagttgtttggggcggttgggcgcggatggcactgccggtgggcgaatgccgagttgtgcacgtgggcaaaccgatggtgggcgaggtgagcagtgcaacatcggaagatgatgcggagtttaactactattatagaatttgactaaaaattaccaaattgttggttgtatatggtcccatgctgctgttaggcgccctcagcgaaaatttaggaaat

SEQ ID NO: 53126 - DNA, 1188 bp, Heterodera glycines
  Genomic contig location: Contig_ID=SeqID_22455; Location=78..1265; Strand=+
  SCN-specific regions: Sequence locations=1-1045,1068-1188
atggcgacgaacaaaacgatgagtgctcaatatgtctcggtgagattaagccggggacaatggtcagaccgttgccgtgtaaggtaataaatacaaatcttgaattttttaatttacttatatgttacttattttagcacatttttgacgacgcatgcattgaaaaatggtacaataaatctgctttttagagatttctggctaagaaatacacaaaaaaaaaatttaggttcatgggcggaaatatcacatgtcctttatgccgtgaaaagttgcaaatatcgcaaacggcacaaacaatgacaatggctaaccatttaggtaattaggcattaaattttgaaagggatgaactgcaagataaaagggaatttctgtttttgatcccttaaaaagtgatctttttttcggaatctggcaacacttgccttccagttcaccatttttcgttagcggaaagtaatatgattaaattaatagaaattaaggtgttatggcaccaccgggtggcattgtagcaccgagagttcaggtaagtggtggcactaatgagggacaagttcggcatggaacggttaccgcagaccagcatgaagttgtcatcgatattggcacgaatgccaatcagaatgatggaaatactggtggaggaacggagagtcaagttccagaaacaccacggcatgaagcaactgaaaataccggaggaacaatgaatcacgggaccgcaacaccacggcatgaagcaactgaaactcggctgaataatggctccgaaaatgagacaaaatgatgcatgagcaatttaaagtggattaacgaaaagctgtaatgtttaaattgaaaatttttaatgataaacaattttctaaaatttctaacttcggttttaggcacctgatgaaacagctgacaaaaaaccaatcgacggaccgattatttctaccacccaaccctacaattatttaccattttttgttttttttcttcatcccatccatttgaagaaaatcactgctgttgtacgaatttctgtttttcctcttataaattacaattctatcaaaacagggttcagctgggtttctgctgctactttttatattcaagaggcttagaatttagaaatgtgattattgggacagagttgtaggcaaaaactgaaactagcaaaatagcaaaaatgaa

SEQ ID NO: 53127 - DNA, 1638 bp, Heterodera glycines
  Genomic contig location: Contig_ID=SeqID_22456; Location=85..1722; Strand=-
  SCN-specific regions: Sequence locations=1-81,103-891,914-1090,1113 -1446,1468-1519,1541-1606,1634-1638
atgaaagacggggaggtcagaggacgcgggggtatttatggggaacatggacgaagagagagagaggagagaaacaaggggagagaaataaagatatgaaaataaagtgggcggacaaaagagtaccgatcccaacaaattttagcattattcttttcttttttttagcttatttgttagcgtttgcttttcttcttttcttttccatcatacttaccattgtagcaatgtccgtgcaagaagatgaggctggataatttggcttaatttctaaaaaaaacattaacttttcaggaagaacttcaatggcgtcgagaacacgaggaaatgcacagaaaacacagggtaatttaattttccttaaaaaactgtcgttcatttataacaaagttaatttttgtagggccacgatgcgatgcatgcggaaatgttcatcattttcattgtctcaatggttgtggcacaaataatcttgatgttgtggaagagaagacattttcgctcataccaggtaaaaaacgggtggtggtttcgctgaaagggctttatctaacaataagatgattttggttcagttcgccactttggtcggtctttggctaatcccttttatggtgtcacttaaaaatggctggtggcgattcattctttcctggactgtgttcacttcttcaatattttacgtttggcggagggtcaatcagccggcaatttccggatcaactcccaggttttcagtgggttttacgcaaaaaagggaaattcgtccatttcccttttaggctcgtctacaaatactttttgttcatgcataaactcagttacatttttggtattgtcggttacttttcactcgtctttactgtcattggaataaattcggtgttcggtaaaattaaattttctaaaaattcaaaaaaggctttttaaggaattagcagtaatctgagcttggattttggcgtgcatttgttgttttatggcctttattacggtgtgcttggacgtgatttggcacattctctgaccgacagattggcctgcaaaatcggggttttaaaaatgaaatggagagattaacacattattattatttttctagtattttactcatgacggattgccaaaacggtaccaacaaaacggaattgttcactgttttttttccaccattttagggttctcgagtcggatatgtgcgccgtctgcgggaataatttgcataaaccgtcgtccaaccaaaacaatttcaattcgttggacgaagcgaatggaggagtgatgaccgaagctgttgaactgccagaagaaaaagtttgtcacggttttgttcgtttttttgacactttctttttagacgtatgctttggcatgtaaccacgtattccacgagttttgcatccgcggatggtgtgtggtgggcaaattgcagacatgcccttactgtgagtgttggaacaaatcaaattctccacgtttttttccaatgttaacgataggcttttaacttaataataagacagatttttatggcaaattaagtacttccttgcaaatttacatatatgaacttaattttatatccttgccattttcaggcaaagaaaaggtggacctcaagaggatgttcaagaaccc

SEQ ID NO: 53128 - DNA, 2151 bp, Heterodera glycines
  Genomic contig location: Contig_ID=SeqID_4086; Location=1987..4137; Strand=+
  SCN-specific regions: Sequence locations=1-211,233-581,605-891,913 -937,959-1445,1467-1527,1549-2151
  Gene Ontology: Cellular component=Golgi apparatus; Biological process= negative regulation of cytokine biosynthesis
atgaatgtcctcatgcgaaatgtgtgcgatttggtgcctgaacagctcactccggacgtggtcagcagccgactggtgatcacacgatgcgaagaatgctcaaaagtgcgttcatttgtggcataatgccaaacaatccgctcgaatggcattttcagtgccctcaaaagttgcccagcattcagcggatgctcagccagatcagtcttgatgccagcattcagtcccttctcggtatgccctaattgttggccaattatcggccatttggcctttgttcagtgattttggtcaaagacttcgaaagtgcgcgtggcattgctcgtcttgcgcagcaggacccaaccgtcaaatttgtattcctcgaagacgacgacttggactcgccgaccgtttgcgaattgaccgactccaacgacggcagctcgctgaaggacgcggactcgctgaaaagcttctcaaaaacatcggtcagctgatgttgggcataaagccaaaccaatccattgaaaccttacaaaaccaatcattccgacagtgaaccatcggcggaattctttaagtcaaaatggggatcatattgaagagacatttttgtaaaaatttcccgaagttagtggatcaaagagaatggcaccgctctaatcggtcaacccggcattggtcaaaagatcccaacccgagatcactaccagggatgtgcgaaaatcacaaaaaaaaatttttgtatacgaaaacgaaacaaaagaggcattcgacacgaaaacgaaacacgaaacgaaaaaattttggtagacgaaaacgaaactcaaaaagtgccgaaaatgtaggacgaaacgaaaacgaaacgaaatttcgtccctcgctgatcactactctcatttatcaatcgtgattttgtttcaaataaatctatgatcagctaattttgccctaaacatttgccaaagttcaggtgctttttgtcagcatttcgttcatcattttgatggtcatttcgctcgcttggctcgtcttttattacgtccaacgatttcgctacgcacacgcaaaagaccgactgcagcggaggtaaaagagacaaaatttgaaaaaacgacattcccgagattcttttttcgagactctgatcgatcggataatagtcgagactgatcattttttatcccggcttttttgtgctctctcaaattctcgtgaccatttctaaaaggacaaaaagaaaatccgccttttttcagactgtttaacgctgccaagaaagcgttggcccgaatcccaactcggccagtgaaggcgggcgacaaggagctgaactcggactgccccgtgtgcatcgacccgtaccggcagggcgacatttgccgacaattgccgtgtcggtcagtgccaaaatgaaacaacgaagaaaaaatgactaattacacgaaacaaaacagcacaaatgattcccaaattctttagacacatcttccacaaaagctgtgttgatccgtggctgttggagcaccgaacgtaattaaaataaatgaattaaataatcaattagtgcggagcacgggaaccgaggcttttttggccaagacggaccacccaaaagacattggctaatttgaaagtgtcgaaaagttggcattcctaaggccttttaaagcaagagaaagcaaagaaactgaatcccgtctcgagactaaaaccaacattttatcaaaacgaacgaaaatgccgaattctctggcactaattgccgttttattcataattaaccgcttcttctgtcaattaaaaggtgcccaatgtgcaagtcggacattctgaaggcattcggttaccacgtgtgcaatggccgacggcgagcccaattctcggcagggatggaggaggacggcgcgtcgggggaccacgacatgccccggggggatcggctgagtttggacgccaattcgacgggcagcgagtcggccaacccattccccgtggtcaccgaagtgcacgaccctttcggcttttctccgtccgcttcacctcaactcattcaggtgtctggacactgccgttgagggagttggagttcgagagcgagaattcgagattgatctctcgagagtttctgacgtctttttaagagtcacaaattatgtaaacagatag

SEQ ID NO: 53129 - DNA, 313 bp, Heterodera glycines
  Genomic contig location: Contig_ID=SeqID_4087; Location=1170..1482; Strand=+
  SCN-specific regions: Sequence locations=1-190,213-313
tttaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttaaaaaaattttttctccatcttcctttttgatactaaagcatcagagtgctaaaattgacttgtaaataaaatttggtgcgctttagagcattttctgaaaaaatatttatgaa

SEQ ID NO: 53130 - DNA, 660 bp, Heterodera glycines
  Genomic contig location: Contig_ID=SeqID_4087; Location=469..1128; Strand=-
  SCN-specific regions: Sequence locations=1-201,223-583,606-660
  Gene Ontology: Mol. function=ubiquitin-protein ligase activity; Cellular component=DNA-directed RNA polymerase II, holoenzyme; Biological process=signal transduction
ggcggggggggggggctccgtctgctccaatttgccaccggcagttcgaggtaacagacactctttagcttctgatcagtaatttatgcgcaaattaattgcgtatgcctaatttttggcatcgtgtttttcctcgtgccaatttctgatcagtttttgagaccaaaacgtttttcatggacactcactctctgctgcagcttttcctttctctcttttgcagtgtgccgtacgaaggcttcagggcgttgaggggttccgatgggccaaaacgcttttgcattgagcggtggggcgagggcgaaagcttgccgagggcgcacacgtgcttcaaccggttggacttgccgccgtaccgggacaaaagcacgttgaagtcaaaactgatggtgagttgttgacattggcacaatgctaaagatcgggttttttttgcacaatttttgatccgcccacgtcaaaccaataaactctgaaagtatgtttcagtgcaatttacgattccctcctcccaaaacagattcccaaatcaattccagtcaaagcttaaagcctcaggactcaagaaaagcccaatctcgagcatcatttgcaaaaagaaaattaagaatatcccccatttagttggccatctacgaaagttcaagctatgccattgaa

SEQ ID NO: 53131 - DNA, 972 bp, Heterodera glycines
  Genomic contig location: Contig_ID=SeqID_22459; Location=43..1014; Strand=+
  SCN-specific regions: Sequence locations=1-797,822-972
atggctgccagaccgattaagaaggcaaacgattggcatttgcatgcaaattgtgccccttttattgcagtttcacttcggcatggacattattcaacagagtgagcatgacgctgactggagacgtccggttatgattctgaagatgcccgcccattgtgtgtttttggtcgcagtgcgtactctgtcgcccaccgcgtgaaaatttactcaataagtatattcctatgcttatgaatttcagaagtgctccgagttggctcgcattagcagtcggctatggcttggtgaatgcgctgaactcattgcatgagaagggattcatccatcgttttgtgacgccgtggaatttcatggttccgatgccattcaccatggacaacattaccaaaaagatgattatcatggacttgagtttggccaaacgatgggaccccaactcgtaagggaaattaaatgtcgtaattaaatagcatcttttctacagcattagtgatgtctcagttcgcttttctggcaccgttaagtacagttcactgagggcactcaattttcgaaccgttgggccggccgatgacttaatttcagtcattttcatcgttgctgagttgatcagcgggaagtgcgttctttgtttggaaattgatttttaacttgcctttgtagaattccctggcgttcggtctcaaaaattgaaaaatgcatcgcgctgcgacagaagttcgcggagtccatcgaatttaggcgccttccaagagaacttcggaaactttatacgtatgttcaatttcagaatgaaattatataaaaattaaatttatcctatttagagatctctgcaacacttctcccgctgattgtcctgcgatcgataatgtgaaagaggcgttcgaatccgcactgaagcgacgagatggcgatgactggagtatcaagccaatgcctgactggttggagatgcctactgaatag

SEQ ID NO: 53132 - DNA, 1681 bp, Heterodera glycines
  Genomic contig location: Contig_ID=SeqID_22460; Location=101..1781; Strand=+
  SCN-specific regions: Sequence locations=1-389,413-420,445-1314,1339 -1553,1575-1651,1680-1681
  Gene Ontology: Mol. function=proteasome endopeptidase activity; Cellular component=proteasome complex (sensu Eukarya); Biological process=proteolysis and peptidolysis
gtctgatacatgccaatcacgggagctccgcgattgattatctgtctgaccaactcagccgtgcttcgacgagtgccgttcgtcacggcgcatgtctgggacttggattggccgcactgggcacacgtaatgaacgtgtttacgaacacttgagggatgtgctgtaccagaacgaagcggtgtcaggagaagcagctggaactgccatgggcttagtcatggctggatcgatgaaccaaatggttttaattgtcttttatttggtttttgaaatcgatttcttacaccttaaacgtcaggccttcgacgaaatgtaccagtacattcttgacactcaccacgacaaaatccaacggggacttcgcacgggaatttctatgttagcttatggagttgcagaaagagctgaagagtgagagcaatttgtttccttccttttttcttaatttgttgtttagttggattcggttgctttataacagtccttacgcaattattcggcagacgggtgtttgcatggtcggtttatcccttttttacttccaatatttcaaaattcgttttcagattgctttggcttacgcgggtacgggaagtgcgtcggtgatcaaaagacttctcgagagagtcgcatcggatccaaatgatgaagtgaaacgatttgcaaccattgcaattggatttgtcctgtcaaagttaacatttttttgttttccaaatcatgtttaccctatttagtaatccgcaacaatgccttgattacgtcgaacttttgacagaacattttaacggtcacattcgatatggcgcagcgattgctttggcaatttcatgcgctggcactgggtacaaagtgagtactgaagtggccacttggcatctgggacattacctcctcccctttaaggaggccatcgcattgcttgaaccgttgctgcaagcgaaggaaaattacgttcgacagggggcgttggtttccctcgcttttgtcctcattcaacaaacgacatcgacctgcccaaaagtcgcagactttcgaaaaactttgattaaaatggttggagagaagggagaagacacaataacaaaggcatgccgaattctattatattttcatgacaaattgtttagttcggtgccgttgttgcacagggcatattggacgcgggcggtcgtaacgtcactctttcgctgcacaaccagaacaaccaaaacgacatgccgtctgtattggggatttttgtgtttttgcaacattggcattggcactcgatgactcatttcatttcattggcacttcgtcctacttgtgtgattggcctcaacaaggatttaaaagtatgactaaacttcattttatctacatacattaaaacatgcgcagatgccaaaaatggacttccgctgcaatgccaagcagtcgatgttcgcatatccgcaaccaattgaagaaaaacgcaaagaagggatggaaaaggtggaaacggcagttctctcgaccacaaaaaagaagccgaatttggagaagaaagcagaggatgccggttagcagaaaaccaatctttctttcggtcacaatttaatttttgacaattcagacggaaaagccgaagagaaaatggaggtggaccagaaaagcgaagaaaagtccaataataatataattcaattaaaaatatga

SEQ ID NO: 53133 - DNA, 716 bp, Heterodera glycines
  Genomic contig location: Contig_ID=SeqID_22461; Location=161..876; Strand=-
  SCN-specific regions: Sequence locations=1-145,169-172,194-207,229 -516,569-596,618-635,657-716
atggcacttttccatcggattggcgtcaaaacaaaacttggcactgtagcggtgccgttgtatcaaacggttgtccgtccctttggcatcccaacgctgagcagttacgtgacaagtgagtgaaagtgccaaaggggggaaggcatttaattcattaatttaatcatttgattaattataatttagaaaatagagtgtcgaaaactaaatttcaattttaattcattggattttaaaaaatcataagagaaactcactgaattttttcgttaaaatttaaggttaattttttaaaacatttttttattacacatatatcattaactaattttgacatttgtttaaaacaattaaagctaaaagctgaattaaaaataatttacaaaaaaggtttattcacgccattgaatggaggtcacaaaatgaattttgtggaacgatttgtgaattttataaatgatttgtacgattggttgtatttgaacaatgtgatggcttcgtatgaggtaagcaagcaaaaaaatatataaaatgctaattttatttaaaaataaaaaattaaatttatcttttaggagcctgttattgctgaagcatttggccaaaatttccccccgctgaaacaaattatgcgcaatgtttccctgctgtttacaaattcgaacgaagtcggacaaaacataatgccaaaaatgattggaaaaatccatttttag

SEQ ID NO: 53134 - DNA, 669 bp, Heterodera glycines
  Genomic contig location: Contig_ID=SeqID_22463; Location=788..1456; Strand=-
  SCN-specific regions: Sequence locations=1-493,515-669
atgtgcaaaatggatgtggaaaacagcaacaacagtccgaacattgtcggtgttaaggagtggtcaatgtgcaaagagtcgatcaaagacctgttgggccccaactttaccacctatttcattctcaatttctatgtaagcaattgtaaaaaaaattataggcctaagactctaatagagccaaggcacatccaggcctaggttttcgattttttggtacttcggtgggcaatctttcttaattactgtccacaacaaaaatttttttttcacgaaaccaactcagttcgatgcctgaccgtcattcacagaacgacccagcccctccatattcgggactgaatcattttttaggcctaaaaaaagagacttgcgaattacaaagaatcatttttcaggacctcaattccgaatagtaaacgcttcgaagatttgccctgccaatttggcgagcttgtcgatcagtcaagaaccaaggggaatgaatgcaaaaaataattattaagaattaagactgatgtggtaagtgtgaagaactgtgttcctccaggcaaaaaattctaagaaaatttataagcatttgaagggttctcagcagtttccctgcaaaatttggtgagcttctgatcagtctagaacgttgggtgataaatgaaaaaaataattaaa

SEQ ID NO: 53135 - DNA, 603 bp, Heterodera glycines
  Genomic contig location: Contig_ID=SeqID_22464; Location=1517..2119; Strand=-
  SCN-specific regions: Sequence locations=1-68,91-97,392-603
  Gene Ontology: Mol. function=DNA binding; Cellular component=nucleus; Biological process=regulation of transcription, DNA-dependent
atgacttcccctttcattggcctttattccttccttttcatccgtgctgagtcgatccacaaaaaaaagagaaagggagaggagcaaaaggcgaagaggaagagaaggggaagaggaggaagagaaaggggaagaggaacagaagaggaagaggagcaaaaggcgaagaggaagagaaggggaagaggaggaagagaaaggggaagaggaacagaagaggaagaggagcaaaaggcgaagaggaagagaaggggaagaggaggaagagaaaggggaagaggaacagaagaggaagaggagcagaaggcgaatgggaacaaaaggctaaggggaagagaatggagaaatgggaatagaacggaaagagttgaaggggaagagaaaagggaagacagagacgatcagaaagaggaacggatgaaggatcagaatgacgatattcccggtgataaatccttcaacttgacctcttataaatatgagccgagcatttgtctaactaaactcgcaaccatcaatctcattgtcgtccttcgaatggacacgaagactctgggataggtaaatgaagaaattctcaatttgaccttggaatacaataaa

SEQ ID NO: 53136 - DNA, 208 bp, Heterodera glycines
  Genomic contig location: Contig_ID=SeqID_22465; Location=1..208; Strand=+
  SCN-specific regions: Sequence locations=1-33,55-96,118-123,146-208
aacagttaccgcccgccctccttcactccgcgtctgtccactctattggaaaagttatttctgaccagcgaccgttcagaatggcatttcgttgtccttttgaattctttgccttttcacctttcatttttccctttgctttagtccctccattatcattctgtgcatagaaaatgagcgtaaagtgtcaataaatgtgcacaaaagc

SEQ ID NO: 53137 - DNA, 616 bp, Heterodera glycines
  Genomic contig location: Contig_ID=SeqID_22466; Location=1..616; Strand=-
  SCN-specific regions: Sequence locations=1-565,587-616
tttccaggattatattcccacttaaatacgggaattacacgaataaataaaaccgaaaacgggaaagaaattggagcaaattgccaatgctcagcagatcaattgccacttttcaccatcgatcggttggccctccacgacggaagtgacccatcgaagccgatttatttggccattttgggccgagtgttcgacgttgaaaagggcagaagacactatgggattggcggcacctataacttttttgccggtttgcgctttattcaatcatttctttcccattgtctatttgcctttttagggagggatgccaccgtttcgtttgtctccggcgacttttccccctccggcgattgttcggacgcaaatgaattgtcggagagtgaattgctcagtgtgttcgattgggtggccttttacgagagggaatatcgcctcgtcggacttttggacggcgaatatttcgacgcgaagggacggccaaccgaaaaaatgcaaagggtcgaaaaaacagaaaatggcaaattgagagaatggaaacccttttaaggtgaacgaacgcatggaaaaagcgaagcggaagaaagcggacgaactcagagaacagtcgctgctg

SEQ ID NO: 53138 - DNA, 708 bp, Heterodera glycines
  Genomic contig location: Contig_ID=SeqID_22468; Location=22..729; Strand=+
  SCN-specific regions: Sequence locations=1-157,195-277,299-708
atgctgaaccattctttaaacgaacttcaagaagcgctttcttctgccgcatttttggacgattttatgccattggttttggcattcgaatttggcgcaacattttgcaccgaaaacggcggaaccaccaaattgttcaaagagaaagtccaatttcatatatataattctcaatttaattaattatttttttagtgcctttcccaatcattggtcgccacaaaaacaaaggcaccgtttgttggcccaaccaaattccatcgcacaacaaccacttttggcattgtgccaacaactgaacaaacctttggctttgtgccgcttgtgcgtcatgtggaccattttggcacgaattgtacgaacattttcttcccgacggaagtggacaaatttttgttgaacatcaccataactccatatgatattggatgtaaaaagtatcaacggcctttgaaaatgaatgatccggaaggtccgcccagcgaaaagcaccgctatttcgatgcttgtaacaaagttccaacggaagaaaaatgcggaaagtaaacgaaattagtggtatttttggtaaaacattcgtcattaattagtgaaacagccattgattaatgaacttggcacagatttattacgttccttaaaattgggtcgcgtcactttggagcggcacattttggcgctaccaatggaaatggcgctaaaatctca

SEQ ID NO: 53139 - DNA, 694 bp, Heterodera glycines
  Genomic contig location: Contig_ID=SeqID_22468; Location=924..1617; Strand=+
  SCN-specific regions: Sequence locations=1-63,85-175,214-390,443 -617,646-694
atggcccggaaacagtccaatcgtcgaaatatgccaaaaacattaggaaggaatttcgggtggggccgatgccaatgcaaatgttgccggattcattataaaaatttgtgttcaccgtaacgaaaacgatctcgtcattgagtcaaccttcaacatttccttctccaatgaaacgtataaaattattatttttgatatttataaattaattaagcaatacaaatattagtcgattcagtgccgaaccaatttttggcaattttaacaaaatttttgaaatcttatggtaggtagagagaatcattagtgcaattgaatgatactcagaatattcaaaattatttgcttctcaacagagtatgagccgttaaattattgaatcgtcgatacaaaattaaaataataaaaataaaaatatttaatattcaattgtaattaaaaacattaagttgcaagcggacgcgaacatttccaatttcgttggagaaaataacagacataacaaattggatgccaacattcttaatcgaatttggcaccgaccagaggaacagcgcaattcgtgaaaaaagcgacaaaaaagaatttgcgaagaattgaaaacggtaaaaaattcgaaataattaaaaattcattaattttttacagagcgatggcattggcaccgtgcttaatgacaatgaaccgcaaatga

SEQ ID NO: 53140 - DNA, 1486 bp, Heterodera glycines
  Genomic contig location: Contig_ID=SeqID_4088; Location=172..1657; Strand=+
  SCN-specific regions: Sequence locations=1-172,194-871,893-988,1010 -1061,1083-1097,1119-1285,1309-1345,1368-1486
  Gene Ontology: Biological process=cell growth
atggcaaaacgaaaatcgaagcgaaaagcgccgaccaaagcgaagtcaattgtggcattggagacgcagttcaattgtccgttttgcaaccacgagaatgtgtgcgaggtgaaaatgtaagtaaaaccaatcccctctctgtttaaaccagcaaatccggtgttttcgttatttttgttttaataaatgggaaatttgttcatttctgccgtcttttagtgccgttgttggctaagcgccgtgcctttttttgtgccgatttaaaaaagaattgacttttagtgttttatgctaaattacttgtttattttgaattcacaccttccaggaaatacgtcattttacatgtttattttaacactcaacttatgcaatttagggaccgtgaaaggaatgtcgggttcattcaatgccgcgtttgcatggaaggtaattatttgactcggtgattactaattgtatggtgacacacaaactatgccaaataagcgtaccgaaattgaaattaaactccagtttaaaggttttcttttttttctccaatagatgttttataggtactttacgattttacattttttggtaattttttagtggttatttctttataaaactgtaattatagtcccaaatcttcctttttacattaatttactacttcaaatatcggaaaatgaaactctcaacaacaaaaaaatcccgtaatattttttgtaagtaagttgcaaacatttttcagacttccagtccaacatcaccgctttgtccgagccaattgacgtgtactccgattggattgacgcgtgcgaggcggccaatcagtgaaaaacaaaagtggacaaatcaccaacagagaacggacattgtgtgcacagaccagggatcaccttattattcactgatcatattggcattattttccaacgcatttttttttttgatttcctttttccattaaaagtcgtctcgtaattcgattttccccatttatgtgtatataaattttgaatgatttttggccatcctttgggaggccattctcggtcttaaattattctctctcccggcttggcccaaaatggccaacaatttttggcattttgatttttgtcaatttcgtctttattacctttcccaactgagctgctgaattattaaattaaaatgagtcattccgtttcatcgtccgttacataattttgtattttgtgaatgcgttgttatcaatttgaattatcaaatttcctaaaatgattgattatttcggtccgatagtttctcgctcaaaaaatatcaattaaattttttcatcccgaatgcttaaaattttcgcagagtttggcatttaaatttcaaaattaatttctgaaaaagatggcggatgattcaccgcctccgtcgactctttgccattatcagcagcagccgaatgcttcacttaaatcgcacattttcgatgaaagcgactgctctttctcagtaaaaa

SEQ ID NO: 53141 - DNA, 1216 bp, Heterodera glycines
  Genomic contig location: Contig_ID=SeqID_4089; Location=983..2198; Strand=-
  SCN-specific regions: Sequence locations=1-64,87-640,663-707,772 -893,927-1042,1064-1195
atgtatggaatttttcaaggtccccacatttacgaagcggacgcgcccccgggttggctcgaggcgggcggagccgccgccgcgacgtgtcgcaccgaaagcggctcaaaggcggccgccacgcgtgacgagcagtccgcgtgcggtacagcacaacgcatgctgttgctcgcctgctcagctgcggcggtgtgcgcggcagcgcacgcggcactgcgcaacgcggtacggtgctggaaaatgcccgaaaattcaacaaaaacccactgtcttctgtgcttcagagtgccgattatctgccactgctcccactgttggcacttgtctcctcaattggcatcgtatgctccgtcatcgtatggctgtgccgactccgtgtggactacggtagcaccgccactgattgtgggcaatattattacagtcaacaacaaattgggcggcatcccctcgagggcaaatggctgccaattggagcggtaattaacggctaattatgcgcaattaaaagaggtatttttaattgttaaggttattgccatgttcacttttgttcagctgtttcctctattccctcccattgaatgggccttttcttttggatgggttttcatcggtttgaaaaaatgataatgaaaataatttttgtttaacaaagtttaggcctttttcttcatgcttgcttcttggcgcgtttgggcaacaacaattaaatgattattaaaaaattcatttgtatttaattttgttttaattaaaaatttaaaaaatggattcgagagaagcagaatcataattaaaattattccaatgaatttttgaaggatccctgaaaatcttttttcggataaattcttaaatcaaacaaatcccatgatgaagtagaaaaagtcttttaaaagaaaattaataattattattttattgttttcagaaaaattttctcattcactaattagcgaaaatgccgtgattttgtttaaaaatgccccgccaaacactaatgagaaatgaactattaaaagaaccgatttaaaaaaacaattaaaaattgattaaaattgatcagttaattccgtcgggctgaaattgcccttctcagtcagaattttggtgatcagttcggccggtgtcacgtcaaatgccgggttccacacagaacaatcggacggacaaatgggcaccccttaaattcttgactttaaataataataaa

SEQ ID NO: 53142 - DNA, 1146 bp, Heterodera glycines
  Genomic contig location: Contig_ID=SeqID_4089; Location=1..1146; Strand=+
  SCN-specific regions: Sequence locations=1-39,61-151,173-481,507 -976,999-1146
  Gene Ontology: Cellular component=eukaryotic 48S initiation complex; Biological process=protein biosynthesis
ttagtggccattctcgtcctccatcgtttgtttctcgatgacccctcttccctccgcctaattaggcgtcattctcgttctccatcgtctcaaccgtctcgaattagcgatcactctcgagactcgtccgtacaatcagggctctcggctgaccgcctttgagcttcagcagagcggcgtgccatttcgactgatcgcggacagtgcagcggcgagcgcaatgcgccattttggggttgacgtggtgttggtcggtgggtgatggggatgaagcttggcacaatataagaagcataaagaattttaaataacaattacacccaaaaagaccctccaattgttaagcctgattttggcggatgggccggcactttgaagaaaaggcccggaatgcttaaggtatacaccagggatggcacggaattccgatttccgacatttttggggcctcggaatgccatccctggtatacacaaatctcaatttttattgtttaaaaatgtgtgccaatttaaaaattgaattttcaaacattaataaattccgggccatctgtgccggagagttttcagagtgggtccggcccgaaggaatgtggcccaggccggtgggtcgccccatgcaaagaccaagcggcactcagatcaaacaaagtgtgccaacaaagtccgcgttaaggcgctgatcaggtggcacggaacggggacacggcaaacaaaatcggcacttatgcgctcgccgtgctcgcccactaccatcgcgtgccgttctttgttgtgacgccgatggcgtcggtgaacggacgaattgctagcggctgcgaaattccgattgaggaacggcccgcgcaggagctgacccaatggcacggtcagtgcaggatgaaaaaacatagagtttttttgccaggtttatgggtttcaacaatggcaccttctgggcttttataacatggcacttttcaccgcccagtttcttttaatttattattatttaaagtcaagaatttaaggggtgcccatttgtccgtccgattgttctgtgtggaacccggcatttgacgtgacaccggccgaactgatcaccaaaattctgactgagaagggcaatttcagcccgacggaattaactgatcaattttaatca

SEQ ID NO: 53143 - DNA, 480 bp, Heterodera glycines
  Genomic contig location: Contig_ID=SeqID_22470; Location=476..955; Strand=+
  SCN-specific regions: Sequence locations=1-266,288-378
atggtggtcacttctccgctgggcgtcggcgccgtttctcttccgtccgaaaatgttggccaaacagcgcttttgcccccatcggacgatgatgtcccgcagcaaaacggcccaccgctgatccgtccctcgtccgccgttgatcgccaccgcccacttcgccttgatcatccgcccatttcggtgccctccgctccgtccctcccttttccttccgcgcgtgccatcgaagcctttttccgacggggcagtgccattggcaccgccgggtcgcttccgtcacctccgacacgaaatgtgccgcctcccttcaacctcggaggactgttcatgctgaatgggggctcatcgacgggcggaagcgacggagggacgggtgaagaggagaagaaaatggcagaaacggaggaggaagaagcggaaggagaagaagaggaacaacggaaggacgaggaggaaaagcggcgggaagacgacgaa

SEQ ID NO: 53144 - DNA, 1286 bp, Heterodera glycines
  Genomic contig location: Contig_ID=SeqID_22472; Location=164..1449; Strand=-
  SCN-specific regions: Sequence locations=1-9,31-336,398-415,448 -591,614-1045,1067-1286
  Gene Ontology: Mol. function=aminopeptidase activity; Cellular component=cytoplasm; Biological process=peptide metabolism
gtgaataacaatagaaattgtcaaatttagattaggaaatcggaattgatcaaaataattgaaagattcgtgatcggggaccccaaaaaccccagagaataaatttatgactatcacaaaaaagttttgcagaacaaaagggtcccaccttttgaaaaaattttcaaaaatcggtaactttgcaagtagcgccccgtttttcgctgaaaactcaccaaaccattatgaagttaaatttccaaaaatacgaaaaatggcgttccggcggtgccgttaggcgcctccgtgggaaattctggggatttaaatggaattgttaataaaattgagtcaaattttcaaaattttcccattttcttgaaaattttttagggattcctcgccccctccctccccctggctacgggcctgctgacatggattttatgagaaaaaactcttccgaaaaagtgaaaataaatttttctctctcaaggcggttgctgctgcggcgggttgcaagacggagcatattttggacatggacatgttcctctacgacacacaaccagctgtacgcaattaagcgaagaaaaagcatcggtttgaccaccccaattattttttaaatttagactttgtccggactgaacgaagaattcatttccggcgctcggctggacaatttggtctccacgtacaccgccatcaaaggacttgtcgaaagtttggaggacaccgacgcttttgatacggacccaaatgtgcgaatggtcgcctgttttgacaacgaagaggtgggtgtatacaagaatcttaatttggcatcatcgacaccgaaaagtttcgtaatttgtctctcgtaaatgctgcatccggacagagtttgcggaaaaacgacgggggtgagacgacctgctccaccgctggttctcccgccgtcccccccccactcccgggtcgtttcctcccgaaaaactttttaaagaaaaaaaattttattttcgtggtgaaacaatgtaggggaaatgaagtgcacccgtatccggggaatgggtttggacttggaaaggggcggggggattggtgggtagagcaacccgtggaagcgaatttcctccgttttaggttggcagtcgcagtgcccagggggcccagtcgcactgtttcgagtggttgctgcgccgcgttttgtcctccgtggaccacccaaccgcctttgagtgttccctcggccgttccttcatggtcagcgctgaccaggcccactcggtgcatccgaactatgcacacaaacacgaggtcaa

SEQ ID NO: 53145 - DNA, 471 bp, Heterodera glycines
  Genomic contig location: Contig_ID=SeqID_22473; Location=300..770; Strand=-
  SCN-specific regions: Sequence locations=1-45,69-203,226-346,369-471
  Gene Ontology: Mol. function=aminopeptidase activity; Cellular component=cytoplasm; Biological process=peptide metabolism
atgacaacttcttcttcccccgctgcctttcgttcttctgcgctcgcttttcttcagttcctcaacaaatcggtcacccctttccatggtcaattaatttcctataaaatgcatagtttttcatttaatttatctaatttatgagttattttgtgccgtaatttgtccttttattcgtccatttttagctgtcgaatcggtcgaggccattctgaagagtgccaattttgttcaaaagtccgagtatgacaagcttcaaattcaaccaaaggatcgtttctatgtcaaaaagtaggactaattatcgaagatattccttggcacggacatttagggttttcggcaattcaatttcaattttaacatttgaaaaattttcagaagcgagacttccatttttgcttttgctgctggcggtgcctttaaaccgtccgaagcgggggtttccattgtcgtcgcgcacactgacag

SEQ ID NO: 53146 - DNA, 732 bp, Heterodera glycines
  Genomic contig location: Contig_ID=SeqID_22474; Location=1185..1916; Strand=+
  SCN-specific regions: Sequence locations=1-11,34-118,140-732
atgacgacgaaggaagacctcaaaaatattttggaagcgcagcaaaaacagtttttggatttgatttcaaaaattttgcctcaaaatacggcaccaagtgccagttcttcggaccttttcagtcaaatcaacagtcaacttccgcaattccactacgaccccgaggcagatgaaacattctcactttggtgggatcgttttggacaatttgtcgagaaggacggtaaggatttgaccggcgacatgaaagtgcgtttgattttgggtaagctctcggcaacggattatttgaggtatgaacagcaagttcttcctaagaagccagccgaaatcgaatttcagcttacaatttccactcttaagtcactttttggcgacactaaatcaatttttgtcaggcgcttcgaatgctttcagctgtcgtgtggcccctcacaaaatgtcatggagtttggcgccatggtcaacgctcgctgtgaacgcgccgacatgactctgtcaaaggaggaagtcaaatgcttgattttcatcacaggtctgagcgacgcgcacaaagaactccgacaagagtgtctccgccaaatggaaaaagcgcgaaagtcaacgccaccgaggtccatgactttggaagcacttctggaagagtgccgctccatccaatcgcttcaaaattcggccgccgctttgtctggtcccgggcaaattcattcggtgcaggtccgaccacaaaga

SEQ ID NO: 53147 - DNA, 1675 bp, Heterodera glycines
  Genomic contig location: Contig_ID=SeqID_22475; Location=1..1675; Strand=-
  SCN-specific regions: Sequence locations=1-69,113-688,711-767,789 -1075,1120-1675
cattgtgcgattcaatgctctaaaatatgcgtatgttgtgtcgaacaaagccctggcgtattgtgacggataaaaaataacaattaaatgttttgtaatttttatttttatacggtaaattgcaaccgattgttctcctgcgtcgcccatgcaacttccgttgcataaaaagggataagtgccgaatttggtagtcaaatttcggttgaattcatcgatctgatcactcgattggttttccagatcaatctgaacaacgaagactactataaaggcacttaaacaggactatcattggaaaaactcgttttccaaggacgggtatactgatttccaaggacataacgggaaatttcgtgaaatccaagggccagtaaaattttttgtcatatgcaaagtgctcattttcaatgacatcttgaattcaagagtattgtgtagttttcaagtgagagggctcaatttcaaggacgtacttgccattcaaggacgaatgcgagccctgcacttagatttgctcttggtctctttgccatgattgaccgaccatgatcacgtgttttgtcgcggcgagcgcgtccgagtcgcgcccatcgctcgggctgtttttgtccacccaaatgttcgcatatttgacactgccgtcctcactggatgaaactgaaaacaatttataattaattaccccttccataatttggccaaattgcctaattagcctgctggagcaatatttggccattttgcctaattaccctgctggagcatgccctggttgcgcagggatcccatgatgaacacaaattcgttgtccgcagcaagaccagtgtcgaaaatggacaacagaaagttgcgacggtcaacctcgacatcgaaacaggaaagcacaactaattgatggtaattagcgatgctatcaaattaattatcccatcacttcgcgatcggttgcgcagatttctcagcgtcgccttcatactgtccacattggactccatctgatgctggaaaacaatggtcacattggtcacgttgagcacatttgtgagactctgtttcaccgagttacagaccctaattaaattatattaatagctaattaattaattaattattcaaaataattcttacattcgctcattgtccggagtgtacacgaaggacacttctgtccaattgaattgcaccaacacactttgtaaggccaacgccaacctgcaataattgttgaaattaataagaaatcattggtcatttgattttgtgacggctcgtaaagcaaatccattttagtttattttattggtagaaataataattttaggggatggaaggcgaagaatattttctccactgacatgtccgagttaacgttcacgttgttcagtgtagggtatacggtagtgttgtaaaattccgaggccacagtagcaccccacaaatacagtggaatgttgtagaaggaggccacgtatcccgcggcgatggcacctttttcatttacgcaatttttggcaaagtgtcaaacaaaaaggcattactggtcacacaaggcggaccgatcaaagcgtccacattttccgtcagaaccagttgagtggcgtagccgacagcccaaggctgaaagcagccgcacattcgccacgtgtaactgaaattggcatttacggccaat

SEQ ID NO: 53148 - DNA, 1675 bp, Heterodera glycines; identical to SEQ ID NO: 22475
  Genomic contig location: Contig_ID=SeqID_22475; Location=1..1675; Strand=+
  SCN-specific regions: Sequence locations=1-556,601-887,909-965,988 -1563,1607-1675

SEQ ID NO: 53149 - DNA, 1173 bp, Heterodera glycines
  Genomic contig location: Contig_ID=SeqID_22476; Location=155..1327; Strand=-
  SCN-specific regions: Sequence locations=1-576,598-912,970-1136,1161 -1173
atggacagcaacaggtcatcgtcgttgcgtgccaacaaatcagaacaacaaatggagtgccgtaattgggcccgaaaatcgccgttggaaatcaacaacaacggcatcaatgagtgagtttcgtcattttgaagatccctggaggaaaaaccggcaaataagttctgtcggggaatttcctcctcttgatccccgcttaaaagtgataatgctatgatattgccatttcttgtatagctttgacatccgctggataaaccgcaccgactcgttgaacatgttgggcgccggtgccatgggctgcttcttctacggcgctgaggaggaaacggaggacaggtgagctctgatgctctgatgctctgtgtgttgtgtgtgttgtatagtacaccattcgtggtcagaattacggtaattggtcaccatcccttagattctgattgactgtatttgttaggttactgtatttttgaatcgtatcgaacccattaagcatccctctccccctctaacattatttgattgattggacgaaaggcgatctaatttgatcaatcccacagttttgttgaccaatgtgcaaaactattaagccaactagatcatcaggttttggtttgatcacttcctcgcgaataaaactgatttcgaatttaatcaatttgtcaagccgattaactctgtttgatcattgatcaaattcgtttgatgggattttgatcatgtaaattgctcccctggtcgatcacttttgctctcattaaaattgctcctctggtcgatcatttttgctccctttcttttccagcggtggcactctccgcattccatgcgctgacggggaggagaacaattcgcaggagaactcgcgttccgcctcctcgcttaacctgtccgcatccgcggtcagcacggcaccgctggccgcggcgacaacaccgacggcgacggcggcgccgggggccggcgcttgcattgtcgaggcgctggtcgaatgtcatgccgaggcgggcgctgaagaactgagcgccaacgccgacgacaatgacggcccatcgacgcagcaacagatcacactgacggcgctaggcgcgccgacggcgacgaagccggacaatggcgacgacacttccaccgaagaggaggagacggcggcgccggatgatggaaaag

SEQ ID NO: 53150 - DNA, 789 bp, Heterodera glycines
  Genomic contig location: Contig_ID=SeqID_22478; Location=304..1092; Strand=+
  SCN-specific regions: Sequence locations=1-445,469-595,619-789
  Gene Ontology: Cellular component=cytoplasm; Biological process =negative regulation of cell growth
actcaattatctgactttccaatcgctgggactcaacccaccagcatttcactggactcaatccaccaacattccaatcactgggactcaatccaccaacattccaatcaacgggactcaacccaccaacattccaatcactgggactcaatccaccaacattccattcaacgggactcaacccaccaacattccattcaacgggactcaacccaccaacatttcaatctctgggactcaaatctccggcattccaaacaatggactcaaatctccggcattctaaacactgggactcaacccaccaacttcaacgggactcaatccaccagcatttcaatcactgggactcaatccaccaacattccaatcaacgggactcaatccaccagtatttcaatcactgggactcaatccaccaacattccaatcattgggactcaacccaccagcattccaatcactggcactcaattctcctacatttcaatcactgggactcaatccaccaacattccaatcactggcactcaattctcctacatttcaatcactgggactcaatccaccaacattccattcaacgggactcaacccaccagcattccaatcactggcactcaacccaccaacattccaatcactgggactcaatccaccaacattccattcaacgggactcaacccaccaacattccattcaacgggactcaacccaccaacatttcaatctctgggactcaacccaccaacttcaacgggactcaatccaccagcatttcaatcact

SEQ ID NO: 53151 - DNA, 207 bp, Heterodera glycines
  Genomic contig location: Contig_ID=SeqID_22479; Location=496..702; Strand=-
  SCN-specific regions: Sequence locations=1-207
agattagaagaggtacaacagtgattagaagaggtacaacagtgattagaagagatacaacagtgattagaagaggtacaaaagtgactaaaagaggtacaacagtgattaaaagaggtacaaaagtgattagaagaggtacaagtacaaaagcgattagaaaaggtacaacagtgattaaaagaggtacaaaagtgattagaagag

SEQ ID NO: 53152 - DNA, 285 bp, Heterodera glycines
  Genomic contig location: Contig_ID=SeqID_22481; Location=510..794; Strand=+
  SCN-specific regions: Sequence locations=1-285
atgacaagctgtgccatattgaaaatcaaggacattggcaatgcttccaagccaaatgaggagccattggcacaaattgtccattggtattgggacaaaaatggcgcacaacagatcaatgatgtaagaaaaaaaaaagattaaactttaaaatgattaactaataaattattttagacccatacacttaacaagggcagtgaaattaattgtgcctgtgccaatgcttcatcaattgttatccgaattctcaaaaagcgggagaagaagcccgatgaaaagtaa

SEQ ID NO: 53153 - DNA, 516 bp, Heterodera glycines
  Genomic contig location: Contig_ID=SeqID_22481; Location=1500..2015; Strand=+
  SCN-specific regions: Sequence locations=1-125,147-327,373-380,402-516
atgctgctcaaattggccgactatttccaggtgggtgccattacgatatttctctaaaattaccataaattcaattgattttcaaaaaatgatacttaaatttgaatatcctttatcaaagagagtttacccataattttcaataaaaaattactttttactcatttttaaattcattaggctaattattaggggcactaattgctccgttttgaggttgccgcgttgaagtcgcgctgcgaaacgcatctgatcaattgtgttgaaattccgctgatcgaccgttttcttttgattgagcgttttgcactcgactatttgaaagtgatttaattttttaatatttttaaataatttttaaatgatttaattgcttttcccacattttagaattattttttgcattttgatgtcaacaaattccgtgccttttttaatgcgaaccatgaacagtttttgcctgttatcagcaaagaatttttgtacgctttgtctgtccgactgtccgaacaatga

SEQ ID NO: 53154 - DNA, 730 bp, Heterodera glycines
  Genomic contig location: Contig_ID=SeqID_4090; Location=187..916; Strand=-
  SCN-specific regions: Sequence locations=1-173,210-334,480-502,525-730
atgaccttagttgcaaatcgacacaaaacgagaccatccatcgcaaaattgtgtgtttgaagacgtggagtatattaaaagaattccaacaaaaaatcgcttgctggaataaaaatttaatatcatttattaggaattagtcattaataaattaaatcatgtatcacgggtgcatttaaaatatattaaaaatgaagttaaaaattataccttttgaatattttaggtgcattttatattgtatattaaaagaagattaaataactccaagattaactaagtttcataattaaattctacaattattcagaataaaaaaaaccaacaattcgacatttaattttattataaaagataaattaatcaaataaataaaaattaattttcatgttattaaaagtataatctatttaataaaaattaaaattcaaggtaattattgaaaataaaagaaattaaagtaacttaatattatatttcagaaaatatttggcaatttcattatttggaacagggatgggcctaattgaaaaataaaaagcgaaatgcgaaaagcgaaatttgcgaaactgaaaaatgcgaaatgaaaaaaaagcgaaatgcgaaaagccaaaatatgcgaaaatgcgaaatgcgaaaagcgaaattttttctacaactttttaatagttaaaatcataaagcaaaaatcattttttaaaattttattccaaatttaaaaatcaataaa

SEQ ID NO: 53155 - DNA, 1083 bp, Heterodera glycines
  Genomic contig location: Contig_ID=SeqID_4091; Location=163..1245; Strand=-
  SCN-specific regions: Sequence locations=1-499,523-852,874-1056
atgaccattctcaaaggtcaaggccaaacaatcagcacggtcggaattgacctcgaaagggatgtgttttcccatggtcaattgtacactgccttttcaagggcaacagacgggaacaacgtccgagtgtacgctcccagaagggagaccgatggccaaggcggagtcaaagtgctgaatattgttgcaacgaaaatgctcaagttgcaataataaatccagcgcgtgcgcactttatgatgtcaccccgttctcatttgcacttaaaacggacacatattcaaaaaagtgctgacagctggactgagggaggcaggtgggccatgacgtgcgagttagggcacttccggtttccattgcattgaattgcaatgtgtcaaggtgaaaccaagtgcatgtcggctgacgcaaagaccctaacacaaggcctaatggggatggaacccatccctctgaacactctcatggagaaggataccatcctcctaaacgatcttacggggacgttatttttttctttgaaaggattaaattttttttctttttagttttttttagaaagagattttttttcaataatttttcaaattccctggaacttttcaccattataatacatgttaaaagagtaatatgaactccctccatatctccccaaaccaatcgaaaattctcctgatttttatctatttttaaggctttatttctgtaaaattgatcaacccttcgatttgttatgaattttcaaatattaggccaaaaacccgaggtccaaaaaattgtcaaatattttcaaatttttaaaaaattccaaaaattctgaaacttaaaatagacatcatattcgtactcagcaaaagtgtttaaaagaggtacaaaaatgattaaaagaggtacaacagtgattaaaagaggtacaaaaatgattagaagaggtacaacagtgattagaagaggtacaacagtgataaaagaggtacaaaagtgattaaaagaggtacaaaagtgattaaaagaggtacaaaagtgattaaaagaggtacaaaaattgaatgcaatttattataaattttaaaaaataaa

SEQ ID NO: 53156 - DNA, 2226 bp, Heterodera glycines
  Genomic contig location: Contig_ID=SeqID_4092; Location=704..2929; Strand=-
  SCN-specific regions: Sequence locations=1-29,68-85,190-231,257 -306,329-465,489-1112,1152-1155,1238-1262,1502-1995,2017-2226
ataatttaaaacttttagcattttaaggcattaaaatattataacaacaataattaataaaataattcataacctctaaaagtggtattttttaaattattatacttaaaagaaataaaaaattttaaaaagataaaaagcaataaaattataatccaaataaaagagtaaaaatattaaaaaaaaattcaaactaataaagacacttatgagaatggaaatttatgcttgtaaatatattattttattaataaatgaccacttaaaattgtaataataatattatgctccatcgccattcaaactaaagaaatctgctaaaacagaataagcatttggcttggaattggactagtagtataaatactaaactagcgggtgcgtgaaccgtcggctatttagctgggaaaaagcgcttcgcgctttgggagcttcgctacctagataagcattgagtttttttagagatttggaatttattttaaaatcttaaggggttttaaggccgcttcgcggcctcagacgggcgcttcgcgcccgttttttaaattgttgagctcatacgggcgcttcgcgcccgtttttaaattttgatgtgcattttcggccgcttcgcggcctcagacgggcgcttcgcgcccgtttttaaaattttgttggaccttttcggccgcttggcgcccttttccaaagtttgttaagcttggacgggcgctacgcgcccgtttttaaatatggtttggaatggacgggtgcttcgggcccgtttttgaaattttgttggactcatacgggcgcttcgcgcccgtttttaaacttggttgggcttgaaccggcgcttcgctcccgtttttaaattttggttatcagaagaggtacaaaaatgattagaagaggtataaaagtgattatgagaggtacaacagcgattagaagagtgattagaagaggttcaacagtgattagaagaggttcaacagtgattagaagtggtacaacagtgattagaagaggtacaacagcgattagaagaggtacaaccactgtcgaaaaggtacaataattgttggagaggtacaaaaattgttggaatggtacaataatggttaaaaagggtacaatcatggttttaaaattaaataattaaggaaatcgtttattaaaaagtaagattaaaaattgaatgtaattaataaatttttaaaaataaaataaatttccttttattaattaaaaagagagtttaaaatgtacagggattgaatatttatttaaattgaaattaagaaattaatattacaaattctaatttaaaaaatacaggagttctttaataaaagtaaataaattattattttaatttaaaacatttttcacaaaaaaaataatttaatttaaattaaaaatttttattttttatggattaaacaaaactatttatatttattaaaatgaaaattaataatataatatttatttaatttgaaatgaaattaaatatgtaaaagtaatcaaaaaatgcacagaaattcttggaaatgacaaggagctgctcaatcgtctgatcctcgcaccacacattgacacatgcgatgagatcaacgaaatcatgatggcgaatgtgcctggtcaagtgcgcgaatatttgtcctcggacaaaccgcttgacgagcggccactggatattgatgaaatcgagtccgaagtggcagcgttgaatcgacgcacagactctgggatgcctccccaccgtctgcgactcaaggtcggaagcgtcgttgttctccttatcaacaaaagtgataaggaaggactgatcaacggcacgcgcatcgttcttgaagaacttggcgacgatcgtctggtcggtcgcgtcattaacagcaacgctgttggtggccaagttaagttcttcatcgaacgaacacgcaatgtctacgaggacaaaacgcctggcggcataaaatatgagcgtttgcagtttcccatcaaacctgcctttgccatgaccattctcaaaggtcaaggccaaacaatcagcacagtcggaattgaccttgaaagggatgtattttcccacggtcaattgtacactgccttttcaagggcaacggacgggaacaacgtccgagtgtacgctcccagaagggagaccgatgcacaagacagagtcaaagtgctgaatattgttgcaacgaaaatgctcaatttgcaataaagcaaacg

SEQ ID NO: 53157 - DNA, 864 bp, Heterodera glycines
  misc_feature (850)..(850): n is a, c, g, or t
  Genomic contig location: Contig_ID=SeqID_22483; Location=119..982; Strand=-
  SCN-specific regions: Sequence locations=1-819,847-864
atgcagcagaaccgccgaccttcgaattcattttggccgagacgaagcacagggtgagtacggtatacttacctgtaaaaatgatattttctgtcctttttttgcagtgccaacaattgtccacaatgttccattgaaggtacaaaagggacaaaaaagtgtgccaatcactgcagatcatctccaagctacggtaacggtcactgtgtcccacttcctacggtaattgtgcttgaaactgttcagcacccttcaaaaatgccgagtgaactccattttatggtatggcaacaacagggcggcgcacttcaaaagggactgaacacgaccatggacactttcacgcaaaaggaattggaccacggctttgtccgctttgaaattgacgaggcgaagggcgtgccggtttgctttttgccagggccaaaatcaacatcgacttttataggacacgaaaatgggcttccattttctgttaaacgacggtcgccatcaattgggccccgaatttttcttgttgcaatttgacgaaatattgccaagcaaaaaagaggacggcacaatgccaactcagtcgacattgagcagtacaccgacaattcatttgcctgtgccaagtgtcgcaattgggccaaaaattgaacgaaacgccaaactcggcactgcgccgggtgtccctgcggtgatcggtcctaatttgctgaaggcgaccggcggagggaaaataccggtcgaaaaagtcattttccacctgacaaagcagccaatgcacggccgactggtgaatggctttccgagaactgctcgggactgttgtccgcttctgttcagctgctcaacggctccctgnggcggttggagcgg

SEQ ID NO: 53158 - DNA, 1305 bp, Heterodera glycines
  misc_feature (1277)..(1277): n is a, c, g, or t
  Genomic contig location: Contig_ID=SeqID_22488; Location=863..2167; Strand=+
  SCN-specific regions: Sequence locations=1-563,585-1305
atgccttctaagcaagaaaaattgcggaaaaaagagcaagagcgttatcagcggcggacggagaaatctgtcagtcgggataactcacccgtcccagacgggagtgcagatgggaatggagaggcatcggcatctctccagggcaccagcaccccaagcttaagtgctttgcaaataagcacgccggcttcttccattggaagtaaaaaaaggggaagacccttgagagccggagcgaagccaattttggcaacgcaagaaactgtgtctgcaattgacacacctcgagctgctttcactcaaagtgaccaaggttcgccgtgcaaaaaaataggaaaggtcgccgagtgcgaccaaccaacgtttgccaatgaagctattgcttcaacgcctgtttcgactcaaagtcgtagagggcgaccagttaagcaactgggagggcatgccggtaaaggaagaggcaaaaccaacgagtctatgagcaaatgctctgaaatggaccaaagtgtggaaaacgctctaagtccggcaccctcgcatattgtgtttgaaaaaattgatttcagcactgtgcaaattaatttcgccacatcgcgaaattttgcctgtaaaatttggagatgggcagcaattggcctttatgagcgtgatggcgaaacagcacttggcccacgctctggcccaagattcattgagacctgctggaacaggccaaatgaatggctaaatgacagctttattgttgcctatttagcttacattgcaagcatttcacaacgaaagacagtagttgtggattctttggcatcgagaactgatgtttctcgattttccaacgtgaagaattacactttcggctatgatccgaatgctgttcctgaagttgtgcttatgccgcttcacttcccaaatcactggactctcattgtctacgatgttgcacatggtgcatacttcgttgactcgctgcatatgagcagcttgagtgatgagagaatggcactcatccagtcaataattgctgagatagtgcccgggagtccgtcattagctgttgaatacgtacagcaattgacaaagcaaaatgatggtaacagctgcgggtacttcgtgtgcctgtatgctgaatcgtggcttatgaacaattgcacttttgttctgccggacttgaacatcaattatgagaagaagcgcattttatggcacataaatgagctttacggctctgatattgtgccgtttcatccaaggggaagggtgtttcacatctttcgctngtgtgtctcatcacaatgggggatgtag

SEQ ID NO: 53159 - DNA, 1371 bp, Heterodera glycines
  Genomic contig location: Contig_ID=SeqID_22489; Location=54..1424; Strand=+
  SCN-specific regions: Sequence locations=1-346,368-539,561-948,971 -981,1003-1300,1322-1371
atgatattcggacagacccaaaccaattggcggagttgcgagtcgctgtcggagtgagccgtaagctcaaaaataattcggtttttgctttgttccgtcagtgttgtccatgtttacaattagctgttgcttattattcgactttgcatttaaattcgccaatttcagccgaagcgacggaggacgcttttccatgagagggactcacaatcagtcgaccaaaggacaaccgaaggcgagcgcagcgaaagccgtcgttcagcagcaaagccctgaaatggtggcatggctcagacggaaagagtacgacccgcggaaggcggcggcagaccaaagccaaagggaagcgcaacagagacagcagcagtgcgttggtggggtgggaggcaaaaaaagtgaaagcggcattttccgaaagggcgcgccttgcgccattggcactccccgaggaaaccctcaatggtgtggggaacgagtgggtttttagtgaaaaatgtatttgttggtggttggaaagtcagtcccctgaatgtctatgcttttctaccattttcttctttcaattgagtttcgtctcgtttttttcatcctcattgtgttttccattccctttgtgaccttctctattgcttaggaactctttcatggcttgtcggtttttctccacctcggcgaatgccaaaacgcccttcgcccgatggcgtcaaaatcgcaagagtcagcagacgatggccgaccaacgaagcaaccgttcccacgacgatttgagccgtctaggggaaagtatggacgacgagtcgcttcatggcgtggctgtcgatccctgctcggttttgttttacccgcgacgctaatttataaccaataaaaaattgcagaattcgctccaacggacggtggacgaattgacgcaaaagtgccacaagtcgattgaacttttgaagtcagttgtttcaaatgaaccaaacttctggttttaccattgtcccctcccccacagattgtgcaaccaatccggcctttcttcgtccgtggagcaactgctcgagaaggtcgtcgaaggaagcgcgggcgaagcccaagtgcattttggaagtgcggattctggtgcaaaggcaaacaatgagaacatttccgatcgcttggagcgcctttcttccgtaagacgcaaatcatttttaatttaattttctcattgccaaaggcatttgacgccatccaaaaatacttggaggagcagacgacaatgagcagttctcgtgtctcattagctgctttaactgggttcgatactttttaccaattaaatttaatttgtttttagtgggaaaatggcgacgacaaatgatgtgaaaaagcaaacgcagggaa

SEQ ID NO: 53160 - DNA, 540 bp, Heterodera glycines
  Genomic contig location: Contig_ID=SeqID_22489; Location=1502..2041; Strand=-
  SCN-specific regions: Sequence locations=1-496,533-540
aataattataataattaccgcctctcccttcacaatttttcagctctttaaaagcaattattttcgttttgccatgcgcactaattattctttattgtgtgacggttattgctctcgcccagcgacgcctttccccccaaattttgtcctttcgaccgctcttttcgtcctcgtttttgtccttgtgattacaaatataatcactctctttttgcttctgacaaaacgtcatcttcgaattggcttcaatgggcacttttcatttgcccccaccgacgacgaaaacggcgaaggattcgaaactatcggcggaggggccaacgacggacagaacccttttttgaaggaaaaccgatgacagacgaacaatcaatggggaggaaacaaacgaccgttaaaatggtgtccttatataaaattgttaaactaaaaaacagaaaatctcacgagtcgtttaaaatattcctactgattagcaaattatgcggagagatggtttaaaaatattatttatttcaatgaataaaataatggaaaatt

SEQ ID NO: 53161 - DNA, 899 bp, Heterodera glycines
  Genomic contig location: Contig_ID=SeqID_4093; Location=135..1033; Strand=-
  SCN-specific regions: Sequence locations=1-358,380-578,600-815,837-899
atgtttaaaagtcaatttcatcaccttgctcttgcgtttttttgtgcgacggtaaacggttttgagctgctatgtcaaaaaggttcttctacttactacccacagaaatttttattcaaaaacaaaaaaaatcttctggaccatttttgtaaattttatgtccaatgctttggggtgcgttttctattttgtttaaataaagaaaactttcaaaaaatgctaaaataaaaatcaaattcttaattcatcaaaataaagtaatgtaaatttgtcctagacgtaactcaagttttaaataatttttttttgtgcttcgggcattaaaagccagcacaaattccactcccaattaataaagattttgaaatttcttcagatttggtctcaacgcaaaaggtgttgctggactctgcgctttcagttaatttttcaattgaagataaattttttgaaaattggctccatgaatatgccactgaagttttttgttgtgaaaaattcggagagaattttgatgattttgattttgatattaaccatttgttggaagatgctcaaaaacttcgcaattcattttgtttggaattgaacaaaagcaaacatttggaagtggcagctaaaaatgttgcgcatttgacccaaaaattgacaaatgaattaaaaaaggatcaaaaaatcagacaaaaaattcagaatacagtgaaaaataatgggaaggaaggagacaaaaaattggaattatcggaaataagaaaaatgaaaaaagaatttgaagacaatttttcaagtgaaaatatgaaaaaactaacgaacggattttatttttctctcaatgaattgtttaattcaatggaaagttagtttcttattttcattaatcaaagcttactcgaaataaa

SEQ ID NO: 53162 - DNA, 111 bp, Heterodera glycines
  Genomic contig location: Contig_ID=SeqID_4094; Location=451..561; Strand=+
  SCN-specific regions: Sequence locations=1-111
gctggttatccgttgccttttaagcgcccctcgagatgggaggagccctatcggagagataaaatggggggggggggaagggtaaaggccatttccggtcccggccttaca

SEQ ID NO: 53163 - DNA, 3062 bp, Heterodera glycines
  Genomic contig location: Contig_ID=SeqID_4095; Location=317..3378; Strand=+
  SCN-specific regions: Sequence locations=1-169,277-345,367-641,663 -875,898-1070,1092-1302,1344-1351,1373-2032,2054-2674,2707-2843,2865 -2947,2969-2980,3020-3062
  Gene Ontology: Mol. function=MAP kinase activity; Cellular component =shmoo tip; Biological process=signal transduction during conjugation with cellular fusion
atggacggaaaaccgctcataaaatgtgtggcgattaaatccgtcattcttgaatttgacaacgcaacgccggaaataattcagggatttgaaaaggaagagcattttctgatgatgtttagaaacaatgcaaaaatcaaacacatcgttcaccttcattacatgttggttaaattgaaaatatttaattttaaatgtttttaaattgaaaatattttaattttaaatgtttttaaattgaaaatatttaatttaaatgatttaattttttttattctaacaaatctgggtagatttgatttcggttccttattctttaaagtccaagtctttcgtgggttggaatttcagattttaaaattttggaattccttataaatttacaggccgaaaaacttttatttgactttaatgccttcgaattacatagagaaatgacattttgaaaaaaaactgtgcctggacgcgttaacctgggccaacctggctctaattttttggacaaaacccagagaaaatgaagatccagggaaaatccgagttgccaaaaaactacctgggcctgaacaggaaaaacacaggcctaggtccaagttcggtagtgttttacttggagttttttttgtgaaaactcaatgtgttgttaataaaataaaattaatacgttacgccaaattcaggaaaaaagattatgcaaaaaatcgtctcatcatcattttggagttgggcaggcatgaccttacgaaacgtatcaaattgatgcgagaccaatggaaaatgtattggggttcaaccgcagtgagcattgaccgccaaattataaaagtgctgcggcaggtgctcgcggctgtcaatgaaatgcacggaagtgagaattaaatcaaaatctttgtaaaacaaaaaaatgtttttttgaaggcacctcaattatttaagacccaaaatacgtttggttttagttagctaagcagaaaaagtgattaatattggcttaatagtaaaattttcgcccaagcgtcaaaaattatttaaaaaagtccttccggtttttttatgattggcatgatctctattaaaatttatttttatttcgagaaaattgggtaaattataaatttggatactggttgcaatctcataacaagaaaatccactcaactgacacttttgcctaaatacatttgattaaaagaggcttaatagaaaaattttctccttcgcgacaacaattatttaaaaaaaggcattccggtttttttttgtgattggcatgtcctgattaaaatatgccgtcgggggatgtttaaaaaatataaatagaaaataattttttttctttaattcctccgccgttcagaaaccattcatttggatttcaaagcagacaatttgctgtttgttgaagaatttaatgcttctgggcgtaaaattggcgaagttttgaaggtcatcgattttggcggaagtgaaatcattgacccattggccgaaaaatcgaacgaggcctccgcagtggccaatgtgtgtcgcgtgcgcacgtcaatgtggagcgatgaccggtacagtagcccggagcagaacgtcacttgtgccgagcaaagcacagacacgatagagtatacggtagactatttaaatttatttacatataatttacaaagatgtagagagaccctttgcttcgggagggggctaactcaaaaatatggtttttagtgggtgttttttccagaatcccgattagggggtatgttttttgattaattagagtaattttcatattattgtcattcattcaaaaacttaaagcccagacgctttccattataattattacctcttgtctttggtttttaacaacaaaccagaatattcaaatgctaaaaaaattatttacccccctagctatgcccttaataatttatatgaaaaattgaacaaacattaacgaattttgcttctgctctttttgtcggtttaatcacgctcagtttcgcgagacttttttttcaaagctttacacgctacccagtaaataatttttttttttattgctttaggtttccacaaaatccgacatttggtccattggcgtaatgttggtcgagtttttgttgatgacgccgcattttcctgaaattgatccaatcgcagaacgaggatccgatgatgctaacaacatttacaatattgtgattggcatcaatcattttcattattcaccggcagacaaaacaaacgcagtcaacaaacaggccactgattatatgcacaaaattcaaaagcttttcccgatgttgtcgtcgataataaaggtaaataatatatttatgcatgaacaaattgccaaaaaaatgttcggagatttttgcctaaaaatatttacgaatcgcttaatttctcattagtgggctgaatcgttagcaatttaactatttttgctggttttttttgcaaaattaaaaaattgtctatttaaaatcaaaaacttaatgaactgaaagaataaagaaatttaacattaaattagttctttaaaaaacacaattttttaaccaaaatcggtcagcctaaaattaaaatagctgtataaattccaaaattagttccttttttatgtttgcaatgcaaaaaaaaaaagattattggcacactccgtatttttaaatagctgaaaaatttagaaatattttttatataaaattaggcttgtctggtgattaacccaaaacaacggccaaccgcgaaagggattctccaatttttggacggcaaatgccaatttggagagtttgaaaatgaaaaagctgaccactaccaatttgatggaaagcaatacgggcaagagttggagagaaggaaaaaacgatcagtttcttcaatgttagatgggcaaaagttttcattgttttcacatgaaattttggaatcgccgccggaaatcaaattctgtgacattggaaatttgaatggaacgaacaattaatttgttttaattttttaaaatttttatttatttgtagagaccggattttttggtgctaaaaatattcaaataggta

SEQ ID NO: 53164 - DNA, 881 bp, Heterodera glycines
  Genomic contig location: Contig_ID=SeqID_22493; Location=690..1570; Strand=-
  SCN-specific regions: Sequence locations=1-636,658-881
atgcattcctttcttgtactgaccattctttttgccaatttggcaacaaatgcttttgggcaacaatggccaaaggcaactagtgaagaaactgttaaggcaacaatcaaagtttcgggaggcgtcaaagactttggcttcaaacggttgaccgcctcttcggcattgggtagcggtgatcagtcggagggccaaaaagcattgatccgtgccgaaaagaacgcagtgatcaaaaatttgatcattggccaaaacggggcggacggtattcattgctatgacgggtgcactctgcaaaatgtgtggtgggagaaggttggagaagacgcggccactttccggagcagcagcgggtgcaaggagtacagtttcacggtcacaggcggcggtgtgaaaaatgccaaagacaaagtgttccaaatgaacggcggtggcactttgacgatcaaaaattttgtggtaaaatttatcagttttctcggacttattataacttatattatgaaatcaatttcgcatttcccgccaatcatagaactaagctaaagtaattatggtgtgcattttggcattaatttcaggcggaaggcattggcaaattggcgcgcgcatgcggcaactgcaaaacgcaatgccaaaaacgaaagtttgtgctggagaacattaaagtgactgggctgaaaacgctgttgtgtggcctcaacgagaattatggtgatgtggcaaccatcaaaaatgtgcaaatcaccgggtcgaagaaagtgtgtgccgaattccaaggcaacaaccagcaaaaggagccgccaatgttgcgcagtttcgacgtcggatcgaaaggcgatggcaaaaattgcatcatttcgggcaccaccagcggctga

SEQ ID NO: 53165 - DNA, 214 bp, Heterodera glycines
  Genomic contig location: Contig_ID=SeqID_22494; Location=295..508; Strand=-
  SCN-specific regions: Sequence locations=1-214
ctgcttctgctctgctcatcatcgtcgctgcttctcttgtcctcccgcaatgtgccgcggtcggcggaatggccgagctgaaggcattgaccggcgacgcgccctatttgggcaccggtaatcaagagcaggcgccagaattttttggcgaagcgttgtcccgccaatactaccagaacccggcctaccggtacaacgactggtacggcacacg

SEQ ID NO: 53166 - DNA, 2079 bp, Heterodera glycines
  Genomic contig location: Contig_ID=SeqID_22496; Location=745..2823; Strand=-
  SCN-specific regions: Sequence locations=1-59,81-439,473-664,687 -1444,1467-1759,1802-1950,1984-2079
atggagattccactaccacttgaaccgagacgccgtcgccttttcgagtagggatttccttcagaaaggaatttgtaaagggaggatggaatattgagtaaaaaaatattaaaacatatttctggggtcgttgaggagtaaatggcttaacactttcagaacaaaatgtttttttaggatttacttacggattcatacaaaatttgaaaattattgctgattcttgatatttttcgattttattatttataattttgtcttggcacctgaaacattcatttggcgactgaaaaggacccggacagttgtgccctgttttctgctgggcgggaaaataaaaaaaactaaacaaagttaaaaattcatatttaaaaatggatattttattaacgatagacctaattgtaagagaaagaagtccaaaaatccaggtttattctataaaaattataatttgaattaatttttttaacgcttttgccaaaaacccctgggaataattattaaaattaattgttatgctcattggcattcatcatcttttacaggcactttacaagcggaaagattgcattgaacgatgatcaactcaacaagctgtcccaagactcctttggcttctctgcgacgcgtaagttgggcccataattagaatttatactgaaaatatataaaatttggcaaaacatctaatttttgtatgcgagtggaaaaagattacctgaattcttaattaacaaattaccattgccccttcccaaaaccgtaaaaaatgtttttcataattttttttcaaaaacaaaacgacaagtcaggcggtgcggaaaatttttggaattgtaatgcacttgttgaaaaaagcgtatttttttccttttaaagaaattctcgcaacggtgaaccgtgctggcgcacaggccattttggacagagtgccgcttacgttcagctattttgacaaggcactcggtgggtgataaaattcgtgaacttgttcaacttgattatccctaatgccttattaagttgagatcacgagggatgtggaaaaatcatgggacatcccaggtaaacgagcagcaaccatcgtagtccatatccagaaaaatatacgagaggaaaaaattgggggggaggtgaggggggcaccaactgaggaacaaaggctttttttgctccaacaaaaatgtttttcaccaatttcctgaatttaaatgcctcgggagaaaatgactttttcggttttcgacaactgcacataatgattttttttttaatttaacgaaatgaaggacacggcgaacgggcaccaggaaggacagcacaaagcgaatagcggcgaaaaatttcctatttatgtaattgcgatgcagggcgaaacaatttttcattgctcatttttacaaaatgatcatcatttctcatttttcaacatgatcattgatcacacctcaaaattattttatcatttgccttccatttattatataaatgattcaaactgaagtttgctaatgaaatggcacatgcagttttatattcgggcagtttaaatgtttttataagtcgctttaaatcataaattgttcaaaaagttttttgggctctcgccataactaacccgtagaaaaaaataagtaagaatataaaaatcccagtttacgcataagatttttaaaaaaacagtatttggttataaatacaagaaactaattactagctttatagaaaaaatcaaaattagaaaacccgaatttagtttttttttttttaatatcttcaataaaatttaacatttttagtcaaaatctgttaaaaaacagtccaaagttttaaaatcttttttcgattgtccttttggcaccgccgaattccaaaattcaattgaactgggtacgaaaaattcaatcaattcaagtattccattggaaaacgatttcatctaaaaccttacaaagatgttgttttttatcaaaatgtatttataaatcacctcaattaaaaaaagatactttgtgcctatcggcatcccatgaaccaaaaaatgccaaaatgctctaagcgaatataggtaataaa

SEQ ID NO: 53167 - DNA, 921 bp, Heterodera glycines
  Genomic contig location: Contig_ID=SeqID_22499; Location=285..1205; Strand=-
  SCN-specific regions: Sequence locations=1-601,642-921
atggccaaaagcgacaagagcaggaaaatgacagaagtaagcgatttcactttatagcataggaaaggaacgaatatcctaaaaagcggaaaatgttgacaaatcgcatgtcagtttaatgtacagtggccatagatctaaacaacggacctaaaacggtctgagctaacggcataagcctagcttatgctttagccaaagtccagaggcctttacttggccttcagtcgacttagctaggacggtctaagcaaagactaaggctagctaaaactaacataagctcaggttatgtgtaagccgaagtctaggccaaagattagtcttatttttgactttcatattttagcttgaatagtttttttaatggaaatatgcaaaatttttatctaaatatttctctgctcgattattgcgttttccgatgcttttccttcataccgaaacattttcttggatgaaaaatccgtcgctttccctttcatagggcattggagtgacgttcattttcataattggcaaacagcttaacaatggcacaaggaacacaatcagtgccaatatcatcaaaaatgattgactttcccaaatctaatggatgaaattaaaatattaattaatattttaataattaaaaaaaacccttttctgtttgagtggaaatgcaattgcagtgaaacgattcatcagaatgagaaaggtggcaatgttcgaggcttggtaagcgactgttgttgcaaaataaaaacacagaacgatggcccagccgggcatcatacggtaaaagggcagcaattgttggccaaacagtgctgggatacggttaccgtaactggaagagagaaaccacagaatgtccttaacatggcatatttgaaaaattattcaataatttttagtatcgaatttaaaacgggataa

SEQ ID NO: 53168 - DNA, 755 bp, Heterodera glycines
  Genomic contig location: Contig_ID=SeqID_22500; Location=867..1621; Strand=-
  SCN-specific regions: Sequence locations=1-361,384-473,519-755
atggccaatgtgatttgtcactgttttggtgctgcattggcacaggcgcaaaaattgtcgacagattctgccttcttggacaaagaagacaaagtgctgaaaaaaccaattgtggtcaaaggtgttcagttagtggatgggaaaatggattttgcaattgtgcaattgaacacagcaaatttggcaaaccgaaaaggcgtgaaaaacatggtttggataaaaccaggtgaagaaacacaaaagaagcctggagaacatatttacaagtaacttaaattttaggtttaccattctacaagaccaaaccaatgcatgaaaatctgaaagccattgaaggacttaattccgaaactgtgcgaaagttttgtgcatttttgctttatagatgagtgctgtttatgctgaataaatcgttttatttcatttcgtttcttttatatattgaacgtttatttcgttatgacatacaaagtttcaactttttacacatttttaaatttggttaattgagaaaggcattaattccattgcttcaaatgtggtacgagagattgcccatgattatcgcggccgttagtatccccgcattttgtaccagcgactattacccactgcattggtatgggacgaatggctgcaaacatcatcgagttctgaaaggacatgagcagtcggctctccttatccgcgacagagagttgaccggctacgaatacaatttgatgggcatcgactcaattccggaggaggattaa

SEQ ID NO: 53169 - DNA, 222 bp, Heterodera glycines
  Genomic contig location: Contig_ID=SeqID_22501; Location=43..264; Strand=-
  SCN-specific regions: Sequence locations=1-222
atgtcaatttatcacaacaatcatcatctgacggaagacagccaaaaatatcggtttttaatcgacaaaaatggcgaaatatggacggtgctgcttttatttatgcgaattgacccttcgttggcgggcgtgttcagtttcatcgcctcaaatgagttgggctacgacgagaattccatcttcatgcgcattgatgaagctgcaaatcagaacatcgcccaa

SEQ ID NO: 53170 - DNA, 607 bp, Heterodera glycines
  Genomic contig location: Contig_ID=SeqID_22502; Location=200..806; Strand=-
  SCN-specific regions: Sequence locations=1-86,108-377,399-607
atggactcgttggaatttacgaaggcttcgatggacatgaactgctcacacaatcggagtcctttgggtatgccctactaaatgtctatttaacagttctaattttgtcaccctaattccatggaactttcacaggtacgcaataccttaatgtggacattgacattgaggcgggccaggaaacgtcaagcacggatgggatcatcggtctggaaagcattgagtacgcggagagtgagtcgtcagttgcgcttattgaggaggactacatggacgttgacgtggaaattgtggacttcgaaaaggaggaggacaccggcgcaattctctcaactgtggttccacccaaatatcaggtgaaacgacgacagaccgacttctgagttttcaaaaccaaacatcgcaaattgtgtttttagtcacggacattcccgggatttcgtttttggaaaaaagcaaaaaataatttataaatctttgtcagaacatcgtcgaaagagtccgtatacagccaaagatggatgcgatctcacgccttcttgaagacgaagtgattgcagaggcagaagaaggtggggacatgggcaacaaacacccaattaattag

SEQ ID NO: 53171 - DNA, 853 bp, Heterodera glycines
  Genomic contig location: Contig_ID=SeqID_22503; Location=38..890; Strand=+
  SCN-specific regions: Sequence locations=1-143,165-374,423-434,470 -707,729-853
atggcgtcggatggacaagcgatggccaaatggctgttcactcccctcccggacgatgtgccaaaggtgttcaactgcgggttgaaagagtatgacgagagttggccgttgaaaattgaggcgttcaaagcggtaattaccactaactaattaattaattgacaatatgacgtttcgccaccaaagctaaaaccctcagtttttgtctttttacaacaaattaaaaaaatggtcttcaaccgtaaaaactcgaacgccagcttcgaggttttaattcagtgaaaatagttatcaaaattgggtttcctgaccctgaaaatccttaaaaacgactacctgaaaaaattggaattttggctcacaatcaatacttttaacaaaatttaagctttaaaattatattagaaatatacatacattttttgtttgctgggaattttaaaatttcatttttgtttatatatttaaagttagagacccagcagttggtacgccacaaaaaaattgttttaaagtcgtataaaaaatgtttcaaggtgtttcgagtgcgctgattatgaatccgacctccatttcgaccaattcagagttccggattcaaactcgaacatttggtcgaaaagacaaaaattatcagttttttaccaatatgattaacaatatagagcaattaattttcgcatggacaaaattttttggtactaatgcagtttgggtcccatatttttgtcaaattttttcaaattttttttttgtcagaattgcttttagattaatggaaacgctaaatcgacgtggcagaagttcaaacatgggtaatactgaagtttatcccccccatttttcgaaaaaa

SEQ ID NO: 53172 - DNA, 2086 bp, Heterodera glycines
  Genomic contig location: Contig_ID=SeqID_4097; Location=232..2317; Strand=+
  SCN-specific regions: Sequence locations=1-723,745-921,943-995,1023 -1418,1441-1716,1745-1764,1789-1794,1816-1949,1971-2086
  Gene Ontology: Mol. function=peptidase activity; Cellular component =integral to plasma membrane; Biological process=proteolysis and peptidolysis
tggtcccgttggtccggtgctttgccggtgccctaccgactgaccggctcactgctcgtccgcctggacgtatggacacgcactgagtatcgaccaattcgaaattttgtggcagtgatgcgcggaagagaagagccggaccgatgggtgatggtgggcaatcacgcggacgcgtggactaaagtgacaattaatggcaattaaaatcccgaaagaacccaattagtgttttattaactaactttagtaattgcaatttaaagggaagcattgacccggggacgggcacctcaacaatgatggagatggcacgagtgttgagcaaatattcagctatgacgggctggaaaccgaggagaaccatcgcattttgccaatgggatgcggagggtacaaatttggatttttaaatattagccataaactaattaaagaatttggcctaatcggctcaactgaatgggttgagcaaaacttgcatttaattcaaaaacgagcgattgcttatgtaaatgtggacaatttgaacggcaacaattcactcgttgttaaggtaaaagcgaaacaatgggaaaaatacagtcatggtcttatgtttatatacacccccatatttccccaattttcagtgtattttgggtgtcctgatcactatgaaggagtgatctggccaagttggtgtaaaagtcttttttgattagcatcaaaagttagcttaacaagaattatttcacattttttaggcctacgaaatactgattttttggggtgttgataaacatttgaccacccataatttttgcataattcatttgataaaatatactgtttaggtagaaaattctttcgagtaataaaatatatcattggaaagcccgtaaaaaatgctacaaaatacaaccaaaatttataattaaaatgactacaaaaacaaaataaaatggggatgtagataaacatatatatgaccatgacttatgtagtatttaaaatggaattaattataaaatataatttaatttcaaaaacccattttgggataataatttgctttttcagtcagtccctttgctgtaccgactgatcgcagaagcagcctcaaaagttgaacagccggtgaaatcggaattgaaaagtgggcgaaacactcttttggattcgtggcaatttcacaaccctcggccgactttgccaggggatcggtgaataaaatattcaaattaatccaattaaaattgtctttcacagctccgtgccccacatcctgccgcctcattcgggctccgactttcagccgttcattgccttcgctggagtgcccgtggcggatttgcgcatggaaagtgccccccaatactcgtacatgctctaccacacggcgtacgaaggtaaaaaaaaaaaatggaaaaagcatagcattttaaatttaagcgatttaaatttttttttttagttccttggcttaacgataattttgtggaccccgaaggggacgcatccgtcgcaatgggccaactttggctggaaattgcgcgaaatttggcggacaatatggtaaaagccgatcagtgttttttgttaatttacttaattgttttgcaacaagatcattccgttcaatgttgaagactatggaattgcgttgaaggaattttgcacaaaagcgaacactcaaatgaagtaattttggtacttttcggttttgtatatacacctcaaaattttaaaaaatatatacaaagttttttcgatggcacaaaaacaaataatttaaatggtaaaaaccctccgaattttgtctttgggcaaattattccttttagacatcaaaaaaatcggtacatcctttgttggcatatttttgaaaattttcggattgtacataaaaccaaaaagtaccgtaattctaaatgatgggcaaacaaaaaattaagtgcaataatataatataaatttcaggatgattggcattgacagtgccatggatgtgcaaatttacaatgaacggataggctttttgaatgattcgatacggcgttttcaagaaaaagccgtcaaatttcagcggcttatccatgtattatga

SEQ ID NO: 53173 - DNA, 378 bp, Heterodera glycines
  Genomic contig location: Contig_ID=SeqID_4098; Location=1760..2137; Strand=+
  SCN-specific regions: Sequence locations=1-378
atggaatttttcttttttgacccggtcaaattcgtccgtttctacaactgttcttcctacgatgtgtcaatggttcagctggaccggcgacagaagccattggtcggagcattgacagttgctcttggcaccattctgacggtttttgtgccggatttggcagtgccaactttcccttttaagtgcctttatttgccctgtctgttcgccctttctcgaccaaaactgatcagacagtcgtgctatcagctgatgttctttctcggccttgtcaatgtgacggagctttgcaccactgcaatttgtaccggagcattcgccatttttggcactgttttctgttctcagccgactttcatgttttggcacgatggttag

SEQ ID NO: 53174 - DNA, 1495 bp, Heterodera glycines
  Genomic contig location: Contig_ID=SeqID_4099; Location=1112..2606; Strand=-
  SCN-specific regions: Sequence locations=1-6,29-70,124-202,246 -384,406-406,428-492,514-803,834-852,926-970,992-1298,1322-1359,1381 -1396,1425-1495
  Gene Ontology: Mol. function=phosphatidylethanolamine binding
atgtccgaaattgcaagtaaattttctgctgccgaaattgtgcctcaaattttaccagaagcacctcaacaaaaattaaatgtatatgtttataaattgaatttaaataaataatttaaaaaagacaataatgctttttaggtcgttttcgatggaattcccgttgaacccggcaaggaattttcggtgcgcaatttgaaggtaaaattttaaaatttaatatattttttaaatttacattttttcagcccagaatcctttttccaaagtctatacatggtcattttggatcaaactatatgcaaaaatttcttcaaaatttatctagcggcccaaccggcaccgccaaacatttatttattattgttagggtatttaaaactaataaaaaatccataaaaatgtttaatgttttgttttttctttctaagctggaattgcttactgaaattaccggaggccttaaaaatactttaaagcttgattttgttgaaaaattttatttaaaaaaatgaaatttccctttttcgtttcctttttaaattttcgatcgcatttctctgtttaatttattgttttatattttctttcgcagaatgcccctcgtgtcacactgaacgttgacccggaaagcaccttttccctcgtgatgattggttaataatttactaattgtcaaacatttatgtaattcaaaattgtttttgcattgtcaagatccggacaatttgtcgaggaaaaacccatcagtggccgaatggctccattggctggtggtcaacatcccgcttcaaacattttggtagaaatttgggaaaattttttaaattgaagtaaaaaggcaactaattcaaaaaaaattagtaaaattttattttaaatgcaattaatcattaatataaagacaaaattaattttaaaaaatggcagataatcctttttgccttttcattgaattaatcatcattcctttttgccatttgttttaaatttgtgcccatcaccctaatggtcttgaatagggatggtgtcttcttcttccgttgatttgccactgatttcggccactttaggagggcatcaacgggggtcagcaccagcagccgtacggttcgccggcgccgcagccgcggacgggcgaacatcgctaccgtaattgtactgtttgagcaccagggcaagcggctggccgtgccgaagtttaacacgcgggcgaaattctcgctgaagcaattcatcgaaaagcacaaattgggtgggcagaagagagcgaacaattaacataaaaataatttggcatttataattatttaattttttacggctttataaaaaataagcccctacaaaatgaacctttactaaatattgcctttattagtaatggaatttttggaaaaaaatattaaaaatgttttaattttcacaaatatcctctaaatttcttttaggcgcgccactcgccggcaattatttcatcgcaaagaatgaccaa

SEQ ID NO: 53175 - DNA, 656 bp, Heterodera glycines
  Genomic contig location: Contig_ID=SeqID_22506; Location=84..739; Strand=+
  SCN-specific regions: Sequence locations=1-313,344-533,571-656
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 53176 - DNA, 732 bp, Heterodera glycines
  Genomic contig location: Contig_ID=SeqID_22507; Location=1470..2201; Strand=+
  SCN-specific regions: Sequence locations=1-322,344-452,490-496,555 -630,652-732
atggccaccatcgacttgttttccggcttcccgtttttcactcccgaactttgccatagactgaaggaggaggtgccgaaaaaagtggcaacagttgcagtggacattttcagcccaacgccaactccgacattggcactgaacagtgccattcaacaacaacaaaacagtgcgtttatgccgtcctcaaaaagtgtttaagcattgactgatcgttctgaccactgactaataagtccaaatttaaaatgagtaattcagcaagcgctttggcgccatcgcctgtccgcttcgtgttcacttctgcgccatcctccgtcccctcctcctcagtgccatttccgatggttcgtcctccgctgactttgccgaattgcttatggccttttatgaattgccaagcatttggatggacagccgaagcagaaggacagaagcaaaaaagtgaagagaaaaagcattggggagaagaggaggaaaagggtaaaagagggagcgaaagaaatgcaaaacgaataaaatttaggacaaaaagtgaggggggagagaaaaactgatcagagtgccgggaggactgatcggcgggaagaagcatctgagacggagcccggcacaccagacaacccgggggaggagattgaggtggacgtggagagtgttgagaagacaagtgacgaaactcagagagagggagccaaggaggagcaagacagtggggtcagttggaaatga

SEQ ID NO: 53177 - DNA, 966 bp, Heterodera glycines
  Genomic contig location: Contig_ID=SeqID_22508; Location=6..971; Strand=+
  SCN-specific regions: Sequence locations=1-24,47-459,481-490,513-966
atgccaatttattgcacttttgataataaaaacagaaaatggaaatggcctcgaaaaggaccacataaagtaattgggagaatatacacaataaacccaaaaaacaaagaattatattaccttcgttatttattactgaataaacacgcaaaaagttttaatgatttaaaagttgttaatggctttaaatataacacgtatgcagaagcatgtttagccttaggcttaacacgagatgatttagaatgggacaaatgcttaaatgaagcaagtcaattcaaatttcctaaaggccttcgttcacttttcgcaaatattcttataaattgtgagccgaaaaacccaaaattactttgggaaaagtataaagacgaattaagttatgatcttaaaaaattgtatacgcaaaatgatgcttatcaaatggctttattattaattgaacagaatctttctaaccatgaaaaaagtttaaaagattttgaaggcatgccaaaaataaatgaaactataaaaaacatttcagagtatcaaattattaacccaaaagatgaattaaaccttgccttaaacaaattttcattaatgaataaggaacaaaaagaaatatttgaaaatataaaaacaatttttgaacaccccacggaaaatcaaaccaaatgtttttacattgatggtccaggagggacaggaaaatcttttgtccaaaccgcaatttttcatttggcaagaggttttaataaaaaagttacaaatatggcatttagtggaattgcagctacagtgttaaaaaatggtagaactgttcataatcgtttcaaattaccgttagatttaaatggtaattcttcatcattaattgaaaataattctaaagaagcaaacgaaattagagaaacagatgtttttattctcgatgaagcaccaatggcaccaaaatatgtaatttgaataatcgataaaaaa

SEQ ID NO: 53178 - DNA, 424 bp, Heterodera glycines
  Genomic contig location: Contig_ID=SeqID_22512; Location=834..1257; Strand=-
  SCN-specific regions: Sequence locations=1-181,203-270,293-424
atgatgtaccgaaatgcaaaagactgtgctttttacacctgctacaaatctcgtaatgacagggacagtaatgacaacacttaattttatgtgggcagttcatttttcaatttaattttatttttgtttgctatttatagaggggtatataaagggagtgaaaggaccatttgattggtacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcagttatcaaatgtacacgcccgatcaaagccaccgcactattatggggatccggaaaaatgatatgtctggggacgaaaagtctgatagactgtgaaaatgctatataa

SEQ ID NO: 53179 - DNA, 586 bp, Heterodera glycines
  Genomic contig location: Contig_ID=SeqID_22513; Location=65..650; Strand=+
  SCN-specific regions: Sequence locations=1-586
atggcacaaccgtacggcatgggaatgccgtcgacaatggcatgccaaaattgggcgccaattgcttatcaccagccggaccattatcaccagcagcagtattatggtgaattttggcaccaccaacaaaaccctggaatttgtgccacaaacagcaatttgtcacaattaatttggccaacaacagcaatggcaccaacagtgccatcagcgtcaacaacaacattttctggccaaatgccaatggtgaagcagtgcaaacggcgtgccaccctcgcctcagttagcaccagtgccgtgccgtgaagggaacggccgaattttcggcacaaaatgccgtcagcaatgtgtgctattacaattatcccccaacaattagtgctaatgatgccttttgtgctgcacaatattattatccaccgccgccgcctaattatccaaatcagcaacagcagccaaacgcacaatcatcatcatcattagcatgtccaaattatcagcagaattaccattgcattgttcaaataataacaaaacatcatctaaatcatcattatgacatttgttggtcaaaattaagagaaaa

SEQ ID NO: 53180 - DNA, 596 bp, Heterodera glycines
  Genomic contig location: Contig_ID=SeqID_22513; Location=1050..1645; Strand=-
  SCN-specific regions: Sequence locations=1-596
atgcatcagcgtcgaccgccacgaaagctgaacaaatgcatgttggccaacaacaatttggacgagttcagaacggaagtgatgcgacgaagtgccattgtggaggaggagagggatgaatttgagcaaacattggaccaaatcatggacacgtacagcccagcagttcgcttcatcgagccatttactgttcgttttttggcaattatagaaatatatccagggatgtgtcacatgccgactgccaatttccaacattttcgggctcagagctccgatcgagtgccaaaatttttagggaattctgatcgcctaaaatttttccgactgccgacacaaccctcaattactacacacatataattttcaagggctgccccatttcgtcgcccccaaaatacccgtaaaaaatacaatttgtccccagcaggcattgcaatttgcactccaatgtccgcttgaatcgctggtgctgttggatcggctgctctttttgcgcgagaatggcatcggtggcgctgagttggtccgtctgtttgacccggccatttcaccgcggtgcgttgccattgtggcacgggtgaatgaacaataaa

SEQ ID NO: 53181 - DNA, 1899 bp, Heterodera glycines
  Genomic contig location: Contig_ID=SeqID_4100; Location=551..2449; Strand=-
  SCN-specific regions: Sequence locations=1-268,328-346,387-614,673 -701,757-871,894-1330,1352-1630,1660-1688,1762-1899
ttactccgctgattcatcattcacaaattactaattagacgtccatctcggccaagtggggcttcgacgcggtcagtggcgcttccaaccaatacactctgtccaacaatgccgacatagcaccgggcgccacaaattcaaatggtggcctcaacattcagggcaccaaccctaacggaccaccagcaacgccaacactccaactgattgaggccaaatattacagcaacggtaattggaggagggcaccaatcaattttaattagccatttttaagtattaaaattagttttaaaaatttattaaatttaatatattttttaaaatgaaatagcagcagtacatgaatttttcttttaagaaaaaattataaaaaaaattttttaccgctctaatatggttggcaaatgtgtgccaattttcactccattcttagggggtggttttattagaggaatgaaggttgggctctaatagagagaatgggaggggaggtggagttatttatttttattttgcatttttttcaaccagatgtatgctttttataaaagaacagcagagggttggtttctaatagaggggggtgggaataataatgaaagccaatgtccataaaaatttaattattaattaattagtattattagtttattttcatatatttattttgtattttgtccatttccaaagaattttgatttgtgtatttgatattcatttcatttattatctccatacaaattttatttttaggtgtttgcggaggatcatcatcatcgtccggcggtggtagttcttcatcatcatcgtcatgtaataataaagacaaaatatgggaccaaagagtcattaaatctgtactggtttcatttgaacatttatttatatgggtaatttgtaattaggcatattatgaaatgccaaaagcagaaaaatttttcaaattgtgccagaattgggcattagaactatggatgaataatgaatatctatcgctatgccttttaaggcatgggctgtttggccagctccggcacatccggtcccattgactcgtacattggcaagtcgatcagcaacagtgtgttcactttctacggtggcggcggacgcggggcgtgcggcctcgattctggcgtggtcagtcaagtagaaaagattcttggttacggtcaggaatcttggttagtcaagagtcttagttacggttaagaacggttactgtcacggagtcttagttacagtcaaaagagtcttggttacaattaaatgagtcttagttacggccaaaaagagtcttggttacaattaaatgagtcttagttacggccaaaaagagtcttgcttatttatggtcaatacagtctcggttacggtcgcgtctttttgttacaatgacacgagcattcattggttacggtattctcatcatccgtatcgtctatttagccaaaaatgtcagcagctggttccggcaaactgttcaagtcggacgggcagtggaaggacgcgtgccgtgccgacaaacaatacatgctggacgacccaatttgcaaagacatttgcattaagattgactacaatgggaaaaggtggggtgaaaagcaattagctcatatcactttcaaattaattaattgattaattaataaattatagtatataataaagtatattcgatttccttttttcgtattttaaagttttaattttatttacatttttatcgtctttttttgagtttttttttctattttttgcagcttgactgtgccaattaacaacaaatgcccggaatgcgatgtgaaccatgttgatctgaccattgatgctttcaactatttggagccacgcggtggcgaagttggcaaagcgaccggtcagagaatttaatgc

SEQ ID NO: 53182 - DNA, 3895 bp, Heterodera glycines
  Genomic contig location: Contig_ID=SeqID_4101; Location=1727..5621; Strand=-
  SCN-specific regions: Sequence locations=1-150,197-224,274-522,560 -612,648-743,771-806,828-858,880-1154,1205-1340,1369-1372,1426 -1581,1625-1679,1711-1767,1866-2045,2083-2120,2166-2196,2218 -2380,2437-2440,2462-2520,...
  SCN-specific regions: Sequence locations=...2580-2850,2926-2987,3015 -3024,3055-3397,3430-3531,3574-3846
atgtcaaaaatagtttttgcttgcacattacaaattgctctgttttttgtatggacccaaaaaaatggtgccccaaatccgagccgtttgagcagcagtgaagatggattattagtcgatggcatgcacaaattatttaaaaatggtaactatttatatattatataaaataaaatatatttttaaaataaattttgtaacaaaaaatgaattacaatttggactaatttatatttaagaatttactaaaaatacaattttttttcaattaatccattttttcgctgccattaaagtttttcaaaccatttctgaccgccccttttttgcaagccccaaataagggttgttgcgaatcgaaaaataaaatgcgaaatatgaaaactacgaaagtaaaaaaaaatatacgaaacacggacacgaaatgccctaaaaacaacaaattacgaaacgatacatccctgctccaaactatgacggttttcatgtttggaaagaattcaaaaaatttggcagcccttgaatataaaaaaaacgtaattaaatttttttaattttacgcagattcttctaatgctaagcagcaaaatcgtgataagcatgtcaatgcaaatgatgatgatgatgataatgataatgatgatgatcaacatcgtccaccaatcgaatgcattgtttgcgcggatagcttcacaaatgatcaattgtgtttctgtgatgttgctgctgatcatgctgacgctagcagcagcagcagcagcagcagcagctcaactgctgcttgccgccaagcacaaggtatcaattacaagtaattaattttgaaattgtcattaatgtacagacagctacagaggtatcaattacaataaaataaatcaaatatttatgaatgtacacacatctacagtaatcattagtgtaattgtgatactgtaaattcactacagttttctgggttacggtgatgttttgttttagtccaaaacagcgacaggacagacaacgcaattcattatctttagcaataatcctacaataatcctaaaacgaattggtttgcgcttgtcgagaagccaaattttccgaggctcaagaacagagaccgggaaaattgtcactgaaattcgaaacccaaaaaacccgagaatatgaatttatatatcttaaaatatttttttaaataattttcatttaattttaagaaaaacatgccttctgcattgagtgccttcatgaatacacaaaagcggcacatgaaatggtgccatttgcgcccagtgggcttggactgaagtgtatggcgttggaatgcgaaaatccaatcacatggagtatggacaattaattaattaattaatgcagtttggacaattaatttgtataattaatttttttaaattataattttaagaaaaaataaaagaattgttaccgaacgataaccatcggtcaattgaaacattggaaaaccattgcgacttcatgcgtatgacaatcgctggaaattgctgcaagaaatagtaagttaaaaaataataatcagaaatctatttaatattttatggagtgaaaacccgcaatatattaatttgtttttcattttaaattttttgaaaattaagcattttaaaaattcaggggcccttaaaaaatccaatcagaaaaatgtttttgtgtattaatttttaaattttataaaataaaaaacaagaaatatcaattaccatcgatcaatgttgttttttttgattgtaacaaatagccaaattaaatttatcaaattcaatttacaaattatgttaaatgaaaatttcatattgatatatttatatatattttttttatcaaaaatcatttttattcacaaatatttttcagctgtccatgttgcaattgtgccattgaaatggacaattctgttgataaaagtcgcccatttcagtgtccaaaatgtggcaaggatttgtgccgaaaatgcaatgtgccatggaataataagcataaaaaagcgacattttgtgaaattcaaaataagtttgttcaattttttatgttttttttaaatttattataattaatgctcgggttttttcaaaatttttactcatttttccaacaaaattttaaattaagttttattaatatttaaaaattatatttttccttttaaagctatatcgtaccaattttggcttaaattttttttatttaaatcccaattaatttaaacattttcgtcagaaatttttggtttcaatccgacaaaaattaatggaatttgtgatattattttaaacatttaagggatcttcatgtttgtgataaatgccacttaatttttattaaagaagaaggctgtaattatgtatgatttttgttttttttgtaaaaataaattataaaattaacaataatatttttttaatttaaaatctttaggtaaattgcccctgcggaagtacccattgttactgttgcggaaagtccgaaatttttggaacaaatcatttttgcgggtaaaaataatttttatatttttaaaacttaaattaatgaatttatttttttattaattagttgtggtgaagaaaagcgaataatttgtgaggacaatgcaacaaaatgtcaattgtgtggcaaatgtacactgtatggaaatgttaaagatccgtcaagcagtacaaatatggacattccatcgaccagtacaaaaggacgcaaaggaaaagaggtacaaataattccaatttatttaaatggacaattaattaactaataatagctctgctcttaattaatcttttaattaacgaatactcttggttagctaattattaatatgctctcaattaactaattaattacctactcttagttaacgaattaattaactttaattaagttaattcattagctaattaaaaataattatctctactccaagggcgtaggcagcgaaacccaaaaaagtaaaaaaatttcagttaattttttgaaatttttaagcaattttcttaacaaatttgcattaaaatactcaaaaattttcccggcggcgcctatcggcaccgccggacccccatttaccatatttttgaaaaatgaaggccaaaatggcaaaaaatagtaatttttggcgaaaaaaggcgaaaaattatgtaaaatacacccctaattcgggatttcaaaaaagcaaaaatacacccctaaaaatcgaatttttgatttcagccccccccccaaagccaagggtctggctacgcccttgctctactcccttctttcactatttcagaaggcagcagaagtgatcagcgatgatttagcacaaaagctaaaagaaatgcgtctaaaaatgtgagttttgctaattaccccctcgtaaaaaaaagagaaaatttaaaaatttatttaaattcaaaatatgcattttagggaagaatcgttatcagaagtgacattgcatcaatgtgcatgtcgaaatgaatattttattaaagaggaaggcccaacttatgtaaatcttcgttataaaatttttttgaaattttttaaatgaaattaatttaaggtaaattgtccagcttgtgagaagttatattgtttctgctgccgaaaatctaaagtgacttcattcaaggaccatttttgcgggtgcaaaaaaatacttaattagatttcaattaaatttaattaggtgtcaacgagaggtcaaaccttcactggacaatccatgcaaatgtctcaagtgtaaaaaatgtattgaaaatagtgattataacaaatttgtacaaatcaaattggacaaaattcaaaaagattataaacaaaaagaggaaaaggtaatttaatttattaatgattaaaaattaaatataatttgtttaataaa

SEQ ID NO: 53183 - DNA, 1492 bp, Heterodera glycines
  Genomic contig location: Contig_ID=SeqID_22517; Location=1..1492; Strand=+
  SCN-specific regions: Sequence locations=1-138,160-503,527-549,582 -991,1058-1492
attcgggatttgtgtttaacggactttcgccaattggacgacgatggacgtgagaaaagggcggggaatgacacaggacagtcgcattaatcaccgcagggcaggcattcgtaccagcgaatgttcggggaccaacaagacggggagttcctgaacggagcgcgcatcgactgggttctgtctcaagagcaggtggaccgcgtgatggcattcactttgccgttgcatgtcagtgtttgtcattcgaattgaaaagggcaaaaaataaacatcgaattcaatgggccgttcatagtttttactgccctttcctcttctgatcggctccatttccttctgtcctttagacgtgcattaattatccgctggatgagcgtttcctcgaatattcgcatgattacgttcgtttccttttaacttttcccaaattgagactgttcaggtccattattttataagcggggacatgcaagaacggttcagctccagcaacgacccaatcttcttcatgcatcacggttctgagtgtcttaacacattgcgaaataataactaattaattaatgataattaattaattaccatttccttacactgagtaattgtcaaatcgattaattcccttcatattccaggcttcattgattggatatgggaggagtggagacaaacaaagcaggttggtcggtcagactggccactaaacgattcaaatgtgccaaattcggcctccatttgtttgttgtgccatccccaaaatcacactcatttgtcagaatcgtctccaacgtgaacgcgattatccccgtgacgatgccgactgcatgcccgaatggcacttctcatatgcgtacatgcctttgttacaacctttgcggaacatggacgctctgtccaacaactacacggaccacatgtacgaatacgcaccaaggccgagctgtgccaaaagtggaaaatcatccgaatgcggcaacaccgagttggtggaagagagggggaaatagagaaggagagtggagacaacgagagagagagagagagaggaggagagagaacgtgaaagagtgaaaaggggcgtagagacaaaaaagaaacaagagagctagagagagagaggagaaaggaaacggagtgtccgaaagggaaaaacagaggcgaaaatgccgtaattaaacaaattgcctgcctttcagttttgtttggtgcgacaagcgaactcacccgggccacgccgtttgcagctccaaagtgaagccggggggaaattgcaaagggttcgaatggagtgaggagatttgctacaaggggaagtgtgtcgggggacgctgctcaaagcaaaggacgggggacggcaaaaggacggggaaaagcggaggaaaagcggacgaatgggcgacggacagttttatgaaatgaacggacggacgagcgactgaccgatggaacaaaactttaagcatttaacccacgaatccttccattcgctagc

SEQ ID NO: 53184 - DNA, 93 bp, Heterodera glycines
  Genomic contig location: Contig_ID=SeqID_22518; Location=839..931; Strand=+
  SCN-specific regions: Sequence locations=1-93
atggggagcaaaaatccaacgcagaattacagtacagactatagggaagctattcccgaaggattcggtctccccataaatctgggcgcatcg

SEQ ID NO: 53185 - DNA, 125 bp, Heterodera glycines
  Genomic contig location: Contig_ID=SeqID_22519; Location=41..165; Strand=-
  SCN-specific regions: Sequence locations=1-125
atgtataattcgccaccaccgcccattcgttggcagatgttgatctacgcgtgtgtgctcaaccagctggacattgctctcacagtggccgccagtctctccgtccagtcgccgttcaccaatcg

SEQ ID NO: 53186 - DNA, 1427 bp, Heterodera glycines
  Genomic contig location: Contig_ID=SeqID_22520; Location=277..1703; Strand=-
  SCN-specific regions: Sequence locations=1-89,131-209,235-877,899 -1085,1107-1258,1280-1427
  Gene Ontology: Mol. function=pre-mRNA splicing factor activity; Cellular component=spliceosome complex; Biological process=lariat formation, 5'-splice site cleavage
aaactgaagcagtcccaactcgaactgcccatttaccaaagtcggacggaaatcctcgaaaaattggaagaagtgggcggaaattcggggggaaatcaaaaataaataaatatgaatttccagaaccaaatcataatcattgcgggggacacgggctgcggcaaaagcacacaggtgaaaggcatggacacaaatttggggtaaaagtgccaaatttttaaaaaagaaaggattccgccccctttaccttacgtttttctgtttttgctttattttcgtgtttagctgccccaatatttgttgaacgcgggttatgccaaaatcgcatgcactcagccgcgacggattgcatgcacaggtcgaaaatggggggggggggcgagaaaaaaagcattttctcagattttaaattgagactttgacaaaaacaaattctggttttatcaaaaaaaatgacttagaaagtctcgacaaatccgaaaaatcacgacactttttgttaggaatatagtcttacttttttctcattgtcaattttatagtttttggcttttcctccccttttggcatttcccacttttttggcattttctccatttcccttttcttttttttcagcgctcgcccaacgcgtcgcctgcgaacttttgaagcagttcgactcgcacatcgcctaccaaacgcgctttgacaagaccaagacgagtgccacgcggatgcttttcctcaccgagggtgtgctgctccggcaaatggtcgacgacccgggcttacagcggtacgacgtggtcattttagacgaggttggccaatggcaaattaacggacaccgaaagggtgtgaggggaggaggacggcgtttttcattttttggtccaaatttttccattatttccctccttttgttcgtccctctttcgttttactattttctcctctatttaaggttcacgaacggaacatttccggcgaccttttggttgcgcttttgcgcagtgcgtgccaacgccgtggcgacctaaaggcattttttggcatttttcagtaccaattccctctttttaataattgttttcccagttagttttgatgtcagccaccatcaacatcgacctgttccaaggctatttcccggaggcgccggtcatttcggtgcccggccgattgtatcccatcgaactcaggtggcggggggggggtcgaactttttttgactcatttttagtctagcgtcgctctcatttttaaataattttccttttggacacttccattgttttttcatattttctctcccctttctcttttaggtatatgccccctctgatccgtgaagtggacacctccaaaagggcggttcgaattgaccccggacccttcgtgaacattttgcagctcatcgacaagaaatacccttccacggaacg

SEQ ID NO: 53187 - DNA, 1859 bp, Heterodera glycines
  Genomic contig location: Contig_ID=SeqID_22521; Location=282..2140; Strand=+
  SCN-specific regions: Sequence locations=1-151,173-1567,1590 -1603,1626-1859
atggagtcctatcggttcgtggcctttgatctggagacaatgcagcatctccctgttgaccctcgtgtacctgagaggcgcaaccacgagccaaacttcattgcagcgaaagtgatttgtccaatgtgcattgaaaatgggagctggaagcaaggaactgccgggtgttgggtgtgcggcccacaccgaaccgttgccttctgccaacgaccatttaacggcacttctgttgacaaacaagtggtcaccgacaatccaatgcaagcgtttgtgggatggctgatcaatgacctaccgaagaaagccaacacgtacgcatactcccattttggcggacgctttgatatggtcatcacattccgtgaactatttcgtcgcggatttaacccggaaatgattagacgagtgagaggctctctttacttttatttttacttagtgaatgtttagggcaacaaaatgtacgagatgaagctaaaggcacagaagaacaaaaatccgaacatcattttccgcgactccttcaatctgatgccctgtgcgctcggacaactggtgccagcatacggcttggacgtcgaggagaagccctttttcccgcacatggccaatcggccggacaactatgggcgcgaaatttttccaacacccgaagactacctggcccaaggaatgatgccggagaaacgacgtcagttcgaccagtggtatgaacaacatcgacgagagccgtttttattggatgaggcgttggccagctactgcaccaacgacgtggagatcttgatggcagcgttggtggcatttcgacgtgaattcctggaaatcactaagcggcaagaatatgtggatggtgtcgacaaccgcgaaaatcacgatggaattgacgttctgaagcagtgcatgaccatcgccagcgcctgcatgaagcacttccggatcaatcatctcccggctaaccatctggccatcgtaccggaaagaggctacgacaacgcccaaaaccaatcattgctggccctccgcttcttcaaatggtatgcggagaaacacggagtccaactgcagacggcccacaccgctggaggtgagaagcgcgtcgccaactactcactggacggttggatcgaatccgagaagagaggcattgaagtgaacggtaattttagaaaataaaacatgtgctagaaaaatttgtgtaggctgcgtttggcacgggtgccgcaaatgtttcccggaggacaacatgctactgcctaatggaaagtcggccggtgaagtgcgggagcgggacgcaaagcgccttgaatttttgcggaaccaagtgggccgtgtggacgtctactgggagtgtgaaatcgagcgcatgctgacgacagaccctgagatgcggcaggccttcgcaggctatgttgatgatggaccattggaaatccgcgccgcgttcatgggcgggcgcactggtcctctgaagctctaccacaaggcgcgagaaggggagaagatttcgtacttcgacttcacttccctctaccccttcattaagtgagttttagcattaaaaatgacacttaaaaatttatgtatttagttttacgacacgctatcctgttggccacccaaaagtgcacgttttgaacgaggacgtggaatggaagtgcgcagcggacaacccctacgatttgtcgctgctcaaagtgtgggtcgtgccacctcgtcgatgcgatgtgccggtgttgccggtcaaggtggatgagcggctgtgcttcccgctgtgcttcaaatgcgccaaagactacccgaccggcggagttgacaacgaatacaactgtcgtcacaccgatgaacaacgcggctgg

SEQ ID NO: 53188 - DNA, 1805 bp, Heterodera glycines
  Genomic contig location: Contig_ID=SeqID_22522; Location=305..2109; Strand=+
  SCN-specific regions: Sequence locations=1-40,62-86,109-207,229 -258,280-340,379-525,547-598,628-803,825-1147,1184-1232,1254-1805
atgaagaaacaattaaaacaattcagaaatgaaaaagattcaaaaattatttcccgggggcaaaattcagttaacaaatttatccgaaataagttatcaaaattttttgagattcctactctaattgataatgctggaaatatgttttccagcaatgtacaaaaatgtaaaatattagcagaaatatttcaaaagtcttttttaagaaaatcaattgttaatggtccacaaactcagtcaacacagaataagaccaagctttttgacattgaattgaacgctggcataatttggaacatattaagaagacttccccggagtaattccacttcacctgataatatcccttatattttattaaaaaattgtgcagaaccaattacaaaaatattagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttgagtagcaaaattttagaatttctgaacagtacaagattctttgataaagaacaatttgggtttttaaaaaatagatcgactacaacccaaatattaaaaacaatggacgatatatataattctctacaaaaggatcaacaaattgacataatctatattgattttgtcaaggcgtttgattctgttccaattgatttattacttcaaaaaatcaaaaagattggaattgaaggaaaaattcaaaattttttaactaactttttaaaaaatcggcgttttaaagttaaaattggcgaagaattgtcagaaagtttcagaatattttcaggagtgccccagggaagtgtcttagggccattactctttttaatttttataaatgatctgccgtcctttattacaaatgaagcggcatcagttggcataaaaatgtatgccgatgatgttaaattatattatgcccatgaaaatgatgaccattcgaatcagttggataaagaaattgaggctttggaaaaatggtcaaaaataaatgggttagaaatttcaactgaaaaatgttttgttttatatttagggaaaaataatatgaaaaaagaatattttattaactcaaaaaagatttcagaatcggataatgttcgtgacttgggaattataattgaatcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgaacgggtacaaaaatttttcacaagaaaagcatttcgaaaatgtggatttgtgtacaaaaaatatatggaaagacttaaaatcacgagtttacacaaattggaagaaagaagaaaaatcaatgatttaacaacagcttttaaaataattaaagggttcaccagcctcgatactgggaaaagtttcgttttctcagaaaggtccaggaggcctttacttttacgagtaaagcgccacacggccaaaactcaaaataattttttccataggatagtaagaaactggaataaccttccagttttagcggtgcaaattaataaggcaaaggaattcaggggtttactaaaagcaatgagttctgagtaggaaatttctgtgccacaattaca

SEQ ID NO: 53189 - DNA, 625 bp, Heterodera glycines
  Genomic contig location: Contig_ID=SeqID_22524; Location=33..657; Strand=+
  SCN-specific regions: Sequence locations=1-203,225-474,496-625
atgatttgcactttgctccgactgtaccgcaacgtgctcgagttcggcccactgtacgtgaaccatgccattccccggatgctttccgtctggttagacttggcgcccaaatgtgccatcgccgaggcgatcgcctcgggcaccggcacaactgttggcggtactgctcgcacttcggctagcaaaaggggaggcaaagctgcagcagcagcggcggctgccgccgctgttgcaacacaaccacacgacccgaacagagaaatgcgtgacgcgttcaaacggctggacagggcgtatttcttctcctcctactcgcaaatgatttcgcgcatcactcactcggacgccgccacatatgccctgttgaaggtccagcggggaaaataaaaatagcagtcgtttccatgtactgtctacccaatccactattagagggtcagcagaagtgtcgttcggctggccatgtaaaacgatgggttttttgtggcgcttttttcaaaaaaataatttttttgggaacataaaggggtctgccgatgctgatagcaccgcgccggggaaaactttttgaattttttaatgcaatttgctgcaaaaaaaatttttttttttgaaaatgttcaaa

SEQ ID NO: 53190 - DNA, 997 bp, Heterodera glycines
  Genomic contig location: Contig_ID=SeqID_22525; Location=26..1022; Strand=+
  SCN-specific regions: Sequence locations=1-455,486-779,803-997
  Gene Ontology: Mol. function=protein kinase activity; Cellular component=meiotic chromosome; Biological process=cell cycle checkpoint
atgcgcaagaagggtccactgatgactcccaccgaattgcaacggtgagtcatctattgctgcacaatttggcactttttgacaaaatgccatgcgattagccattttagtcagtaataattttttatgcccacattacagtcttctcggagatcaaacatccagaggtgatcggttgaaggcttttcgtgaagtctgtgctcggcatcccctcgcaatggcacaatggattcggtacggtcgcactttcacaaaaatcaaatccaaaaaaaaattgttgtgtcaggaccacctttttggacgcctgttcctggtacaatgctcggcttgcattcactcgcacggccgccacgatgagcatggtcggctttttgttgggcctgggcgaccggcatggggagaacatgttgttggatgtgaggacgggaggtatacggaaataaatccatcattattttccactttttggtttttaaaaaataaacctaacaacgtactttgggtgtaccccaaaatctcgtcaccaaaattcaccgagacaaaatcacgcccacgaaattgtttttataagaaaattggcggcgagattttgggtgcccccaaaaattctttgtccggtttttcgatttatttattcacaaaccgaaaattatctgaaatcaatcatgcaattagaaacccttccaagatttgatccacgtggacttcaacattctctttgacaagggcgaatatctgaaggtgcccgaggtacagtcattccgttacaatttgtttccaaatatttttttttttaaattttgcgataaaattctaatacaaaatcacactccttctggtttgtcaatttcagattgtgccgttccgtctcacccgcaacatggtggacggatttggcgccaccggtgtggagggtacattccgaaagtcgtgtgaaaaggcgttgaaggtgggaacatggatggatggattcatccgtcaatcattgtctaattga

SEQ ID NO: 53191 - DNA, 598 bp, Heterodera glycines
  Genomic contig location: Contig_ID=SeqID_22525; Location=586..1183; Strand=-
  SCN-specific regions: Sequence locations=1-356,380-598
  Gene Ontology: Mol. function=protein serine/threonine kinase activity; Cellular component=intracellular; Biological process=cell cycle checkpoint
ggtaaaccgcccgcgcaaccaaacgcacctgtctgtactgctggtttctggcctcggttgtggtccattccagcagcgggtcatgcgcaaaagcgtgcagaacggtgcggagcatgcgactctcggcccgcattacctgtcgagagtgtgaagcgagtgcatcaattagacaatgattgacggatgaatccatccatccatgttcccaccttcaacgccttttcacacgactttcggaatgtaccctccacaccggtggcgccaaatccgtccaccatgttgcgggtgagacggaacggcacaatctgaaattgacaaaccagaaggagtgtgattttgtattagaattttatcgcaaaatttaaaaaaaaaaatatttggaaacaaattgtaacggaatgactgtacctcgggcaccttcagatattcgcccttgtcaaagagaatgttgaagtccacgtggatcaaatcttggaagggtttctaattgcatgattgatttcagataattttcggtttgtgaataaataaatcgaaaaaccggacaaagaatttttgggggcacccaaaatctcgccgccaattttcttataaaaac

SEQ ID NO: 53192 - DNA, 1242 bp, Heterodera glycines
  Genomic contig location: Contig_ID=SeqID_22526; Location=128..1369; Strand=+
  SCN-specific regions: Sequence locations=1-488,511-796,825-1242
atgtaccaaatatgtataaaaacatttcacggaaattctgttctaaaggtgtgagtccacccatggagtaatggaaatggccgaagcgcccgtgtggttatgagctctgtgttggtgagggcgggcctcaacactttggtgctctagccgcaagcacgtaaaacatatgacgacttccttcaacgcgcaagcggcgcctatcggcaccgcctgaccctaaaatctataattatcttgaaaaatttgatcaaaatcgctaaatttggtcatttttgggacaaaatttgttaaaaaattgcaatagaactttgggcctcggaattccgatttcctaaaattttttgacactcggaattccgatttcctaacattttttaatcctcggagttgcgatttccgaatttttttggggcctcggaatgccatccctgctccccacccccaccccccccctcgctgggaccgttcccgagggtagactttggcaacaattttttaagcaaaatttttctatattttaacaggcaacaacgacatgccgatgaaatgagatccgagttgcaaatggagcaaaatgagcctgaggcagacaatggacgtgcggcagacacattgtctgcgttcggtgacgacgaacaacacctggagattttgaacattgttgggacagttgaggccttttctgtggaagtaagaatattaaacttaacttatcagagctttcgactgatatcacttttttgaaaaatttatataatttggtgcaattacatggggccataattgtgctgttaagtaaatttattttatttttttaaatatttgaatcactttttccttttttaacattattcatttcattattttggattcaactaaaatgatggaattatattccgtgaatttaaaacgtctcaggacataatttaatcaaaataagttactagagtattttcctggcattggttaacccacacataatttatttttcagcatcttaatgcgatccacgcacacatcatggaaggacatccgtctgctggcgaaattcgcactgttgacgtcaacattattgatagggatggaaacgtcatttaccggccaccaccacattcgcacgttttacaactgatgtctgatttctgcgccaacttgaacgaagcgatgaaaagcgtgaaaaagagacgcatggaagcattggcagttgctggtgggcccaccaccaattggtaatataaatga

SEQ ID NO: 53193 - DNA, 357 bp, Heterodera glycines
  Genomic contig location: Contig_ID=SeqID_4102; Location=2412..2768; Strand=+
  SCN-specific regions: Sequence locations=1-335
atgccaacattcatctttttcaaaaatggacagaagcttgttcgtttattcagcaaaattaatttatctaaaaatttcagcaaaccatcgaaggaaataattacgaaagtcttcggaaaacagtggaaaataataaatgaaggacgaagtgcaaaagaaaggaagggaagggtgaagtgaacgatgggcaaattattgcgatcttttgagacgaccaatcactcattttaattgggggggggtaattagtgagaattggtcagtaaaaaaacgcactcttttcaataggactgtcttctgaaatgtttggcgcactgcactgttaaatacacaaaccacaaatgaagaaatattgaa

SEQ ID NO: 53194 - DNA, 861 bp, Heterodera glycines
  Genomic contig location: Contig_ID=SeqID_4102; Location=4316..5176; Strand=-
  SCN-specific regions: Sequence locations=1-589,611-861
atggccgaaactgcaaaccttcgagaaacgacgatcttctcgagaatggtttcgatgagaatgagacggagaaagccgagagaatggacgaatcagtcgaagggacgcccaatgagcgaacggaggccgaacaacggaagcgtttcccgtcgcggttggtccgactccgttcgtggcgaaagttgtcttccatggccatcgcaatgagtcggtgtctctttgcctattcaatggcagactgttttcaggtcattctttggatggaaaaccttcaaaaaatggtgctgaatgtccattggctgcggacgaatgcgctgccgaagagaacggagcggcgactgaggaaattcgtataagacggaaggacctgaacttcgaagagccgttgcttttggcggtgaaggagggaggtcggtggacatccgacaaatcaattgagcctccgacctcaattacactaatggcactaattagcagatgacttcacccgttccctgggcacttcgccttcttcgaggcgtccttctttgtgtgccgacgacgcgaaactcgccactgccgaaactgcgcaaggggagcctaatgagttggaaacaacggaaatgtgagaagcagagtgaataatgaggaaacagtgaaaatattcaaaattgattggatttagcaacagttcactcggaatggcacttcaaatgaaactgaaagtttcggacaaacccttgcggtgcatttcgcttggccatttccaaggccaggaagtgatcatcaccggcgcgggagaatatggggacgatgaagcccttctgagatggcgccgcgacccgaaaaatgtgacaagttttagggaaatttgttaataaa

SEQ ID NO: 53195 - DNA, 1626 bp, Heterodera glycines
  Genomic contig location: Contig_ID=SeqID_4103; Location=1..1626; Strand=-
  SCN-specific regions: Sequence locations=1-460,484-1158,1180-1626
ctttgggactgttttctatacgaaggaccgaaggtgcttttccgatttgccattgctctgttgggtttccatgaggaggaactgctcgcccattccgacacaatttcggtcatcaaaatgctcaaagcggccgtccgactgaccttcgacgtggatgggctggtccgtccgtttcatcatcattccttcttggcatttccgttcagataaagttcgccttcgagcagctcagtccgttccccagcaaagcttacctccgtcaacgccaatcgctttatctccgcgtgctccaagagcagcttttcaagaggcagcaactccgccaactgctcaacataacggtgaattgtgttgccaccattaattgggtcaattaattgggtttcgcttcagaattcgtcggaccaatcagaccaactctgtgatcttcccattgaggcaacattttccctttgcttgtccattttttctgtttgtcccccaggtggtcgtgttcagtcaattcgttccgggcagaggctacgtttgtgccgggaaccaaaaacgcggaaaattatcgatgatccaactgcaccaggagactgccagtctggacactctcgaattggaggtccactcgagagacatcctttgccttggcattggcatcgctttccctttcagttcgattgtcgactcatttccatggttctgttcaattcggaaatggcttttgtctcgcttctttctggctacgttatcgctctgcaccttaatgagtcgggcgaggctgaaattctgtgggagttgaagctgaatgacgtggcattgaaattggtcgctttgatgcgacgtgtctttctcaaacgtccgtttaggtcaactgtccccagcgtctctattcctgtctcgccaatggcactttggctgttctcgagaatgccttcgagcgaatgccttctgctctcgacctttaccacattccgattgcagctgctcccataacggatgcactgcttgacgatgacaaactttacttggcagttgcatgcaaaattgttgtgctcaaccgcagcaccctttcaaccgtggcgagtgtttatgttgcctcggcatcagtcggcagccaagtgccaatgtttgaaaagtcgttgtttcacccgattttccccatatttatgtttgattttggaaaggattcgtaatttggcaccttcgcccttcggaatttggctgctcaccgcccattcgtcccttattcaactttggcgcgacggacagtgcgaaatgcttttcgacattcgctacgaccacagccatcggtcactgatcggctggcactgtctgctgacccaacagattttcccatttaggaagccatccttcgacgaagacgacgacaaattggagcaggttgagctgtgctccatccttttccacttggatgagctttgggtgggcaccgtcgatggtcggtcattctttccgaattcgtcggtcgtcttcccacctcctgtccacccttttttaggctatttaatgctttatcgcgtccttgtcgagtcgccaaacaattgcaaaccgaccaaaacgcgttctgccgagtgtcgattccaccaggaaagcgtctctcagcagtacatggcc

SEQ ID NO: 53196 - DNA, 49 bp, Heterodera glycines; identical to SEQ ID NO: 51181
  Genomic contig location: Contig_ID=SeqID_22527; Location=520..568; Strand=-
  SCN-specific regions: Sequence locations=1-49

SEQ ID NO: 53197 - DNA, 1118 bp, Heterodera glycines
  Genomic contig location: Contig_ID=SeqID_22531; Location=204..1321; Strand=+
  SCN-specific regions: Sequence locations=1-1118
  Gene Ontology: Mol. function=chaperone activity; Cellular component =extracellular space; Biological process=cell organization and biogenesis
gtctgaatccactgcacaccgacgcactagactcatcaaatgttgacgactcttccgtgactgatgataaatcatccgatgttgacgactcttccgtgactgatgataaaccttcagatgttgacaattcttccgtgactgatgataaatcatcaaatgttgacgactgttcagtgactgatgataaatcatcaaatgttgacgactgttccgtgactgatgataaatcatcaaatgttgacgactcttccgtgactgatgataaatcatcaaatgttgacgactgttccgtgactgatgataaatcatcaaatgttgacgactgttccgtgactgatgataaatcatcaaatgttgacgactcttccgtgactgatgataaatcatcaaatgttgacgactcttccgtgactgatgataaatcttcagatgttgacgactcttccgtgactgatgataaatcatcaaatgttgacgactgttcagtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttccgtgactgatgataaatcttcaaatgttgacgattcttccgtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttcagtgactgatgataaatcatcaaatgttgacgactgttccgtgactgatgataaatcatcaaatgttgacgactcttccgtgactgatgataaatcatcaaatgttgacgactgttccgtgactgatgataaatcatcaaatgttgacgattcttccgtgactgatgataaatcttcaaatgttgacgaatcttctgtgactgatgataaatcctcaaatgttgacgactgttcagtgactgatgataaaccattcaatgttgaccgactgctccgagagtga

SEQ ID NO: 53198 - DNA, 1550 bp, Heterodera glycines
  Genomic contig location: Contig_ID=SeqID_22532; Location=24..1573; Strand=+
  SCN-specific regions: Sequence locations=1-117,140-655,682-1221,1243 -1390,1412-1550
atggcttgcggcgacggtgatcaacccgaagaatggagaatggaaaagccgaacaataaaagtgaaggacttcaacagcctttacccatcccggtaagaaatggcacaagaaatgactttaaaaatttaaaatttttaagcaacatgttcaccaagtacccggttggccacccaaccgtggtgcaattcgacaagaaagtggattggcgctgcccggcacatattgtaggcgaggacggcgtccggcttcaggggatcatcaaatgttatgcggtgccaccacggcattgcttgtttgacatccccgtgctgccgcatcggaacagcaagcgcactctcttcccgctgtgccgaacatgcgcgaagatatacccgaacggcttgattgaccccaactacaattgtccacacttttcggacgcagaaaggggtaaaatgggcaaataaagtaatttttacagagaagaattcacaggtttttccacatctgtcacgcacattgagttggaggcggcactccgatcaggctacaaagtgacgcacgtctaccgtgcatacatttggccgctggtgtgcgattggagcgatagcgtgttccattcgtacatgaacaaatttctgaagatcaaattcgagtgtacgcatttttttaaagtaatacaaaatttaaaaacaaaaatgcttcagcaagtggatacccagcaccgtgcagagaagtcggcattgacgaagaggagcgtgagcgtcggcagcaggactacatcaataagccgtgggagggcaacaaagtgtgcctcgatgcgaacaacattacgccaaatcccgggctgcgttacctgtcgaagctgtgcctcaactcgttgtggggccgttttgcactcagaaaccggctcacaaagacggagatcgtggaatgccatgccgagttggccaagctgctgaacaacaccaaaatagaaatcagcagcatcgaccagctgacggagaaattctggatggtctgctacaaggcctgcgatgaggatgtagtggagcacggcaccagcaatgtaaacttggaaacttttgtttttaaatgcaaatatctcaggttgccattgccctctggacaacggcggcagcgcgggttcacctgctcgaatcgctgcatttggtgtataagcaagaaaatggggtgcagcgatatgacacgcaccttctctatatggtaaaatcaaaacaaataataataataataataattgctaaatttaaggacacggacagcatcttctacgacttcaagtcagaactcagcgaccctcttcctggcggccagcagcttggggaactcaccgacgagtaccccaaccacaccattatggaatttgtgtgcggtaagaatttgcgcaaaataactttaaaatgatttgaaattttcagctggacccaaggcctatgggctgcgcaacaacgccacgggggaggacgagtacaaggtcaagctgcgcggcatcaccctggactcggacgcctgcgagaggatgacgttcgagaagatgaaagacatg

SEQ ID NO: 53199 - DNA, 378 bp, Heterodera glycines
  Genomic contig location: Contig_ID=SeqID_22534; Location=216..593; Strand=-
  SCN-specific regions: Sequence locations=1-324,362-378
atgccttattatgtgttaatgttgtgcctaatgtttcacaccgtatttatggaattcattttaccaaaattttccattttctacaaaacagaaatgaaccaaattgtgcccattttaaaaaatgaaatcaacaaaatgttccgaaacaaggattgggattatgcgacttttgactgtatgcacacaatcgaatggaatctgctcagaattgaccttgccaagatggggcaaacccagaaagaaatggaaaaattgctgaaggaatggcgaattttgtacaacaattgggtgctgaacaaaagtgagatgaatcggccgaatttcgcaaaaataatgcaaaaaattgtgcaaaatttggaaatgatgagcataaaataa

SEQ ID NO: 53200 - DNA, 829 bp, Heterodera glycines
  Genomic contig location: Contig_ID=SeqID_22534; Location=897..1725; Strand=-
  SCN-specific regions: Sequence locations=1-183,274-402,443-487,509-800
atgccgacgaaagtgaattcgcaattgttcaaattgcttttctctttggcaattcgtttatcggcacaaatggaaagtgagcgtttggcagaaaaatatgttaaccttttcatttctgtcaataaatgcatttcaatttcggcagatgacataacggattactggtgattttgtagataaaacattatttaatatttatacaaatttaaatgtttaattaatttaaataataataaatttatatttgtaatatttaattcaattaaatttttagtttacttcaaacgcaaatcaaaattaaccaaaaaattattgaaattgaacttccgaattggaaggacaatttgctatttgcaagaagcttgggaatgttgcaaagagaacaaataaaaagtgggaagctaattttaatttttaaatcatttttaaataaagaaaatttcgactttttgtgtttgttgtccgattattctcccaccatttacgaaattattcaaatgcttaaaattgttggtgaagcaaacaatgcacacttttgggttgagccttctgcgccccaaatttttctacgaattttaaatttttcgatgtcaacagaaataagtgacgacaaagtgaaagtgccaatccgaaaaagtgagttttgcgttttggtgaatttttcaaatgatttgttggaacgaattatgaaaaacagaaaaaatcaaaatattctgtttaatggcgtcgagccaattgaagtgacaattagcaaatttgaattgataaagcaggaattgtgcagtgatacagaacactcgtaaattatttttaaatttaaattattaaa

SEQ ID NO: 53201 - DNA, 824 bp, Heterodera glycines
  Genomic contig location: Contig_ID=SeqID_22535; Location=342..1165; Strand=+
  SCN-specific regions: Sequence locations=1-68,97-98,120-177,258 -287,318-436,469-540,562-688,713-824
atgtcttggcctgatcttgtcaacaacaatttgatcggtaaaattaataattttacatataatccgtgaaaaaaatttttatgaattttttttaaaggcactggtcatgtttctaaggctgcaatttgtggcttggacggttccatttggggaaaatcggacaattttaatgtcaggaatttattttaatttaattttaattattaaattaaaaagatatgatgaattattaattaaatatttttttagaaaattttcccaaaaaatcgcagaatacttttgaaagtttctatttcttgaaattttcttattaaaaaatttcttaacatttttttgaaaatttgttaagtttgaaagtttaaaaaattttcggggtagggatgaagcaaacgcatttttttattgaattaaattttacttctttgagcttcaaatgtttaaaaattaaaaaaaaaaattttaatttaagttggatgccacggaagtaacggcagcgatgaacggactgaagcaggtcatcgttttcaaaaaaactaaaactaattttatattaaaattttagccggatgctgtgctcgcctctggacttcgtttcgaaggagaaaagttagaaaaagcgcaaaatttggcgtcggacaatgggcgccaacttagactttttttataagataattaaatcgataacaaattttcaaagaaaaattttgttttaattaggcgcgcttcagttcgaatgagaaaagttcgacaaaaaggctccaaacatttggcgccggacaaatgggcgcaaagcgccagcttagcctttgtgctttttttcaaaa

SEQ ID NO: 53202 - DNA, 372 bp, Heterodera glycines
  Genomic contig location: Contig_ID=SeqID_457; Location=2162..2533; Strand=-
  SCN-specific regions: Sequence locations=1-192,214-242,264-372
atgcaccagtctctgccattgtttctgccgcttttcatcttcttcgtctacacgaccgattgtctcaacggtatgaaattttgatttaaaaatttgtgaaaaaccttggacaagaaaaaaaatcggaatatcgctttttgtcgttgtatagggacagttaccgtaattgctaaaatgtttttagcaattattaattaattaaattgaaaggtctgaactgccaacaaggagcagaaatcaagccaaatggtcaaaaatttaacaacacggatccaaagtgcccacaaaagggcgcgaagtattgtgtgacaagcatctgcacaaccggtcagccggcacggcccatcaaatggggcggggaataataataaa

SEQ ID NO: 53203 - DNA, 1309 bp, Heterodera glycines
  Genomic contig location: Contig_ID=SeqID_457; Location=2840..4148; Strand=-
  SCN-specific regions: Sequence locations=1-372,394-591,619-1051,1103 -1154,1180-1188,1214-1216,1238-1245,1268-1309
atggctaacccaattgcaaccaaaaaacaaaaagtaaaattgtcttacgaaggccacctttacactttgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatgcgtcacgtgttgatgctcaaatggtcacgaccgcaatcaaaaggcgcgcaattgccaccttcgaaccgccttctgtcatcagagcagaagcgcttcaaaatgtcccgtctccgtcggcaattttggtgtcaaaacaagcagcaaaagatgtgaaaacaaaatatttttcatataataaaaacaattccaatttagttaatcaaaagagctcgccgagaagtgaatgcccccccccgtcgttcctgcaaatcttgagcagcttataatcagcccggcgtatcagacgtacacaccgacggacggcatcgatgaacagttcctgttaggagacagcggcgtatattatgaacgaggaaatgagaacccacagaggtaaaatgacaattattttcttatttttcttttgttatagaattttgttgttcggacgcgagtcatttggccggtgggcagatcgaatggaagcttgcttcggtgacgggaccttttcattggcgccgccacttttttatcaaatttatacaagagcatcatcgtttacagggcgccttcaattgccgacacccgtcgatttttcacttcattgacgtgctacgtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttcatttttctgtacttggggcccaaacgaccctggggcccaaaaacgagggcccaaacgcgggggcccaaacgcgggggcccaaaaactggggcccaaacgcccccgactcacatatgtaatatgtagaaaaatccgaaaatatgtaaataaa

SEQ ID NO: 53204 - DNA, 377 bp, Heterodera glycines
  Genomic contig location: Contig_ID=SeqID_457; Location=3783..4159; Strand=+
  SCN-specific regions: Sequence locations=1-377
ttttcacatcttttgctgcttgttttgacaccaaaattgccgacggagacgggacattttgaagcgcttctgctctgatgacagaaggcggttcgaaggtggcaattgcgcgccttttgattgcggtcgtgaccatttgagcatcaacacgtgacgcatctgctggacatgtgtgcggagttgcgaggcgaatgaattggtcgtggaggtccgtccagattcggccgttgcatttgtcggtgctgtttttgaactcgcatctccaaaattttgtcatcccatcagaactcattttagcaaagtgtaaaggtggccttcgtaagacaattttactttttgttttttggttgcaattgggttagccatttctgaaaaat

SEQ ID NO: 53205 - DNA, 686 bp, Heterodera glycines
  Genomic contig location: Contig_ID=SeqID_457; Location=4781..5466; Strand=-
  SCN-specific regions: Sequence locations=1-80,103-207,380-538,560 -582,609-686
  Gene Ontology: Mol. function=structural molecule activity; Cellular component=cytoskeleton; Biological process=spermatogenesis
atgacttctcactttctcgtcggcgctgcagccttcggggcgggaatcgtaagtttttttttgttgtttttcggtccaaattttacatctcaaacaaaattttttcaaattttcagtgcttcgcgaagacgtacatggagaaaccgaagagcgaagacgacaaagaagcgcccaagaaggaagaagccacgaccggcggcgacgcagaggagaaggcaaagaagaaggacaagaaaggcgacggcgcagctgcggcggacaagaaggaggagaagcgcaaggacaaacacaaatcaaaggaggggaagagcgacgacagcaaccgccgttccaagaaggacaagcacgggaagaaggacaaaaaggacaagaagaaggacgccgccgagccagccgctaacgccggagaacagagcacagcggagacgacccaagcggacgaatagccagcgatgagaacgacgacggtgcacgacctcacccttcacgatcagtcccccctactgcttgctgttgtttgtgtgaagtccgttccccatattttgtacatattccatgtgatcagcgaccttcctaatgtgatcaaaatatgtatgtatgtgtaatatccattaatgtgctgcttcatattcgttatttgtgtgtttgtacagtgtttgtattcattgttcaatgtgtgtaataaa

SEQ ID NO: 53206 - DNA, 1565 bp, Heterodera glycines
  Genomic contig location: Contig_ID=SeqID_459; Location=383..1947; Strand=-
  SCN-specific regions: Sequence locations=1-396,420-657,679-736,787 -1419,1441-1565
atgggcgacttacagtcagagaaaggaggaaaaactggcaaaagacaaaaggtaagaaaatgctaaatgaaaagaaaacctatcagcagatcacccttccatgtgcttatgaattacttttcgataagttcgccgtgtggcgaatttgtttatttcgttataaaattacaatttaatcaaattcgttaatatttaattatttgcattttctatttctctgtcgtagtgattgatttcccatttgatcagtgatgactaataatgagaatttgtcggtgatagtgatatcaatggttggtgatcagttgctcaatcagtgatcactggagattacaaaaaaaaaccccaaaaatcacacgcaaatcaaattgcaaatgtttcgatggaatcggtttccgtttctctctttctttcttttcgtcactttttcctccccccccccggcattttcggcggatttcctccgccggtggtcattttgccctcaaggcaatttcccagaggtgtcaattgtccgccagcgattggaaggattagtgactgatttcattgtgatgctttcatcaatttttcctcatgcaagtttttttctgacattttgtttattttcaattttattctcattttttagaaaatcattcaaattgtttaagacataaaaaagatattttatgagaagggcgatgttttcggacctaaaatctgccaaagtaagtaggatttaaatggaaatttgattttttaaaatataatttttgataattttaaatgaattttttaatttttgaaaacatccattttaggggagtgttttttacttttgaaaagttttttatatcctgtatttagctttctatcgcttatctttttctatttattttattcactttgtctaattaaaaagacggaaaaattaggcgaagacggaggattatggtaacgaattggcggtgtgaaactgaggagggttatggtaacgaaggcgggacgaagacgcagggttatggtaattaacggagagtgggcgtaggattaagtgtaataatccgtcattggggaggggcggggggtgggcatggatcagcaaatcctttaatttggtcccaaaagcattagcaatggcgacgaatgggtggcacaacgaaaacaaccaattattaggaggaagtgaacagaatcgggcaactgaatgccatgccatttgttagcctcaaacggcgcttttccattttcttggcaaataatcgcaaaatttccttctctctctctgttttttcggctttcttttctttttcttcgccaattgacttgttttttcgcaacttcggttatttctcttctcatagtgaaaatggacgaaaccctcaactcataaaatgtgaaaaaccgaaattatctgaaatccatcccagtacgagttgggtttttactgatgaaaatgagtaaaagtggagagaaaatgcatacaaatttgctattttaaatcacttataaaagcagtgatttatgtattccatccgaaaatggacgaatgcgcatgaattggcatgagatggacaaataaa

SEQ ID NO: 53207 - DNA, 654 bp, Heterodera glycines
  Genomic contig location: Contig_ID=SeqID_460; Location=404..1057; Strand=+
  SCN-specific regions: Sequence locations=1-89,113-605,642-654
atgcgcgaggcattggcgacgcggattcagctgcctgaaagtcgcattcaggtgggaatgggactgaatcagcagatagtctcaatgttcaggtctggttcaagaacagacgtgccaaatttcggtgtgccattcccaagaaatcgaatagcaatcgaattgtttagtgccaataaaaaaagcgaggaaattgcgcacaaaattcatcagttggcatcggcgaagttcccctcgggcaatgccaatgattcgccgcccccggccgaaccgacggtggccaaaaatgagtcgctgaagagggcacagatggaaacagcaataacattgagcaccgcctcgggggaacagccggcatcggaagcggaggaagcgaaaatggcggagccaacagcggacgatttcggcacaatgttcgccccttccgcactcaaattggagcctcaaactacccatgccatcgcctcagcctccctccccgtttcggtggacagaacaacgatggcatctactctttgggatggcaatggactggcagcggtggagtcgacgaatcatttaacgacgggcggagcaaacggaacggcgatggattggttggcagcggcacaatggcacaaacaacagcagcagcagaatactcaataccagctctcg

SEQ ID NO: 53208 - DNA, 726 bp, Heterodera glycines
  Genomic contig location: Contig_ID=SeqID_4106; Location=1133..1858; Strand=+
  SCN-specific regions: Sequence locations=1-127,156-726
atgccgtttgatccggatcgctacggatgttggagaaatgtgacgaagccttgctcgtgtccctgttcgaaactgcgtgccatcaaattctgccgagtaaattcaaaattttaattgtcaaagatgcttaattggcattcattttccttttggcatctgtccgtccgttttatcttcgcttttgtttttcagattgagtgcgatttcatggaccgtgaagccaaggagtggggcaatgccggtcgcgtggctgcgggcgttggctcgctcggcctggcgtttattcctattgtcggcccatttcttgcagtcggcgcaattgctgctcaagcaaaaaattggggcgaaggtggatgctgttgcttttatcaataaatttattattaattaggacaattaaaatgttttagagtaatcaatgcaaaaagaagcgaaacttagcatcccaacttattttcagacatgactcacaccgcgctggaagtacacttcaaatgcgagcagtgtggccaaattgcgtacaaaacttatgaaattttgcgcgaaaatatcacgagcaaccgatggggacgctacacgaacacttatgggggcgagcaaatctgtggaattgacaccacggcatttgatgaaattgagcaagtgttccgtggcatgcccaaggcgtacaacttcgcctacaacaattgcaaggattggacgagcgaaatgaccagacgtctttag

SEQ ID NO: 53209 - DNA, 1188 bp, Heterodera glycines
  Genomic contig location: Contig_ID=SeqID_4106; Location=2305..3492; Strand=-
  SCN-specific regions: Sequence locations=1-25,48-62,91-158,181 -297,320-331,353-364,386-1077,1101-1111,1133-1136,1159-1188
atgggccggacggaccctcttcgtttgcaaaaatttgggtttattaagatcagtttgcaacgattttttcttaaaaaaattatataaaaacgaaagtagtgaggaaaatgccaaaagagtgaccaaaagtccgaaatagtgacaaatggtgacataattttcagcctttaggggtgtaaataagaaaagcttaaaatctatagaagtttttctattattctgaactaaaggcaatagactaaaagttttttcatgaaaataatcgaaaaatttgtcatttttcgtcttaatgtcagtttttgtgttattcttgtatttttatgttcccgagactttttaaaaaatgacaaaaacttgttttaggggtgtatttttcaattttcttgtatttttcatacaaatttttctcaaaaatgccaaaatatatgcgaaatatgtgccaaaccccgaaatatgtgcgatatgtttttatttgccaaaatgccaaaataagtgtttctatgtttttaagtcgctctaaatcgaaaattgggacagggtctggattatttgttgacgaaaataaaaaggttagcaaattttaggcacttttaaaaaaccatgggccggcccccctgtggtttgcaaaaatttgtgtcatattaagtcgtgaataattcgttgtttttcagatttctgatcacgaaagttgacatcaatttgaaccaatccctgaccgaactcgaacaagccgaaaatttaattttgaggacttgaaattagtcgaaatagaagtccgaatttttgtattcaccgaccataaacccatgcgaacgaattttttacgacttattgctgcgacaaaaagttttttggaaatagggccgtaccatttatgatgtatttttttaaaccaatttctttagctgaaaatatcagcatttgctcgaaatttcttttaatttttctaaagaattatcggggcaaaacgcataacttattttaatgaaaaattgaaatgggagatcaacagcaaaagggtaagggaaaagagcaatgcttactgtaccaaccgtaacatggttactgtcaaattagttttttcttttcttcaaattgtttattgtggtttaaatgaacaaaaacaacagaacagaataggcataaaattaaagagttagacggtcaaatatgaattttaataataaa

SEQ ID NO: 53210 - DNA, 1665 bp, Heterodera glycines
  misc_feature (17)..(17): n is a, c, g, or t
  misc_feature (42)..(42): n is a, c, g, or t
  misc_feature (64)..(64): n is a, c, g, or t
  Genomic contig location: Contig_ID=SeqID_22538; Location=1..1665; Strand=-
  SCN-specific regions: Sequence locations=1-539,561-1074,1096 -1279,1304-1665
caaataagaaatatcantcccgtaaagaaataaaatactatnccgtgataagaccagattattntcgtatcttagaaaatactttaaaccattagaagatccgccagttatacaatacaatacttcttttatttctgattcaatttctaaagcggaaatttttgcaaaatttttttctgaaaattatattgttaataattattctcttgattttgataattcttgttcttcttcaacaataaacgacgtagaatttaacattgtttctgttggtaaagtacttagaaccttacctaacagaaataacacatcaccggacggtattacctttagactcttaaaaaattgttttctttcgtttactccttttgttactgaaattttcagactctcccttgatacaggaaaacttcccactatatggaaacaatcgattattatccccctgcataaacaaggggacaaaagtaaccctatgaattataggccaattgccttaacttgttcattatgtaaaattatggaaaaatttatttgttggactatttctgattttctgttaaagaacaatttattcttggaacaccaatttggatttataaggggtagatcaaccacaacacaactaatttcaacccttgaaaattggtatgatggtatttataataataagaatatcgattgtgtctatatagattttaggaaagcatttgacgtaatcccccataatttacttttatataaggttcataaaattggtattaggggtaaaatcctaaattggatatctgactttctttcaagccgtacctttagggttcgggttgatagtactctctcttctgaatataaaatgagctctggcgttccccagggttctgttcttgggccacttttgtttttgatatatattaatgatttacctgaattaattcctaaacaaatttctataaaattatatgcagacgatgtcaaattatattctgtacataaaacaaaaaatgatagaattgttatgcaccacgctttaaatattctctctgattggtataagaaatggtatattaaaatttctattaatataacttttatcatttacttcggaaaaaataaccccagagaacaatataaaaataatgataatgcaatttgtgaagttgaaactattcgtgatttaggaattcttattgacaataaatttactttctctgaatacataagcaaaattacccgtaacgcctactaccgtatgcgtttacttttccgtgttattaaatcaaagaaaattgcaatttggaaaaatatttatgatagttatatacgttcacttcttgaatatacccctgaatcttggaatccgcaactaaaatcgcatattatcaaaattgaaaaatgtcaaaaatatttcactcgaatcgctttcagaaaatgttgtcttccaaatattccctatgaccaacggcttcggttttttaaattagctactcttgaaaaacgaagaaaaatttttgacctcctaactacttataaaattttacatggttttacacatttggaccataacctaaatactcgaaataagtcatttttccgtttaaatgttaaattacaatctaaaaaatctaatgaatcttttgtaaacagatcagtcaaggcctggaatgc

SEQ ID NO: 53211 - DNA, 207 bp, Heterodera glycines
  Genomic contig location: Contig_ID=SeqID_22542; Location=624..830; Strand=-
  SCN-specific regions: Sequence locations=1-96,162-207
aatttgggtgaacgtggcgatcgcctcaactcaactgttgatgccactgaacagctgcggaacaatgcgcaggcaattcagtcccgatcggccaagtaaaaataatttaaaaattaatttatttttcctattttatttaaatttatttattattattattacagattattggaaaagtatgaaaggcggaaatggtatcagctgtga

SEQ ID NO: 53212 - DNA, 1396 bp, Heterodera glycines
  misc_feature (746)..(746): n is a, c, g, or t
  Genomic contig location: Contig_ID=SeqID_22543; Location=820..2215; Strand=-
  SCN-specific regions: Sequence locations=1-221,248-433,457-502,532 -612,635-642,686-706,728-827,849-1136,1158-1198,1220-1231,1269 -1319,1341-1396
atgatgcaacaaattcgggacaagccgaaactcagacacgtaagtttgaaaataaactattttttcaaatattttgctgtgaaaaaaaattatattgaaaaatgggtaatactggcgatggtactcctcaaccaatttttttttagatagtgcctccgtgggcttctcctccaccggctactccgtcgatgcctttcccaccaatgccagcgttgccgccatcaaccagcagcagcagcagtcggacaacgaattttgacaatccgctgttggtgcagctgcggaacagaattccactgggaccggtgagttttgtgaaaattgcaatcctaatcattttaaatacctacattaattacacaatgcctgattgtgagcatcatcaacaatcgaattttcagattctcgaaaatgacgcgggaagaggcgaagttggagggaccgcagacgaagtggcgaaaggggtgaataaacgtcgcgtgcaaatgaattacaatgaaggtattttagaaaaaaaaaatttttttttttgatcctacattagatgacacatcctcgaactccaggaacacgacattcgaattggaattggaagatgaatgattttttaaacctgattaaatttttgttgtacccccggttctgtgaattttgcattttttacaacctgttttaatttagtgtaccccgtccccccccctctgtgaatttatagattaaatttttagttcactttaattttgcancggggtgggtaatgattgccatggacataacgggaaaaactcgtaaaatttgcaaggacacatacaatgttttaatatataatgagatttgtaatggaaaatgccggacttgcatagcgaaagaggaagatatatcatatcatgatcactgatctaaatttttacctgaatgattgggaatcatacagtacccgcaaagttttgtatgttgaatgccactcatagtttttgaatttgcgcaaatcaacaaaacgccaaacggaatgatggctgcgctgtaaaaataactctggggctcaaatggcatacgcgagcatttaaatggcacacacgcgggcgctcaggtggcatgcgtcccttcccttccctataaggcatgacagctgacgtcctccctctgcctccctttccttctctaataggatttggcgttgggttttatccttcagatgttttttcaattatttacctcttctgggattggatatatttattataggtgttttttaaaggtttaaatttggtactgaaacgtccctttccattgggactgaaatggcggggctgaaaattaagggccaaaatcttggggggtaactactggaatggcaaggaaaagcgcttatattaaacaaatcattgttaataaa

SEQ ID NO: 53213 - DNA, 917 bp, Heterodera glycines
  Genomic contig location: Contig_ID=SeqID_22544; Location=666..1582; Strand=+
  SCN-specific regions: Sequence locations=1-186,208-259,281-443,465 -560,588-723,749-917
atgccgtgcctgaaggacgggcgactgttcgaattccatcgcagatggacgcccttcgagggttgcgaaagcgatgcgatcggaaagaggcgacaaaatgtgcgaatcggtgcaacgggcgacctcaatttgtaagagctgtctgtctaattgggtgtttcagctgatacggtcaatttgatcactttccttttgtctgatcactttaagttttgatcactctcatttggtctgatcactttgattttgtctgatctgtctcatccctcccacctgctcattctctttgcttattggcacttccttcgtcctttgatacactttttcacattcggtcgaataaaattgcatcggtgtccaagttcgacccctatttgccgatttgaaaatggccaatgaatcggccaaacggccgcaaaaatgcagcgatacataagtgatcttaatgacatcattaattacacaacgaaacttaggaaaattaatcacttcaaattttttgcccaatgacaaagtcaacgaaacattgtggggaaatgcggtggtcggttcgctgacccaacaagtcaaattgttggcattgttcagatcagtgagcagtgccgccggatgggccaattgggccaccgatgggtcgcacaattcgcacttttcccggagaaggccttcagcggagtttgccaacacacagaaactgaaacgaaagtcggggaaggcatgaaagaggaggagaaggaggaggaggagggcagattagacgatgatcagactgatcggaccaaatggaaaaaaccaaacgaagtgccaaattatgggagtccaatggccaacgttatggattatgcaaatacggcgaatggagccaattttgatgagaaattggagaacaatttgagggcccgtaccaaaagaacgag

SEQ ID NO: 53214 - DNA, 292 bp, Heterodera glycines
  Genomic contig location: Contig_ID=SeqID_22545; Location=1045..1336; Strand=+
  SCN-specific regions: Sequence locations=1-35,72-195,218-292
atgggaaattttttttctacgggaattgctgaacgtaattttacaaaatttttaatttttctaatatttttctacctaaagctgacgttgaacagccgtttggaccagaccagcggccgagtgcgccggtcgtgtgtgtgtgtcgtcgtgtgatgacttgggcatggaatgaacgagtaaccatgctgctgctgttcattctgctcgtactgatgtgccagttcgttttttggaacatcaccatttgagatttttttgaatttttaaatgattcgatgctttcaatttgata

SEQ ID NO: 53215 - DNA, 1031 bp, Heterodera glycines
  Genomic contig location: Contig_ID=SeqID_22547; Location=84..1114; Strand=-
  SCN-specific regions: Sequence locations=1-113,157-165,187-311,350 -486,517-561,648-779,801-861,884-1031
atgtcggcttcatcgtcactttttttggttgttgttttggcatgtttggcgatgtctgcaaacagtgagtaattagcagcagcagagagttgattggattgaggaataatccgtcttgtgttttttgttgttataaatacatattttaaaaagaaattaaatcgttttttaggaaaaaagttcaaattgtaagtgtctttagtacaaaaacaatctttggaaaattatggcaaaataaacggtacaaaaaataatttgttttttttgctataacttaagttttttttattttaaatgcttattcttagtagctttaataaagattcttttttggaaaaaatggcattttgaaatctcttatgcagtaattaccctaatttagcactgaagtgttggtttggcaatgatgtgtttggcaaagtagaacaccagtgcaagcctggcactgtcttctgctcaaaggctaactgcctgaggaaatgtaccatttaattatttttttttttcaaaaattaagtgccggtggagaaaaaatagcatttgtaacaaattttgaccaagaattaaacaaaattttataaattatatagaagtttatcataaaactttaataaaaagtttttttttaaatgtttatcttttaaaaagattttactggatttatttgtgtgctgctcaaaagtctcggtctcgacaaaaaaacaaggattatttttggtctcggtgttaattataaatttcagtctcgagctttgggaaattctttggtctcgagcagcaaaaaaaaatttttttttaaaccatcttttatttatggaagcgagatttaatttacatttccaatttaggtatttgcgcatataaaaaggaaaattttcagatgacaatatccgagtcattggaatgggttgtgaacccaacagctcagtttgtgaccttgcctactttgacaataaattcatcaaatgcgaaaatattcaatgctgccgcgacgacttttgcaacggagtgcccgatcgtgtggaccccgg

SEQ ID NO: 53216 - DNA, 1351 bp, Heterodera glycines
  Genomic contig location: Contig_ID=SeqID_22548; Location=263..1613; Strand=+
  SCN-specific regions: Sequence locations=1-389,418-1351
atgtctgacaatccaaaggaagcggagaaacaaatggaaaaagcgatgtaataattcaaatttggattgtccatgctaattaatcattttgcttctttttcagctttatctctgccgactgttggctcaaagtgttcgatttgcttccacgctctcaacttggctgtggcattgcgatggttagccgccgttttgactgtttcgtcgacgaacacttcaaaacgcgcaaatggaaattgggcgacatgattattgaaggcaaaattggactgaatggcgcaaaaggaatgaaaattgtgcaaattgccaatctcggtggaaaagaattgccaatcccacaagttccgttgccgaacaaagtcatcggattcggacgcatttcgatcaagtaaaaaatgaatttaaaattttttaaatgttttgtgaccgtcaacacttgctaattacatttcagcttcatcgaccaaaatgtgctcactttccttcgccgttttgaccgctttttcgcttcatgtacaacaatctttgacatttacgttgaaaatgttcgcatttcggagttcgttctgcgcaacatttggccgatgctcaaggacaccgttctttatgtgcaaacggaggccatcgtttttcgtcaaatgcgtcaattgggcctgtcaacgctcaacgattatccatcacttcgaattttgtcgttgaccgagattttccccaaatttccgcccgacgacagtgccaatgcgtcggatggccaagtggtgaccaaatggctgttctcgcctcgtcccgacaatttgccgaaggtgttcacatgcattgtggattcgccggagatggcatcagtgggccaatggttggcaacaatggaacaaatcaaaacggtgattactcaatttaattcgtctttttcctttttatggtcaaattgaaattacctctttttatcattcgattactctcggtctgtaaagcacgaaaatgaaaacgaatttttggcggaaagcattttgtactttgttatgggcccggaatttactttttttttactcttttcaggcattttccatcgcttcttctcctgtcaatttcggcttctctgttttccttccgccgtccgatccgcctttgaccgttcagccctttgatctgactaacgaattgactggggagaaattgacattgttagaagaagacgacgatgctcttgtggtcctccgttgtccaacagcaagcgatgtgctcaaatggagaaagacggctcatcatggaatgaatgatcgacagaaccaatcggtctcgatgatcacaggagacgttttcgactaaaggagaacaacaattaatatgataa

SEQ ID NO: 53217 - DNA, 1051 bp, Heterodera glycines
  Genomic contig location: Contig_ID=SeqID_4108; Location=314..1364; Strand=-
  SCN-specific regions: Sequence locations=1-174,206-351,394-448,471 -660,689-897,933-1051
atggccaaggatttggctgaacaatttgatgcattccgatcgctgtgcaaaatgatcagggcgactggagagatcggtggtattttttgtgaaaacgcctctaaaaaattagaaaaaattaacatttattgcttttaattccatcaagtaaaatattagaaacaaatttggaagtaattaaataataaaacttattaataaaaatgactttcataataattttaggtcaattgaagcaattatttattttaatgtcgcaatagaatatttttgttaatcgcataccaatatattttttgaattatttgcaatattttttcaatatttttcgtatttttgaatagtctttaaatagctgaaaaatatgcaaaattttcttaaattcttttaaaatttctcatttttctccataaatgcgtctaagttcttttttacttaaatcactaaatatcaatttaaattatttataactttgctcaaaagcaaccaaatttttaattcttggtatcattcgatagccctaagtgttctctatcagtctacaaaatttcaaaaaaaattcatcaagtttcaaaagagttagggccaaagatgctcgaaaaatgctcgacaaacaaggtttttgagttcctctagccataacttttttgaaacttagcgaaattttttttaattttttagatttatagagaacactaagggctacgaataatatcaaaaattaaaaatttgcttgcttttgagctaagttataaataatttttaatcaaatcatattgatgatttcttaaataatgactccgccgcccaaaagttttttttttgaaaaaagcgcgcagaatgataagaaaagcaaaaaaaaaagtcataggcttacatggccggaactccttagcaaagaaaaattagaaaattttttgcttttaaatggcggtccgcgaccgcgggatttttctgcagacgctccacccttggcattgtccatcggagtttttttccttatatttatatttttcacaatttggtgtcatgataaatactcatcaataaa

SEQ ID NO: 53218 - DNA, 591 bp, Heterodera glycines
  Genomic contig location: Contig_ID=SeqID_4108; Location=1817..2407; Strand=+
  SCN-specific regions: Sequence locations=1-56,171-325,369-482,504 -535,557-591
atgtcatcatcgagcggatccccagattcttttttccgttcagaaattaatcaaggtaataaatatatagaaaaaaattcaaaaaagaattacgaaaaatagaaatgattaaattttattgaaaaataaaatactaatttaaattttatcaccaccagcagaagcagaagaagtgggcaaatatgaagtgttaagttggcacggactttggggtgatcaattgtcagctgaattgttcgtcactgatcagcagctgctgaaggtgagccatctcaaaacgtacaaagagaggtcgcccggttccatgccggacttacggaatgtgccaaaaaccgaaaacaattttgcaaaatttagttcaacatttcaaattcgtttaaagttttttaaattaagcaataacataaaattaataggagaaagtgccggccgtttcatagcgcaatttttgatggcattttgccaaaaacctttcaataaacggacataaaatttaaaaacttccaaattcttaattaacatttagctgaccgtttaacaaatgcaattaaatttcagtttttgttggtcaattggagacatttttggtag

SEQ ID NO: 53219 - DNA, 916 bp, Heterodera glycines
  Genomic contig location: Contig_ID=SeqID_4109; Location=443..1358; Strand=+
  SCN-specific regions: Sequence locations=1-180,202-231,296-607,754 -793,845-916
atgtcctatgtattacgattaatagatttgactcgttatatacgcgtttattgccatcttgggcccatgtcatccggcagtcagcgtctatggtgtaagtctcatagccagcacatgtccaattctccgtttcatcaattgtaagaactgtttaaataataacaatgccaggtttccatataaacattttttcattttcaagcacatagaaatttttgagcacaagggttgttaaatttattaaattttaatgatttatataacattttatatatttatgttgttttatttttttgaaatccctccctctggtgcccaaacttcccggtgcccaaacttcatgtcgccgtttctttggccactcgacagatctttttgacgaaaaatggccgacgaattggtgggccaaacaaaattaaaaaaagcaaataatttaaatttccatttgtcagatgacactcttttttcactacaactcccgtcaattctctgtttccatgcgtttctttgtggactggcgacaaaattgaggccaattttgggccaagtttcaaatttaatttggctactctttgaagaaagtcgaagaaacaacggaaaagggcgattaatcattcattaattaattctttttttcattgttttatttttaatttcactttattttcaattttttatcttattttgtcatgcgtatttgttaacgaatattaatttactgttttattttgctaatttatttattatttgttttcctttttcgtgtaaagatttacttaaaagggaccacagaagcaaatattgaagctgaagaaatagcaatttcaagaaattccccaaaaggtttttaacaaaatacaaagtcgtaggaatatgaaattaaatttaagacaaaataatttcattttcttacaaa

SEQ ID NO: 53220 - DNA, 2248 bp, Heterodera glycines
  Genomic contig location: Contig_ID=SeqID_4109; Location=3373..5620; Strand=-
  SCN-specific regions: Sequence locations=1-124,156-250,272-657,680 -1103,1132-1329,1355-1663,1698-1718,1740-1763,1927-1965,2011-2248
  Gene Ontology: Mol. function=poly(A) binding; Cellular component =nucleoplasm; Biological process=regulation of transcription from Pol II promoter
atgaattattctattttaaaaaagattgccctgatcatcggatcaacacgggatcaggtcttgttggaagcgagaaacgaagtgcagcggctgctggaaccgttgaagaataagatggagacggtaaattttttcattttcattatatatttttaacccaatttatcaacaaaaaaaaaatgaaaaatagagtcatggtcatatatttaaaaatctttaatttttgaaatttcaatcggttaaaaggtagaatttttgaagcattttttgtgggctttttaatgatatcactcattgacgaaaacattcgtgattggaagtggtaccggcaagaaccaattataccccattttcgggtggtcatatgattataaccaaaggttttatttgctttaactcaatagggttgggaaattttttttgcaaaaatcattatgtccatctgaaaatctacaatatgaaaaagaccgaaagtcgttgcaacttatacctgctgaggtataggcatttcaatttcgatgtccacaaaaagtactgtattgccgaaatgatcaacacccttatcaaagtgctcatacctcaacgggtataagtcgtaacgactagaaatcagttgcatattattgagaattttgtgctcactccaatgggcctactcaaaattttaaaaaattcccatccctataggaatttttttcaaaaatttcccagattttcagtgttttttagggtgtccctatcaccatgaagaactggtctgatcaagttaatatgaaaaacacttttgataaacatcaatgttacgttcacatgaatttttttcagatttttctgtgctctaaaaagcgagattcaaaaactggtttaacatataccacccgaaaatggggtgtggtacacaagtaaaatgtaatttgggattaaccggtatatggcttaatgatggtttcattggacaaccctataaaaatgttacaaaaaaatgcaacggtatatgcttatcaaagagctataaaattccaaactaatttggttattttttcagctgattaaaaagttgttcatcaaaagaacgatggacagaactgatgtttttgggtaagtttatttcaaatatataatttaaaaaaacacaacaaaaaaattgtgagtaaaaaatacaggaattttaatgcaccataacttattttagaagcatccaatagaaaaaatgtgtagaaaacgaattttttgaaattttctgaaacactacaaattttgccataatttttttttacttgccaatccaaacattcttgctatttcttcgaaagctttatgtttagggaatttagaaatacaagaaaagagcaaataaaatacagcgaaaaccgaaatccataatttttcgcgtatattcaagaaattttttgtctgttacctttatcccagatttttgctagacaaaacttctgtagacttcaagctttcgaaaataccaagaatgcataaattgaccacgagaaaaaagttacggtttaagaaacatgttgatcactgactgtacgcgttaacagaaatagagcctaaaaagaccttattatttcatgttaagtgttatgaacacgttgccaatgtccgaaaaaagcggagacaaggaaggcgatgatgtgctgcgttatgatgcggatgcggaagaggatgaaaatgatgaggaacctgatcagcaggaagatggacagcagggacaacagcacgagggacaacaacagggacaacagatggaagaagatgaggtagaagatgaggagtatgaggatgatgatgaaacggacgaggaagaaactgaggaagggggagatgaggatgatgatgaaacggacgaggaagaaactaaggaaggggaagcagaagaaatggaagatgatgaagttgagtaagaggaagtgatggaatatgctgatgaattaattgtttaaagccggctttattttttttgaaaatatatttatacattttaatttttaaatagattttctaattttcgatgcaaaactcatccgaacaaatccataataattagaagcaggattttgaggcatatgcctttctttttgctagcttgctacggcctaatatggacgaaaaacgagtttttaactaggtttaaagctttagctagaactttttggtgccttttcttgcgattttggtgccttatgccgggcacgtaattttggtactttttttgccgtttgtttaaaataaa

SEQ ID NO: 53221 - DNA, 1471 bp, Heterodera glycines
  Genomic contig location: Contig_ID=SeqID_4109; Location=6769..8239; Strand=+
  SCN-specific regions: Sequence locations=1-17,39-170,194-285,307 -387,410-477,499-559,581-1123,1145-1272,1294-1471
atgccgaacttcaactgcctggagcggcccctctcccaactgttctaccggtacgggtgcttcatcacgcgcactccgttcccgctggtggtcaccccgctgctgatcaccattttctccgtatggggcttcatgtcactgaattccatcacaggcaatagcaaaattcgttttttaaataaaaaaataaaatcccatcgcttttcattaatcagtaatttgagaggcatccggtttttttttaattttttcttatttggttttcttaattttttaccgctatggttttgatttgttttgccagaaaaccttggtgaagcttaaaacctttaagcatagacaatggcgggcaatggcaattgaaaatttagttttatgatccctaaaaaatccaatttctccccaatttttatgcattttaaattctattgaaaaaaactttcgttcgactcaattttcttaatttttttccatctcaatatttacttcctcttttaagacgccatttatttgttcacgccgcagaacgcgccctccaaaatggagcgccaggtcatccacgacctgtggccgttggtcaacggcagttacatcccgggccgggccgtcacacagtcgcgggaagtccaggttgttgtcggatgagggcagatggcttatcatgatgcttttgattaggggtggcgtgggatgctatgggttacctaccactcggggggcggggggaatgattttggtagttcgatttaccattagatattggacacacaaaaatggtggcggactttttaagacgcggaccgcgaaaaagtgacgcgcaaacgcgtcccgcccctggccaattgtgcgtgtgtccaaaattggtccaaattcacaaattgggttaaatcccgaatttaactcatttcctggctcactttttcataaatttccgtttcatagatcactgtaagtgcgcgtgagcgaggcgcaaacatccttgaaaagccctactccgaggcggtgcatgtgttggacgaaatcatacaggttttttgttgcaattttgggcggtggagtggtcctagtcaactcctttcataattgtaagaaagaaaataacgaaacaaatttcgcgtaatttccaaatttttcccattttcccggcagcgcctgtgtctgggcgcagccaattcaatttggcgccagcccagttcaagcgttcactattgtttataaaatttcgagagattttaaacaaaaaaagttattgccaaatattctataaaattagatttttgaagcaaatttattaaaattttgcaggattatagacaacattcggataaaactattgaatgatatcaaattgattcaaattagtacaactctgaaggagttctacacaaaaaaagaaagccgggttggtgccacacgtaaccggaaacggaatttgactccatgtgcttatacaattttacacagaaattga

SEQ ID NO: 53222 - DNA, 810 bp, Heterodera glycines
  Genomic contig location: Contig_ID=SeqID_22552; Location=91..900; Strand=-
  SCN-specific regions: Sequence locations=1-352,374-461,483-730,752-810
atgaaagatgaagaggaatatcaaaacaatcgtgttcggcttttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagaatattgttgaaaatattaattttgttgcgttgttaaaaattagtatatgtttgtttcgcttatgtcaaaatagggggggggggcggcgcaagtgtctgcggcgcaagtgtcgcggcgcaagtgtcggcggcgcaagtgtcactttggctgggcggcgcaagtgtctgcggcgcaactgtcgcggcgcaagtgtcactttggctgggcggcgcaagtgtctgcggcgcaagtgtcggcggcgcaagtgtcactttggctgggcggcgcaagtgtctgcggcgcaaatgtcacatcacccaattccacaccattgcccttaagccaaactgtattataattagggcgttgaattcgttgtgtgaatgcgccctcgacatttgaattcgccgtgctgatgttcacagcgccaaaattttacgtcaccatcggcgttcaacaaatggaagacatacaggcagccttcatgttcgagtttttttattttttcgttgagatttaatttcagcattttccattttcgcaaggctaaaaaattaatggtactttaaactgttaggtaagtatatactaataaa

SEQ ID NO: 53223 - DNA, 393 bp, Heterodera glycines
  Genomic contig location: Contig_ID=SeqID_22553; Location=718..1110; Strand=-
  SCN-specific regions: Sequence locations=1-22,44-337,359-371
atgccgccaagacgagatcgatcaagggaaagaaaggggaaggcgaggcagggacgacatcgatcacggtcaaactcgcagacgcgtttgagtaagccaaatctggctggaagcccaggcccgtttaatcagatgggctgggctaatttggagattttttttgttcctccaattttttgtttacaatacgatttgcaaaagttatgcgtcgggggggggggggggaatatgcctttttaggtaatttaaaactaatgaaaagtgagcaattcagaaaattttggtcatatttttgaaaaaaaattccaaaatggcggttatccgaaagcgaattatcttataaaaaataatttttttaggtaaattattgtgaaaatgaaataatttaataaa

SEQ ID NO: 53224 - DNA, 853 bp, Heterodera glycines
  Genomic contig location: Contig_ID=SeqID_22554; Location=122..974; Strand=-
  SCN-specific regions: Sequence locations=1-81,103-175,197-342,364 -633,655-666,688-696,718-853
atgaaaaacccacctaaagaaatcggaaagaatgatgatacggaaattaaacagtttgtgcgagatctgttggatcattacaacatggtaggcaaagtactgtttgtggatcagagccaggcaatcgattacagtgtgattgaagcgatactgtacaaaagtgaccagacaaaggtgatcagagaagatttttgggctaaaattgaccactttttttacaatatgtatagttcaaattagggttgctacccaacttttggggatacaaaagtccgggatcaaaatttcgcgatggctggaagaaaattgaaaaaatgcaaaccaataatcatcattctagataaataatttgtcaaaatccaattcaaatatcgaagaaattgtcaatgggattggaaagatcacgttgacaaagtttgataaaaaaggaaaaaatggtaaaaagttaaattttttgtatatctaataataaaaaaatcagattcttcggtgaagccaactctaatggataaatttgaaattttgaaatggattgaccaactcgacaaacctatggctgatttaataagaaaattgcacaaatcagtcaacgaattaagtgcttcaattaatgaaggtgtatttaaaaaaataatttatttatttatttatttagattctttggaccaaaatgcaaaaattcaaaatttaataagtttgattaaagaaattgcaattggtacggcaaatcgtttgcaaatctcaacaaatgaaattatgccaccggcagatggacaacaaattgatcagaaaagcatgctcgaagagttgaccaaattttggcacaaatttagggaaaatggggagcaaaatt

SEQ ID NO: 53225 - DNA, 460 bp, Heterodera glycines
  misc_feature (365)..(365): n is a, c, g, or t
  misc_feature (374)..(374): n is a, c, g, or t
  Genomic contig location: Contig_ID=SeqID_22556; Location=93..552; Strand=-
  SCN-specific regions: Sequence locations=1-188,210-224,246-460
atgcaaccaaatttcaattttctaattgttctgattttattcggtgtttccatttgtacggcttcatcttacacttggaaatcagagcctaatttggccaacaatgtacaaacgtttgccaaatttatggatgatctttatgtggaatacaagaagactgtaaaaatgggtcagttcaatgcaaaatgtaaaataaaaaatatattttagtgaaatttaccagcaaaaaaaattattatttttttggatttgtttttttggatataaatacactttcagacacaattctacgaaatccgtcaacgatattattgactaattactcagacaagcagaaaaggacagtgttcaatttgacatttgtnaaatgtgtnggcggaattgcctatttccaagtgcttagccaaaacgacgattcaaaagatgcttatctgattttaaagtgggcattctccatgaa

SEQ ID NO: 53226 - DNA, 327 bp, Heterodera glycines
  Genomic contig location: Contig_ID=SeqID_22557; Location=544..870; Strand=-
  SCN-specific regions: Sequence locations=1-134,171-268,290-295,317-327
atgtgcggaagttttccgataattgttggcgaaatgcgcgggcaaagaaccagcaaaatgtatcgaccatttctgatcgctaccgtatgttttttctggcaataatttctggtcattaaaccgtatgttttggcaatatattttttaaaataaaataaaatatttaatttcgtgaattttaggtcataacagcgattgtcggaataattgctacaataacatttttcacagaaaccggtaatgtttgaaattgaccattaattgttataatgaagtctttaatgtttttccaagaaaacattttgatgggaatgtttctaaaataaa

SEQ ID NO: 53227 - DNA, 1439 bp, Heterodera glycines; identical to SEQ ID NO: 22560
  Genomic contig location: Contig_ID=SeqID_22560; Location=1..1439; Strand=+
  SCN-specific regions: Sequence locations=1-391,418-1011,1033 -1162,1185-1439
  Gene Ontology: Mol. function=metallocarboxypeptidase D activity; Biological process=amino acid metabolism

SEQ ID NO: 53228 - DNA, 2335 bp, Heterodera glycines
  Genomic contig location: Contig_ID=SeqID_4110; Location=352..2686; Strand=-
  SCN-specific regions: Sequence locations=1-255,354-362,384-480,617 -625,647-926,948-1367,1437-1623,1645-1678,1710-1744,1766-2036,2112 -2254
atgtttaatagggattggcatgacaaccctgcgccgacaattgacttcactggagaggtgagtgactgcaaaaaataaagggttttccgcttgggttgggttgtctacgagacttttatattacctattttaaaaagtttattcctatgggcaaaattttgttttttattttattttttgtcttttttttcaaatatgatggcttttggtaaaaagattatcaaaaatattgggtttttcgtcttcagcaggacgaaaaaatttaatacaattttttaactaatagttaaactttttttatatacaaaatttgtataaaataaaattgattacattgtttaaaataaaaaaatgaaattgttctgcaaacttttaatttattcattgggatgtctttaaataaaaaatgaaatttggtctgcaaaattttaatgttataaagaattgagattattttaaaacaaattcggtgagaaatgcttttttaattaaaaataaaaattattattttattaaatctattttcacataaatattgtttttaaatctgctaattaaaaaattattaaattaatattttaaataattgatataatttcaaaaaataaaaataattcgccattatttattttcatttattaaaacaactacagtttgatcagtcgggtgcggatgagccggttattcctgctgaacaacatccgcctgtcccaccagtcgttgctgacgacaaggctgaacgacggtgagccaaaaaacagctgccagcagaaaattttgcaccgaattttgggatggtgccaaaaaatcgttgccaaatttttgcatttcactaattttctttttatgtgactaaaatttcaatttactaaattttgcaccgaattttggaatggtgccaaaaaatcagtgctaaatttgtgtttcacaaattttctttttaatttgattggaattatttcgaatagtggtgcaacacactcccccgtccgccggccatcgattcgcaccaccattgacttttcggcggcatcacctgaaccagaagaggtgggtcatgtcgtataaaaatatacatattgtcttgactcaaattaatccgaaaaaattgaccaaatatttaaaaaatgagctttttttgattttttaattaattctttttttggatttttgaaactttgatcacttttttctgatcagttttttggtgagggccaaaaaaaggtcgagaatttatgatagaataccatctatctccacaaaataaaagtggtttaaacgtgatttgaatatttactgtaagaaatgttcccttgttagaaaaaattaattaaatgtttgctcaaaaaagttttgaaaatatgttcaaaaaataaaattttaattttatctattttaaaatgattcaatttttaaatatttaatgtataaaaaatcatgaacaggagcggaccgcgtccagtagcggaaggcggcgacgcgttggcagcacagcggcggatcggtcggcacaggcggcagcagcggcttgcgctgcgggcgaagaggcaacagacgaggtggacaacaacgaggaggagcgacagaacatggcggtggtgacaaaaaggatggcaaatttggtaaaaaaaaatttaaattattggatatgcttcaatattttttattattgattaccttatttataaataaaaaagaaatgaaatttgatctgcaaaatttgtcaatgggaaagaattgtggtcccaaatttaattttttgggctcaaaatcagtttccgaagggtgttgatatgtttctaaacacggatttacccaattccggtaaaacttcgaatttaagttttgcgccaaagattcgtgatcaataccctcgaaaacccacagaaactgattgttgagcccaagaaaactcaattttgggaccacaattctttacttttgcccaaaaatttaatattttctatttttgagtttaatttttgtttttttaagacggcccaaagtgaggacgagcggcgagtgcgaactgcgtccggtggtggaaggcgacggtgtgacgacagcggcgcggcggcggatcggtcggcggcacaggcggcagcagcggcttgcgcattgaaggtgcaaaacattgggaatatttttgaaaatacgagagaggcatatttgtaaaacaactaggaatggattttttgaattttttttttgaaatcaatttttaacggagtatttttgtttttactgtattttcttttttacaaaatatttttataaaaaattgatttaaaaatggttaaaaacatttttgtaaatattttatttatgaaataaa

SEQ ID NO: 53229 - DNA, 460 bp, Heterodera glycines
  Genomic contig location: Contig_ID=SeqID_4110; Location=2910..3369; Strand=+
  SCN-specific regions: Sequence locations=1-208,231-314,339-460
atgtgtaaaattcgccggacatctcttacagaagaatttggccttgaattaaattggtaagttttcaagaaaaagtcaagaaaaaatgttataaaaattttctagaggatatgtttttttcaaaaaatagaaaaatctctaaaaatgaataaaaattagtcacaaatcattaatacaccaaaaatagtcattctgtacggattctaacataaaagtaaattttaaaaattgctttttgttcgaattcgggtccggcttttggaatcggtcaaaattaatgttagattcatattcagcgcataaaattaccctagaaaaaataatttaaaaaaaaatttcaggggggtgacaaaaaggataagaaccaaaaattcattcaacaaaattttatatgcttatcaaaaaccgttaacagcaacttgaccagatcactccttcatactgatcgggataccctaaa

SEQ ID NO: 53230 - DNA, 128 bp, Heterodera glycines
  Genomic contig location: Contig_ID=SeqID_4111; Location=2898..3025; Strand=+
  SCN-specific regions: Sequence locations=1-128
gtcattaaaaatctgttgaaaaataatccccccgtctccattaaaggccctgtctccaattatgtccccctttctaaagaggttgaaaaataattcccccggggccttaattagagaaaatacggtat

SEQ ID NO: 53231 - DNA, 621 bp, Heterodera glycines
  Genomic contig location: Contig_ID=SeqID_4112; Location=699..1319; Strand=+
  SCN-specific regions: Sequence locations=1-144,167-621
atggaaaaattaaaaaaaagtcccgtgcattctaggagaatcgaactttcatcctattcaatgagaagagactactctaccgactactctattgtgattgttggatgttttaactctcactttcctaatccttgtccataaatttttacagaattaatttcattttatgacaatatgtatacctttttatttgcttagtgatttggattttgaactacaaacgaacaaatcccatggcccggttaagcagcacaaaaaaagaagtaaaatcccgggacggcccagtcgccgggatagacacccggcttagtccggcgctgatattgaagccgatgacatgacaacttgtacaaaggcaactcgtacaaaaggcaatcaactcttacataggcttaaactaggcctaagctttaagcctgcttggtactaggcttaggctttttttgtaaaattattacagtacctttggatctattgcactttatgagcccaagcgacttttatgagtcagaagtattttatgagtccaatcaaataataatacctggtttttatacagcaactttgttcatgtttgaacaaaccctaatttttggtatcattcgaaagaacaaagtctga

SEQ ID NO: 53232 - DNA, 1156 bp, Heterodera glycines
  Genomic contig location: Contig_ID=SeqID_22561; Location=736..1891; Strand=-
  SCN-specific regions: Sequence locations=1-25,47-114,153-283,305 -317,340-370,392-454,476-478,542-542,564-664,700-734,756-793,956 -958,984-1121,1143-1156
atgcttgcaagtcgtccgtgccaactgctgctgctgattttggcatctgcacattttttgcaagcggaatcaaaaattggtaaaattcatatttcaaaaattttgcattttctgtttttaattataaaatttatttgtaaaattattaatttcagatgttcaagtcaataatgatcctcaaaaaacggcttcatcatctggtgttgatgaagatcatcgtaatgttgttgtgaatgttaagcatcaccataataatgtcgaacgagatgaagccacgaccgcaaaaagtaattagaaatattaattatgattttcggaattaaaaaattaatttttttaggtgaaaaagtgtacaacgaaaaatcaaccgcctcttcctcatcatcagcatcttcggaagaaaaaaatggacacaaacgacacaaatttgtcttggtccaacatggtaaattcattttagttaaaacatttaaattgcatttaaaatttaaattttaaaaaaatataaattattaaaaaaaatataaatttgaataaatatgattgacaacttgtgagtgtgtaacctatttcagaagtgaacggcagaaagaagcacgtattgcttaaagtgagaggtcaccgattgatggaattgtaccgtggtaaaaacattaaattttgcaatttaatttaatttaattgaattaattttaattttagaaagagacggaaaacatggactcaaaaagcatttgctgcttaaagttaaaacaccacaccaccaccgcaaatatgttcaagatgaatatggtaaattcagtaaattatgaattaatttaaaaactaaaaattaaatttatttaaaaagtattttaaataaataaaaatttaaagtgaaaaaagatgagaaaaatgacgataaattcagtaaatttcaaattaatttaaaaaataaaaattaaatttatctaaaaagtattttaaataaataaaaattttaagtgaaaaaagatgagaaaaatgacgacgaccctaaaaagaaagtttcagtgcgagttcacacttcacgtgaaggtggcataattgacgataattaagaattgttccggagatgataatgcaaaattgttcgaattgaattttgaaagatttatctaaattgtttttcaataaa

SEQ ID NO: 53233 - DNA, 1219 bp, Heterodera glycines
  misc_feature (397)..(397): n is a, c, g, or t
  Genomic contig location: Contig_ID=SeqID_22562; Location=1..1219; Strand=-
  SCN-specific regions: Sequence locations=1-7,31-525,547-1219
attctgcaaaataaaatatttttaaattttggaagaatttaaatgcatcggagtgccatccgccgattgtttgacgttgccatcgtcggtggcggaattgtcggctgtgccgtcggtttgcaattcgtttcctttggcttcgcttttctctgttttccccaaaaagtccgtagacaatttcagcccgtcagctcaaaattgtcaagcccaatctgagcgtcgttcttctggagaaagagagtcgcctcggtccgtccgtcccccctcccccattttttgctttaccaatgccaatttcagcttcccatcagagtggccataacagcggagtgcttcatgccggtagtaacacaaagcgtcaaacttttgaacttaaaacttaggaatttattatgcnccgggcagtttgaaggccaaactttgcgtcagcggttcgttccgactttttcagtgcgattttttacttttttgagggatcgatttggcctacaaatacttggaggacaatgaaatcgcccacaaaaaatgtgggaaactcattgtggcccttgacgaggcggaaattcgccgtttggaagtgggaaaaagggaggagaagaagaattttaagcaaattaattgccaaaggcattgttcgaccgtgccaaacaaaaccaatgcaaaagcatcgaaatgattggcgaggacggcatccgtcaaattgagccgcactgtcgcgttagtaatgccaatttggccaaatttggaacaatttggcatctaagggtcgaaaggcaatttggtcgccgtacacgggaattgttgattggacgatggtcaccagaaaattcgccgagtttgcttcgatcacttcgccatttactgattggtgtctttaagagacttccagagaatgggtgggactgtcttttgcgattggtccctcgagggcattggcccttcggatgactccgcccatcccttgcgactgatcggtgcccccaacggcgcccaagtgaattcctcgtttttcgagctccctttaatttcatcgtcagatcatcgactccaaatttctgatcacttgcgccggtctcttctccgatagagtcgcgcgtctctccggctgcccaaaattaccaaaaattgtgccttttcgtggcgaatacctcaaattaaagcctgaaagacgctttttgatcaaaaacgctaacatttaccccgtaagtgaataataatg

SEQ ID NO: 53234 - DNA, 772 bp, Heterodera glycines
  Genomic contig location: Contig_ID=SeqID_22563; Location=146..917; Strand=-
  SCN-specific regions: Sequence locations=1-75,97-103,125-219,274-772
gcttgaaaatcttttcgctttttgtaaaggctaatagagcatgtgaagagcttcgaatgataccaacaatgtttgatttggctgacaaagaaaaaagttatagtggaaaagcatgctggggccaaatcgtgacggccgaactgaacgcgtagatttattattgtcattagtcgtaatttcaaatgattaaattttctctttttgttgattacttttaacatttttttaaatttaatttttcaaattttagtttctaaattttaaaatttaaaaggaatttatgaaaatatttttcgttcattattcatcgttttctttcagctgtcatcgttttcccttttccatcctttcaattcaattcgatgtcaatcgatgaaattgagcggacaattcctttgccttcgtcccatctcttctctcattcgcaattcgtccgggctgagattcactcttttgaagaagcttttgtccacaacaaacgcttcaaagagttcgaaggattactcagaacgaatcacaaagttagaaaaagaaaaggaaaaaagaaaggaaaaagttacagacttacgaaagtgtcgaagcgaaattcgacctgcaaaaaatcgaaaaaatgagcactttgacgaatcgactgaacaaattggcggatcatttgggggaaattggccatttgcattttgaaaaggtatgccaatggggaaaatgggaggatgaaaatggcggggcagaacgatgccaaaaaatgcctaaatttagtttaaaaaatattaaa

SEQ ID NO: 53235 - DNA, 1627 bp, Heterodera glycines
  Genomic contig location: Contig_ID=SeqID_22565; Location=33..1659; Strand=-
  SCN-specific regions: Sequence locations=1-8,37-317,351-494,516 -1043,1065-1129,1171-1337,1359-1522,1544-1627
  Gene Ontology: Mol. function=hedgehog receptor activity; Cellular component=integral to plasma membrane; Biological process=regulation of smoothened by patched
atgtcggtggacgatgacgacgacgatgaggaggaaatcgatggatggagtggggacgaggaggacgaattggagcccatcgaaccgaatgtatgtgctaaaaatggtggcatttctcaaaaaaatgccattttgacacatttaaacttttttttcagggggggggatgactgaaatttcgctacatcccccaccaatttttgaaagttaatcccaaattttaatacggatttccgaaagagccgtttattttaatctataacattgaagggcatttccaaatatcccatttcaactttcatatgaaattggccatgaaaaatttcaaaaaaaattttttttttttttttgatttacgcatttgaaacccttttttgattcgctttgaaatttcaaactcctccaaattaattaaactcactcatttttttcagtgtgttgaccgttgtttggcggttggccaagcgccggatgaaacggcattttccgacaagtggaagagagagttctccaagcggccaacatggttcaacgcggacatggcactccaccagattttgcgggtactttcctgtggcaaaattaatttttggtgttacaaattacggatttcagggccatagcctgcagatttcactatattctgccataaattctcaaatttctatggaataagtaccatcggtttaaattagcattttatttttttcaaatttacaaaattgttccatcgatttccatcaacctttttccccaaataaccagggccgtgccatcgtctcatattttttaaataggcatttttcctcaatttacagaattgtgccaccgatttccatcgacttaatccatttttttccaaatttctagggccgtgccatcggcttccgttggcccctgtactcgcgcattctcatccaacgctctctgttcggcatcggctgcttcgtccaacggcacgcctggctgatcattgtcctcgttctttcgctgttcacctttttttgttgcgggctgcgctatgtgtacattgagacggacattgtcaagctgtgggtttcaggttggtgtaaaaattttgaaaaaaaatatttgaccgggtcggacactgtccgtcagtttttactataataaatttaaagggaaaattggaaaaaatgtttctttccattgaagaatcaacaattttttcaattaaaatcattgagttttttgaaattcattgatgactaactctatccacacaccgaacccaatttatggtttttgacataaaaatgggcctaccccttccccgaaggcgtattttcctcctttttttggttcaaacgaatgaattttttgggtaatttttgaatcttgcatggttttcttattaaaaatcctatgaaaatttctttttttccacacggcattgccgaaaaatgccatcggagaacccaaattttgcaatttcggtccaaaagtgcccataaaacgttggatttttttctaattttttagagggtggtcgtctgaacgaggagctgaattttctgtccactctgcagcaggagagccgccaacgtcgtcaaaatgcgacaaaacggcacagcgacgaggacgaaccgacaaccgcggcatatga

SEQ ID NO: 53236 - DNA, 771 bp, Heterodera glycines
  Genomic contig location: Contig_ID=SeqID_22569; Location=262..1032; Strand=+
  SCN-specific regions: Sequence locations=1-1,31-169,191-741,767-771
caatttaaaataaacttaaaaatattttatgatggaacgccgaaacagcaccaaaaatggcggtctgtcccccacccctcaagagacgaccattaatttgcccgtttcctccaatcgaagggcttcgtccgcttcgattctttttgcccaggtccccaaatgccattggctgttttgtttcttcgtctgtttgaccttcacttccccccaggcgagtttcgacacgggcctcgacgtgagccgcgcctcgcaattgtcgtcccagcggaatgtgctgagtacgcacgtgatggacttgggcagcggcagaccgtgcagtggcatccaatgcaaagcgttcaaatgggacaaaagccattcggaatggattcaaatcggagacacgtaatttggcgcaccgtccgcccgaactgacgaacaaatatttgagggtgaccaatgcgcaggggcgcattccgctggtgcaccccggcacttcgctgtccaaaggcctttacaaattgcgttttgccacgaaggaatattacgcacgtcaccagctgaagtcactgtttccgcaagttgacgtagggaaaagaatgaatgattttgaaatggatttgccattgttttaaggtggtcattgaggtggacgacgccagcgaacattgccatgtgccggtgttactcaaccatttcggctactccgtttataagggacactgatggaatattccctctctcattaattctcattttggtgtatattaaaaacaaataaaataaagaatt

SEQ ID NO: 53237 - DNA, 822 bp, Heterodera glycines
  misc_feature (57)..(57): n is a, c, g, or t
  misc_feature (64)..(64): n is a, c, g, or t
  Genomic contig location: Contig_ID=SeqID_22572; Location=171..992; Strand=+
  SCN-specific regions: Sequence locations=1-585,607-822
atggctatatatcaggactcgcattcgtactttgatgccaagtacgtacttgggatntgggctntcatgcttggaaaatgtaactgtactttttccaagaataatcttggatttccaagattagacttggaaattggcattttaacacatgattatcaaaaatacccgttgttatgaaaaaagtttacatttttgtcattcttctgtctaataataagcattaatttttttacaccatagagagtgcggaagaaaacattttggcatttatgccttttgctgtccgcacgtcaacggaattcacacagtttggatggcccgatttcgatggttttaccgacatgatgcaaattctgtggattttcctctgccggaccatccgctgtctaagcaaaaaaaaatctactccaaatcgcaaaactttgtaattttttttacccagtttgtctaggtttttggccataacttttctgaaatttaacaaaatttttcgattttggcatgctaatagagaatacataaggctatcgaatgctttaaattcattcacttcggacaactatgaaaagagttatgctccaaaaaccaggctggagcccagttggttgcagcccagtcaaccctcacccttaaaaattactagggttgtaaattatcgtggtgcgacttttggggatttgcaacttggggacccgacatttggggaactagacatttggggacctgacttttggaaatcccgacatttggggacccgacttttgggaatcgaacgacttttggggatccgacatttggggaactagacatttggggatttta

SEQ ID NO: 53238 - DNA, 521 bp, Heterodera glycines
  Genomic contig location: Contig_ID=SeqID_22572; Location=1136..1656; Strand=+
  SCN-specific regions: Sequence locations=1-136,158-258,281-521
atggcctcggcattttgttgctgtacgcaattagacagtaaagtcgcctttaactttttgaatgcccttgatgaatttctgttcccgttggcccttgggaaaggcgttttaaataaaaattggaaagggtgtacggtaaatactaaaatgtattgttatttctctattgggttgtggttagtatgggctcaaaattctgctacctcaccgctgtgagtccggaatagctctaactttttttttcgtacatctaaaaaatagatgtccagaatgtttgttttggactaaacctttaacaacagctgttttacctactttttcgaaaatcaagtaatttttgtaaatgctcattgtttttaggaaaagaactcggtataaaaaaaatataaattctcccacgttccaaatactaaaaaaatatacaactaagtttagaatttaaaaaagcaaaattttttagctattatctgtaaaagaccgttaagaccaccgttatataaaaaattaggttctacaaaaaa

SEQ ID NO: 53239 - DNA, 1469 bp, Heterodera glycines
  Genomic contig location: Contig_ID=SeqID_22573; Location=266..1734; Strand=+
  SCN-specific regions: Sequence locations=1-776,801-808,833-930,990 -1043,1093-1469
atgggccttcaaacgcaagcaaaaatggaaaataagccgctggtactcagttggccaccggaccggaaaacccgtatttttcccggatgccccgtcccgagatgcctatgtgtgcaaaatttcagccccctaactattcccgttcccgagattttggttttaaggatgaaaccccttatcattctaacatatatataacttttagaaatatttatttcttgggataaattatcaaagggttttggaaggaattaaaaaaaatttgacaaatccgtaagtctttcgtgtaaataaagaatatgtatacaaaaaatatcaggaatttttttctaaacaaaaataatgattcactactcatttttttatttttctataatttggaaactaaaagtgagtgaattttaatcaaatttacgactattttttttgctctcagaattcaggtaccagagtttactatggtttttattatattttagattatcctaatgcttttgagcataagaaaaaaaccaaaacaaagaatttaaaaacggaaatgttaaaatcttagaacttaacccaggccccattcctccaaaagaataattaggtctatagggtagaaaattttttatacaaaaaaatagacccgaagaaaaatgcgtcaaattccttacttgcctttcgaatgaatgtgtattaattctggtaaaagctgaaatataatcacagataagaaaaagaaagagaagaaaaagcaaaacggataccaaatgaatttttgtactatatcgtttttatttttaatgaataattttggcatttattcttaaatttttcaaaaataattaaagatcgaatagatgtctatagataaaattactaaatttaagcaaaacttgattaaataattccttcatattattctaaaaaataataaaaagacggtatttaaaatgtataattaaaattatgataaataaacataattcattaacaaaataaatggtagaagtacgaatttgttattctttttatcaatgatagtcattcttatggtgatttaataaaaataaataaataaataacaacaaaattaaattaaattaagacttaaaatgggtaaaaactttactgattgatgaacttttttttgggcattcaaattaacggcgcaccacatagtctaattatttaggaaaatccgggcctttgctggctcagctgtcaaacaaatggttgatgattatatttgtgcatgcaaaaattcggacacctgcctatttcgcaataagtatgtgacatacggtcagtcagtgaaatgcaccgcgcggaaaggaccgatcaatatcggtccgcttaatttacatattggaggaggaggtcagtttatgtcacttgtcagtcggtcggctggcacgtgatacttcattaatcgctataaaaaactcaaatgagcaacattccatcacttgaatcgagaaaaa

SEQ ID NO: 53240 - DNA, 492 bp, Heterodera glycines
  Genomic contig location: Contig_ID=SeqID_4113; Location=293..784; Strand=-
  SCN-specific regions: Sequence locations=1-362,401-492
atggtcttgcttggattcttcaaaaagatgattagctccgcctccatctatacacatcagcaaattgcaggtaggtctgacacgttgacagtacgttttcgataagtacccatccccaaataatgtatgattaagtggatggttaccatccacatgtaacggttatgtggatggtaacatctgcatagaattgattatgtggatggttaccatcaacatagtaatgattaagtggatggttaccttccacatagtaatgattatgttgatggtaccatctgcatagaattgagtatgtggatggtttccatccacatagtaatggttaagtggatggctactttaatatttaaactaaaaagtttaaaaatccttttacattttttaaaaataggttttggggctgggcgacgaaaaccaacaacaacaacgttttatacggtccacaaaaacgacacccacaacaatggcatgttcaatgacaacggatga

SEQ ID NO: 53241 - DNA, 1521 bp, Heterodera glycines
  Genomic contig location: Contig_ID=SeqID_22574; Location=1038..2558; Strand=+
  SCN-specific regions: Sequence locations=1-295,336-629,659-680,722 -782,822-835,876-1054,1103-1212,1234-1236,1258-1521
atgcccaccacaccaatgagcggaaacatgaccgaaaacgcaactgttgcgaccggtaaggctctgttctttttttttgcgagatgagtgagagtccggcgggggaaaggtggggtcagtctgaccattttcatgaaatccctgctggttagcatgggataaagcaaggatggcatggaattccgaggatttgatttctcgaaaatttttgggcatcgaaattccgaaatttagagaaaaaaaagacggtaattttgtacgaaaccgtatttagggagaaaagtttgaaaattcttttttttttttacattgtatttttattttactttttatttcatttaatgttttctaataaagcctatttaagcacattttgggtccggtggtgccggcccttgccccggggaaattttgatttttgataaatttcttaaaaaacgctacttttcaaaaattttacttgattttcataaaaaattaattttcatttatagtttaagggggggagggggctataacgccctttctctatgctcttgctataaattaaatttttcagatgcaagtggacatcaccatctgacggctttggcttttatcttgccatttgtcattggtagtaacattgctaaatttaaaataatttattcataataaacctccggggatcccccagcggaaaactttggattaaagggattttttaattttaaatttcattgagtaaactctaaaaatttcccaacatttgactcaaaaacaaaaaaaaaaatcatgttttcatttttattcttttaaattattatattttaagttaaaatgtgagactctaatcaataaattatttttaaaatatgcaatttatattaatttaaggaattttgccaaatttggccatgccattcgctaccaacctctagacgacctaattcaagagaaacaattgatggccagaagcagatcatagaaaatcccaaaaaaaatttatccatttaaaaaacaatagaaaatcccaaaaaaaaatttatccatttaaaaaacaatagaaaatcccaaaaaaaatttatccatttaaaaaaatttctaatatttttatttatatgtatgtaattttaactagagtagagattttgaaaaatcctgcacctggattaaatccaggttcagcaaaaacccaggcttgtcaatgcatcgactcaggccttggatctggattttttgaaaaccaaatatttgaaaaaattaattaattgtttggctaaaatatgtataatccaggaaatccagcttttcatgccgaacatggaattagatttatgaaaaatctgacctggacctggatccacgaaaaatcccggcctcgatccaggtcatgatcaaactctagttttactaattactatatccaatttttttacaatttacctatatgtatgtcttttctatatttcgggacatttctattctactcctttttcgactatgtttatttctttaatcaagcatttctttttgtggtga

SEQ ID NO: 53242 - DNA, 733 bp, Heterodera glycines
  Genomic contig location: Contig_ID=SeqID_22576; Location=91..823; Strand=-
  SCN-specific regions: Sequence locations=1-96,118-681,722-733
atggaaattgaaaaagtgtccgaatttgcgttggaggaggtgggaagtgagcgattaagcgatgccatggaaattgggggattttcatgaaaaatatgggcagttttccttgtttcccgcgcatatttttttactctttttctctgtttctctcttctctcttatggtgaatgcgcatctttctgccagcgtacccgcgcggattttttacacctatactactcctgccgtcatgttctggaaaaaaaccaatatttagtcattagcaaaacttcaaaaaatagggtcagtcattaaacaactccattagggtattaagaagaaaattggagttgcaaatgttcggcaaccttgctttttttgtttaaaaataagtaccgcaatttttctggattctctgaacacgtttttaacaatgaacatgcagccggcgatttatatgtcccttaccatttgcggtgtgttccaatttaaataaatccaaattaactaattatggttattaagctactaatggacccgctcaaaggcttttacaacaaaaatgaggaccaattgacgctttgcatcgaaatcagagaaatttcagacagtgagttggtatggcaaggccaattctaaccgctctactcatactgttttcgacaaaaaatcgtctaagtttgaaaaaaagttacggacaaaatttttttaaagaattttttaataatttatttaaaaagaatacaataaa

SEQ ID NO: 53243 - DNA, 1489 bp, Heterodera glycines
  Genomic contig location: Contig_ID=SeqID_22578; Location=190..1678; Strand=+
  SCN-specific regions: Sequence locations=1-2,25-227,252-290,317 -534,598-1172,1195-1355,1377-1489
  Gene Ontology: Mol. function=profilin binding; Cellular component =cytosol; Biological process=cell growth and/or maintenance
agggtttgaaagtggcacagaacgcagcggcacaagccaaactagccgaacagcagcgacaaacggccaacagcacacaaaaaacaactccgacaacacaaacaactccaacggtaacagcagcgaaagttgggaaggaaaaagtgagggaacaacgggacagcagcaaacagcggacaacgcaacagactgacaaggaaatggtacggtgaatgggaaaaatgttgtaataattaattaaattaattaatgcacgatttgttacggaaaagcattaaagcacggaaaagggacacaaattttgatttattagcaacaaaagaaagtatttgaattgttggagaattattttaaatagtcttatattaccaaatatgatttgttgcctttacaggattccgttgactccgcttctgtcaattccgcaccacgtacaaatccgtcacagcagcagggtaacaaaacaacatttaaaggtctaaaacttcaaaaaaaattgcttacaattaagcacctccgaaaaaagcggtggcacctcccccaccaccgcctcctcctcctcctccgccgccaccattgtttgtacagcctaaaaaagttgtgcaaaatggccctaaagcagcgggaggaatgccaccaccgccgcctccgcttggcttattcgtctcaaccgctgaagcggtgccgaagaagaaaattgcgaaaattggcagcaaaatgccaatgatcaattggacggcgctgaacccgaaccaagtgaagggcaccgtgtttaacaacatgaatgacgagtgggtgatcaaaccgtacatataacatgtattttttccttttttcagaaaattggctgaagagcttgacctgagcaaattggtcaataattttcaatttttatttttaccattttctatgcaaaatatgaattcaggaagcaatgtttagtctggacgagaagaagccgtcgtctgaatcgcaacagcaaaatgtggacgcaaacgcagcggtcaaaccccgtggacagccgtcaccaaatgcgaccgtaaattgcggaaaaaacactgttctctcaactaaacggcttcaaaacatcggttgggactttttctcacactgggagggcggaatttgcaatcattaagccatagaaatttaaaaatgatttttttgcccacttaatattattttatttttttacagccataattcgtcggaagatcgggaaaagtgcaatggatgtgagtatcaattgaaaaggggcgggttcatgttcgggttccatacctttttgtgtcctttaaaagcaacaaaatttggatcattgcaattattttagaaattcctcgtgttcatttaacttaaaaaattttaaaattaaacaatcattccaatagttgtgtaaaatttcgcttttttcagattatgactgccgtccataggttcgatttctcagtgctcacttccgaccaagttgatgttctgcttcacaatt

SEQ ID NO: 53244 - DNA, 665 bp, Heterodera glycines
  Genomic contig location: Contig_ID=SeqID_22579; Location=52..716; Strand=-
  SCN-specific regions: Sequence locations=1-391,423-665
atggataagctccgaattgggacggaagtccaaattttgagatcggatggccgcgttcatgcggcactcgtcacagcaatcaatgaacgaggtgtcagtgttgaatggatggaagaagtatttaatgccaacaattaatacccaacaaaaaattataatttcagggcgaaaccaagggcaaacagttggacattgaagtgattgtcaggaacaacccatctctctttccttcccgtgttcacaaaccggagaaatcatgcgccgacccgaaaactgcgtcaaatggagttgtctcgaacaaaaatcggcactctatcgccgcttcatcaagcatgcaaacggttgttggccgacaaattgattgtggcccttccgtgggttatatcagcaagtcgccgccaccaccaccaccactgcagcctatagcacccgtcaagggtatttgttgtagcagaatctatatataaactgttaaaaattattgtctttaagacatcaagagaatttgtgccggaatgagcgtcaaaattgagcgaagcaacggacgcgttcaaaccgccctcgtaacgacaatttttcccgagaaaaatggtgctgctgtggaatggcaagaacaggtccgagtttgcctatcccaaaattcatttgttttgttaaccccataa

SEQ ID NO: 53245 - DNA, 599 bp, Heterodera glycines
  Genomic contig location: Contig_ID=SeqID_22581; Location=336..934; Strand=+
  SCN-specific regions: Sequence locations=1-414,446-556,578-599
atggacgagggccgtgccgcacattattttgccgacctttcgcgccaatgtatgctcgaagtggacgtgggggaggcggtgacggagaaggtcaaccgcctgaagagagcgatgttggacgattctctgatgattttggctgctttatgcaaagaaatgaatgtaaacggaaatttaagcgaaggacagaaaaatgtggcaaaaatcgtaagaaaaaattataaaatgatttcactttaattttatttgtttagtcatttccctttttcagatcgcaagcaatgagaccgttttgttcatttaccattcaattcttcggatggatacaatttccatgttcaaattgcaaaagacagttttattagtgagtaatttcatttgccatatcaaatggttttttgcccttggatgttgaagaaataatttttaaaaatttagaaaaagactaatttttggaaacgttttcattttcttagactttaaaccgaatcacaaagtctggcgctttgcccgctgtccttgacaatggtccgcttctctccgaagcattgctcaattttctattttcttcttttgactcgtccaatgtcgccaaattg

SEQ ID NO: 53246 - DNA, 910 bp, Heterodera glycines
  Genomic contig location: Contig_ID=SeqID_22582; Location=505..1414; Strand=-
  SCN-specific regions: Sequence locations=1-324,346-440,462-577,599 -617,730-825,848-910
atgaaatgtgaaatgaaaaatgatcacttgaatacgatctttgaaaattggatagcaaaagcaaattttggggaaagaaattggactttggaaaagggtagtggaagaaggtgagcatcgttccttcgtctttcttttatacggccatccgtcggacaagctgatccatgggcgggccgttgagttgggcgttcggcaaattgttgatgaccaaggaccggcttacgctacgtactgaccacgaagatatttaaaaatgggaaaaacgcagggattaggtgggaagatgatccccatatttaaaaaagtccgactagggcaaaattcccaatccaaatcttttaaggaaaagcgaaatttatacgatcaagattacatatggattcaacaaaatttctgtccatgacactaacatttaaaataatttttgctcaagatacaagacaaaaattcaattatgattttgagcctcatgaaatgtacaaaataattaattgcgcttttagggcgagcggcggaatctgcacaaatattatttatgccatatgtggtaattcttttacatattccttttgaattaaaagttttaaaaaataatcttatgtcataaattatgcaataatttttacatacatatattatttttgtttttataaattaaaaatattcttttcatttcatataaatttgattaaattgtttcttttaaaaggttaaaataatataaaacttacttcccttggggttttatttgatcattttttagctaataaatttaatttttaagccatccaaactgattaaaatgtaaaatgagaaccagcgtgtttaaaaaattaatagtcaaatcaaaacttaaagaaacagaattgaaaaaaaagaaaattaatttgtaagagggaaaaataaa

SEQ ID NO: 53247 - DNA, 1690 bp, Heterodera glycines
  misc_feature (1470)..(1470): n is a, c, g, or t
  Genomic contig location: Contig_ID=SeqID_22583; Location=597..2286; Strand=-
  SCN-specific regions: Sequence locations=1-439,462-677,961-1690
atgactgtccgacactttgtcattataatgccatttcagcaccgctataacatagatgcgcgtggtcagcggaaattccgcaggaatatattctttatctttctaaaccattcagtcattgaacgaatagcatggtcgtcatacatatggtcatttaatgccgtttaggcaccagtgtaccaagtatgcgggtggtcttgggaaattcttcaataattaattttcgattttcttaaatccgtaaatcacatagggaaaaatatcaagatcatgatcattaacatgctcatttggttttggtgctagagtgacatttattcgcatagtcatgggaaattactcaacacctagtggacttttcttaaatatacaatcattccaagaaaagcacgtctctcagacttatgctctgtatattcttatttcatcacaatattaatgatcagcacccttctccaatcgatgtatattcattggaatttcagtgaaggcgacggcggaaaacaaattattttttgaaaaaaaaaaatcgaaaaaggttagaattcggggttaggggttcgaaattttattaatctgagttcagattcgtgcttagcgaccccgaaaacccctggaagcatgtttataatgctttaacaaaaaaatttttatgtggtctaaaccacataaggtccttatttttttctaattttaataatcattttaatttttaaaatattttcatctgctgcaatattttaaatttattttgaaattcatttaaatcttttagaaattttgaattttatgtttatttatttttgtaaacttttaatacttaataattaagtcacttttaattttttcaattatattttcaataaaaattttgaaaattacttaatgaaataaaaataaactttttaaaaaaattatttcaaatgaaataaaaattgggttttttaattatttattttagcgttttaaagtcgggcaatgcctttgccatttttgaaccgggccctgcaaatgttctcgagcgtcgatttgcccgatttcgcatcagattggcactgttcgacgccgtgtcactttcacagaacgaggctgttcaatttgttggcacgaaatttgttgatgacgacaattatggcacttttgggcgcctaaaaattgggcattttgccacaaattatgccaaagacagtgccgtcgttgatgatgacacaaccaattcgaaaacaatcaccgattttggaccaattgcttatgccattcaaacgtcgggctctaccggtgcaaaatttttgttttttgtgccaaccgatttttgtgtgaaagtgccaaaatttcgtttttttcggattttcaggcattccgaaggtcgtcttggttccgttctctgccattttgccaaatgttgaggattttatgtaattactatgtgaaggaagtttcaaaaaacttcgaaaatttctatctttttantaaaactgtaatttaatgacaaaaatgaaaaaaaaaattcgttttcaaaaataatggaaatattttttgaattttgttagtttttcgccccaaaaacatttatgagaaaatttaatattttagttagggaaaattttttatagattttttgaatttatttacatttcccaaaaaatcgcgaaacttttcaacttttgcgaaattttataatgaaaataaa

SEQ ID NO: 53248 - DNA, 2333 bp, Heterodera glycines
  misc_feature (2261)..(2261): n is a, c, g, or t
  misc_feature (2283)..(2283): n is a, c, g, or t
  Genomic contig location: Contig_ID=SeqID_22584; Location=1..2333; Strand=-
  SCN-specific regions: Sequence locations=1-1396,1418-2075,2097-2333
agagcgatgggcaatcctgagctcgcgttaacctcgagcttgtgagaacgccaggcatgactctggaccacttcgtgtcacttgccgcgcgtgctgaatctacgcaaaaggcaacacaacgattttcgaggccggacaacagagaaaggacttggagaacgaacacaccgcaacatttttcccagacgaataatgggccctcaagaagcaattttgaggaacggggccagcaaatgcaaaaatttggaacccaatcaaaccgaagttggagttgcttcaactgtaacagcccaggacatttggccagagattgtccccaaggaaaaatttttcgcgcaattgagcgaactaactcttctacgacaatgaatcaacaaggcaaacaacaaatgggttataatcggcagcaaatgcctgagcccaacgaaaacccaccaaatcggctttaccagcaaaagaattatttgaagcaaaattgcttagttctgcaagaggaacaagttcatcaaaacaatttcattgttggtgaattgaagcagggacctggaagatttttttgacgaaataaggaaatgtgcgacggaagacaaaaattcgaatttttcaaaagtcggaaaagtaatggcagttttggttgaagtttttggaacgaagacgaaggcaatgctcgacggaggcgcacaaatttctgtaattgaggcaaagttcctctacaatttgataagggacaaaaaattggacgttcggaatttgagtgttttgaaagcggaaaatcgcatttccgatgcgaatggcaatcctttggaatgtttaggagttatttgtctgccgataaaacggcatgagaattcgagcgaggtcaaagtcgcgatgcatatcgccaaatcgtcgattggatttgaccttctttttggcacgaatgcgcttaatgaatctgggctttaagctgtacgatgccatcagcgacactgtaattgattttgaaaaagtgaaccaaaataaaatcgattcgctcaccgtgatctacaaaacggtgttggaaccacgggccacgaaagtcatcgaatgtggcttgcctgaccaatatgaagggagagaagttttattgacatccgatcaagaaaacgatcagattcgtttggaaccaacaatcgcgattggacgcaacaacaaaatcgtggtgccaatcataaatttttcaaatgcatcagtaacgctggaaggaggaaaaaaatttggcacggccgaattaattgaagaagtttgcgatgcggaagactttttagcagcgccaaaagcattgattggaaaacttgaagtgcggagagcagaaaaaactgcggagattgaaaaaatttggcacgaatgggtagacaaaaaggcattggaaaagaaggagacagatgatattttaaaattgctgatgcaatatgaaagtatttttgcgattagtgatgcagaattgacacaaaccaatctgatcaaacaccaaatcgacacaggcgaggcggaaccaattcgctgtaagatgcgttttgtgccatatgcctacagggagaaagtcgcggcaatgttacaagactatttgcaacgagatgtgatccgtccctcccattcgccgtggtcaagcccaatcgttctcgtgccaaaacgcgacggaacgttgagattttgtgttgacttcagggccataaacgcggtcaccagaaaagacagttttcccctgccaaacatcgacaacacccttttaatgcttggaggccggaaattttttacgaccctcgatttcatgacgggttattggcaaattcgtatggacgaaaattccatcgaaaaaacagcattttctaccgaatttggcctacatgagtttacggtaatgccattcggtttgtgcaacgccgtagcaactttccaaagatttatgacgcacctttttgacggatacataaacaactttgtttttgtatatatcgacgacgtccttatcgcttccgactcatacgagcatcatttaaaacatttggcgcttgtttttgaacgaattcaggaggcgggactcaaactgaagctgtccaaaagccatttttgtgctaaagaattgccatttctcgggcatattctaactcgcgaaggaataaaaatggacgtcgacaaagtgcagccaattacaaaccttccaatgcctcaaacgcgaaaggaattgcattctattttgggctttttcacatactataggaagttcatctaaaactttggtnccatcgcagctcctctttttcntctcctgcaaaagaacgtcaaattttccattggtgaagtggaaaaagagg

SEQ ID NO: 53249 - DNA, 2299 bp, Heterodera glycines
  Genomic contig location: Contig_ID=SeqID_4117; Location=315..2613; Strand=+
  SCN-specific regions: Sequence locations=1-25,47-149,199-215,238 -349,371-573,615-687,724-878,917-1067,1091-1169,1252-1279,1302 -1794,1816-1883,1968-2046,2099-2104,2126-2299
aaagcacgagagcatgctcaacctgaacatatttacaaaaacgcagccaaacacggcaattttagtgctaaaaatccagtgttgttgtcagagattgtgtcagtgatcgatttgttccgaacaatgccgcacttcccaatgttagagccaagtgatcaagtaattaattaattaattatgaattaaaaagccaattaaaaacgaaaaatgattttaacaaaacaaataatgaaagcaatcgaagaaacatataattaattcatggaaatatcaaaagcatttaattatgatcaatagggatgtcaattttatgtatattttttcctggattctccatgctctaattagtaggaaaaacactttcttttttgtgtttgcatataaaaatcgggatttttatttatatattcggggttttatacataatttacatatttagcgattttatatatatttggtatatattttggacttttttctgacctattttcatttttatatatattgatgatttttacggaaattttttggaaaacctcaaaaaatataaaatctctcgtaaatttttcgtagatattttcaatataaaaaattaatttttaaaatattaaaatgtgtttctaagcctatttaggtcattttatgcaatttgtgcctatttcaccctctacaaataatttttttgccaaaaataattatttaaaatttttttttagatattttgatacatattttaggtttttgtacatattttttacatatttatgtacatgttttgaccactttttgcacatgtttttgacatccctaatgtcaatgaatctgatgaatgagaagctgatcaaaaactcaatttatcaataaattattcattttgctaaatatatataataaaaattttaattaattaattttaggcaattcttttgagttttgttgccgttccattaattgatgtgaatgcccgcttttattcatcaaaaatcaactcacagatcgtcacagtgcttccaaacaactcatttagcccattgtacctttattacaataatccgttttatgccggcgataaaacgtaataaaaatttaatatttcggaaaatttttgctaaactttaataattaaattgctaattaattttccatgaatttctcaaactttttttgacattttaaaaataattcattaaacactaataaattttataaatgtttagctaaaaattaataattaaatgtttatttaattttccattaattttctcgatctttttttggcattttaaaaaaaaataatttaagcatccaaacactgtctgattcattgtacgtcaaatcaatgcgaccatttaataaattgcgactttctgacgaagaattccttttggtccgcgcattgatctcatcacattcaggcaataaatcaaattggaacaattttaattttctggaataaaatacggaaaatagcgaggtacttttcggttttaggcttaggcctcaaaatttaaaaaaatcattttaaaccaaaaaggccctatatttttatttcctttcaaaaaatttcaagaaattttgaatttttttataccccccccccccaaaatagcagcgcgcgctaaaatgccttcagctcgccctttgttgaccttttttttataaactttaaggtgtaagtccaaaagcaaaaaaaaaaaccaatagctaaataaacattaaaatattccctcaaaaatcaaaaagaacgaaaaataaattggcataaaatatcaaatttatgctaatttcaattataaagcatttaattgcaaaacttttttaaccaatttttcatccaaattacacaaaaaatgctaaaatttaaattaagaaatctaattataatatatatatatatatatatatatatatatatatatatatataatatatatatatatatatatatatatatatacaatatatattaattatatgttagttcaattttttcagcatttaattgcaaagcttttttaattaatttttcatccaaattacaaatgctaaaatttaaattttgaaaatctaattacaatataataaataaattaaaaatcaattttgtttcaattttttcagcagttaccggtctgtccgctgctggtcgtctcaccctgcagcatttatccgaacattatgccgatctgttgatgcaccttttgcgcatcaaccacggcaacatggcgggcgtacttcgctatgccgaattgatccatctgatcgagtcggtgttctccaccgcgaaacggcaccgtga

SEQ ID NO: 53250 - DNA, 267 bp, Heterodera glycines
  Genomic contig location: Contig_ID=SeqID_4117; Location=3505..3771; Strand=-
  SCN-specific regions: Sequence locations=1-150,213-267
atgagaaaaatgtcctcgctgggcacgctaattaatggatgtgctaatttgtataattcgcttaacataatatgccaggaaacagaaaatgtgttccttatttgtccaattccttagcagctcacgcgaatattaattagcaagaataagataaaataataatgatttattataataattatgcaatttttaagtaatttttagataaatttgtttgtcatgagattaaaatgaatttaatggggcataatttgtttacctaataaa

SEQ ID NO: 53251 - DNA, 391 bp, Heterodera glycines
  Genomic contig location: Contig_ID=SeqID_4118; Location=648..1038; Strand=+
  SCN-specific regions: Sequence locations=1-104,156-174,196-391
atgttcagctgcggcgccaaatatgtgggcacattgcaaagactgaaaagaatcattgaggtaaaaaggaggcagaaatgacagaaatttgaaaacaaaatgccaaataaatttaaaatatttaaaatataatttaaaatgttattgaatataaaggaagtgcatgccgactattcggaatgccaaaaatcgatgaagcaaatggacgaggacgagcaaatggcattcggaaaagggcacggcacagagcgatttgcgatgattgacgaactgatcaattgagcccaggggggcaatttgtggcaaaatcacaaaattcgaagcataaccatttgaaaaacattgaaatgatttttcattgtttgtgataaagcgaaacagcaatttgtta

SEQ ID NO: 53252 - DNA, 204 bp, Heterodera glycines
  Genomic contig location: Contig_ID=SeqID_4118; Location=1063..1266; Strand=-
  SCN-specific regions: Sequence locations=1-102,124-204
gtccgattgcttttccacgccaaccttcaaaaagtgtttgagcattttctcaaagccaaaccgaagcaggcgaagtgcgcagatgcattttctgatgagggcaaaatgatggagaaaaaaggcgaaacgacgaacaaaacaaaaacgaattatggggacgaattgtgaaaaaaattaattaatttttgttggacagcgaataaa

SEQ ID NO: 53253 - DNA, 2225 bp, Heterodera glycines
  misc_feature (177)..(177): n is a, c, g, or t
  misc_feature (179)..(179): n is a, c, g, or t
  Genomic contig location: Contig_ID=SeqID_4119; Location=50..2274; Strand=-
  SCN-specific regions: Sequence locations=1-163,187-1140,1162 -1202,1224-1415,1437-1694,1716-1851,1898-2029,2051-2103,2135-2225
atgccaagtcaagtgccaaaaataaacaaatggacagtgtcgagagtctcggttaaatgccggaaaatgcagcaaaagtcgcagcagaaggagaaggcaattagcaagcgggcagaagagtgggggcaaaaacaatagaatggagggaaggggtgggcccaaacccccccccccccncncccccccattgtccccactttcgaaactgaatttggcactgggccaacacggcacaaatcgccgttttctcaaaaaggcggacgaccattcatttcattgggtgccacgcgcccattcattacctcatcatcattagcctaaaataaaaagtgctcctccccttttaaatgatagtccttccaccactaatctgcactcgagagtcttgactttgctacaaaaacattggcactttagagctttttatgttccgttttaatgtctgtttcattttggcatttgccatttgtcattcattggctttccgtctgaatacatcatttaacagcacatccgtttccacaattcactcatcatttgcttagaattatgaagtcatcatttgtcataattcagctgctggcgaattaatagaggaaacaaaaaagcaaaataaaaaataaaaagtgaaaaatattcaaaatttaattgtaaacgtcatttatgtagttcgctcatttttgccaattttatccttttttttctttaaaccccaaaaaatgccaataaatttgcttcgttatggtgtcattttacatgaaaacgtgctcaaagaaattcggaccaaatttaatgacaaataaattgcattttttcgtttaatggcgatgaattcgccggaacaaatattggttagaggaatttttgacatcatctgataaattatttaaacaaattcaaatccaaaaacaaagagaaagaaaaagcataaagccaaacaaagaaaaatgaaatggagcgaaagatttccaaaaattttttataaagcaatggaaaacaaaaaacagacttaacaaaagtaaaaaagtaaacataatttaaacaaatgaaagaaccaatttccttcggtaattagtcatttcctttggcgaattgtgactgtcaaatttaaatggagacaaatctcattaaccaactactaattctataaatgaccaattaattatcttagggaccggaatttgtaaaaaaaaaattcggagcaggaaaagatttaaaaattaaatgcaattacttaaaatgatttttacttagcaatttagtcatttcgttgctcccaattaagaaacagagcaacacattggtttattttattcaattaatccatttgctgctgatcgccatttaaaagtgccattttcttccgctttttctctttttcctaatttcctttttccatttcattttcattggcactcccttttttgatttgttaaatttagtgcccaaatttaatttgctttccgatggcatattaatcaaatcattcgcctgtcaatttgtcatttttgacgcactccttcgcccacttccgtcccatttttcccccgtttgatcaaatttcacctgccctttttttgcccaattggcgaataaattaagtgccaacgcgagaattgccaccaccacccatttatctatttaattaattgcttttcagaacgccgccagcgattgttttgcttttgtcactctcattttcattcagtcatttgtccctttccgcgccattcatttgccattcgccgccaaattttacgagcatttgccgcgttcacaaatttgggcattcattctgctgaaatgcgccaatattccgctcacattaatgcattcttttttgggttagtcattttttaaatttaatttctatttctattctaaatttaattaatttcccccgcttttccccctcagttcgcttttcctcctcattttgccgtccgtcgtgcgcactttggcggatgaaaacgaacgattttccagcagcaaaataatgagacgagggccaacaattgcaatggttttacagcgacaaaaacaacaaaaaagtgaggcggaagaaatggcaccggccgacgttgacgatgacgaaaatggggcaggaggaagaggaggaggagagggaagaggacggcacgtgccaatagaggaggaagacgacggggcagcagaaagtggacaacaaatacagtgccaatttcacgccaacgaagaattgcatg

SEQ ID NO: 53254 - DNA, 1336 bp, Heterodera glycines
  Genomic contig location: Contig_ID=SeqID_4119; Location=2494..3829; Strand=-
  SCN-specific regions: Sequence locations=1-209,246-268,299-325,347 -398,422-856,881-900,928-1131,1182-1336
atgccatccgccgcggtcgccgatgcgtcgtcggcatttgcccagccgaccctcgccggcacaggccactcgcgactgttcgaaagtgtcattgccctgaagtacagcgtcagcttcacctttgtacgaagcgaatggcactggacgaaaaatcggcgcaatcgaagtaggaggaaaagcggcaagtcaaaattttaacgcatcgcttcaaaaatacaaccaccaaaataatgactttaaaaaaccaacccccataagttgtaatttcaaaaaaattttgaaataatttttttattttcgaatgtaattcatcataacagaacagaaaaattggttaattttaagtgcaatttgttctaaattgaaaaaattgcatacttttcgattttaattagttatttgaatattttacgcttatttcctgtctattttagggtggttttcttatgtttttttgcctatttcgccatttttgtgccacagccctcatgatcagtcattgttataatttgccatatttggcggttcttttctttaataacaaagaaaacaaaaattttcacacgttttgccattctaaaatagcataacttaattaagttaaatgtcacaactttattttattcatgcgttctcccccccggcaattcttttttttttgtttactccggccgctcgacttcaattgacaaaaatggaaattgcctctctggcacttcccacgccattcattccatcattctgaatttcggcaaatttgcgcatatgacaatttaaatgttttccggcacaaaaataacacacaaaaaatgccaaaagtgaaccccccccccatcaattagagaagcgaaaaatgctggaaaaggggcacaaaaagcggaggaaacaattaacattagcagggaccaaatttaatggttttataattgtatggttttcttaatttaataattttttacgtggttccaaattgccaaatagtcttagattatgccatgacatttattcttcgccataatggtaattttgcattaatataaatttaactttaataagttagtctaaaaaatgcccaaattcgtgataatattgcatacaataatcatttatataataaaagtaaagaagtcgaaatattttatttaaaaagaatttaactttttttaaattttaaataaattcgctttattttgcattaatataattttttagaccgaactttaataagtttggctaacaaaatgctcaaattgctattaatctttcactgatgaaatcattaggattctaaatatttaattttgtttatggatttggattatctttgccaaataaa

SEQ ID NO: 53255 - DNA, 840 bp, Heterodera glycines
  Genomic contig location: Contig_ID=SeqID_22586; Location=160..999; Strand=+
  SCN-specific regions: Sequence locations=1-512,534-840
atgggcaccaaattggagttcaatgtgaatacaaacgaaaccgaggatggacagcgaatttgggatgttttggcccgtcaaatttggccaatttttgctaccaacattcgccatttgtgcttttacgatagcggcaatcatttggacaaattgcgtcgccgtacttcgccgacacttctcaccgattcaaatcaattgatttcaatcgagtcttgtggccttttacccgatgcaattggcgatgatggaccgaatgcaactgctggccaagcgctgtccaaatggctgcacactccgacgaaagacggccaaccgaaggaattttgttcgtatttagctttaatggaaataaacaattggttcgacaatcacaaacaggtggtcgacaaaaaaatttttacgattttgaattgcatttggttaaaatttttacgaaaatgcactttttagtgaaaattttcggctaaaaaccgcaaaatttgatcgttttttgcacaaaatctgttagcaaattgcattcccaattttgtttagacatttctccatgccaccacttctgtcagttacaatgtgcgaattattttttataagacaacaacgccaattgagccatttgaattggtgaacgaacgaaccaaggaaaagctgacatttatgaagaaagatggcggtggtaaattgcttaatgcttggctgttgaaacggtgcccaattattgttggggagacggcggcggcggttcaaaaagacgaaaatttggaccatttgaacggagttcacttccgtctttatgatgattattgcattgggtgagcagcaaagaaggcgccttacttttga

SEQ ID NO: 53256 - DNA, 970 bp, Heterodera glycines
  Genomic contig location: Contig_ID=SeqID_22588; Location=31..1000; Strand=-
  SCN-specific regions: Sequence locations=1-69,122-280
  Gene Ontology: Mol. function=protein binding; Cellular component =axoneme; Biological process=regulation of transcription, DNA -dependent
atgattattgttctctattcgataattaatccaatcaattcccggtaaattcagatcaccacagataagaatattattataattaaattccataatataatctaataattttttaaaatttggtgtagaacattgaggcggcttatacaaagcaaaaatgtgaatcacttttgctaaacaaagtttaatgtgaataatttcacattgaaattttgtcccagaaaaaatttcaagcataggaatatcagtacttattagtatagcacaccctcagaaagtggaagagaaagtggaagaggaacagaaagtggaagaggaacagaaagtggaagaggaagagaaagtggaagaggaacagaagtggaagaggaatagaaagtggaagaggaacagaaagtggaagaggaacagaaagtggaagaggaacagaaagtggaagaggaacagaaagaggaagagaaagtggaagaggaacagaagtggaagaggaatagaaagtggaagaggaacagaaagtggaagaggaacagaaagtggaagaggaacagaaagtggaagaggaacagaaagtgcaagagaaagtggaagaggaagagaaagtggaagaggaacagaaagaggaagagaaagtggaagaggaacagaaagtggaagtggaacagaaagtggaagaggaacagaaagaggaagagaaagtggaagaggaacagaagtggaagaggaatagaaagtggaagaggaacagaaagtggaagaggaacagaaagtggaagaggaacagaaagtggaagaggaacagaaagtgcaagagaaagtggaagaggaagagaaagtggaagaggaacagaaagaggaagagaaagtggaagaggaacagaaagtggaagtggaaaagaaagtggaagaggaacagaaagtggaagaggaacagaaagtggaagaggaacagaaagtggaagaggaacagaaa

SEQ ID NO: 53257 - DNA, 1452 bp, Heterodera glycines
  misc_feature (1400)..(1400): n is a, c, g, or t
  Genomic contig location: Contig_ID=SeqID_22589; Location=1..1452; Strand=-
  SCN-specific regions: Sequence locations=1-1,25-94,136-264,301 -634,684-779,823-1057,1080-1120,1216-1452
ggctgaagatgaggaggaagaacacaagcgatcgctgcaactttatgtgtttgtggccaaatgcattgcctaccatttcaacgccaaacagcccacagacatggccagaaggcaattgaaggtcaatcaacaaacttaaggggcggggctgatcagtaggggcgttcgaaattcattcaaaatttaccgagactcgaaaacatagatcgaccaagattgactcatacactcgagaccgagaattgaccccccagactcgggactggaaaagatcctaagaattaaaactaatgcccaaaaactcaccaaatcttcgactcgaaaacagggaccaataattttgacctatcgagaccgagaattgaccctgatatctcgagacttaaaatttagccatacaaatgggacaatgcaaaaaaaaactaagaatttccgacacgaaaatcgagaattgagaccctcaagcagcttccttgctgaatagatcggtaaatattaatgtttgatattttaaggtcagcaaacatgaactttcaaggacaaaggaacgcttcaacgcatttctcaagggcgacatacaaattccggtgggtggggatggcatttcaatgtgaaagtttgctggaaaattgggaaattttaaaatgataaaataaaaatagagcattttattatttatatttgccatttttttgtgcaacaggcggacgaagcattcacaaaggcaattgagagctattttgagggctttctgaagtcagaaagggtggccaaagtggtaaataatgaatttgttaaaaaataaaaacatttttttaaattctcctatatttttttaagatacaagccggcggcttttccagcaacgattttcgtgaggtaaaaaaattggagaaaataaataattatgaaatttcaaccaaattgtattttcctaattagtcccgaaaatgctaaaaaaatggtttcaaatttttcaaattaaaaatgaatgttaaatttggcaaaattttgctttaatttctttctgacaaaggaatcttccgtcgaagctttgataaaaatataattatttttttctcaggtctttcgctgcaacgttgagagaaggtaaaaaaatttttattaaattaaatttaattttaatttaaaatttaattttaattaatttaattttaatttaaaatttaattttaattaatttaattttaatttttagaattcgatcattgcctgaaattgatggattaagcaaggacacggtgttggcctcatggatggccaaatttgacatgatcatgaagacggaagatgacgcgacccacccgcgacatgccaggcaaaaaacaatggcatttttaaaaaaaaagtatttggcattttgtatttttttaaattgnccaaaattgtaagggtttggcaatttaaaaaaaaaagtagggtgtcacggga

SEQ ID NO: 53258 - DNA, 312 bp, Heterodera glycines
  Genomic contig location: Contig_ID=SeqID_22593; Location=141..452; Strand=-
  SCN-specific regions: Sequence locations=1-20,42-312
atgacaaatgttggcattgtgttggaaaaactgggaaaattgatggcattggcaatgataaagttgaaatcaatttttttgaattgttgccattgtgatggaaaacttggaaatgaattggcatttgatggcaaaattggaaatgaattggcatttgatggcaaaattggaaatgaattggcatttgatggcaaaattggaaatgaattggcatttgatggcaaaattggaaatgaattggcatttgatggcaaaattggaaatgaattggcatttgatggcaaaattggaaatgaattgttgccattgtga

SEQ ID NO: 53259 - DNA, 1062 bp, Heterodera glycines
  Genomic contig location: Contig_ID=SeqID_22594; Location=146..1207; Strand=-
  SCN-specific regions: Sequence locations=1-52,74-169,192-374,403 -439,491-554,576-915,938-1062
atgttggcaattatgcgttgttacaatgagcagtacggtcaccgtaaccagaaaaaatcaaaggcgaagagtttgcgtgaccgtttaaaagatgagctgcacggcgatgtggaaaggctggcgttggatttgttggagggaaatcgcaacgaacgaacggattttgtgccaaactgtgagcgggcggaagaagtgagtgtggacaaacaggacaaggctcttctgccgggatatttttcaccttcgatcctgagcctgaatttttcaaaattccgggcttaagacaaataacagcaaacggaccctcatgtttcttccttctgtcaaagaacttgcacaagcagcgagttttttaaattttagatttcaatttgctacccaaaacccaaaaaatatcaaaaaggggtagtattcggcatgcccatcggcgatcctagagaaaaatagaaaatttcttaaaatatatttttaattaaaattgataaattttgaaaaatccgtcaacattcgacaaaaaggcaaatttagaaataatgacactttcagccttgaggtaaaactttgcacattttttccacattacatattcggctttttttcaatgggaaaactttctatattcgatcttttctctccttaaggctaaattagcccgaatgtttggtttaattagtgtagtaacaaattttcgattttttgtgacccatttttcgacattttattcagcaagccgctgaactgcacaaccccggcgagggaccgctaggcaaaataagaaaggccactgctcgtgtattgcttggtcaagaaagcacttcacttagtgtcaaatatttcatcgaatttttggcaaatgaacattttcgacaattgcgtttgatgttcgaaatggtaaaaattgtttaaaaaaatctccaatatttttcattgaaaaaatacggtttacctcaattgggcccgctcgtttggggcccagcatgctttccactataacttttttctttgccatacaaatacatcaatcttgatattttagaaagcttaacatattttcttaataaa

SEQ ID NO: 53260 - DNA, 293 bp, Heterodera glycines
  Genomic contig location: Contig_ID=SeqID_22595; Location=436..728; Strand=+
  SCN-specific regions: Sequence locations=1-293
aatttcgcttgacgaaagcggcgacttttcattgtatttggacggcacaaaacgtgtggcattggtgcacattgctgacggcaatgtgccgcatgagtacccaacggagcacgaatggacggcacggacaacgatcgagcgatcaaatgccattttgtcgccaaacattcgcttccacctgagcagcaccaagaaaattcagcaggtccagccaaattaatttttcaaaaaatactctaatttcatcccattcaaacaaaaaatttaaaattgtcaaattaacaaatcattta

SEQ ID NO: 53261 - DNA, 1656 bp, Heterodera glycines
  Genomic contig location: Contig_ID=SeqID_4121; Location=994..2649; Strand=-
  SCN-specific regions: Sequence locations=1-39,69-888,911-949,971 -1054,1076-1126,1160-1502,1524-1656
  Gene Ontology: Mol. function=pre-mRNA splicing factor activity; Cellular component=spliceosome complex; Biological process=RNA splicing
atggttgaatccgagcttgaccggttggagcatttgaatttggtgtcaagagttgtcacagagttggagaatcattttggcattagtgagcgcgatgttgcagaatttataattgagctggctcgaacatcgtcaacatttgacaaattcaagaaaagtttggaggagcatggcctggctgatggggtgagtacagtctttagtactaaattggttttttaataaaaaaatgtaattgtcctattggcgttttaaaaaataaactgccttcattgtcagtttgacgactcattggctcaacatattctccgcttggtattgaacatggaaaagaaaaagagacaacggaattccccttccattgtcgccacaataaaagatgagaaaagtgcgttgaaggaaatggtgccggcgcttgccatgccgaacacagcgaacactttgctcgacgaattggagggactgaagcagaaatgggaggaggaacaacagacaaaaaaggtgtctattcaagttcagtgccaattgttttacacgaccaatccgagttcaggatgaagaggtgcgtcgctcaaagagtcgcagtcgtagcagaagtcccagtgacgggcgaaaacggcgaaggcgtgactacagtgaacggacgtgtgaaacccagtcgaggagacgccacgacagacgcagtcgatcgccacacagcagacgaagggggggagggggagggacgagtcggtcgcggtcgccccggaaaagcagcaaaccgctacgagaggaagttgaaatgaacgcaatttatgatggcaaagtgaacaacatcacgaactttggagcctttatagaggtatttgttggtactgaattttctaattaaccaaaaattccaaacccataatttttccatttactttttcagttggaaggttttcgccgccgcaccgagggacttgtgcacatttcacaaatcaaaaatgagcgtgtcaatgccgtggccgatgtgcttcgccgagggcaaagagtgaaggtcaaggtgagttgtcatttttgatatattcttttgtacattttaaatggtaattccacccctttgcaggtcattaagacagtcgactcgaaagtatctctgtcgatgaaggaggtggaccagcagaccggcaaagacttgaacgccgctatgccgatcagtgctgctgccgtggcgggatccgacaacagttttctgaccaacccggacgccccttggcttaatccgtcctctgaaaaaatgtcgacaaagctcacacaaaattcgaagccctcgcgcattcgtctgtccacgcctgagcgatgggaactccgtcaaatgcaaggcggcggtgcaatcacaatgatggatctacctgactttgaccaggaattgggagtcttgaaaaactacgaaggtaggatactagagagatctaaaaaagaaacattggaagttataaataaattgccatctcttttacagaggaaagcgatggcgaagacattgaaattgaactcgttgaagacgacccagactttctgaagggttatggcaaacatgttgctgatctcgagccggtcaaggtggtcaaaaatccggacggaagtctggctcaagcagcgctcatgcaggttcagtggattgaattttaa

SEQ ID NO: 53262 - DNA, 514 bp, Heterodera glycines
  Genomic contig location: Contig_ID=SeqID_4123; Location=148..661; Strand=-
  SCN-specific regions: Sequence locations=1-33,56-123,155-356,378-514
atggctgatgtcgagtcggaggagctgttggcgagtcagaagctgcaaaatgcattggattacgtcgaagactcagtgaacagaggaatcaacattgttgttcattggtcagttgggcataccaatattatatatacatattattatattttttcattagggttttattcgaatttaatgttagtaggttcaaaatgtagtagcctatctatattcagtcaatgtggcataagccgatcggcaacagttgtgatggcttatctgatgaggaaatacaaatggaatgttaacgattcgttttcttttgtgaaagcgcgacgttcatgcgttcagttaaacgaacatattttgtaatgcatataaatttttatatttttgaggccaaatccgtctttcttacgacaattggaagttttccagaagttggactatcgttgtgacttgctaactctgcgcaactcgaagctgttcaaggaattcgaatgcatttccgaaaatccatccgaagtcagtc

SEQ ID NO: 53263 - DNA, 60 bp, Heterodera glycines
  Genomic contig location: Contig_ID=SeqID_4124; Location=84..143; Strand=-
  SCN-specific regions: Sequence locations=1-60
gttctcgttacggtgcttcaattccatttgaaaaagcaatgcgaccggaagtaattattg

SEQ ID NO: 53264 - DNA, 575 bp, Heterodera glycines
  Genomic contig location: Contig_ID=SeqID_22597; Location=584..1158; Strand=-
  SCN-specific regions: Sequence locations=1-143,165-258,301-361,383 -512,542-550
atgattctttttgttaagacaaaggaatttgattaccgtgtttggtccgctcagatgctcagtgaacttgaagagaataatgcgcttactgtgggttattttagttgttttgcatttattttttcattttttagattgaccattagcaaaaaagcaaatgcttcttcctctgatttcgttttttcgtattacaagggattcttttttatgaaaaacgcaaaagtatagctaaagtatgtatgaaatatgtacaaaatgtaaataaaattttaaaaatggttattttttagaaaaaaaattcctcgtaaagggtgaaataggaacaaaatagcacaaaattgttacctaaatggcgcagaatcacattttactattttaaaagttaatttttgattgattttttaggagtacatttaaaaaattttatttttcacaagaaattactataattctcaaaaatcttcaaaatagctaaaaattgcaaaatatgtgcaaaaaatgtgaaagagttgtataaaaatatttacatatataatatatagaaaccccgtaaatatgtaaaatatataaataaa

SEQ ID NO: 53265 - DNA, 847 bp, Heterodera glycines
  Genomic contig location: Contig_ID=SeqID_22598; Location=298..1144; Strand=-
  SCN-specific regions: Sequence locations=1-341,363-596,632-847
atgggaggacgaaatcgttcgggcaccacattttccaattccgccggcactttttttcaaattgagggatatgcattaaaattgaaggattcgaaaaatgtgatgattcaatgtccgtgttccgtaatgaattttattgaatgtttaataaaattatttttttcaatgtgtgaagctgagggtgggtctatagagagaattcggatcacataggagccctaaaacttgttcgaattttgatcagcactctttttaggagcttcgaattttttttgctattttatgtttatattgtgtctggggttaggaaatgggttatataaatgtcgtattcgtattcagcgaccccgaaaaccttaatttagacccattttccggctttttaatagctttttcgagttttggacacttcgtgggtttttactcttttggacatttcgtggcttggacatttcgtggcttggacaattcgtggcttggacatttcgtggcttggacattttgtgggtcagcggttaattcaacattaaaaaaattaccggtatatattattcatcttcatatgatatggaacaatcaatattatatacaaacaacagtataccctataataataataatattgttgattatcacatatttacagcatttatatcacaataattgttggcataatagcattcatccattctttctctttcatctctctctttcatctctgttctcacaagcccttgttgtaatagaccaattcaggcactggcacatttttggccacaaatttctgacgaatttgttcctgcaattcgagctccaactgcgccacgcaacaaaaagaccaattaaa

SEQ ID NO: 53266 - DNA, 559 bp, Heterodera glycines
  Genomic contig location: Contig_ID=SeqID_22598; Location=1163..1721; Strand=-
  SCN-specific regions: Sequence locations=1-431,453-559
atgacctttgagcgcggaaaaaccaattttgggtgagattgtctatggttgaaaggtatgtttgaagcgccgcaaaaaatttatttccaaactattcaggatttagattcacacaccactcaggaaattgctgaagatgcacaaatcgagtttttctcaattatcttggccgtcttctcctggaatgccaatgttcttcctttacttctctcgaacatatatcggcttgacacagcgccagaagttggatggtgttgacgcattttgagataatccactcaattttcacccaccggcaaccattgtttgttagatttaggcatttatttccaaaaactaaaatttttagctacactcgggacaataatttcgactatcaactcggaacaagctatgcggctacccctagagttcggcaccggcaccatcaactcttacatggccaaccactgtgagtccacgggagcagcttgttcaatactcgttgagcccgctatcgacttcggcagcgccttcaggcagaattatttaatcaattcatccgtttaaatttaataaa

SEQ ID NO: 53267 - DNA, 691 bp, Heterodera glycines
  Genomic contig location: Contig_ID=SeqID_22601; Location=343..1033; Strand=+
  SCN-specific regions: Sequence locations=1-140,162-179,208-423,444 -453,478-653,679-691
atggtcaccaaggagggaatcaccttatggtgcacacgcatagaaaaagcgcagtttgtcccttttgacattgtctacgagctccccggtcattgttttttccgcgtgaaaaataaggcaagggtgttcagcgttccgtacagcgaactgccgtcctcagacaggtgcgcccagcctctacccccaccaccaccaccaccaccaccaatgacaacagcaaaacatcaacggacaccggacgacgaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaagcgtaaaactgataaactcgctctgccctatatataaaagttgttgattgctgcacgatttgtcataatttttgaaaatgttaaattctcaatcgttcagta

SEQ ID NO: 53268 - DNA, 658 bp, Heterodera glycines
  Genomic contig location: Contig_ID=SeqID_22601; Location=1670..2327; Strand=+
  SCN-specific regions: Sequence locations=1-13,52-72,95-511,533 -538,572-658
atggagcggtataaacggcaacaacaacgacaacaacaacaacaacaacaagctaaagttactcaactaataaaagataatgccaactggctttgcgcactgtcgaaggcaaaatgtgtgaaacgatgcgggagactgatcagaaaggcgaacactgatcagctgctgtcactggtggaagtgtgcttgaacattgttgcttcctgattcagactgacaactcggcagaagaaacgactaatgccctacgtggacacggtgcgccgcgtgagtgagcgagaagtgagagggacgctaagcgagcgcttgtcatccagaaaggagaggggtttggcggactatttgcagcccttttaacccccgtattaattgaattggccaaatcggttgtgacccgaaaagaaaggaatatgcggacagaccaacaaaagttgagctgaccagggaaataagtgtaatgatgaatagaggtggcgaaggcttagataaatcatgcaaagtttaaataatcacaaaatacaagtaatatacatagccgaatttaaaaaaaatataaattacaaatatttttgatacagcaaaaaattaaaattaaatccagattagcgagtgataaaaaacttacaattgttaaactgcccatttgatttttgaccaa

SEQ ID NO: 53269 - DNA, 1261 bp, Heterodera glycines
  Genomic contig location: Contig_ID=SeqID_22603; Location=758..2018; Strand=-
  SCN-specific regions: Sequence locations=1-122,156-181,204-476,499 -536,560-604,626-1015,1037-1261
gacgcggaatccttggaaaaatttttccatcaaaaaataaagaggcacatgcagaattggacgaggttgacgaaattattgaggagccgtttttattaggaagtgccctggcatctgctgcggatggtggtggtggtgatgatggtgatgatgatcaccttattgtagttggggaggatgtaagttaattaattaattattaacatttcaattactcaattttgtttaaaggcaaatggtcctcctaaaaagaagaccaaacgaggagggaagaaataccgttaattgcgtgataaagcgaaagagctgcgagcgtcaactgtggaatcagcgagtgtggtgtcaacatgatcaatcaacatatcaaaatttaaaaaaattcctatggaatatgctcaaagagttgcgcaacttcgcgagcatcgcaaaacaaaattatgtggaatcggcaaggagttggtcaatgtgagaagggggaggggagtgcaggattaaaaatttatgaattctttgcatttacgaagagttttaaaagcaaataaaataattaattatttttcgtttcgatatcgaatttaaaaattttttgacaaattgcagattattttcagttctttaattttaaacatatggaattcttcactgcgcgacagcagcgtgtccaattgcccgaggggttggcaacggtcgaacaaattgaaaaatttagtgagggaatgacatttcaaggaatacataatggcgcaatttgtactgttgatttccaggtatttttaaacagaatataaatcacattttaaaattctccacatatttttagaacaattaattttaagcggtggtgttgacaaatatgtgacattaaacaaatttaatgaggaggacacccaaagaaggacttttatcgggcattcggctaaaatttcaaaagtttgtttacatccaagcattgaaacatttgtctagggctcatttgattcgcaggtctgtttaaagggttttatatcttttttttgaatattttgttttcaattacccaatcaattttttcattaagatccgaatttggagtgtagatcagtgtacatcaatccacacaattgcaattcatggcaaagctgtgaacgacgtgtcgttccacccgactggcgactttgtgctctgctcctctgaggactcgcattggtcgctaatcgatctcaatgctggacgccctttggtcaaagtcggagaacagtcggagaacaacatattttattaa

SEQ ID NO: 53270 - DNA, 352 bp, Heterodera glycines
  Genomic contig location: Contig_ID=SeqID_22604; Location=620..971; Strand=+
  SCN-specific regions: Sequence locations=1-74,96-176,198-352
  Gene Ontology: Mol. function=isovaleryl-CoA dehydrogenase activity; Cellular component=mitochondrial matrix
ggcattttggctgatcaccgctttttccttacattattatgcgctgcttcttcccccgtgtcgtccgaagtgttttcccctcgcccctttccttcgtccgttcctctctctccactttttatcccatcgatgaccaattgttcggtttggacgaggaacaacgacaggtgttcggacttttttctgatagtttctccattccttccgttagcttcgtcaattggtctttcgactcgctcaaaaggaattggccccttttgctgatgaattgaccgtcaaaatgaattcacaaaacttcgcgatttttggcgattgcttggtcaacaggccttttgtgggtcacagtgccagc

SEQ ID NO: 53271 - DNA, 572 bp, Heterodera glycines
  Genomic contig location: Contig_ID=SeqID_22605; Location=1..572; Strand=+
  SCN-specific regions: Sequence locations=1-337,359-437,461-572
  Gene Ontology: Mol. function=acyl-CoA dehydrogenase activity; Cellular component=mitochondrion; Biological process=energy pathways
ccccccccccctcccgcagactgatgcaagccgcttgtgacgtcgccttcgaatatgcccattcgcgcattgccttcagcagtcccatcggcacatttcaggcaaagcccaagtgcctttggcaatcgcatggacacgcccattttcagctaatgcaaggcaaattagcggatatgtacgtgcgtttgtccgcttccagggcgtatttatacgcagtggcaaaaaatgcggcggactcagacgaaggattaaacgcaaaagtttgtcaacttctgacaactttgtgatcaaacacttattataaaggattctgctggaacgatcctttttttggccgaaaatgcaacacaaatggcattggacgccattcaggtcaaataaacaggggggggggggtgaccaaaggatgtaccgacgcagcaaccgatcaggtgctgggagggaacggctacatcaacgattaccccacgggacggctgcttagagatgcgaaattgtacgaaattggggcagggacgtcagaagtacgtcggttggtgatcggaagagcattgaacagagaatatatgaaa

SEQ ID NO: 53272 - DNA, 315 bp, Heterodera glycines
  Genomic contig location: Contig_ID=SeqID_22605; Location=790..1104; Strand=-
  SCN-specific regions: Sequence locations=1-315
atgttctaccagccctggtcgtttatgaagcggacgccgtccgtcgccaaagccaatgatttccaaaaacgccccgaagggcgacaatttctgctccgatgggtcagtcggcgtgccatcccaatcatccccccccattttaagccttccgccgatcattttggaaaacggtcaactgtcgtcccattgatgcgattcggccgtcgaccagcggaaagggcggcccctctgattcggttcgggaaacgagcttatattcggacagatgccgcaccactgatcagattcggaaggagttcagaagagagaaaatga

SEQ ID NO: 53273 - DNA, 1137 bp, Heterodera glycines
  Genomic contig location: Contig_ID=SeqID_22606; Location=232..1368; Strand=+
  SCN-specific regions: Sequence locations=1-271,317-514,577-602,624 -1060,1082-1137
atgccacttgtcaccgacatcacagtttggcaggggccgaacacggaagagaaaatgatgcgcgaaattatgacaaatgggccagtccaagttgcatacaacatttacgaagatttccatcgctgttgcgcaaacggcgaaatatatcaagtaaccataggggagattttggcgatatgtaaaaggagtaggactccgatttccgaaattttttggcttcaaaatgcctattttgctttcattttgggcgcctcggaatgccagccatcccttttatatataatataaatacatatttattgaaatttttaaaaatgcacgtttatactgtagcaattgctttaattagaaaaaaattttgattaatattttctgctaaactactatattatcggcccggtacagtatgacacaaaaatatattggcatatccaatttgtgaaaaattttatctgctattgatcagactgttttttagaagggatttttctaacaatatgtgggtggaatgtagtttttttattttaatttgtaatctttttaaaatgtatattaaatattcttaaaattttaattccgatgtaatttttgttgctgaaccaaaaatatattggaaaattttagaaaaaaaaataattcagataagtaatacatagaatttttttaaaaattcggtatgcctaggtaattttgtgtcacactgtaacacttctctctaccgtacttaaacctaattttatgtagcacggtgtcaacagtacaaaaactgaattcgcacattcggtgacggcaattggttggggtgaagcgaacggtaccaaatatgggctgcttgccaacacgtggggcacagagttaaaccgagcaactaattattagggcttcctttttacaggcaaatatgcctaaattttctgcgcattcatacgctcaaaataagcacgaaaaacgcgttttccttggtttgggatttctacggtaacttttataatgcctatttttgcctgttccggcatttttgtgtctaatgtgccaattttggaaaaaatccttaacaaaattgctataaaaatgaaaaacacactcctaagaaatgactaacaaaagtttcagaaaatactcccctaaaaattgaaa

SEQ ID NO: 53274 - DNA, 289 bp, Heterodera glycines
  Genomic contig location: Contig_ID=SeqID_22608; Location=306..594; Strand=+
  SCN-specific regions: Sequence locations=1-43,67-132,154-257,279-289
atggtacgaaatattggaggatgacgacgacaacgtaaaaaaattttttgttgtaaattgtatttcataaattattttattccagattttacattggttcaccccaaagaaggcgcgtgacgtgtgccaggaggttttggaatttgcacaagaacgaggaatgccttgcgagaagttgaccaaatggatgaaaattctcaacaaaatttgcgccccacgacttgaagaatcgaagtgacctgatctctttcaatgtgaagaaattcctctgtatttctctcaatgctaa

SEQ ID NO: 53275 - DNA, 573 bp, Heterodera glycines
  Genomic contig location: Contig_ID=SeqID_22608; Location=829..1401; Strand=+
  SCN-specific regions: Sequence locations=1-573
atgtccgacaaaagatcccttgtcaatcaaattctcgcccaatcggacatcactgtgacaacaagcggcataactgtgagcggtcctcgtctctccactccacggttcatacctttcgatgagtgtggtcgctgccgtgcatgtaaagcaaccgaagttgaggtggacctaatggtgaccaaagaggggatcaccttgtggtgcagtcggatcagcaaagcccaattcgtcccatttgatgtcgtttacgacctaccaggccactgcttcttccgtgtgaaaaacaaggccagagtgttcaatgtaccctatggagatttaccttctgacacgtgtacccccaccccgaccaccactccaacccaaggcacacaagccggagagcaacagcaggacttgaagcgaaaggcgaaggtagctcttgacttggtggaagctgggctaatggccgatgccatgcaggacggcacgcgttggaagaaggccaaaaccgcaatcaatgtgcttggaaatctccttttagcggaatctctggacaaaaaagtgacaaatagccctgtggaggaagaaaag

SEQ ID NO: 53276 - DNA, 1709 bp, Heterodera glycines
  Genomic contig location: Contig_ID=SeqID_4125; Location=1042..2750; Strand=-
  SCN-specific regions: Sequence locations=1-677,707-901,923-1140,1163 -1477,1500-1550,1572-1709
atgtcttctacagagcgagtgatgagtgaggaggaatttaatgagtggtttggggcaggggccagagttcgtggcacttgtgaaaaaccaacaatgtttgataacgtgcgcggcttgataattgacttgcgccacctgtttggcatgctttcgctttttaaagtgcttggtgtagagtcaccctcaagtgggcaggggcaaattactgcatcggaaagcatcactacagaaggctcgagtgcagttgttcgtaaatatagacgttatgcacttctttgtcacccggataagcggatgaagtgatttttgcatgaaattataattttcaagtgttattaaatttttttctataatcagcagcaaccattttatttagtcaatttcctgaggaaaagaagaaggataccgaacgttttcaaataatacaaaatttatttgattgttggaaagctgctgcggattactttgtgacaggctgttggtcccatgcggatacacatgcggagaacaagtacaatttttggacggactatattaacggtaagtgatatagaattatatttttttatctaaaaaagaatttaagtattggacaccatcgaaggatgggaggttgtgttcaaacagcagcaagaagaacattttgaatcgttggcagcggccatcaaacggttgtgttttttaaatgttttaattatttttttaacagtttgaaagatgcttgtccgttacttacgcatacgcattcatcatatgtgcaccagtgatgtgccgagccagacaaaatccgattccgattaaatcgccgattccgattatggccaaaaatccgatacggttttaaaaccgattacgattatggcccaaaatccgattaattgcgattccgattacgattccgattttttaaaaataattttttcccaaaaattttattcataatcaaaatcataaattttaagattgtgatgcaaaaataaaagtttgtccacattctgaggcaataaacgttttctcagatctgtcacaatcaacccagcggtggagaaaagccgttcgctttcagtcgatgtagctggggctgagaaatatttttttgattgcttagattcggaaacgaaatgtcttctgcatacagaagcccaacaactgttttgttttgcaaaaaacgatcaagcatttggaaggtggatgaccaacgcacctgataggaaaattgcaacttagtaataattcattcatggttcttttctgctttaatgtcccaacaaattttttcttcaaaatttcgacttttggttcgaattcgggtccgggattcaaaaatacttgaattggctgccatgttcttaaactgacaccattaacaacccttcaaagactttgacatttttgctaaataacaaaaaacttgattatatcggggagaattaacccggcactgctttgtgagaaaaatttaatttcagtcattatgttaaaataagattaaaacattcgtttcagaaaacatttttttcaaaattcattggtattctcgctaaaaaaaattccttcaaaggtcaattcttatgggtgtaataatcggatttcaagccaaaatccgattacgattatccgattccgattatggcccaaaatccgattaattgcgattccgattacgattacgattccgattcggcacatccctgctatgtaccaataaa

SEQ ID NO: 53277 - DNA, 138 bp, Heterodera glycines
  Genomic contig location: Contig_ID=SeqID_4125; Location=1855..1992; Strand=+
  SCN-specific regions: Sequence locations=1-138
tcgtaatcggaatcgcaattaatcggattttgggccataatcgtaatcggttttaaaaccgtatcggatttttggccataatcggaatcggcgatttaatcggaatcggattttgtctggctcggcacatcactggtg

SEQ ID NO: 53278 - DNA, 524 bp, Heterodera glycines
  Genomic contig location: Contig_ID=SeqID_4126; Location=1414..1937; Strand=+
  SCN-specific regions: Sequence locations=1-165,187-254,284-524
atgggcatgacaattgcgtgtggccgcccctgcccaatggccgttgcacgccacagcaaaaacaacgaattagttgctgcacatcatacttttgcaacaattcaatctcatccgctggtctcgcatttcgcggtaagcgccctagacttatagtacttgaactacgtccctgcctcaatgttggtttctttgcagtcgcgtgcacagatgatgaatgcgtatgcgtaagtaacggacaagcatctttcaaactgttaaaaaaataattaaaacatttaaaaaacacaaccgtttgatggccgctgccaacgattcaaaatgttcttcttgctgctgtttcaacacaacctcccatccttcgatggtgtccaatacttaaattcttttttagataaaaaaatataattctatatcacttaccgttaatatagtccgtccaaaaattgtacttgtctccgcatgtgtatccgcatgggaccaacagcctgtcacaaagtaatccgcagcagctttccaacaatcaa

SEQ ID NO: 53279 - DNA, 559 bp, Heterodera glycines
  Genomic contig location: Contig_ID=SeqID_4127; Location=463..1021; Strand=-
  SCN-specific regions: Sequence locations=1-200,223-332,354-538
atgcgtgaagacctcggtaagagcgaacggaaaaatatgatctttaaaattggcattcaaaaaaaaatttcctaaaatcaaaaaaaaatttataaagattttgtttgtttgtttttttgaaaatcttccagaatttttgggttccgggaacatacataagttaattaaagtgctgaatccaatcctccaaacttttgtgcctatttaaaaattgttttccccattatccagggatggtgatgtgcctgctctcctacggtgccggcctcgacgagcaggcggacagtggcaaaatgacggcactgcattttgcggtgtccaatcgcagcctgcagatcacgcgcttgctgctctgtctgggcgccgacccgaacgtgaacaatgcgcacggggagactccacggcatttggccgccatattgaacgagtaatttaattgattttttgaggttaattcattttggggcccactgtcagttattcttcacccatttttgagaccgcgacgttttgagcaccttgccctttcgcccctggaaaaattaaacagtttaataaa

SEQ ID NO: 53280 - DNA, 1012 bp, Heterodera glycines
  Genomic contig location: Contig_ID=SeqID_22610; Location=26..1037; Strand=+
  SCN-specific regions: Sequence locations=1-1012
acactgggactcaacccaccaactttcaatggcattccaatctctgggactcacccacccagcagcatttcaatctctgagaatcaacccaccagcatttcaatctctgggactcaacacaccagcatttcaatctctgttactcaaatctccggcattccagacactgggactcaacccaccagcatttcaatgtcattccaatctctgggactcaacccaccagcatttcaagctctgagactcaattctcaggctttccaatcgctgggactcaacccaccaacatttcaatctctgggactcaaatctccggcattccaaacactgggactcaacccaccaactttcaatggcattccaatctctgggactcaacccaccagcatttcaatctcggtgactcaaatctccggcattccagacactgggactcaacccaccagcatttcaatctctgagactcaattctcaggctttccaatcgctgggactcaacccaccagcatttcaatgtctgggactaaaatctccggcattccagacactgggactcaacccaccaactttcaatggcattccaatctctggggctcaacccaccagcatttcaatctctgagactcaacccaccagcatttcaatctctgggactcaacacaccagcatttcaatctctgggactcaaatctccggcattccagacactgggactcaacccaccagcattttaatttcattccaatctctgggactcaacccaccagcatttcaaactctgagactcaattctcaggctttccaatcgctggaactcaacccaccaacatttcaatctctgggactcaaatctccggcattccaaacactgggactcaacccaccaactttcaatggccttccaatctctgggactcaacccaccaactttcaatggccttccaatctctgggactcaacccaccagcatttcaatctctgggactcaacccaccagcatttcaatctctga

SEQ ID NO: 53281 - DNA, 946 bp, Heterodera glycines
  Genomic contig location: Contig_ID=SeqID_22611; Location=40..985; Strand=-
  SCN-specific regions: Sequence locations=1-366,398-402,424-582,604 -811,834-857,879-882,904-946
atggcagacgaaattcaacaaaaaattgttcagcgaattgatcaggactttttttcggtgacctctgatgggtggtctcaaattacaaaatcacccgcgctcttaaggttttatactcctttttttcatggtttatatcaacagattttagtgttactctacaccatgtaaatgaatactttgaacgcgccgattttgtacttgatgtgattccaatgacaaatcacacgggaatttacatagcagaagaaatcgcaaattcacttcggacaaatggaaacccagaaaaaataatttgtttggtttgcgataacgcaaaaaacatgataagggcctccaatatttcgaacttgaataggttttaccaaattttagtttttttataattattttttaagctttcaatgtgtgtgccattttcttcatcttgttatgggagacgtattgggactgcctgagttggcaggacttatttccaaaattcggtcttgggttaccttttttcgtacaagtaagggcatgtccttgctccgcgggtaccaagaaaagacaaattcgaagccaaaaaaactcataatggttttataaattaatgttttcaaaatcttcatttaaattaaggcctgcccgacccgttggaattcgacttttgaaatgatgatggcatttcgtgaacaaaaaaacgttcttttaaccattgaaggagaaagacgtggattcggtgttggcccatcaaaaaagtcgcgcctcgacattgtcgcagaaaatttgccaaatttggaaattaccgactttgattttttgcgcgaactgtgccctttattgggagtttttcatcgagagactttaaaggcaagtgaaatatgtaaaaactaaaaataattgtgaataatttcagttttctaatgaaaaatcgtcagcatcaaccgttatttcgactattaaa

SEQ ID NO: 53282 - DNA, 148 bp, Heterodera glycines
  Genomic contig location: Contig_ID=SeqID_22611; Location=1129..1276; Strand=-
  SCN-specific regions: Sequence locations=1-148
atggcaaagaatatgaaaaatatttgcaaaaatctgaccagtctacggtaatataaacttcgtttttacctcaaattaaaaaaaattcagaaaaaccaagggattaccaaattctttggcaaagaagacccaaaaaaaaggtggatga

SEQ ID NO: 53283 - DNA, 1299 bp, Heterodera glycines
  Genomic contig location: Contig_ID=SeqID_22612; Location=58..1356; Strand=-
  SCN-specific regions: Sequence locations=1-106,129-231,288-333,362 -405,431-540,580-869,899-1064,1086-1168,1190-1299
atggtactgacaattttggcaattttttgcttggcatttgttcatattggcatttctggcaaatacgataagtcggacgagcacgatggcaaatatggtgctggtccccctggtggctggctacccacatgacaacaacaacaacaacttaaaatcaaaatttgaatttcaaaattaattcagaacactcaccgaagcggcggtggacacggattgtccatcatggaaaagtaaattattaaatgtattttaatgcattagttaattgtttttaaaaattaaattaagaccggatgaacaattgttgttacgtgcagactgagtaaaggattgataaaaatatgaatttttataaaattatcccaaaataattagcgaaaaatttaatcattttttgggtaagtttcaattaaattaaccaaaaataaattttcatcaattttggtataaacctttaaatataatctttcaattacagatgctacaacaagcaaataggacaaaagagttgcgacaaccaattttgtgaatgtatggaggtaaattaattttttaaattaaattaaaattttaaaataacaactaaattttagagggcaactgctggcaaaaaacgttgctcaatttgggaggggccaggcttctgtcgtcactaccgcttatacggcggatcagcctaccgcgaagcggctccgtaagtgttcattcattaattagaggcaattaatttacgaaattgtgcgacaatcgtgctaggcgctaaatagctaagcactggtcaaacaaggctatgacggagtcagtcagagccagtcaggaaggggagctatagccttacatttttatggcatttttgctgggactaaacgaattttttgtaaaaataaataaataaaaagttccaaatatggttattaatgtttcacccatttctagcccattttggagcagttgtggcaccgttttgaacagcgaaaaatatttgggttgtccctgcggcacgtacaaaacatgggaacgctgtgatttcacatgcaaatccatcggtgagtttaaatttgagctaattaatgaaacattttatttacatcatctattttatatatatggatacgatttttaggctctaaaaactgccaaaataggtaggcactaggttctaaaaaaactccaaaatgggcactaaaaagctttaatttagggggtgtaaaatgacaaaatgcatcaaaaaggtaacaaaattaagccaaatcacttttgagatacacaatttttaaaaaaattcttgtcaaaaataaa

SEQ ID NO: 53284 - DNA, 1262 bp, Heterodera glycines
  Genomic contig location: Contig_ID=SeqID_22613; Location=477..1738; Strand=+
  SCN-specific regions: Sequence locations=1-178,202-271,322-524,553 -657,679-823,845-1047,1070-1262
atggacgcgatggaatgcgatgaagtgagtgaagataagtaccaaaaaaatgccaaaaacttttcggttgaggtcgaagtgccgccaaaaaagaaagaaaggtccgtcttctcggctgagcaattggacagattggagcgcgaatttgtggccaacaaatatttgagtgcttttcaacgggaaaaattggccaaggaaaatggccttacggaaacgcaagtgaaagtgggaaaatattttactatataatatcggtcaaaaatattgcttcaaattttttttttaacaaaaaattgtttttttcaataataaaattttattcctttgttatgccaaaagaatatggcctaacaaaaaagcaaatatacacgaacagatttgctgaacctataaaaggcaatccgatagagaattttgtcctcttttttagaggcctattcaatttcccaaaaaaattttcccaaccccttaggaatattttcgaaaattttagcaattttcagtttgtataaactatagtgaacgccccgtgaaaaatgggttaaatgatataccaatcgattcgtctcaaggagctaagcatggaaaaatatgtctcgagttgcggaaatgccaaaaaaccggtttttgaatcggttcaaaactcgaaaaattgagtgaaaagggggacctctgaacctttaagacggtcaaattcggacaaatttggtatcattcgaaagctcttgatcagctaagtctaaaaaaacaaggtataaattcgaaccgatgccatctaggcactggacaactgagtcccagtgaaaatggacacttcagtaccaaaaaaaattttaaaaaatttcatcttatataatgcacgaaaatcgtttaaccttgaatatcgagtattgcgctaaaaaaccgccgcacactcgactacggcggccagtaggtggggcgagactacggaagaagtccgcgcgtgatccgcaggcggttgactgattggcaaagccaattggccagcttcgacgaattaacaccgaaccgatcttcacatgaccgcagatttatcctaattatatgattcgcacttaaacaagataatataaagacctcagctcaacatacttccaagctgatgtttgcacagtactacaaccaaatgcaccttataatgtgagactgcagaccaagaagcttacactcacgagggcttgacggccacctgacattcttctcggagtgctacgtattgaaaccagttgattgttagacaa

SEQ ID NO: 53285 - DNA, 448 bp, Heterodera glycines
  Genomic contig location: Contig_ID=SeqID_22614; Location=597..1044; Strand=+
  SCN-specific regions: Sequence locations=1-44,77-448
atgcaaattcgattcgcggatttggaaatggattgtgactcggttgtgctgtcttcttcatcttcgtcgttgtccaaaacaatggagagtgaaactaatgaggacgaaattgaccaagaagagcagggaaacgaacacactcaagcggaagaggacgtaagcgattgtttgtgttattacgcctttattaagtgccttttagacttcccaccatcagcagaaatgttatgttgcgaaatgcttagactccattgcaaaactgcaaaggacgttccaattaagcaatggtctttccttcttcattcatattgacattttataattatttccctcttcagcctcggcggatgttttggaccgtgccgccgattatatgcaactttatttggaccgttatgcgaatgggaagttcggcgcagatgtgcgtttgttttctgttagcatttaa

SEQ ID NO: 53286 - DNA, 617 bp, Heterodera glycines
  Genomic contig location: Contig_ID=SeqID_22615; Location=11..627; Strand=+
  SCN-specific regions: Sequence locations=1-103,129-617
atggtcagacagcagcacataagagaacagctggaggaagctgatcagctgcacgaccaaattgtagaagcggaacagcaaaacgacgaaaacgaggatcctgccctgcaacagcagcaacagcagcgtcaaatcatgttgcaggagcaatacgagaggaaagtacgtctgcagctgcgcgaaagccggcgattcagcagcggtgcggcgtcgtcacttgtggtgcccccagccaatttgtactgggagcgcgaatgtctgatctgtacggacgcgcccgccaactttttcaaccgttcatgcggccacgtgtgcctttgttcagactgcgctgtgaattgtgttcttcacaaaatacccacgtgcattctatgccgcgcggtagtgagtggcatttatgcattcgttcgttgaattatgatgtgagtgagaaatggcacttttcatattaatcaattcgctaccttcactcactcatatcaaaatggccaatgattcacaatatttgtaacccaataattcatcacttattttctctctggttttacgtgacttaccatcctttgaattaatttgcattccgttttttttcaactgcattttcaattaatcggcaa

SEQ ID NO: 53287 - DNA, 65 bp, Heterodera glycines
  Genomic contig location: Contig_ID=SeqID_22616; Location=409..473; Strand=-
  SCN-specific regions: Sequence locations=1-65
atggacattttgacagtgaactcatttggactgaagcagacaattggacagcggacattgcgaca

SEQ ID NO: 53288 - DNA, 347 bp, Heterodera glycines
  Genomic contig location: Contig_ID=SeqID_22616; Location=2556..2902; Strand=-
  SCN-specific regions: Sequence locations=1-123,145-347
atgcttggagagcgcttgaagagctgcaccggatgcgagtgccgccgttgctgtacgcttagcagttgctgtgcaatgacggaaaattgcttgaaaaatatacagcagaaaaaaggaaataagatcaggaatacactctcccatatcacctgtagacaaaccgaagggtatatggacgaacggcaagtggactacggtacccaattaatatttttgggatgcgaattgttaaatgcgtaactgttatgaaaaaagggtcgaaaaactgtgataactccactcaaagaagaactaaaaaaatctgaatatgcttggactaccgtaccaactattatttttataataaa

SEQ ID NO: 53289 - DNA, 1187 bp, Heterodera glycines
  Genomic contig location: Contig_ID=SeqID_22617; Location=371..1557; Strand=+
  SCN-specific regions: Sequence locations=1-210,254-959,981-1044,1067 -1187
  Gene Ontology: Mol. function=RNA helicase activity; Cellular component=cytoplasm; Biological process=post-embryonic development
aaaaaatgaaagaaaaagcatttgatggatagaaaaaccaatataaatgctacatctcatgttttgcctgtgttcgagtggaatatttatatgcaattgggatattgacgtgccacttgcgggatcaaatttaggtggaaagttttaaacaggtcagttttaatttgaatttatggggtgggggcaataattatacaccatagtgttttgatttattatgggttatatttcaatttctggattccttttaaatagttctgtattccgttgctgaggttgagttccggtgattgaaatgtcggaggactgagtcccggtaattgtgttgctgaaggattgatgagattgagtccagtgatttgaattcgggagaattgagtcccagtgacttgaatgtggtggattgagtcccgttgattgaaatgttggtggattgagtcccagtgattgaaatgctggtgggttgagtcacgttgattggaatgttggtggattgagtcccagtgattgaaatgctggagggttaagtgttggcgattgaaatgttggtgggttgagtcccagtgattggaatgttggtggattgagtcacgttgattggaatgttggtggattgagtcccagtgattgaaatactggagggttaagtgttggcgattgaaatgttggtgggttgagtcccagtgattggaatgttggtggattgagtcccgttgattggaatgttggtggattgagtcccagtgatagaaatgctggagggttaagtgttggtgattgaaatgttggtgggttgagtcccagtgattgaaatgctggtgagttgagtcccggtgattgaaatgcaggagatttgaatcccagtgattaaaatgctggtgggttgagtcccccagtgattgaaatgctggtgggttgagtgccagtgattgaaatgcaggagaattttgagtcccagtgatggaaatgctggtgggttgagtcccagtgatttaaatgctggtgggttgagtcccagtgattgaaatgctgttgggttgagtcccagtgattggaatgctggtgggttgagtcccagtgattgaaatgctggtgagttgagtcccggtgattgaaatgccgcagatttgaatcccagtgattgaaatgctggtgggttgagtcccccagtgattgaaatgttggtg

SEQ ID NO: 53290 - DNA, 639 bp, Heterodera glycines
  Genomic contig location: Contig_ID=SeqID_4128; Location=65..703; Strand=+
  SCN-specific regions: Sequence locations=1-260,284-340,362-380,434 -462,484-551,599-639
atgcctaccgtaacgattaaattcgggcgaattgtgcataagatagaaggacagactcagttgtttgtcgcccatttctgccctccccattttgcctctgattacaacggtgtccccggcgttcagtgcattttcaaattttttggaccaactttggcgttttgatttgacagcttcaggcttaaagtaaaaacaaattgaagtcgaagaagtaaaatcaattatgtttgatttttaagaaccttagaaaattcgaaatgaattaaaatatatttaaaaaattccaaaaagtccctaatttgtcaattcatttttaatttttttttcagcaaattccaaccctttgaagtcgaagaagaaaaaatcatttaagagttttgaaattttagaaattaaaaaattcgaaatgaattaaaatatattttaaaaaattccaaaaagtgcctaatttgtaaattcatttttaaattttttcagcaaattccaaccctttccttcacttggggctcttcaatactgcttgggtagacatcgcccgcaatctgagcaagtttaaattatttacatttattaaaattcgaatatttaataattattagggcttccttttttacgtaagaaaaatcgctaaatatgtaa

SEQ ID NO: 53291 - DNA, 2871 bp, Heterodera glycines
  Genomic contig location: Contig_ID=SeqID_4128; Location=553..3423; Strand=-
  SCN-specific regions: Sequence locations=1-88,125-158,181-304,327 -565,604-687,709-874,896-951,980-1115,1138-1159,1187-1549,1571 -1787,1829-2000,2027-2361,2393-2544,2576-2644,2679-2761,2809-2871
atgagtcctgaaattcaattccaagtgccgaaccaccaggaagtaagtaatcactaatcaaatgccgggtacgaatatcgataatgtgaaaaattaattaaaattttaataaaataattatttactttcctttctccaactataattgaaaaattttgtttcattatcatttttaaatttaatgatggttttctgtggtctttgtttggtggcggaaattcccagggatcataaaatccgttttatggccgagtaaattggcacgaaaattgggagaaaaagagggtggatttattataaacccacaaatggaaaagcagtaaattatgaaatcatttatcaactcatttgcaaatatttagagcaaagtggctgaagagtgtttggaatatcagaaaaaattcgacaaaaagataaaccaaatcgcaagtcattggcacggcgtccgcgtgagcgcgccgaaagcatttggcggcataatgatcgaattgtcaattgcaaaagaaaagtggaaattaaaaatggagttggaatgggacggagtcgctatttaaaaaccatcaatatgaaaatttttcatgaaaaaatatttataattttgctaaaaaccaaccagatttttaattcttgatgttatttaatagccctaagtgttctctattagtctgcaaaattacaaaaaagttcgtaaagtttcaaaaaagttatgattagaggaactcaaaaaacttggtttttgaacattttttggccataacttttttgaaagttaataaattttttttgaattttgcaagctaatagagaacacttagggctatctaatgataccaagaattaaaaatttggttgctttagagaaaagttataagcaaaattattattttgatggttttttaaataacgcacattatgatgttttaaataacgacatagtaccattgaaattggaaaaatatttttaattttaattattttacaggtacaatctgagcgacacccaaaattttaacattgaatttggaaatccgaaagatttgatgacaaaaataacggacgaaacgggtgaaggaatttaacgaaatgagtgaaaattttgaaatgtgtaattaaggaagagaaataagattctcaaaagatgaagccattcggaaggcgtatttatccaacaaaatcaaaagagacgcgaaattgcgtaattacacgggcctttggatgctcgggttggacgtgttgccgatgaacaaccaggacaaaatgcaattgcacgtttacagggactgcaggtgcgaaatgcacgcatgggtagggcaattaggcaattagggacagtaattagccaataatttaccatatttacgatatttgaacccccgggggttctatttttcaactcccctcaaaaagggggttttaatacagaggggggttcaaattcaggggggggggggtttaaataccgtaaataaggtaaatgccaaaaaatcgaaaattatgtgccaaagtttgtccatccgtcggacgaagtgccgccactgctttcggatcaccccgtggtcagcgtggactgcccaaccactgtccaggaagtggactcacatcagtttgcactgcccgagcccgtgggggtgggccgtgcgattcgcatgcgacaacgactgaacaaaaacccggagggcatcgagctgcgctttggcaatgaaaatcaaaaggatttgctgatgctccgtgtggacaaaccgccgtatggaatcattaatatttcaacggtaaattggcgattagaagggtaatactaaataatgaattcatttaataactatttatttggatgtaaagcaatgcttaaattgttaattggataaagaaggcgcaattttcgccaaaatttttacttgttttaaagtatatttttgtgttcgagttcgggtcaaattagggacccttattctaggattgattgccgaatagggggcaattcaccatttgttaaatttcgctaattattaattaaatattaattattgttgacaactgattaaggccggcggttaccagcgcattaaaggtggtaaggatggagaagaaagtgaagcgggcattatcagaaagcaaatgctggacaaaaaagcttcggcgggccaccatttcaaatcgtttgagtcggtggaaaatgacaacgaatgggaggacaaatatttggatgttgaattggtggtgcacaattatttctacgaagtgaaaatcggcgaccgaaagtcggtcaaatattttccaaaaccatcggagtggtggacggaggaggacaaattggacaatttcacgcaaattgaggcacttatttataaatccaattataattatttagggctttcttttttaattacatttttcctggattctccatagcccctaatgaattttttcgtacatattttgcaatttttgaggatttttcaaggaatttttattgtgtcccaaaaaagttcataacttagttattattttttttttgaaaattacttttaaaacatcgattttaccaaaaaaaaatacaaaaattaatttttaaatactaaaaggtgattctaagcctacttagctcattttttagcattttgtgcctatttcacccgttacaaagaattaaaaaaaaatttaaattttatttatatattggtggttttatactatatttcatctttttagacataatttatttacatatttagcgatttttcttacgtaaaaaaggaagccctaataattattaaatattcgaattttaataaatgtaaataatttaaacttgctcagattgcgggcgatgtctacccaagcagtattgaagagccccaagtgaaggaaagg

SEQ ID NO: 53292 - DNA, 234 bp, Heterodera glycines
  Genomic contig location: Contig_ID=SeqID_4128; Location=3888..4121; Strand=+
  SCN-specific regions: Sequence locations=1-168,191-234
attcccgcggcaattccgttggccatcggcggtttcgctgtcccatttttggtcacattgtcttcaattctaaccttacttttgccattttgacttggtttctgatcggctattcctttttaaatattaatgtttaatgagattaatttcactaattgctcaaagaagaaattaggacaaaaataaataggaattatttaacccataaaagttatttataaatgctaatattaa

SEQ ID NO: 53293 - DNA, 1500 bp, Heterodera glycines
  Genomic contig location: Contig_ID=SeqID_4128; Location=4234..5733; Strand=-
  SCN-specific regions: Sequence locations=1-324,346-359,404-799,865 -1398,1420-1500
atgtccttcttcatcctgactgtccgtggaggcgctgtgcgcggagggcgcggggcgttcattttcattggtgctcttgcagtggcagccgtcctgcagggggcaaatgctgaccaggctgccgacagcatacaaattaatgtaggtatattcaaaaatctaattctgtttttattgtattttttgcttttttcaaccactttttacttttatttttttgcctttcatactaggggtgggacggcggcgttttttccgcggttcgcgaccgcggcaatttgaatccgcgactgtgggattttttttttgcgcggcgtgccgcggattttctgtgacaaatttttgttgaagcgattgtcttttttaaatattcaaaataaaataaatttttttttgaaaatttggattatttttcacaaaaaattcgtttcaaaattccaatttttcccctccagagctgacaaaacctttaatttttctttaaattttttgattttttggcacaaaatttttattttttttcacttttgtaaaatttttccatctttacttaccagtttaaaagtgcctttttctttaggttataaagcatattaaagagggagcccggaaatgcatagagcatcaccgaacgacaacaaccaccacaacgccgccgcaagccgagggcgagttttggcactttttagcaactataaatatcatcccaaattattacttttgcaatttttatggcattgattacttttgacatttttttattgtcatcatttttttcaatgaaaaaacctttttctggaaattaaattaaatcaaaagaataatttaattcaatgaattaattaatattttttcaattaatatgcattgatttgcggatataagatgtttcttgttgttattagtgcatttttttctttcacattgttcgtgctatttattatcttggagacataagtgccacaatttcaattagggttgagctcgggctccaggctctccgccctattgtgcctctccccgatcaccgaatctggcctctcaaacgtcctgagatttcttccccgaggggtcggggcttaaccctaattttaagcaaattcatcaaatgggccgttttttgcggtcctttggcacataaattggaatcaagagtaaattactcaattacgaaccttgtttaaagattaactcatttttccttgatttattttgttacattgcttacacatgcaaatgattgattattctatggcatttttccactttccttaggtaccacgacccggaaaatgagccgtgcgggacgaaagcgattggatttgatgcggaagcaatcgaacgattggaggcggaacagctgaaggaggcgctaatggccgaagcggaacaatttgggaacaaagacaacaaacaaaacgccaatcagatggaaatttgaatggaaatttaaatttcatatttaagacaaatgggtaaacgggaacaaatcagaataaa

SEQ ID NO: 53294 - DNA, 526 bp, Heterodera glycines
  Genomic contig location: Contig_ID=SeqID_22619; Location=250..775; Strand=-
  SCN-specific regions: Sequence locations=1-43,66-106,129-147,169 -172,194-211,271-526
atggtggttacggtgacggatactgttacagttgcggtggtggaggatgctacggatgctgtggttgagaatgactcgaaggcacatcaattatataatgttcttttgtgcttttattttatttcacaattacatataaaaagagctcccgcgggtttgcgggtcgctttgatcaaattcttcattttatttacatcctttttttctgatgattttaattttaagaaaatttaaataattttttagaaataatttttatttattttaattgcattttttggcaatggttccatttgtgagccagaaatcgctgaaaatgttaaaatgtgttgtaaaattacaagaacagccaatttttcgacaaaaaactgaagactataacttgtactatatctttttactctaatcaaaaaagtcaattgcaccacctgatcagatcactccttcaaaaagtgatcgggagtgaccagaatttcagcacgccaggcgactttgatctgctctactaattgtcaaacgtaataaa

SEQ ID NO: 53295 - DNA, 1428 bp, Heterodera glycines
  Genomic contig location: Contig_ID=SeqID_22620; Location=205..1632; Strand=-
  SCN-specific regions: Sequence locations=1-139,164-447,474-697,721 -918,947-1351,1400-1428
atggtgaaaatgaatttggttattattattactttcttcttatatttaatcatcgtactaattgatggaattgaagaagatttatttgatgatttatggaaaaattcactgctatcgacatcaaaaaattatgaacagcaaaaagcaaagaaaacaattattaaatctgagaattgttttgaaatagaaattgaagacataaagccaaaagttcaacaaaaaattaaaactgaacaattggatgatcaaacgaattttttaatgccaaaatccatcaaagtgccaaaaactgaattcgtccaattcagcgaagaaggatcatttgtaaatcagattgatgagcaaactgatcagaatgatttacatactattattcatagcaatgctgtgggtgatcagggttccagtgatacggtaatgtaagatagaatactgtacaatttcatgaaaaaaatatatatatttttaatttagagtgttttcttaatatttatcctaattagggaccggatttatatggatttcaatattttgttttcacaattttatttctgcctaaaatcatgtgcatggtatttttagccttggtttgatgcttctaggggatgccttttttatttccatattgtacatccatatttcggcattttcacaaaaaaaaattcgaaaaacacacccctaaagatggaaattttttggaattttggaaaatataaaattgaaaaattgcaaaaaaaaattcattacaaattcgcgtaaaaatgaattttttgcaaaaaacttattcagaattttttgtcatctccacatttcagcatctttcgtccatattttacgattttttcgtccataaatataatccatattttggatttttttttgtccatataaatccgctctctatttttaatatttaggaggcagaaaaaaggaaagaaatggaaattttgaacaaatttagtgcgatgaaaaaggaattacggcacaaaaaagtttataagaaattgccatttcctaaatttgaatatgaaattgcaaaaaaattgggcacatctcgcgacaacatttatcaattcaagaagcaattaggacaaacacagaagaagcgcagcaacaccatggttaaggacattgataaggacacaatgattggactgatcagaaaatttgatcaaatgagaaaagaaaaaattcacggtttcaaatatgatgaaaaaaaaagaaattaaattgaatatgaaattgcggaaaattttggaaccacccgtacaaaaatttatgaatggaagaagcaatttggtaagaaaaaatggcatattttcaaatcgaaataccttaaaattcggcgccgaaattttcaaaaatttaaatttaaaaaattgttttaaagtatttttttgaaaattctagttgttactgaaaaataaa

SEQ ID NO: 53296 - DNA, 690 bp, Heterodera glycines
  Genomic contig location: Contig_ID=SeqID_22621; Location=407..1096; Strand=-
  SCN-specific regions: Sequence locations=1-89,156-382,404-586,649-661
atggcgcgggctaccttaaactttgtgtttaatccacttacggaggacgaacgtgaagaactatgtcaaacatggttttacaattacagtaaaaaaaattaaatttcaaataattagaaaaattgagaaaatctaaaaaaataactaaaaattaaggcgcatccactatagaatgtttaaatattagaaaacacatcgagatatcagtttcaccagcagcaggagctcacgaaactgagaaatggatgaacaatttagacttagcatcaaccagcaaattgtttcaattaaatataatagtttgcgaacgtatacaggaaagaattttccgttggcaagtgtatacaccagatttagaaacatcggttagactcttttgattatacaaattcatattaaaaatttagcttacgaatctgagtcaaaaagaaacacagcatcagtatttttgtattataattagagtgccactggaccgggaatttttgccaaaaccgggaccgggacctgagaagccgggaccgggacctcgattttttttcgggaccgggaccgcaagaaaaaccgggaaccgggaccaaccgggaaattttaaaaattcaaaaaaattttaaaaatttaaaaaaaaaatcaaattttaatttatatcaagtgaaaataatacaaaattatttggttttttataataaa

SEQ ID NO: 53297 - DNA, 692 bp, Heterodera glycines
  Genomic contig location: Contig_ID=SeqID_22624; Location=435..1126; Strand=+
  SCN-specific regions: Sequence locations=1-114,139-507,531-692
atggcttttggcgctgggcattattctggagcggccgttgtttccattatttggcttggaattttgactgctctaatggtcgccggtgaagaaaagtttatatatttctttataatgaaggggtaaaatttttgaaatctaaaattatttttttcaagccctattgttaattttccttcaagtttttaattaaccgattattttgaaaattttctaaacaggaattaaattgtccattgggccaaaactgttttcaaagttgccataaagtttcagggaaaatttaggaagcgcagggccaaacattttcaaaatattcaaaaatatttctcttcctattactcaaaaagaatgaaaaaatagtgtattttatgctcaatacatgacaaaattgatgaaatagtgccgacaatcagttttgactattgttttttttgacccaaaagcttttttacagtttctgtttctatttgaaaatgtcagattggagtcctcattatttgaacctaaggataattaaatatttttaagcgttcataagaatgaagaaccatcgctaccgcgaggaccgtcgatcgaatcccaatgccgacgttttaattgatcgggaaatcaatggccaaatgcttttttgaaaattacaatttaaacgcataaaaacgaatattttcaaaaaatggtaatttaaaaaa

SEQ ID NO: 53298 - DNA, 1078 bp, Heterodera glycines
  Genomic contig location: Contig_ID=SeqID_22624; Location=1157..2234; Strand=-
  SCN-specific regions: Sequence locations=1-760,809-1078
atgggtgaaatgcaaaattattcatccgtaaaacggctgaaatgcaacaaaagtggccgaggtaatagataataagttgcttataggttgctaatccctcaaaaacagctgaaaatgcaaaaaacctgctttattataattttgggcctgaataattgttgtcggtgccaaaaaaagactggaataagggggagaggtaggggggagtgcttatataaagcgtgcctattccaatagcgcaaccaacaaatgcctccatatcatcggttggccaaaagcctgtctccttcttttaaaagtgtgccgtttttacggcaacgttgttcatcctttgaccggattggagctgtattgcctgtaaaaacggcacggctttacagtcggctttatgatgcccttaacggaaacgtcgggaatcgtcgaaaggcttcaactccccatcctaatatatttgatgatgcaccctttaaccccttaggttaccttcccgatttccaaaccttctaaataaatagtatttcagattttattaccaaacaaaataattcttccgtaatggaaaaagggtttttcgcgccaaaattggaggttttttttgccattttccataaataattaacattgaattaataggagcaaaaacgcaaaaaacaaagtgctttccttaaaaaagcattacgtctaaagattggagcattatggaagcagtatagatcggagcgggcaaaaatggttgaggaatacaccgcggctataggtcaattaaatttagtttttttttaaattttgattttaatcatttatttttcagcgatcttggctccacaagaaaatgtttggtcttcgcctgatcctgacccaaacgtgccatccacaagtgcagcttgggagcacaactacgtgccaatctcggcggattatgcagctactttaatgtagcgatgcactacaaatgtgatggtctttaattggtgatattattttagtttaatgcaattattttttaattttgcttgcgttttatcaatagatatgaaatacgaattaatacgcaaatatttgtttagggataaataaa

SEQ ID NO: 53299 - DNA, 1820 bp, Heterodera glycines
  Genomic contig location: Contig_ID=SeqID_22625; Location=22..1841; Strand=-
  SCN-specific regions: Sequence locations=1-224,246-539,561-757,802 -808,830-1005,1109-1151,1184-1201,1266-1820
  Gene Ontology: Mol. function=GTPase activator activity; Cellular component=cytosol; Biological process=regulation of G-protein coupled receptor protein signaling pathway
gagcgcaacagcattatttgccaacgcatttgaagacgacgacggaggaggcagaagaagtggcggcgagcgacaagcacatctccgagcagtacccgcaacacaaccccgacgactgtagcaaagtgccggccgtggcggcgtcctccgtcgcttcgtttgccctttctcggaacagtgaaaacaaagaaaaccgccgcccgtcgcccagcgccgttatatcggaaaaaacaaaggaacaaacgcaggcggaagcagcgcgagagagtccgaagcggcgaatcggtcgtcaaattaggcacggacagcagcaaaaacaaccgaagcgacagacggacgcatcgccgcaggcgctgcccattggccacgcgcagcgccagtcgccggaggcgtcaatgcctcccgcgccgggctcgccgaagcagcagcagccggacagcagcgtggacttggagcaggtgctcaagtcggaagcggcgcgagcgccgttccatgtgagtaaattggggaggagggcaaaatgccaaaaaaggaaaaacggaatatttgaattttaagcaattcctccaacaacaattttgtgcagagaacatcaacttttatttggcggtggaggagtacaaaaaaattcccgagaatgaatttggccgacgaacggactttgggaggcaaatttatgaccgccattttgcggccaattgtattgaaccggtgaatattgacaactcaacatccaatcaagtgagaatgaatgcttttaattataccaattaattagttaattaactaattaattaattaccattcgttcgttcgttttcccttttcattttaattttctcagattcgcgaggcgtacaaaaacaatcggtttaccagcgacgtttacgacgtggttcagtaccaaattttccacttgctcaaatacgattgttggccgcgttatttgcgcgccgggggacaattggcggaggaattgggcggagatgccaaatcgcacggtgaaaaaaggaaaataacgaaaaaaagaaaaattaaaataggaaaaatgaaataaaatccgaaaaataattaaaaagagaaaatgataataaatgtaaaattcaaagctttttccctttcagattctggtgccagcacttctcaggtgatttcgttttgattttgtttcgttttgttttgtgccgtttctctctgtgcctatttatttgtaattatttttaaattaattaattacctttttcgttttttttaaaattttaattcacttttattggcattctgtttaaaatgacgttttggctttttcacattaaaatggccctaatttttgttggcgttttgttcgtttccaaactgtcgtttcagcaatgtttggtggttggtgccggcaaaggcaaacattcgcagccgcgccgcaagtcgctcttccgctttctgatgaaagcggcaaaaacaggcggcttggacaacgcgtcgtacagcgggggaaacgaaaacaacgcggaggacgcgtgctgtacatgttccgttgcggaataccaaccacaacacccctcggacgcgctcaacggcgacactgtgcatgtattgctgcgacgacgtgcgcactcgcgttcaccaaacaggcgcgtcggcttgcggcgccgtgcgcggcgtatctgcgcggaaaggacgaccgtcgctgcgacgagtgccactgcagaacacgcggccgtactgatgctgagcgcgtccatcatcaacttccccggtggagcaaagagacgacgcggacgaatgtgcagaggcgtaacaagaacttcaacgtttacatcttc

SEQ ID NO: 53300 - DNA, 464 bp, Heterodera glycines
  Genomic contig location: Contig_ID=SeqID_22628; Location=1..464; Strand=+
  SCN-specific regions: Sequence locations=1-70,93-134,156-178,204 -273,295-464
gacgggtgcgcatgattccactgttccaagcaccccaccaaaagcaaaacgatataaccaaaatataaggaaaaatttttaaaaaattttttctccattttcctttttgatactaaagcatcagagtgctaaaattaacctgtaaataaaatttggtgcgctttagagcactttctgaaaaaatatttatgaaattaaaaaatcgatttattcaagtgtccgtttggggtactcaaacaattatggggagcaaaaatccaacgcagaattaaaatacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaaggtaaaaataaagtagtggtatatcgaagctattcccga

SEQ ID NO: 53301 - DNA, 1105 bp, Heterodera glycines
  Genomic contig location: Contig_ID=SeqID_4131; Location=25..1129; Strand=-
  SCN-specific regions: Sequence locations=1-71,94-206,233-340,362 -622,644-786,809-1105
atgccaattttggacaaaagcgggtgcgccactccgaccacagtcacaggacgcggaacaccaaacaccaattgtggttggaaatattggcattttttaaaaactaattaagtaaacaaaaaaaacttgtaggcattgttcacccaaatggtgacgacaaaacgccaatagcgaacccaacggaagacatggcgaataaagcaaaagacggaggaggaggggaaggaggacacattgcggagcaggacgttcaaacggttcaaacttactgaacaatggggtcatgaattgtaaaaaagaagctgtgcatatttgtatagattaggggtcgacaaaatcaaagggacttctccgttttggtgacgtgaaaaaagcgaaactttttgtccgtccaatttccaaatgcataaattagcgcagcagcaataaatccctcgctttatgttttatgcattagaggcgtgccttttttgctaaaattttatgggtaggcaaagcaccgacaaaagggtctcttccctttggttttttgaatacaagtgccagggactgccaacaattattcaaaagattgctgttccaaaccgtgtttagactaaataaaccctgttagggtatttggaatttattttaaactaatttagaaaaaagcgcaaattttagcattagtacagccataacaaattaatatttttgtcgcttttacaattttgccaatttttaggaacagccgaatccaatagcggaaaaagaaaccgcttcaacggtggccgcgtcgaaaagcgtaaaggaagacaaagaagaagcgattgccatcgcccctggcgagccgaccgattccgtcgccccaatggcaccgccgtcggcggcgacttcgccagcgccaccaaaaacgcctgcttcggcagacgatgtttcttcatccgcaccgaattcgactggtgctgctgctgcgattatactttcttcgtccgctccttcaactaattcaacaacaacgccaccaacaaacccatcccaaagtgacaccaccgacgaaaacggcaccaaacagcgggtggcggtgccattggcttcaagcggcgtaactgtaagagatttttga

SEQ ID NO: 53302 - DNA, 350 bp, Heterodera glycines
  Genomic contig location: Contig_ID=SeqID_4133; Location=263..612; Strand=-
  SCN-specific regions: Sequence locations=1-215,237-296,318-350
atgagcaatcaatccgcggctcaaatcgctgacgaatatgagaggtgggttttttggtgaaggtcctaatttggtgctctgttttacattttttttctgttttaatcaattttactgcatttaggggtgacggtgaagtcatcaagagcaaccagggcaagcgcaccaagtccgaacaggtcggatcgtttgttgtataataaggctgattgtgcgtcattggcttttctaaaaaaggaccattttgatcagggacggtctcagtgggacgtatcccccccccaaccattcgaaatttcaaatagttttttctataattttggaaatcacatttagtaaagaaaattaaa

SEQ ID NO: 53303 - DNA, 2576 bp, Heterodera glycines
  Genomic contig location: Contig_ID=SeqID_22629; Location=1..2576; Strand=-
  SCN-specific regions: Sequence locations=1-62,106-212,234-238,359 -407,429-1116,1365-1415,1621-1804,1856-1925,1947-1998,2061-2576
ccaacctgcgtattccgtgttcaaccaaacacattactttcggtaattggacacatattgtgtttaataatatttaattttttcatttaaaaattgatttattaagctgtggtacaccatcggttgcactttgctcaactcctggttactgtacctggcctttgtacggtatcgactgtacaccgacatgcaatggtgagcagtgagtagtgatcagagaaattatttttggactgggttaattttaaatttaaatcaaactttacctaaaataaagaaatattaagacaaatatataaataatatatctaaggaatttaaatggaaataaaaaaaataataaatttaatttaattttctaaaagatgaaaatgccattaatttattgcttacttcaaaaattattagcttagaacccacaaatttgtggattaaaatatatttcttgcacatttgaggcctgccggcgcatttcctcgcgtttggctcaccgcttacatatcattgctcggcacttgcattccaattttggcactatttttggtgtttggccttatgaaaacggtgttttgaatttttcaaaaactttatttaatttgaaaaatcaccacacagggcaatttggccggtgacaatgatcggttgggtgcacgtccaaaacggaccattgagctgatcaaaggcggcatgggcaacaccgctgtacggcaccggaattcgaatggtaaagcaaaaatgccaatgccaaggaaatgagtttaatacagagacactcgagagccgagaaaaagccgactcgaaaactaagacagagaaatcgaattgtaattgaggattttaagttcgctatgtccgttataaaaatgcgaaattacggaatatttcagccattcttttttcccaaaatgccaaatttgattttctttgaaatgccaaagtttgaataattttgtttaagcatatcgcctgtgccattgtttgcgttcggcatggcttcatgcgccgccggcaccccagtgtttgcatgtgctgcttgcactgctccaactgttcgtccagcaaacaatgcttgcgcaactctaccgatggggcttcatcaactcgggtgattgaatgtttaatatcttttttaaaaaataaatttaattatttctaaatttttatggatttaaaatagatttataattaaataaataaatttatttatctaatgattaatttaaggtaaaataattttattatgtaattattaaattttatcatatctaatgactaatttaaggtaaaataactttattatatatcattaaattttatatgtttaaaattaaaattaattaatttttaatcttttaattgatttagggttaatttttaatctttatggattttttaattgaaattacagaaataacaaattatttttttaattagtgatttaaattttttaaaaatttcaacaattattaaatttaagttaatgctttattttttaaatattactttatttatcaaattaaattaaatttatttttgagttatataaatgtaaaaaaattactttttttttgagtctaaattttatttatttattttaaaaatttgaatttaattatttatgatttcaattttaaggcgatttcttgaacacggagctcgactggctgcttcagcgtgctcgtcagttggccaccaatttgcccatgggcgaaacgcggcttcagtccttccggatcagtaccgaggagctttccgcctcgcccgttgcgccaaacattttgccaagtcagcgcgagaatatggcaaaattaatataatttaaatgtaaatttaaataatttttgaaataaaatttcagttttaatgcacactcggttgttcggcattccgttggaatttgtcaattttctgatcgctttggtatgtatttccaaataaaaattttatttcgagaaaaggactaactcttccataattttcgatgattttgacgttgagaaaaattttttaaattccattttttaattaatttttccatttttaaaaaatctattaaaaatgatcagaaaataccaaattttacatggttaatttggaaacaaaagaaagttgtaataggccaaagagacacaaagacaattttaattttggcatttttttttacaaaatttcggcaccaataattctcgtaaaaaagacatagtaattagtagagatcggacgggtccggtgctccgccgggattttgccgcgaataccgatctcgatcccggtttttttcgaccaacacgaaaaacggaagtcccggttccgggaccctatcccgctcaattttccacatcacggttccgaaatcctctctcgacctatttcccatgtcccggtctcggccattcaaaatcccggtctctattaattagtgctaatgaattcattagtattgccaaaaatttctcaatttttccctacaggtggccttctccaccgcttacccctccgttttttggcgcgtttcaaagtcttttgcgcttctgttcaccgcttttctgggcgtccattcgctgtgcttggttgga

SEQ ID NO: 53304 - DNA, 351 bp, Heterodera glycines
  Genomic contig location: Contig_ID=SeqID_22629; Location=2124..2474; Strand=+
  SCN-specific regions: Sequence locations=1-25,47-95,216-220,242-351
atgtgcaagaaatatattttaatccacaaatttgtgggttctaagctaataatttttgaagtaagcaataaattaatggcattttcatcttttagaaaattaaattaaatttattattttttttatttccatttaaattccttagatatattatttatatatttgtcttaatatttctttattttaggtaaagtttgatttaaatttaaaattaacccagtccaaaaataatttctctgatcactactcactgctcaccattgcatgtcggtgtacagtcgataccgtacaaaggccaggtacagtaaccaggagttgagcaaagtgcaaccgatggtgtaccacagctta

SEQ ID NO: 53305 - DNA, 393 bp, Heterodera glycines
  Genomic contig location: Contig_ID=SeqID_22631; Location=465..857; Strand=-
  SCN-specific regions: Sequence locations=1-393
attttgctgatcgttttgcaactcgttgtctgtactgtttgcgccggcgaagttaccagcgcgtcgtcagattggtattggaaaattctcgcatctattggggcgttgttgtctattgctgcttatatttgggcgatggttcatctgttagtgacctcaaaaattgatgttgtgttggtaaaaatagacggcatgaagacagagatgggtttgagaattgatcttctgaaggcggagctcaacgagaaaatgacggagaaagttaagtccatcaaaacggagctcaacgagaaaatgacggagatgaacaggaatgtggagtccatcaaacatgaagtcacttctattcgcgaagacatcaaaccaaaaccaaaacaggggctgttttggtga

SEQ ID NO: 53306 - DNA, 682 bp, Heterodera glycines
  Genomic contig location: Contig_ID=SeqID_22632; Location=196..877; Strand=-
  SCN-specific regions: Sequence locations=1-453,475-492,514-682
atggggccggaaaatgacggaaaaaatgggccaatcattcgcaaagagaacggcggcccacaaattgagaaccacgaaatttgcaagaaggaacacgaggaaggtaaatcattttaatacgttttgtgatttgaataatcgccacctatttgctgtaaatggcttctaaacacaaaaagttgtcaatacctcataattgaagtggatttgttttattttctcaattaaattatgactaagccaatgaaaaactccaccgaaatttgaaaatccatcggaaacataattgtctttaatgcaatcaattcgaacggcgtatttcatttgttctagatgccacgaagtggcaaaacaatgacgtaaagacaaaaaccaaaaaagtgacatcactaattgttgtaattaaataatttgaactcatttcattccaattttaggtgccgaacagcggccgtttttgtttttgaattgtcagtgtctttctgccaatcgcatttacttcaactttaccactaaatcggaaaaatacgaagattggcttgagaaaggccgaggggaattatttgagcaaattaatagtaattattgtttaaaatcaactgaagatgcaatttttgtttcgaccttaagccattaccagtggagttcagcgtgttttcaccgaccccaattcatttcttga

SEQ ID NO: 53307 - DNA, 855 bp, Heterodera glycines
  misc_feature (111)..(111): n is a, c, g, or t
  Genomic contig location: Contig_ID=SeqID_22634; Location=54..908; Strand=+
  SCN-specific regions: Sequence locations=1-30,53-68,252-405,428 -570,592-648,676-755,777-816,852-855
atggaattaacacgtatattattctgttcaattttatttttgatcatcctaactgatcagatcggatcagaaaagaaaaaaatggaacaaaaaacatttgatgaaatattntggagaaaaatgggaagaaaaaagaaacgaagaacagaaaaaaagagaaataattggaaaatattataaaataaaagagaaaattaagcaaaaaggaagaaaatacccaagaaaagaatggaataaaattgaaggaaaaattgcaaaaaaattgggcacaaatcgccaatatatttatgaatggatcaaagaattgggattaaatcaaaaaacaaacaaatgctacaaatcaaaaactgatgaagaaaaacttgacactgtacagaaattcattgaaatgtcaaatgaatttaagcaaaaaagaaaatattcaagcaaagaatgggacaaaaattatgaagaaatttgtaagaaaattggagttagccttaaaacaattacaaaatggaagaatcaatttggcattagccgaaaatttataacggaaaaagaaaaaacggagaaaatgaaaatttattggcaaataaaaagagaaatgccgaaaatgagtgacaaggaaattggaaaaacattgaaaattaatagaaggaccataagcaattggaagaaacaatttggagaagaaataatggaagattgaaaacggatgaatgattctaagaatgttagtgatatgattttaagagtggctataagcggagatcaaaaattgaaattaggtaattagcatttgaaatttttcaaaaaagagaaaaaaattcaatgaatttttattctaaaaaattatttataaaaaatttggca

SEQ ID NO: 53308 - DNA, 734 bp, Heterodera glycines
  Genomic contig location: Contig_ID=SeqID_22636; Location=367..1100; Strand=-
  SCN-specific regions: Sequence locations=1-226,256-345,415-652,687-734
atgaataaatatttttacaaatttatttatctaactaaaacaatgggtcacgcgtgcccttttggtccgtcatgaaattttttttattgctttaattaatgtgctctgtcatcaaaaactgaattttcctcactcctttaaccaaaatatataaatcaaattcactttctcgagaaaaaaaaaacgaaaaaatttaccgtataaaaaagttgatgtaatgtaacagataatttaattttaattttcatttttattccaccaaaaatttgcccgattaatgattaatcagaattaaaaaaagcaataaattcattagatagttagtttaaacaaatttccgaaaccttaaatttttagaataaatgaaaatttaataaaagtttttataaagaaaaaaatctaatttataaaattcagacaattaattaattggaatcattcaaaaaatggttgctctaaatggctgcactttctcaaggagtcgaagcagtgccccacaaatgatgacaacaccagcaccaacccatgtcagcagtccgatgaacggtcgttcggcgccgcaactgagacgaagactctcaacaaacacacgtaatccaagcacacaagagggaattgatcagattagctctttaaaaaaatttatggattcaaaaaaacattttaaatttttaaaaaaatattaagattagcttgagatatttcccctgcaccgatcatcaaatttgaataaa

SEQ ID NO: 53309 - DNA, 1153 bp, Heterodera glycines
  Genomic contig location: Contig_ID=SeqID_22637; Location=41..1193; Strand=-
  SCN-specific regions: Sequence locations=1-74,97-356,394-396,441 -479,501-819,887-896,918-1153
atgctcaaaacttcttctttcacaaaatcacgggttggttcagcccaagtgataaaaaaattatcattaaattgttttgaatttattttcttaattgcctttttttgctaaattattatttattagtggccggggaaacccctcgggggacaaaaggaatttccccttacatttttggctgacggtgaagggaccgaaaatgtgctcaattcacttatttcaatgaaaaatttttttgttggaaattgcaccgaatgacagaaagaaggaatttttgcgagattatgtgcaattattttattgcatttatgaactaattaattcatatcatgtagaattcaaattgtttgggcaaaaaagtttatttaatttttaaattcaaatttcgccccctccaaataataaaaataatgaatttcatttaattttaataaaatattcattaatcattaagctgtggtattagtgactttttggccccttatttgattgtttgtatttgtttggcgcaatgttaatttgaattcgacccaaatattttggttttcttaaagtgcaattggttgatttagtttaaaaatattcattaatcattaagcatctaatcttcatcataattactaaggctatttttaaggtttatatataaattttactaccatccgttgttgcgattcgaaaaaagcgaaatacgaaaaaacgaaactaaaataaatacgaaatgcgaaacatgagatttttactgaaaaattgaaaatttttttgaatcattctcaaaatttgatcaattaaaaaattcgaaatcaatttatttgaatgaaataatattttttatttaattaagataaaaaaattgaaattttctacagaaatttttaaaatttaacccaaaaatattcatttttcagctttttcctaattttaacaatttggaacgaacagatgatgcgaaatgggtgaaaaagataatttgttagaaatcaaaatgtgatttaaaaattacgcgaaacacgccaaaaaaaaaagaagaaattcgtcgcgttaagcggtcgcgcgctaacggaccatatgtcattctgatgacaaatttcgtcgttcccttcatcttacaaattagcatcacttccctactcaatttaatccgaaaattaaa

SEQ ID NO: 53310 - DNA, 1237 bp, Heterodera glycines
  Genomic contig location: Contig_ID=SeqID_22639; Location=107..1343; Strand=-
  SCN-specific regions: Sequence locations=1-135,158-357,381-1034,1084 -1090,1112-1237
atgctaaaactattaatttctctattgattctaaatgtacaaagtgattttgtatccttataaccaaaattgttagcatttacgaatttgatgttttttcatgtgttagagacatgaaaatagtactccaaaaggagagaaaaagaaatgcaaaaattttaatcactccatactttttagttaaccctttttttgctcttaaaaacccttacattttgttcctaatttttttctctatcgctatgcaaaatttgatgtggatttaacaaacagaaaaaaagttaaacaggatgaagtaaatgttgttttttacataattaaaatgaagagatagtacgccaaagagagagaaattacaaagaaaaagagaaacgacgagatagtacaaggcttttctctgcacagtggagttgacccataggggtccactgcgtttcggcgctcgcgtttcggcgctcccgtttcggcgccagcatgtttttggctataacttttttctttgtaaaccaaatccaacattgttggtgtcgttcgaaagcttaatctatttagaagctttttttaagctattgctttgcgattagacaattatcaaaacagttatgcatgaaaattgcgaaaagtcgaaatttttgaagttttttcttaataaaatttttacaggcttgaaaaacttttcgtttttgatacggctaatagagcatgttaagagcattcgaatgataccaagattgttggatttggataacaaagaaaaaagcttaagtggaaaaacgagctggcgccgaaacgggagcgccgaaacgtgagcgccgaaacacgagcgccgaaacgggagcgccgaaacgggagcgccgaaacgcgtggatcctttttttaacttagctcatcaagagctttcgaatgataccaaatttgtgatattttaccatttaaattcggttttttgttcaagtcagggttcgagtttcgaatttggccaaaatgcatgtcataatcgttttcagcgacctctaaaacccctagaaatatgttttccttgtaatttatgaatttagaatttttgttcgaattcgggttcgggattcggaattttgaaaaataaatgtcatattcgtgatcagcgccccaaattaccctagaaatgactttttatttgaaaatttcagggggggtcacaaaaccgaaaagaaccgtgatcttataggtgctttactggcgggtgttgcgagcattg

SEQ ID NO: 53311 - DNA, 1085 bp, Heterodera glycines
  Genomic contig location: Contig_ID=SeqID_22640; Location=178..1262; Strand=+
  SCN-specific regions: Sequence locations=1-143,166-206,339-394,418 -860,882-1085
ctcgacgagtcatcgggcccggacgatgtgtttgctgaagctcatccgatgcaaccggtcgctgctgacggtaagagcaaaagctcaatgcgaaaaaaaaacaatcgatcactggccaatcgatcagtggaaagtccattggcaaaaattaaaatttttaaaaaacaacaaggattttccaattttacatattgaatttaaaaaggttttataatttttaaaaataattaatttatcattatacaaaatatattattttaagtttttttatcaaattagataattataattttttcatataatttaaataaaatttgttttcaaaatgaatttttattgacggattgtccactgatcaattgatcagtgacggattgccactgataattttgatatttttgggtttttattgaatataaagaaatttttgggcagcgctgggcacatcgggagggaaattttgataaaataaaacgaaatttgttaaaaattttattgttatttctctaatctttcattcttttaaggtaccccaacattacccggaggcattccccgcaattcccaagcccaaattgacgttgtccggaaatcgacgtcggcacgtggcaaaaaaaattcggtgagtaaatcagggttttaaacaggggtctcaactgaaaattttcaagatcagcattttgattttggcttaaaaatcagcatttcaaaattttattacaaatggttaaaaatcaacaaaaatgtttttttgcggcgcgcttctaaaaaaaatatttttttttgtggaatttggagggggaggtgccgatagagactatacatatatggcaatttttgaggattttcaaaaaatcagcgaattttgaaaaatttttgcttggattttggtagaaattttacataaaaatgaccatttttgaggttttttaaaatctttacaggtgaacgcggagggcgaggcggacaaagcgattgtggccaaaaacaaggccggtcctggacagccaagtgacccgtcagacatgatcatgctgccttcaacatcggatgcaccaaggaggtctcgtcggatcgtggccaat

SEQ ID NO: 53312 - DNA, 974 bp, Heterodera glycines
  Genomic contig location: Contig_ID=SeqID_22641; Location=666..1639; Strand=-
  SCN-specific regions: Sequence locations=1-354,376-601,625-665,699 -831,853-974
atggcaatgaaaatcaatttgctaattttattttttctaaattttgttcaaattttcgtttcgttttcgccgtatcaatgggacccaacaaattcggtcaccaatgttcacacatttgccaaattcattgacaaccttttcatgacttacacaatgaataacaaaatgggtaagtccggataaaggctaattaaagtcggaattccgtaacatctctggcagttatattcagtgccaaaaacaagtgttttctttccaagatacactattgtactttctttcaccttccttttgttttgttttaatgtgccctatttttcgggtttccgtttccctattttcttttttcagttcataacaattttattaaatgttcatacccattttcaggcttcctaattcgaactcggccctaaatttagacaccatcttcccaaatgttctgccgtccgcccgtctctctgatcagcaaaaaagggccgtgtttattttcacttttgtcaaatgcgccgctgaatttgcccatttccgagtgaataacaaaagcacggccgacgaaacttaccacaatttaaatgtgtttcgcggtggaatcaatgcgaattttgtgggttttcttttttatgaccaatcgcttggccatcgaattgcgaaaaaagtcgaggaattttgtgcacaaaacaaagaaaatggtattttgatgaagcaatttatgcagctgtttttctcatttgccctgcggattcttctcagtgtggtgtcagtgataaaatttaaattgtggagcgaaattttggggatttttcatttcaaaaaaccgataatctttaccaaaaactgttaaaaaaccttcaccaagagccaaatgcatcaagtatttatgatcatcacaagtatactaaaatgttttactaggagttcatattttaaataataagattctattaaaaaacgttttagaaaagtaaaataaa

SEQ ID NO: 53313 - DNA, 1229 bp, Heterodera glycines
  Genomic contig location: Contig_ID=SeqID_4134; Location=402..1630; Strand=+
  SCN-specific regions: Sequence locations=1-192,214-352,376-621,660 -754,777-1087,1109-1229
atggcgtccatccccgcgcttattaatcatttggcaagaaatgttgattactctgacgtaagtcaataattgataaaatagcactaacattgcctcatttctccaggaagtgctctgttattcgtcaattgcgcgagcactcagcgattttttcactccttttgtggttgaaaataactttgacgaagaggatacaaaagtgatggaagagcaccgacgaattcagatagtgcttcgttcaattattttcccaactctgaaaagtcgtttccttcccccgtcttcactttggccatcaattgaacgagtgactgacattgaaaaagccttcaaacaatttggtcgatgttgagactccattctcagggttgtctattttcataatccatccatttgtccaggcctgtgccgggccaactccatcttcaaattttgttttatcgtctctatttaatttttacttgtatgattattagcattataatttcttggaatttgaatttgcgtttgttaccaagaagcgaataatataactatagccaaaatttttgcttttcgttcatgaatttggtggtgtagcaatagtaatttttttttttttctggagatttcatacttacctattttaaaagggattgaaaaaatcatttttaatattacaacaaaaaatgttgattgtctgaattttttgcagagcgtttgcacagtgaacatgccgttgaactatccttcctactgccgtgccatcatttgtgagaacattttttaatgacttttgaagtaaaaatttgtttccgaaaatagagtgggcgggggcaaaattgtgtttctacagtaccaaattttataaaatgctcaggatttagaatcacacaatgaaacaagacaattttgttgaattaaattgaaatatccccttttcagccttgggacgttgccgtgttgaagttgtacgcagaaaccatgggaaatatttgggaccccctttttacgtacctggacgaagtcatcacttcagtgagtctatcatttacagcaaatagttggcattattttataattgacataaataagcaaagtgtacaatcctttattttccaaaataatcaatcagtcttattttatttaacatttagctggaggatcgcacgaattctccctctcctccgacgctcaacggcaccaatttggcatttcgtcaaacacaagcgcaacatttgctatggtga

SEQ ID NO: 53314 - DNA, 2512 bp, Heterodera glycines
  Genomic contig location: Contig_ID=SeqID_4135; Location=93..2604; Strand=+
  SCN-specific regions: Sequence locations=1-35,57-406,428-622,644 -895,917-1080,1104-1568,1590-1747,1770-1809,1831-1925,1947-2355,2377 -2512
atgctgaagtcgttgctccaaccctttgacgacgacgtggaggaggacagcgaagaggattcgcatttggcagcaatcattgacacggcccaagtgattgcttttgattgtgagggctcacgggcgaggagtgtcctttttgtgtggcaatgttactaaagaatattttcaagaaacttgccgaccgtcaactgtctactgagggggaagacccttccgtcgggactgttgaccgcgcggcgaagccggcctggaaacggctcaagtcgcaactcggccgctccattgcgcgccgttttgaacgccgttgcaaatacatttacgccagttcggtggagtcgtgccacaaacggctgcaacaatcgcaggtgttagtcccgccgagcatgaagtttcgctgctaatttttgtttgtctgtttcaaaaagagtctaagctgggacgataattacgagataatacggtacatgtggagatgcttaaatgagaaaaaaagtgaagaggcatttgataatataatggagcaaattggtgaactttggccatgggaataaatggactttaccaaattattaggaaaaatatcaattgtgatgaacgttgttaaaataatgttgaaaactgttaatgatttgtcagtgtttaaatcagtaattttcctgctctacaaacaaaaaaatcaaccaacgtaattggtaccgaattggcactataaggtatgaatcggttcaaaaaacggtttaaacttgtcggatcaacttccccccacccctagatcgatctgtctcaacgagagctatcgattggtaccatattcttcgagattggtccacgagaaaaaaacaccgtataagtcaagatattctttttctcaatcttccagatattttctccaaattcttctgttgtttttgttcgatggcctttccctacacaattattcatgcgcaagctgatgtatgtttaaattacatatttttgcattgtttatggtcaattagtcaatttaaagtatttatttatatctttcaagttttacctgtacctattatttttgacaataatttattttcagaaaatccaattggcccttttccttttcccccactaatccttttttgcccactgctaatgaaaataaccaacattaaaaacaaacttcccctcgaactcaacgatgaactgcttcattttgtccccgagtttttttgccgaagggttttggttcgctccaacttttcatttttttgtttggtccaacggagtaaaagagcaaaacattggaaacacaaagtacaaaaaaatgggaaaaatggcacatgaaatgccgataaactgctgctaaatgtaattaaatgtgcgattcattttaggacatcaatgcacaggaggagcagaccacgtacggattcggggacaccatttaccgcccgttagtcccgcggcttgagactcatcgcgtgttgacttcctttgtcggcaatctttgtgcgcccaaccattttttccgaccagaccacaacagcggccgtttctgtgtggtgtctatcaacacgcatgaagctaacgtaattataaaattaaaatgtgattaaccgataaactgaattttaattatatatttcattcagccccttggtagttacaaaaatggaaaatgagttgacacagccaacaaaataaaatgtcttttctctacagaatttcgaaatgtttttcgtagtcaatttcatgttagcgttccccgaattctccattccctctgctgaaatggtttaaattggcaaaatgggcaccatcataatcaataattaagaataatattttcttattcgatattcagagagagatggtccgcactttctttcacgacaacgaggctgggttcaccaaaaaatattatttctgcgaactgcaattttttcctatcaatgaattggtaaatggaatttcggcgtttttcgcaaaacttcatttgtccattttgaccaattccggacaccggatccgaactcgaacaaaaagccgaaattcaaatttttcgagtttcagaaattgaaaaatttgaatttcggctttttgttagagttcggacccggtcttcgtaattttatacaaaattttcaggatttagaatcacacaatgaaacaagacaattttgttgaattaaattgaaatatccccttttcagccttgggacgttgccgtgttgaagttgtacgcagaaaccatgggaaatatttgggaccccctttttacgtacctggacgaagtcatcacttcagtgagtctatcatttacagcaaatagttggcattattttataattgacataaataagcaaagtgtacaatcctttattttccaaaataatcaatcagtcttattttatttaacatttagctggagaatggtgacatgccgccgtacatttccgaatcatcgccaaataattcggccaattcactcgagaatctcccgtcggttgaggcaccgcaatcggatgattag

SEQ ID NO: 53315 - DNA, 758 bp, Heterodera glycines
  Genomic contig location: Contig_ID=SeqID_22642; Location=272..1029; Strand=+
  SCN-specific regions: Sequence locations=1-172,195-250,307-388,434 -486,509-625,652-758
atggcctctaaaaatgggctcattatgaaacatttaaagattctgttccctcatatcatatccaattcccgcctcccaaaacccgccaaaattgcttccccaactcagtccgagtccgtgttcttctaccggtcgtccagctcctcactgctgtcgctggactcggccacttccaccaccaccagcagcagcaattcgtccggcattggcaccagcgacgcggaaacgccgccgttggcatttgagggagagcagcggcaacaacaaaagcccaacagcagcagcagaagtggcacgagcaaaagccaaaatttgtgcggaggcacggcactcaaaatggcggcagacggaaaaaaacagcaaaaagttgggcacaaaacagcaccaactgcagctgctcactgctgcccgatggaggaggaggagcaacagcaatccatggacaaggagcagcaacaattcgaggtgctgccaatgtgcgacggcatttttgggtttcccaaaaaacgaaatgcttttcgctaataagaaagccaacattttggtcaaaattcgttaaattttcccaggcgtcctccaccgcgcactgttcgccgccgtcttcgtccagcggcggtcaatccggcgccgccgccgcctccgtgctgctcgtcgacctgtccaatccgatgctgcagcaattctatgtgcagcaacggttgttcttccgacaaatttatgcccagcagttcgccgctctgtccgcccgacttggcatg

SEQ ID NO: 53316 - DNA, 697 bp, Heterodera glycines
  Genomic contig location: Contig_ID=SeqID_22644; Location=1076..1772; Strand=-
  SCN-specific regions: Sequence locations=1-191,220-240,270-436,488-697
atgccaaaatatgcacatataatatgcacgaaatgccaaaatatgcaaatatgcatatggaaagtcatcctagaagcttcaaaacaagctaaaaacatgtttttcgtgcgtttcaggcctcccagagtccaggaaaaaaatatgcatgtgcatataattgattggactccctagtcatctgttaataaatcttagtaaaatttttaaaatttctcccccaaatttcacaattttttctctttacacaaaaataaataaaacattttctttgttagattggcagggcgaggaatgaaaaaattgatttcacaattgctgagcatcagagaatttcgcgttatgcttgtcgaattgtggcggagcgcaatgcgccggccaatgtgtacatttatgcagctggatttgatcaggaaaacaatgtataatagaatatatgaaaaaaaattatataaaaaaagaaaaatttaaacaaaaaaaaatagaaaaactctacaaaaatttaagtaaaaaaaattcgagtgttaggtagagaccggaaatttcaaatttgcggatcctgttgcaggattggaattcaaaattttttacaggacaggatccggcaggattaatcctgcaaatcctgcatttaaaatctgcaggatcctgcgcaggattgcggattttaggaaatttcaaaaaattctgtattaataaa

SEQ ID NO: 53317 - DNA, 337 bp, Heterodera glycines
  Genomic contig location: Contig_ID=SeqID_22644; Location=914..1250; Strand=+
  SCN-specific regions: Sequence locations=1-89,111-337
attatgagccacccaatttggcaaatcggtctttttaaacgcattaaagaagattcagtcgattgcttggagtgtaagcaaaaaaacgttattaatttttcatcttcatcattttttggtttaaaaatatatttgaatacttttttatactttgaaagattttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctaccta

SEQ ID NO: 53318 - DNA, 717 bp, Heterodera glycines
  Genomic contig location: Contig_ID=SeqID_22646; Location=1..717; Strand=+
  SCN-specific regions: Sequence locations=1-51,73-166,188-208,230-717
  Gene Ontology: Mol. function=calcium-dependent phospholipid binding; Biological process=vesicle-mediated transport
caggcccagctcattgcactacgtgaactcgtgtcagctgtatcagtacgaatgcgccatcagtgccgtgttggaaatatgcgaacattataaccgctccaaactgttcgaggcgtacggattcggcgccaaaattccgccggcattcgccgtcagtcacatgttcccattggtgggccatttgttgacaaatttaaaaaacggtaatgtcaaagcggttgaacaacaatgagagggttgtgcacggagttgcgggcgttctggaggcgtatcggtacgccgttctgaacacccatttgttcgggcccaccaatttcgcaccgacaatccgcgaattcattcacaaaacgagcaaattcccgcgtgacggcagccgatatcaggcgagcaatgaccattgttatttacatattggtgagttcgtcgtcaggtgctgctcattctcaccgatggcgtcatcacggacatgcaaaacaccgtcagagcgatcgtcgacgcgtcccatcagcccatgtccatcattagtgagaaggccctttgattgaccttcttccataattacgccctccccaacttgcagtaattggcattggctcggacgaattcgccaaaatggacgcattggacgccgacgaccgaactttgtccgtcgatggacacaccgccgtcagagacattgtccaagtgggagaggagacgacaatcagcaaattgatt

SEQ ID NO: 53319 - DNA, 426 bp, Heterodera glycines
  Genomic contig location: Contig_ID=SeqID_22647; Location=1014..1439; Strand=+
  SCN-specific regions: Sequence locations=1-128,151-348,370-426
atgactctggcccaattcggcaccgccggcacttttcccctatccctgaaattttttctaacaaagccgactgccaatattgtgggcaaagtaacaaaaaaaaactagtttcatggaattaccccatcaaacatttattttttgaaaaaatgaatttttttcaggacccggttagaaatcgatatccggactcggttgaagaatttgggcccggaaccggttttgcacaaatatccggacccatgaaccgtactcaaaatggtagtaccggtgcgtcatttttccaaatccaacagcgtaaccgatttaccggaataatgaaaataagttgaaagagatttatccactaaaaagaagtttaaaatgaaagataggaattctaaactaaccgaaaaacaaagaaagcaaagtaaaaaaggacagaaa

SEQ ID NO: 53320 - DNA, 592 bp, Heterodera glycines
  Genomic contig location: Contig_ID=SeqID_22647; Location=1544..2135; Strand=-
  SCN-specific regions: Sequence locations=1-287,314-592
atgaagaatgtaaagtcatcaaagccttccgctattccaccaattagctgtatactgtacaacttgggctttcaactaaattctttattgtcggagccgacacagaaattcggtgaattctttgcaaagcacaaaagagggtgtggaggagagttgcacaagtggatttctgaagtagttgacgacacagtattggatgatgtatatggtttgggatacaggtaaattcatgcaaagcttaatttaaatatagccaatcatttgatcgggctaggtttgaacaaatctatttaaaaaaatataataattttatgcttactccgtcgtcattcggtcatcaaaattccaaaaggagccgtagttaaaatatttaaaattttacgtacttttatttagcattgaacaaatcgatttggaattgttaaaagagccaattaaacggtacgcaaaagcaattggatttaaagagacggaaaaaaccgaaaagccaaccgaaaagccgacaaagggaaaaggcaaacagaaaactgatgcaaaaaaagtcgatcaaaaattgaaaggaaaaaaggccaaccaaaaaaagggccaatga

SEQ ID NO: 53321 - DNA, 74 bp, Heterodera glycines
  Genomic contig location: Contig_ID=SeqID_22650; Location=1831..1904; Strand=+
  SCN-specific regions: Sequence locations=1-74
gttatacggaattgacaatgcttaaggagtccaatttgctcagagaagagatttcacggtgttcggacgaatga

SEQ ID NO: 53322 - DNA, 558 bp, Heterodera glycines
  Genomic contig location: Contig_ID=SeqID_22651; Location=614..1171; Strand=-
  SCN-specific regions: Sequence locations=1-110,132-356,392-558
cgaagctttgatgaagttcaaactcggcactctcccactttttctgctatttagtgaatgtttggcggtgatacctttgagcttatcgaccgaacgatttttggtaagttaatttttaaaaaattctctaaacagcgtcgattgagaaggacaactttgaaaagatggggaaacgaagcgaagtcgaatacggtaattggcaattgcagaacacagtaacagggggggggggtctattcagaccaattcatcaagggaaccggcattccgatgatcggctttggcaagagggacaccgagttcgacccggcgaccattccgatgatggtagctggagaaagaatgctttggaattcaattttgttaagggcttcgggaaaagagggacgggcaggccattccgaaacaatgccatggagacgaagttgcaactttggagaatggggctgctgggataaaatgaaaacactcatcagcccatccaaatgatcgaatgctttgaacataaataaattacaataaagttaaacaaaaaaatgctaataaaaaggaggtcaa

SEQ ID NO: 53323 - DNA, 687 bp, Heterodera glycines
  Genomic contig location: Contig_ID=SeqID_22652; Location=119..805; Strand=-
  SCN-specific regions: Sequence locations=1-687
gaaggcaagccaacactttggtcatgtcggaagaaaacatcgccgtatgttttttgcatttgaaagtgattgaagaattgaaagttcaatgtgatcgatcagaagcaaagtcaaaaactatccatctttgaaagtttaatgtgatcagaagaaaagttaaaaattatccatcatcttttccatttgctaatggaaaatttttgatgttaaacgaacaaggaatgaatgcccttatgattttgatttttcttgaagtaaatcttacgggttggctgtttaaactaaaatatagataagcatagattgtcataattaatatcagcgatgagttggagcaagaagtttaacaaaatccgagacctggattgactgccaactggaaaaattgggcatggaagattatttcaatcggaaatacactgatagatcaaggaaatcaaattcatttgcaacatcgtgattagtaaaatttttaaagtgaatcaaaattcgaaaaaaaatttttttgtaaggaaatacgtcaaaaaattgctttttaaaaagcataaaaaatttaaatgatttttatgtcattattaagtttttgaaaaatctcgggtttattgtgtcttgtctcgtgaatctcgaaaaattttcggtctcgaacatcactaatgcaacctgcttttagaggtttccgagaataaa

SEQ ID NO: 53324 - DNA, 417 bp, Heterodera glycines
  Genomic contig location: Contig_ID=SeqID_38; Location=18242..18658; Strand=+
  SCN-specific regions: Sequence locations=1-17,39-43,65-104,126 -164,186-322,349-417
atgagcataaaaaaaggtttgatttgataatttaaccatcagtaaattttggtaaaaatatttaaacgatgaaattaatgcgaataaaaacaaaaaaatttcaataaaattttagtggtttatggttatctcgggttgaaaaataaatgcaaaccctatggagctatgcgcgaatgttttgggaacaaatacacgaggcacaaacgcatacacaccatatataaatcgtttatttcactttacagaagtttatatgtgcataaaaattccataagctataattattttcagagaacactaaaattaaacaaatcccgcgaaaatgtgaaaaataaagttatatgagttcaaaaaaaagccaatttcaagtgctcaaaacgaaaattattagcaacgtactaaaggttttaaaaagta

SEQ ID NO: 53325 - DNA, 786 bp, Heterodera glycines
  Genomic contig location: Contig_ID=SeqID_38; Location=21222..22007; Strand=+
  SCN-specific regions: Sequence locations=1-414,437-786
atgccgtctgattcgactgacaattccaccaaccgcggagcaaaacggagcgcggacgcggtcaagcgctcgatggacctggaaaaattgaaggacgacaaacggaagcgtcgtcagcatagacatgaagaaggcatcagaaggcaaaaagcactgctcctgctccaatccgagtttcggacggcgcgtgaggctgtccagagcgggcatttcaaattagtgtgcacacccaattcaatcaatttgaccgtcccgacgcttgtgagttgccttttttagtttttgagggggttgtggccaaatccttccgatacatccattcataaaatgacatttttccttgtttgccagagacgttcgcctttttttatggccataaagcaagaagcggtgcaatccataacgccaactgacccccgttctgctgctcccgcccctttaagtcacactgtgccggtttctactagttgtcagtgcttttgttttgaaatggcatgtcgtgaccgtccttgttgattttcagctattgctcccgttccgttggcctcagttgtagtctccacatgccctcccccgccggtgccaccgaaacttcaatctgttgctcattctggaccgttgactcgaactgctgctggttcgtcaaaaatgcactcgaaaaacaaggcgcaaaaaaaaccctattcatccgatgatagcacgtggagcgatggatccgagggaccatcggaaccaaagagaaggatgataatttgctcggatgatgatgaaaaaatggaggggtaa

SEQ ID NO: 53326 - DNA, 2018 bp, Heterodera glycines
  Genomic contig location: Contig_ID=SeqID_38; Location=8286..10303; Strand=+
  SCN-specific regions: Sequence locations=1-853,876-1232,1255 -1344,1367-1442,1464-1562,1591-2018
atgctggttcatttcatgaatgttttttacgcgggtatagtcctcagctgtgtgccgtcacgattgcaatcggagctgataaatgtagattttacggttgacaatcaaaactattttgacagcggcaaatatcgtaccttttcaaaagatgctacagcagcagaacactttggttatagtcggaatacagcgtgccgaatagagaaatgtgagcgtgacagcgaatgggccgtttcgcttcaaaatgtgtacactttgcacagctatcagagtgtgtttttcgaaatgaaatcattggtgaaaatgtcaccattggcctgttttgaatacaatgggcatagttttaccttttttgaagacagcgaatctggtgagactactatcttccgtggtcaccagcataagattgtgcaacgactgtccaaacatggacgggttgtgtttgatcacctatcgggtcgattgtttctgatcgataagtatcagaggcggatcagcgaaatagagcttgaatacctggagcattggtggcttcgaaaaaaccaatcttccgcacatacgatcttgaagagcaattttgtcgcttttcttccaccagataaaagcgactttactttggcggacaaccatgtgtttgtgatcagagaccagcgcatctataaatttcacattggcgactatgcaaaagggaatcgtgcgctaacttttgtaaccaattcaaatgatgtccgctttaattatctaatctataaacccaaagaccaaaatgttagccgtggtgtttttgcccatctacgcatgtcggacgcatggatgccgatatcgtacctgttcaatctgctcctaattgtactgtgcacatacatacttaaacagctacggcgagtaaaccgacagagtccgcttaacgtgtccgatagcgccgattattacagcagcccgttcattgacgacgcttattcgccccaacatcaacaattgctgaacataccgtatgaaactgaaacatcgagtgatcaaagtggtggagcccgtagtcggagtatttaaagaacgattttttgttgtttggattcagttggccatttgtttcctacattttaagaaaagctattgtcattttacataattgtcacaatatatttacctgcttattgcatgcaaagggcaatccgttatctgatcgacagttacgggctgagcagtgtagacgatctgtacacctgcttgaaagaagaaattaaaagtgggcctgaaggtgggaattgtctctatcccaacccgctttgtgctgttgactgtgtacacgttgcaaacgctgatcatccgaaccaacctgtgcatattgacgggtcgcttgaattgattgctgacgttgaattgtactcaacatgctatccgaagaggaagttcgaaggaatagtgtggtaagcctactaaacaaaaaatattttttgtcaatatccatttttaaggagcgaacctctgtatgtggagctgaaagatctgaagatttgtccgggcgactcgccgctgtgtctatcgcgccatttcgaactaccgaacagcaacaacaacaacatggacctgatagtcgacgagctggatctatccaactattggagcgacgacgagcgcgaaaacgagactacaacttggtgagagtgctgtgccgattcaataactgtggtccctaccgactcgctaaacagctacagaaacggaggaccgaaaatctcacctatcttaatcggttagacattgaaactgctcatcttaggaaaaatatcaaagttataccggatgctttatgcccaaatggggctaatcaggtgtttgcttatcgcggattcctcggaatcaccgttcaacaacatttgtattctcgccaccgtgtcatgctaaagtacccgggtttaccatgcattgttcaatttggcggtggttaccaccgtgacctatttcccattgaattgttacgagtcgctaatgccgaaatgcatagcgaaatagcttaa

SEQ ID NO: 53327 - DNA, 536 bp, Heterodera glycines
  Genomic contig location: Contig_ID=SeqID_38; Location=10430..10965; Strand=-
  SCN-specific regions: Sequence locations=1-536
atgacaaaggtggcaacagcggaaagaacgacgacaatggtagcaagaaaaatacagggaaggaggtgcgcaatcgaaaaagaagctacccgctcccgttactttcttgtcgagcaaggcagacttggttcgggtttcacatggatagctaattctttttttgttgcagggctgaagcactcgacaacattgaaaaaaaatattcaaaaatggaagcggatataggcggtgaggaaagcgacgaagacaccgtcgattttttcgtggatagcgttgaagaaattatggaaaagtatgtttcaaaagaaaatctgcttcgtgccaatagtcggttcattcttataagaattcgtcgatcggaagagaaggccaaaaaatggatggacacgcgcggtcgtgatgaagccaagaccgtcagcgttgagtttttgtctgctcaggcccaggctgttaagaaagaagatatggactccagcaatagtgagaaggatttggatgaaccaacctcaacggtctatctggaccgcaaaaattga

SEQ ID NO: 53328 - DNA, 2268 bp, Heterodera glycines
  Genomic contig location: Contig_ID=SeqID_38; Location=11112..13379; Strand=-
  SCN-specific regions: Sequence locations=1-401,423-885,909-1258,1280 -1456,1478-1882,1904-2268
atgaggaacaacgaggaaacgaaggctgttaactgtcactctctgttcagtgtctgcatgaccatcttcaaaggacaatttttgaaggaaaatcagctagccatcgtacccgaatgtggttatgagagaaacgatcgtgccagtgtttttgccataaaataccttgactggcgctcaaaaaaagacggaacacgaatacagcacgctggaaacgggcttgaaaagcgttggcagcaatttaggttggatggttggattgaggagcaaaataaatgcatcgaagtgctggggtgctactggcacggatgtgaacgctgtttcaaacccgaagacaagttggtcgacggaaaaacgtgcagagagctcaacgagctgacccatctacgtttattgaagctacgtggacctccaggcgatttgcacagcaggctagagattgaggcagtttgggaatgccagatcagagaacagctcaaaagagacgacgaaatgcgagatttttttgccgatctgggaacggatcggggaccgattgacccacgacaggcctattatggcggtagaaccgggccacttcagctgatcgccgagcctaaagaggacgaaaaaatatcagttttcgatattatatcgctatatccatgggtaaattattccgccgactatccggttggcgttccgtcggtaatccacccgaccgctgaggagatgcttgtcgattggactcgggctgagcaattacaatatcgtggaatctatcgggtccgcgtaatccctccgcgggggcttcgaatacccgttttaccactcaaaattgacgaccgcctcctgttctgctgctgccaccattgtgcaacagcattccgaaagacaaatacgcgccgaacacataaatgtatacacacagatgagcaacgtgcgtttactggcaactacacacacattgaactggaacgtgcgttggaatcaggctacagagtggacagattctggagagcctggcactacgacgaatggtatgggtgcgtaccggcgggaagattaattgtacattttttttcaatttaggagcgacgaaatattcaaagactacgtcagacttctcataaagcttaaggtaagtgaccacatttacgtaacggaacatcgtttttggcagattgaggccagcggttttcctgacggtgtggtctgtgctgaacaacggcaccaatacgcggaagaatatagacggacatacggtgtcaatttggacctggggcatgtgtgtaaaaatcctggactgagattcattgcaaagttaatgctcaatagcctatggttggttaaagactttattctttctgtagcagccttattttcactttaggggcaagttcagcatgagaaatgagctgggtgtgaataaagtgattaccagaccacaagagtttttcgacattattttagatcatgcgattgtgagcagtaacaagatatagttttttctaatatatttctttaggaagtaacagctattatccctttatcggacagggctgtaagagttctttacaagcacaaaagaaatttcatcacggaacactcatccagcaacatcgtcctaagtttatggactacaagccgcgcccgccttaaattgctcgactttatgactcaaattgagcgcaccgaaggagcaaaactactatatacggtcatttttttctttaatggctcttgaaaaaaaacatcaaattcataggacaccgacagtgttgttgtattgcacaagcgtgacgttgcgccaatacagactggagaatatttaggtcaaatgagcgaggagtacctcaactacaatatcaaaacctttgtctgcggaggttatagaatttgcctattatttatttatgaaaaaacaaacatgttcaaggtgccaaacaatacggttttcgtatgaaagacaagagcactggagcagttgaatacgtcctaaagattcgtggcataacatttgatgtgaacaatagtaaagctctgcagtttgagaattttcagcaaaaggtggccacctatggcaggaatgttaacatcggcaacaacgatcaccataacgatgacagcgacaataatggaaatgcaccctcagtatttcgctacaacaaaataatgccgacacgtgatagtcgcattatcacgagagagatgcgcaaaaaatatgtgcctgtgtgccaaaaaggaataataaatgagcagtatgaagtctttccgtttggatatgaataa

SEQ ID NO: 53329 - DNA, 1691 bp, Heterodera glycines
  Genomic contig location: Contig_ID=SeqID_38; Location=14482..16172; Strand=-
  SCN-specific regions: Sequence locations=1-541,563-1392,1414-1691
atgaaaagggtagaagcagacactgtgaaggcttcagcattgaccgatcatcgtggcggagacgaagaatgcatggtcaaacgaccgagacggcaaagttgggatttcaagacaatgtcccactttgatatggatgcagcgactggagagaacaggccgaaatcaccgccgttgtttgaacagagacactattatgtgcatcgagtggaacgattcgctatgcaacgtcacgtgaccgaatttttgctcaacgggcagcacgatgagccggaagaggagctccagcgcacttttaaacacatcattgagcgtgcgatccgaaatgcggaggaccccaaacagcaaaccggaagtggagcaaggggagatttgagcgacagtcgtcgcaagcgtcaagtcaccagacttggcatattgttgaatgggagaggtgggattgaccgggaggagggaacacttgtttcctttatgttggcggctgatttttctctgcccaacaggtctgagtgatccgattgtgctgccaatccgcccgccggagcaaaacacagcagaagttttgatggctgaactagacaagcttggccagtcggacggtgatgaggacgtgcacggtggagggataagcaaacgctcactgttgctcagcgaaccgattgaaattattgtcacgtgcatcgcgcctccggttggcgctgcgccacgtttccaccaataccaacattggggctatgatgaccggcagatgattcgcattatgcatatggatgacaattattgtctattccatgcgttgattgccactcgtgcatacacagaccaagagtttttgaagttgtcttcgcgacgggcggctgaggcggaagaggatggtggcccgcagggtgccgtgccagctgaaatcgttcgacgagtgatgacgaggccggacttttgtgctggttacgaggcgttgaaccgacttgtgtcaaaccgagaacggatgaaaactgccgtggcggagctgatgcatactgcagggattccgacagacgaagatgcatatgggatggagcacctcgtgcaaattcaacaattttgggtgaatgctattagcaaaatcagcttattctttaatacgaaaaacaggaccaaacctacgctggtttgtaccggattgttctgttcgaagaccattccgaggaactgcctcgcccgatttggaagggccctatgggacgccgcatctatgtgtcgctttttgtgtccgaaggacactattttggcatcaaaaagatacactgcttcttcaaattaggccgaaaatattgtctggactgcgaatgtgcctacaaccgtgacactaaacacacaatatcgtgcaaaagtcgctgtccacaatgtgctaaaggtagtttccaaataatttttatagctttattatttcttatttttgcttaagttggaccccaatatccatgcaatagagagcaaggggtatgtcttcactgtcagcaatgtaatcgctttttcttctcccaaacgtgctttgatggccaccgacgcagtcagacctgcaatttgcttaagcgttgtcccagatgtagccgtaccttccaacaggatcctaaacgccctcataaatgctacacttctttttgtacacgatgcagggtatttttcgtcaatatctggctaacgtaaataataaa

SEQ ID NO: 53330 - DNA, 885 bp, Heterodera glycines
  Genomic contig location: Contig_ID=SeqID_38; Location=16308..17192; Strand=-
  SCN-specific regions: Sequence locations=1-885
atgaattgcctgaaacgtttcgaaattgccgcttcaccgaagaagcgcgtttctgaggaatttcctaccgttcttaaacatttgcgagatctaaaaaacttcaatgcccctggagttttttacgcaaatgccaaagtcacggacttgcaattctctttgtataaggtattaaatgctttaagtatctgccgttgtatgtttctcttaaaaatcaacgttttaggcgtgcccccttaaaaatagaggcatgctgtgtaaaaagaagctcgacgacgacagcttctgcggaatatgcatgcatcgcgccaacagaccgctccgcggtctgtatatgcgtctggaattgcacgattgcggagacatggaaattagccaacatgcgaccatgttcgcttcggttgctgagagttacctggatatgaaggtagaccaatttgccgacatggttgagcagcgacctgagaaggtggaggcgatgcttgagtcgaaaattggccaaatagtctgcgtcaagctgactcttaaggtcggcaccatttttccatcgtttgatactaactgtattcgacttctcgcctcgttttaggcaaaaggagagcatggattgctagactgggtcatttcggccctaattgaaggtgaaaaaatgcagatggaggagccaacggtgactaataacgggcaatttggagatggagacggagctgaagacggggaaataattgcgcttgatagtagtgacaatgcatttgctccatcaggaggcggtccaccgaagaagcgggccaaaaagaattgagcggtctgccgccttgcgaagagggctggactatgtcaaaggcggaaaaatgataggtcgcttgcaaaaagattgttatgaataaa

SEQ ID NO: 53331 - DNA, 5606 bp, Heterodera glycines
  Genomic contig location: Contig_ID=SeqID_461; Location=116..5721; Strand=-
  SCN-specific regions: Sequence locations=1-767,790-1193,1215 -2007,2029-2219,2244-2589,2611-2720,2742-2742,2767-3067,3089 -3090,3112-3182,3204-3265,3288-4056,4078-4313,4335-4730,4752 -5004,5026-5606
atgataacacgctcgccacctcttactcgccaaagagcgcttaacctgcgtatgttcggaaatgtcgaaaatcggccggccgctgctgcaacgcaacaaaatcaagaagaaaacagagacaatacgaattttactaataacccgatctccccaaacataactcataatttggaggaacataaccaaaatcaaagtcattttagtgaagacgaaattatgggcgacgacgaaattcgaaacgcattactgcgtgtgtcaatcgagccaagtcatgcacgccaacaaaatgtgctcggtgccgaacagcagcaacaaggcaatgtcacaggtattgcggaatttcgaaatattgggatagtcatcgacagaaataacgagagagggcgtgaccccgacaattttgggacccaaaatgtcgcaatgaaccgacaagttgcgcaatttgattcgatggtggttttagcacaaaatattcctcagaataaccaccgcacatcgacaccattacctgataatggtcttacccacaatattcagcgttcttcagtcggtgtttttgaccaatacaatatgggtaaccgacagttacaccaaaatcaccacttaagtcaccaccctttggctccatttgtaccaattgaacagaataacgcacgcattagaaacgtagaagaaagagtgcaaaatcggcacgcgattccaattcaacagttacgtcaacagattccagtaaacgcagacgcttttcctgcctttcaattccaacatgggcaggggtttgaaaaaggtgtacaatggcaactgcccgaacaaaatccaatgtttttcgaaagaaataaccaagtgcgcgtggaaacacttccaaaccttcctcaaaatcggggaggtgcaattgtcaatcaaacgcagcggcctaacccgatttttggccattcgaaaactgatacgactgttccaagcaatctcgaattaaatttggtactggaaagaattcccgatcttactggaaaagagggaatggataaagttcgaaaatttttcaaaaagtttgatgtatacaccgaaggatggcccgaaaaaacccgtatttcggcacttcaaagcaaagtatatgaaaaagctgagagagccttagaagctgctttgtcaacacaaccatttcgttatgaatgcattaggagagaaatgcttcaacaaatggaagaaacagattcgagaaatctgaatgcgttcgacgaattgatgatgggcgtatgcagaaagcccaacgaagggatcgatgacttagccaacagaatttcaacattagtcagaagtgcatacccgggattgaccagtaatttgtctgatgaatactcaattaaatttctcattcgtgcaatggataaccccgagctagccttgaatttggagctggttagaatgccaggcatgactttagaccatttcgtctcattagctgctagggcagagtcaactcagcgcgccgcaatgcgttatgcgtcatcgtcctatagtcgaagggaaaagactaagcaagaatattctaactatggaaggcaaagatttttcgcaaatcgcttccctgcgaattctgacaaccagccaaattttacacccagatcagaacagcatttttccagccaaaattggcaatgctataactgtggcgattttggacacatttctagaaattgccaaaagcctaaacagtttcaaaaaaactggccaattccatcggacaggaataacccaaattttgggaccaacagtaaccatgcggcaggaacgccagcaaatcgtaatgcaaatagcactaagcctaattcatcgaattatctaaaacagcattgcatcacccaacaagaagaaatccaaccaaatgtttgtctgagtaaaattgagtttgccccagaaatggatatttttttgacaatattcttgagaatatggaaaattgtcaggatgagacagttcctgcaattggtaaagtgatggcggtaaaagtgcaattatttggacaggaaaccgaagcaatgttagacggtggcgctcaaatttcccttattagcgcatatttcctttacaaattactaaaggaggaaaaagtcgatttgggcacgcttaagccttcgaaatcacttgcacgtgttttagacgtaaatggcaagcacctttcttgccttttctcagtgaagttgccgttatgccgtcgcgggcttaaatttccaaccaacattattgcgcacgtaacaaaagccccgattggattcgatttactgataggtacgaacggtttggcaaaacttggctttaaattatatgacaatctgaacgacgaaatggttgaattcgaaaagttcgaagcgaaagcgaaagcacaaaattttctcactgtaatataccgtaccgtaattgagccacgttcaacaaaaattgtcgaattcgaaattgatcaaaatcacaatgattctgaaattttgatcagttccgttcaaaccgataagttgcacatcgagcctactataggaaaagttaaaggaggaaaagttatcgccccaattacaaatttgtccatgaccacaattactttggaaggaaaacaaaaaattggtcaattcgagtcaattacggaaatcggtgaaagtgacgacattttggcaaatcccctaatagtatcgtcattatgcaaacagttggattccattgagctaaatcccaatctgaaaatatgggatttatggaaagaaaaaactggcatgctttctgaaaatgaactagccaggttaaggacactcagcaaagatttcactgagatttttgcggtagttgacaatgaattgacgcagacgaatttggttgaacaccgaattgaaacaggagatgcggcaccaattaaactcaaaatgagaccggtgccatatgcttaccgtgaaaagattgcagaaatgatccaagattatttgggaagaggtgttattcaaccgtcaatttcaccatgggccagtcccatcgtgatagttccaaagcgagacgggtcccttcgattttgtgtggactaccgttcggtcaattcagtaacacgaaaggacagttttcccttaccaaacattgacaataccctgttaatgttaggtggtaaaaagtttttcagtaccatggatttcatgaccgggtactggcaaataaaaatggataaagaatccgttgaaaagactgcctttacaaccgaacatggcctttttgagttcattgttatgccgtttggcttaactaacgccgtcgccactttccaacgatttatgacacgcctttttgaaggagtgatcaatgattttgtgttcatctacattgatgacattttggtcgcttctgaaacatttgaagagcatttgcagcatcttggtatcgtctttagcagaataaaagacgcaggactgaaactgaaattgtccaagtgccggttttgcgcagatgagcttccattcttgggacacattctcacccgagaaggcataaaaatggacatcgaaaaggttaagccagtaactgatttacctattccgagcaacaaaaaggagctccattccttacttggattccttacttattaccgaaaattcatacattcatttggtacaattgcagcaccgctgttcaaaatgttgagcgaaaaagtcaaattcgaaattggagagaaggaaaaggaaatcatagagattttgaaaaccaaaattcttgaggacgtagtattgtattttcctgatttcgaggccgcacaaaacgacccaaatcggcagttcattattatgactgatgcgagtaaggcagggatttccgctattttaagccagccggattttgataataatgttagaccaatttattttgcctcaaggcaatgcaacgagcacgaagcacgctattcagccacagaacttgaggcactcgcagttcgtttcggtgtcaaaaaatttgcacagtttgtaacaatgattccaacacgagtcatcacagaccacaaagcattaatttggatgtttaaaagaaaaaacgaaacaggaaatgcgcgcgtggaccggtggcttcttgaattaaattcgagatttcacttgaaagtcgaataccaacccggtaaaaagaatataatagccgatgtcttatcgcgctcgtttgcttcaccaaaaacccctgaaatctgtcaaaatgacgaagagatcgcaattatcggacaaatccgagaaattgagccaaattgggacgaattggcgcacaattatcagggttgggtcgaagaaaccaaattaagcgaaatgggtgcactttatgatttcctagaacgtaggattataccgaaggaccccagggaacagcaaagcatttttgataagtgtcataaatattcggtcatcagtgggcttttgtatctgtttgaaagtggaagcaatatgagattgttcgtgcccaaaaagtttcgtgaggaattagtcaaagctcatcacgaaggaaactgtgctggccatatgagtggaaaaaagttgtgtaaacaactttccgaacaatatttctggcccaatatgcttgccgactgcgtcaaagcacacgaaaaatgtcgaatttgtgcgcacactcgaaatccgcgtgctaatgagccgccattaaatgtcgttaaatcaaccgaaccattggagttgatctgtatggacatcttagatgtggggccaagtcattcaaataaaaaatatatttgtgtaattgtggatcatttcacaaaatatttggtcgcagaaccaattccggataaatctgcaggttcagtggccaaaatttttgtcgaaaagttcatcttggtttatggtacgccaaaaaaggtccattcggacagagggaaagaatttttgaattcaaccatggaagaaatatcaaaaatgttgagcataaaaaggtcatttacggcagggtatgacccgcaggcaaatggtcttgctgaacgtgtcaaccgaattttaattggaattttaaaaaggtcaactgcaagcaattggacgtgggacgaacgattagcttatgctactttttcatataacatcacaccttcaaataccacaggattttcaccttttgctctcatgtttggaaggattgcgcgctttccccttgatcaaaacgtacctttttccgtaaatcccgcttatacggtggattcggacaaatacattcagctgtttagagaaaaccttctaaatatgcttgaacaagcaaacaaaaatgctttagaagcgcgcaaacaaaataaattatggtttgactctcaaccacgcgtaacagccaacaaatttaaagtcggagatcgcgtaatggtcatttttcccgggctccaccgccggaatccacataaaaaactcatttggtcaaatttcggtccattcttaatacttgaaattggcgaatcttcagctaaagttgtaccaattgataagcaaaaagatgaaccaataaaagtgcccattgaacgattggtcaaagtcccaaaagggataccggacatctcaactttgcctaagggaaaaaaaaacgcctacaaagagactaaattaatggcgtaa

SEQ ID NO: 53332 - DNA, 255 bp, Heterodera glycines
  Genomic contig location: Contig_ID=SeqID_463; Location=1396..1650; Strand=+
  SCN-specific regions: Sequence locations=1-90,186-255
atgttttatttggatgtcaaagaaaaaagctatcatggaaaaagagctggcgccgaaacgcgtgggtcccgtttgtacatttagtctttctaaaatattttatgaattttaaaaaaatactatttttttcagaaaatttttgtgttttaaaagtatttaaaataacaaataaatattataaaattgtccataaaaagcgacgaagaaattgatgcagaagtttcctaatattttttttgttaatgttttattaaa

SEQ ID NO: 53333 - DNA, 61 bp, Heterodera glycines
  Genomic contig location: Contig_ID=SeqID_463; Location=1..61; Strand= -
  SCN-specific regions: Sequence locations=1-31,53-61
tatggcacggaaagacttccgatttccgacatttttggggtaggaattccaacttccgaaa

SEQ ID NO: 53334 - DNA, 677 bp, Heterodera glycines
  Genomic contig location: Contig_ID=SeqID_4137; Location=463..1139; Strand=-
  SCN-specific regions: Sequence locations=1-584,666-677
atgaagcgcgagctcaccgaccgacggatcgtcgagttcgttgcgggtggccccaagaactacggcatccggcacaccgctcgggacgggacggacgagcgcgccaacctcaagatccgcagcttccgactgtcctacactgcgcaacagctgctcacctttgaggcgatgaaagacctgacgctggccacttacaacattgacggcccaatgtgagtttttaacatattattcttttacataatattaaaaattgaattttagcgatgatgccttggacaatgacgacctttacgtgtacggaggcggcgaacatcgtgccatacgcgtcaacttcccgcaaattgatcgcaatgtgtacgccgatctctacacgcatgaggcccacaaagactacagacccttctatgccaaggggcgcgttcggcctgggatgcagacgcgcccctttggctatgtggaggatgatggtcagccgaacgaaggacaacggacgcatcgacgaaagagaaattttgtggagcaagatcccacacagcccggacactctgggtggttctgatgttatgatttattgtgatttgataatattttttaaatttttttttgtaatatttcctttaatttgatatttattgtttatgtttaaatttgtaaaaaataatgtgaggaataaa

SEQ ID NO: 53335 - DNA, 2275 bp, Heterodera glycines
  Genomic contig location: Contig_ID=SeqID_4138; Location=1768..4042; Strand=-
  SCN-specific regions: Sequence locations=1-597,619-1119,1141 -1490,1513-2275
atgcttttcaaggctggccgccaaattggcgagtgctttgtcattgagcgctcaacagccatgcggaacgtgccacgcaacacacgtggagagatttgtgaactgcgcttcctggcgctggaggaagcgcagcagtccgatcttttgatggaggccacatccagcaactcctcgaccgtgtgctggctggtcacccgcgcccatggatggtcggactacagctccacccgccgggatttgatcgtccatatgtcatcgggcttcgtccgccggagcaaaacaacgcagcggcattggcggcagctatcgagcggttcaatgagcagtcggcagccggcattgatctccttgccggaacaacagtcatcaaagtcttggcggtctggccccttgactccattcgtgctgatccccaaaggggaggtgaatgccattcttatttcattaacacattttggttaaaaaaataggagcctgtgaccgtgacgtggagcaccatgtttccagcaacgtgcagtcacttgtccggattcacaaccccaacgaccggctctgccttgcgcttgccgttctcttggggagcatgaccgtgagacacgaatggctggcggtggcggcaaagcggcattcaacctgttcgccagtcgtcaagaccaacacggtccggcagcagcgcagatgctgactcgtgccggcattgctgcgaacagggacatgtacacgctggacgatgtacaacgtctccagcagtggctcaacaatcaacatggtgtaggccaaattcgcctggcggtgtttgaaaaggagcaggaataccgcattgtattcaaaggagatgggtgagtttttttgtttcttttcttgttttgggtaaattagttaattgaagattggcggcgaaattcaacctttgccttgtgttggagcgtggacacttcaactatattggccgtgttgagcagctgtttgatgtgcccaactactgcatcgactgcgagcggagggccgacgcgcgctaccacgcgttcggatgcaaagttgtatgccgcctttgtttgcggtatggacctggttatccatgccaaactgaacaggtagattaaggttaaaaaaaactacaaaaacaatagcaaaaaacccaattaagctaccgaatggtggaagtagtgctcgaaaatgcgctgattgtctgttcatcttcccaaatggtgggtgctacgactaccatctcagcaaccacgctccagctccgatggacggtcgtggtcagcgacaacgtcggcccatctgtcaatggcgccgggtgtgtcgtgcgtgtggacgtatcgcctacgtggccacacatcagtgcccacatgaccagccagccgacgatggaatctgtcgacgctgcaatgggccccacaccgtcgatgagccttgctacatccagcccattgacgacggctcagtccgacaacgtgcatcgattgctgttgacaacgacgattttgacgacgacgaggacgatgaagaattgccgcttcgtctgtgcttctttgacgctgagacgtcacaggatatgccattacagctgaacaaccgcactgtccagaagcacgtgccgctgctcatcgtcgccgaagtcatctgcgaacgttgtctgcaggctggcatcagcgtgaacgatggccttggaagacgggctcctggctgcgtctgcatgacaggaatggtgagaggtcaactgtttcgccagtggtcttcgccaccctttgccaatgcaccgggagacaacagcgcttcgccagttggagcaccagcgttcaaccagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaagcactacaccgccgaaaccgtccacccaagcatctgtgcaccaccggattgaagatctactcgatgcgtctgtccgggcgtaaccaaagacgaatcacctttaaggattccatcaactactttttttgtgccttggacgcgttggtgaagagcttccaagtgccggaccatctggcgacgttgaagcccttttttccgtatctctacatacgacgacaacatctgtcgcagcgcctcaacggtctaccggctcaagagttctacgcaccggacacgatgaaggcagagaaacgggcgcaatttctccgttga

SEQ ID NO: 53336 - DNA, 102 bp, Heterodera glycines
  Genomic contig location: Contig_ID=SeqID_4139; Location=2022..2123; Strand=-
  SCN-specific regions: Sequence locations=1-102
ttgctctcctccgccgtcctccgacttatttatttgttattttaatttgtcttcaataaattatttatttgttcgtccattcgacatttcggggactgaaca

SEQ ID NO: 53337 - DNA, 678 bp, Heterodera glycines
  Genomic contig location: Contig_ID=SeqID_22654; Location=147..824; Strand=-
  SCN-specific regions: Sequence locations=1-316,338-562,584-648,673-678
  Gene Ontology: Mol. function=ankyrin binding; Cellular component =spectrin; Biological process=neuromuscular synaptic transmission
atgcgcattcactgcttggaaaacgtggacaaggggctgcagtttctgcgcgaccagcacgtccatttggagaatttgggctcgcaggacatcgtcgacggggcgccgcggctaacactcggattaatttggacggtcattttgcgatttcaggtccacacccaccctcacaattggatcttatttgatcctatgctttcccttgccttttgggccaaatcccttccaaaaagtgccattgccatgcccccgctgtccgtttcagatccaagacatcactttcgaggacgtggacaaccaggagacgcggtcggccaaggaggcgttgctgctgtggtgccaaatgaagacggccggctaccgcaacgtgaacgtgcgcaacttcacttcgtcatggcgcgacgggctcgcgtttaacgcactcattcacaagcacagagccgacctaattgagtacgaagggctgcaaaagtcgaacgcactgcacaatttgaacaacgcattcgacgtggcggagaagcaattgcaattggccaaactattggaccccgagggtaaaaaggggaataaatggaaaatgaatgatggcatggcacttttgaagatgtaaatgttgaacagccggacgaaaagtccatcataacgtacgtggtcacttactaccactacttcaacaag

SEQ ID NO: 53338 - DNA, 1017 bp, Heterodera glycines
  Genomic contig location: Contig_ID=SeqID_22657; Location=345..1361; Strand=+
  SCN-specific regions: Sequence locations=1-354,396-1017
atggcgctcaacatgcaagacaagaagggactcctccaccaaattcttggcgaagcagacatcacggtgactacgagcggcatcacgatcagcggtccacgtctctcctccccccgttttattccctttgatgaggccggccgctgccgctcatgtcgtggcaccgaggtggaactggacacgatggtcaccaaggagggcatcaccatttggtgtacacgtatcgaccgggtgcaatttgtccctttcgacatcatttacgacttgcccggtcactgcttcttccgggtgaagaacaaggcgcgggtgttcaacattccctacggggacctgcctgccatcacattcccaaaccatcaagaacaacagcagcagctgcaacagcaacaacaacagaacgatttgcgccaaaaagctaacacggcgatggatttggtggagagtggactgctagctgattcgttacgtgaagaaggcgtgcagagggctgagctaaagcggaaggcaaaagttgcactcgatctgattgatgccggtttgaccggtgatgcactgcatgaggagggacagcgttggaagaaggccaaaactgcactcagcgttctcggaaacatgttgttggccgattcacttccggaaaagaagactgcggagctcccgcttccaccagccgaaaaaattgaaacactgccacttccaccactcgaaaaaatgaaaacgcccccacttccacctgccgacaaaatgccttcgccgctcccaccatcatcaaaagtggaaagtgatgagcaacaattctacgacagcatttctgcggctaccactatgatggacagcgcctcaatgcagcagcaggcaccgctgaagagaaaacagctgactccaaaaggcaaaagcaacaacggtatgaagaaggcagctgagccgcagcatcatcacaacgtgggggacatggacaagactcttgacgaattttttgagagcgttagcgcagcgacgaccaatttgtctatataa

SEQ ID NO: 53339 - DNA, 795 bp, Heterodera glycines
  Genomic contig location: Contig_ID=SeqID_22659; Location=52..846; Strand=+
  SCN-specific regions: Sequence locations=1-173,196-449,471-759,783-795
atgccggaatggttcaatgccctggggacggacgagcagcaaatgaagcagcgcattgatacgctaattgagatggaaaggcaaatgcacgaagatgaccgtaagcaaagcgagaagcttaatttggggatttgaatttaattctaatggtaaaattgatatttattatgcaaaagtgccacttttcagaaagcattgaggagaacaacattgacaccattgagctgagtttgggcgaactccgttcggactttcccaacggattcgccgtcgattggcaaaaactgttcaatgccattgtgcacgatcgcaacttcaccgcctcctccaccgttctgttggtagcgcaaaaaatgaacggacgcactgagaggcaaacgccactcgacgtaatggcggaatatatgcgcaattttgggcccaaaaacgacaccctcaacaagtgggagcagtatgtagagtggctgctgatactgcaacatgccgcactgtcggacaacaaaatgtacacatgggggaagaccgattggaattatttttgtggttatttactttcagatttcatcgtattttccgccggcacccgcggtcagccaatgccatgatgagtgctttgctcgtcaacaaatactttttcgagaggcacgacgacgagcagtatatccgggacggcacatcggaggaacgtcgcgtggcacaaatccggcacaattgcctggaacagctgaagcatttcttcccagaatatgttgaccgaatgtttgcacttggtatgtaaaaatttagaatttaaaa

SEQ ID NO: 53340 - DNA, 683 bp, Heterodera glycines
  Genomic contig location: Contig_ID=SeqID_22660; Location=90..772; Strand=-
  SCN-specific regions: Sequence locations=1-34,88-634,656-683
  Gene Ontology: Biological process=embryogenesis and morphogenesis
ctgcaacaggcgacaacttcctttttggcattggggcgtcaaagacgacggcgccaatgacagcgacgacgacggcactgacgacgagcgcgggcagtcctttcgcctttggctcgtccgcctcgaccaccgcttcccccgtcgccaccacaaccaccgcctcggccactctcccgcttctctttggcactcagcagaaaacgacggcacccgccgctgtgccttcctccgtccccaccttctctttcggcaccgccaaattcccttcttttggctcctccgccgccggtggcactctcttcggttcgaccaccgccaacaccctcacgacaagtaataaattcatttagtggatgtataaatatttgaattcaattttcatttggtttagtttcttctgctgatgtttctaaggctggcaaagtgacagacaaaggcggcgattcagacgacgaagcggccgaagaatttgttccgacgggcacttttaagccgattgttccgttgccctcaaaagtcgatgtgaaaagcggcgaagaaaatgaggaggtgcttttgctttttgcttgttccatcttttttatttatttgttttttaggttcttttcagtgctcgttgtaaattgtttcgctacgacccaatggacaaaaagaacaaagaacggggaattggggagcttaaa

SEQ ID NO: 53341 - DNA, 333 bp, Heterodera glycines
  Genomic contig location: Contig_ID=SeqID_22660; Location=439..771; Strand=+
  SCN-specific regions: Sequence locations=1-247,301-333
cttgtcgtgagggtgttggcggtggtcgaaccgaagagagtgccaccggcggcggaggagccaaaagaagggaatttggcggtgccgaaagagaaggtggggacggaggaaggcacagcggcgggtgccgtcgttttctgctgagtgccaaagagaagcgggagagtggccgaggcggtggttgtggtggcgacgggggaagcggtggtcgaggcggacgagccaaaggcgaaaggactgcccgcgctcgtcgtcagtgccgtcgtcgtcgctgtcattggcgccgtcgtctttgacgccccaatgccaaaaaggaagttgtcgcctgttgca

SEQ ID NO: 53342 - DNA, 1208 bp, Heterodera glycines
  misc_feature (1205)..(1205): n is a, c, g, or t
  Genomic contig location: Contig_ID=SeqID_22661; Location=22..1229; Strand=-
  SCN-specific regions: Sequence locations=1-1208
atgtacgaaatgcggattcgaaggcagaagaagcgcaacccaaacattgttttccgggattcattcaaccttatgccaatgtctcttgcctcgctggttccatcatttggcttggatgtggaggacaaaccattctttccgcacatggccaaccacccagacaactatggaaagcagatccatccaacaccagacgactatttggtcaatggtatgatgccagataaacgacagaaattcgacgactggtatgaacaacaccgtcaggaaccattcttcctcgacgaggcgttggcaagctactgcaccaacgacgtggagatactgatggcggcgctggtggcttttcgtcatgagtttttggatgtgacgaaacgaaatgaaggaatcgttgcggagcgtgcggccttctatgagcaccacgacggcattgatgtgttgcgggagtgcatgacgatcgccggcgcatgtatgaagcattttcgcaccaaccatctgccgaagaagcacttggctatcgtcccggaacgcggctacgacaacgcccaaaaccagtcgttgctggcacttcgcttctttcattggtatgcggaggagcatggtgttgtggtgcagacggcacattcggctggcggagagaagaaactcgggcagtattccgtggatggctgggtggaagcggaaagaagggtaattgaagtgaatgggtgcgtgtggcacggctgcaatgaatgcttccccaatgacaacatgatgatgccgaatggaaaaacggctggagaggtgcgagagcgggatgagaagcggctggaattcatcgaaagtcaagtgtcacgagtggacgtatactgggaatgccaaattaaaagaatgctgaaccgtgacccggacatgcgcgaaagttttggtgattatgtggatgatggcccgttggacattcgcgaggcgttcatgggtggaagaacaggaccactgaagctgtaccacaaggcgggagagggcgagaaaatctcgtactatgactttacgtccctctacccgtacgtaaagtgagttttgtttcgatcattattcacaatttataattttttatttccagtttctccaccacttacccaattgaacacccaaaagtgctcatcttgaatgaaaatgtggagtggacaactgcacgcgacaacccctacaaagtgtcgttgctcaanggt

SEQ ID NO: 53343 - DNA, 574 bp, Heterodera glycines
  Genomic contig location: Contig_ID=SeqID_22662; Location=65..638; Strand=-
  SCN-specific regions: Sequence locations=1-574
atgaccgtcacatccaacaccgaattccgactcatcgaatgtgtgcgaatccttgaggaagttgctcgtgaatttggctgtattacgccactaccaaaccttgggtatgtttctttcgttttacaacactaactccagcatacagtagccatcgtgactatcggtaagcggatgtatgatgattcgcacgctgacatcgttgaatcgacactacattttcgatgctgaagactgtattgaggttaatggaaaatatgtttcatattttattgctattttaggtgaagggtttcttaaggcaagaggacggcacgagccaaaaagtggtcaacgaatattatgaaaaatatgatggactaaatggatttgctgaatttattcggaattgggcctttacctttttctgtttacatgcctttgatgatgatgacgacacatctgatgaagactaattccgttaataattattgtatgctcttggttacaaaccgataaacaaatccatcagggttatttgaacgattcaaaatttgcataatattttcaaaacccaatccgacggacataaaataaa

SEQ ID NO: 53344 - DNA, 420 bp, Heterodera glycines
  Genomic contig location: Contig_ID=SeqID_22662; Location=836..1255; Strand=-
  SCN-specific regions: Sequence locations=1-153,189-420
atgaatattttctgtttctgtcttttacaatgctgtttagccaaacgaagtatgaatttcaacaatttgactacgccgattgatgaacaaacaatgattgaaaccctgtctttggatgaaccatcaaacgagctacgatctgttgaggttaacttttattaatattatcaaatagaaataatattttagaaaatggacgaagaactgaacaaaaaggaggagccgtttactctcgccgaatgttgcacagcctttgacctggtcgcgttcatgttcgactgcaaaatcccggtgccgtacgagaggagcacaagcgttacgtattcgagcaccaggacaagccgcgtctcatctacatcaccgaagatggagaccagattgagttcaagggaattatcaaacagtttggatacgtcctaa

SEQ ID NO: 53345 - DNA, 69 bp, Heterodera glycines
  Genomic contig location: Contig_ID=SeqID_22663; Location=160..228; Strand=-
  SCN-specific regions: Sequence locations=1-69
atgactgctaggaaaggcgacatgaagtttgggcaccagaaattttggcaccgggaagtttgggcaccg

SEQ ID NO: 53346 - DNA, 840 bp, Heterodera glycines
  Genomic contig location: Contig_ID=SeqID_4140; Location=21..860; Strand=-
  SCN-specific regions: Sequence locations=1-47,89-114,144-226,248 -520,542-572,600-693,716-779
atgccaaaaattgtccgaattgtgagttacaaacatcaaaagggacaagtaccaaaatttgtgtgatttttatttttcttaaaaaggctttgagcacaatttattaatgcgtccattaattaattaattatttacatatttttgttcaattaaattcactgccaacaaaaaatgaaaaagcttctctgggtcatttattcatttttgtgaaaatcacaagcaattttttcttgtccaaaaataaaattctgtacaaaatgaagacggaatgattttgtggttggagcgccatcaattttatttgcgcagatgccactgccatatttttttggccatttctcatcaattggccaacgatgtacccatcaaatgagctgcttgtccaccaaaatgcttaaataccgagacaaaaattggtcattttgtcattaaaacagttcgcccccaaaatgtctttgttttgtccattaaaatttgtccttttccttttaattgcaattgatcaattagtggccttttcttttgtgcagaggaaatgggtaattgttttttttgtgccaatataaaatggcattaaataattttaattttttaaaaaaggattttttattgccacgcgatttgatggagaaaatatttgcgctcgaatccgattcggaattggacaaaatggaggtggaaaggctcactgatcagctgctgaaggaggtgccccgatcggttctcgaccgattggaattgccgagattctactcccgactgccattcagcagtgaaacaattaattgaaattttataaaatatgatttataattcaattttaaatatttctatattaaa

SEQ ID NO: 53347 - DNA, 633 bp, Heterodera glycines
  Genomic contig location: Contig_ID=SeqID_4141; Location=412..1044; Strand=+
  SCN-specific regions: Sequence locations=1-277,300-633
atggacgtgccaagggacctggcggatgtttgtgccgggacgtgcggacgtgttttcggtaaaataccgttaaaatcattgcattgcataaaggttggaaaagaatttaaaaattactcactaattatatacaaaaaaaatgaaaaataaaagagagagtcctttgccatgatcccctgctgctggtcgtaatctgttgtcaaatcagtgataatcaccaaaattagtattgaaataatgactgaaataatcagagaaaaattaattgttttatgtattcaaatatttaacaaattgggttggtcagaaatcattaccctaattagttagtgcagagcaaccaatagtcaggcccggaatttaatggacgtctctaatttcatgatttttcgtgtcttatttatacagctccagtggcaccaccaatgcaacgccccgcagacagaagacccgactcccgtcaacgaaaatgggccagaaccgaaggatgccacagtgaagacgtttcaaaatcaacgcaggttgacaagacaaacctccaaaacgaaatcccaaattcactccccaaaattgacaattttatatcctccaactgcaatcttttcaaaaacaattcacccattgattcaataa

SEQ ID NO: 53348 - DNA, 488 bp, Heterodera glycines
  Genomic contig location: Contig_ID=SeqID_4141; Location=1617..2104; Strand=-
  SCN-specific regions: Sequence locations=1-110,134-143,219-405,442-488
atgattgatcaaatgtggcaaaaagtgtacgaattaggcgatgattgttcaatgtgccaaaaaatgcgcaaaaaatgggaacctcatcaaaatgaaacttttttcgttgtgaatgtatgatggctttctgctgctgatgctacaaataataatattgtttatttcaattaaaatttttgtttatttattttcaacttatttattttatgtaaaatattgcacacaataatcatttataaaaaaaaaagtaaagaagtctaaatattttatttagtttttttggtatcttttcaaaagaatttaatttttttatgctaattttaaataaattcgctttattttgcattaatataattttttagacgggaactttaataagtttggctaagaaaatgctcaaattggttattttttatttatttattttcaaaaataaaataaccaagctgcctcttacacttttgatggaaatcaggtcaaatgggtaa

SEQ ID NO: 53349 - DNA, 273 bp, Heterodera glycines
  Genomic contig location: Contig_ID=SeqID_4142; Location=680..952; Strand=+
  SCN-specific regions: Sequence locations=1-17,40-273
atgttggcactttgccgcttccttttcccattggatttgggttttttatttttgatcatttttccaattgttaacgctgagcagcagcagcagaatctgtggagtggcttttaccaaaattttgcgctcgaattgccccaagaggagcgatcggacgacactttggcactgtttgccgagatggacgaggtcgacacggtgttgaccgatggaattggcgcagcaattatggcaccgccgagcccagcacacccggcattccaggcaatttga

SEQ ID NO: 53350 - DNA, 353 bp, Heterodera glycines
  Genomic contig location: Contig_ID=SeqID_22665; Location=1240..1592; Strand=+
  SCN-specific regions: Sequence locations=1-28,50-57,122-353
atggaagagggcaactatgagcaaaaagtaaaataaaacccaaacatttttatcgactttttttcaaataaaaaaataattttattttaaatttagagtttaaaaatttaaactttaatttgtaatagaaattgtcgcctgcccaattctcgcatcatgcccccaaaaaaagtaaaataaaatcctgagattttcaaaaaaaataatttttttttgtttgttttttcagacattggctcaacttttgaagcctctgacaattgtcacgcgcagtgcacaacgaggtgcagcggaggaggacgcggtgccgacaaagagacaaatgggcatacgaagagggccacttgcaaatc

SEQ ID NO: 53351 - DNA, 494 bp, Heterodera glycines
  Genomic contig location: Contig_ID=SeqID_22666; Location=277..770; Strand=-
  SCN-specific regions: Sequence locations=1-107,129-254,288-449,471-494
atgattaaaaggttcccgaaactaacgagcaaactcacttttaccaatttagtaaaattggacgaaaaagaagtttactcacccgttaaaaaaatttcggcgccacaaaaaacaaagggaaattgccaatgcggacgcactgaaaaggcgacgatggcgaaattaacgctgacaaatttggaggataaaaagcctattgagcttaggtttaaagaagacgacgtgcttggtgaagggacttattcaaaagtgagaaaaattaaaattgaaatttttaatttttaattgcttttgtccgcttttgcgcttcaaaggtattccatgtcgaattgaagagcattggcaccacaatgtttaacaaatgcgtggcgttgaaaatgactcggaaagacttggaaagcagcgattggcaaaagcacaccaaagagtggaaaattcagaaggcatttgaccaactgaaggagcaaaaacacgtcatcaaactattcgcttag

SEQ ID NO: 53352 - DNA, 1253 bp, Heterodera glycines
  Genomic contig location: Contig_ID=SeqID_22667; Location=92..1344; Strand=-
  SCN-specific regions: Sequence locations=1-17,46-245,267-277,300 -391,413-698,769-1253
atgaacagacggtaagcaatttaaaaaaaattaaaattttaaattcccaattctttttttcatgtttcagttggatttgtaacgatgtttggatggacattctcccatcttttgaccgtccccaactcggcatcaaaatggcattgctttccgaccaggggtggagcgcgcacagaaaaatctcgcgtccgcgcaccgcggatcgcgcatcaaattgccgcggatcgcgcaccgcggatcgcgcatttataaaaacataattcaaaaatttcaataatcaaaatggtaaaggaagatcattaagaataaatcctgcgctgctgaaaaggcgttccgactcaacacttcccggtggcacacttgagaattgtcagatttctcaattttttccttctttttacgtaaagcttcatccctttgcttgtaatgttcaggatgcttagattttaaatggcgttccaaatcagatgttcgttttctcggccctctgtcaactttataattgcatgccttgcatttggcataagaagaattgtcaattttgtcaaaataaaaccaatagagtctttttcatgagtcatttggttttaaattacagaagaaaattgtctagaaaagttaatgaataatatttcttatttttggaggaattagtgagaatccaatttctaaatctcttgctttttatgtacataaacaaaaatttacttttaaataaatttagttataaaacaatcgctttaaaaaaatttatttgtaaaaattttagtcaaaaattaccgcggagtcccaaattccgcgcatcgcgcaaaaaaaaaaaaaccgcgaccgcggatcgcacatcgcggcgcgcccccatccctgtttccgaccgcttcgatgcatttcagattaagtcattttaaacttttttgtatattaaagcatttgtatgcttcttcagctacattgactattccgtcattgaatttgttcgttccaacaagcaaatttgggacagaatgggcaccaatttggagttgtccattgataatgaccaactgatttgggatgttttttgccgtgaaatttggccgaattttgcgacaaacatccgccatttgagctttactaatgacaatcatttggacaatttgcgcaatggcatttcactgacaattctcaccgatctcaatcatctgaattcaatcaattccaattttctgttgcctgatgcaattgctgatgatgggccaaatgcttctgccggccaa

SEQ ID NO: 53353 - DNA, 566 bp, Heterodera glycines
  Genomic contig location: Contig_ID=SeqID_22668; Location=803..1368; Strand=-
  SCN-specific regions: Sequence locations=1-62,152-387,410-446,469-566
atgaaacgaatcctattattctctgttattgtattgttaatcgttcaaattgaaattggagcagaaaagaaaaaaacggaacaaaaaacatttgacgaaatatttggagaaaaatgggaagaaaaagaaaatgaacagaaaatgaaagaaattattgaaaaatattatcaaattaaagagaaaatcaagcaaagggggagaaaatattcagcaaaagaatggagcaaaattgaatggaaaattggaaaaaaattggggacaaatcgccaatacatttataaatggatcaaagaattaaatctccaaaaaaacaaatgttataaatcaaaaacggatgaccaaaaaattgaaattgtgcaaaaatttattgcaatgaaaaacgagtacaaacaaaaaggaagaaaatattcggcaaaagaatggaagaaaaattatgccgaaatttgtaagaaaattggagtatgcaaaagagtaattgaaaaatggaagaaacaattcggattgagtagacaatgattaacggagaaagaaaaaatggaaaaaatgaaaatttatttgcaaataaa

SEQ ID NO: 53354 - DNA, 845 bp, Heterodera glycines
  Genomic contig location: Contig_ID=SeqID_22670; Location=360..1204; Strand=+
  SCN-specific regions: Sequence locations=1-263,285-317,438-442,465 -535,569-663,730-845
atggggtataaaagagcatatacggtatctcgaattcgcaaaacctagctaatttaaattcgaatttacaatgattttagaaaagagtaatttagattttcgactttttttcgagttcgggtctgtgattcgaaattggacaaaatcaatgtcagattcatcttcaccgaacccgaaaacccttggaaacatattttcagtgactttttaaaaaagtttgttgttattagggtttttaggtaatttatgcaatttcttcattctcatatattttattacaaagatggtttgcatcccatgaaatgcgatttgttttgtttaaataattttaacagtttttaatttaattattcttttcttattatgctttcaactttttttttatttaaatttttaaaatttatttaatttatgagtttattaaaatgttatttaatgaaagttcataattttctgaatataaatattgtaattttcttccagagtaatgtaacggtcgtagaaactgtaatcgcaaatgcggctctttcatttcatttttattattttttgtataaatatttaaattcattacggcggtcagcacatttagccggattaataggggaccgctatttaataattggtatagttattatgtttaagaatctgcccgatgaatcgataatttaattaattaaattagattattgtgtttttaattaaatatttattttgtttaaatttatactcttattgttaaattctttgtgtacataggcacaaaaacctgcagcgatacttattgatttatttatatcaatttttgtgtcagctttatatattacatttttgaaagccatgta

SEQ ID NO: 53355 - DNA, 904 bp, Heterodera glycines
  Genomic contig location: Contig_ID=SeqID_22671; Location=186..1089; Strand=+
  SCN-specific regions: Sequence locations=1-87,109-904
gctttatcttctgaaggtcgtatcagcaagctttatgtggaatgtttcaacgaacgcgagaagtgtttaacggtcatcggagggggcaaaatggctactgctttagtgcatggattagtttccgctggtagggatttcgtttaaacaagacttaacagacccttaaacacccgaaatatttttttgatgaataaaagtaaataagctgcttatattgtacttttaggttttatcgacaagtccgaagtgaatatctgctcaagatccaaagaaacggcctttcgttggacggtttttaaagactgcgactgactgggaacggtttttaatttcagacacaaggttaccaaaatgcatatacaaatgatgaattttacagcaaagtgaaaaagccacgtggtaacaactttttgcttatttttgaagacttggtcaatttttaggaattgtgattgtcgcagtaaaaccacagatctttcccgggtttctcgacgaactgcgtaaaaatggttggcttaactttgttgggcctgaagtgctttgtgtgtccataatggctgggattgcacttgacacctttaaacagcaggcacccacagttgttggcttacgtataaaccttttttagttgaaattggttggtttcaatggccatgccgcccgttttatgccaaatgtgaattgtctcgtttctgctggtatcgttttggtctgtgccgatgactgtgttccgacggagatggtttagcagaaattgctctagttatcaaattcatgcaatttgtaggtgactctactgctggaaatgggttcaaaattagggtattcagttcgaatcgacgagtcgctttttgacgccgcgtccgcccttgcgagctgtgcacctgcatatgtacggatgtaa

SEQ ID NO: 53356 - DNA, 921 bp, Heterodera glycines
  Genomic contig location: Contig_ID=SeqID_22672; Location=3..923; Strand=-
  SCN-specific regions: Sequence locations=1-20,42-275,297-552,574 -807,829-883,905-921
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcaaaattaattcttcaatgtggcccaaattttaggcccccagccacagccccttgcttcccccaggttttaagttttggatttgtcaaataaa

SEQ ID NO: 53357 - DNA, 976 bp, Heterodera glycines
  Genomic contig location: Contig_ID=SeqID_22673; Location=241..1216; Strand=+
  SCN-specific regions: Sequence locations=1-269,291-346,368-396,427-976
atgatggaagtcagccaaatccagctgaaaatgctgcgaccccttttgattgccatttacgtatgtattttcatccgtttcccattgtttaggcatttgtccgtgccaccgccacttcttccgcctgcttcaaaaggccatttttggcaaccatgtctgttttaacaaatatgaatataaataagctttttagtctatattttgggctttttaagtccatatttggcgttttttagtccatataatttataaccctatttataagttataaaaattaatgtcaaaataagttggtggacgagcacaaccatcggatcatccctcgtcgtcatcacccaaacattcgtcttcttctcattcttcttctgaggatgaagcaaagatggcttcatcatcacttcctcctcatcatcatccccattcatcctccgactcggaaaaggaaggaaaaaacccaaaaaatgatgatgaatttgaagtggtcgtggaatatgtgccgaataaacattgaaacaaatacacaattccggtgaaacggacggacactttggcaacattgaaggacaaaatccgggagaagtacaccgaggattacaatcagtacggatttggcacaattgaactggtcaaagagttcaaaacggatgaacgtgagccatttgtaatgagagatgatgttgagctttggcacgaggatttggacgagtacaaaaccatggagcaatgtggcattagaaaagggtcaacggtttccgtgttttatgctcgtcgactggacaaagaagaatatgatcaaggattttacatccgtccttggccgacaccgaaaaagatttgcttttaatgcttttcctattgcatagtttttcttcaatagcactgaaaattccgaaaaatgcattctttaggttttcaaaaaaggcaatgacgaaaaaaactcgaaaaactaaataatttcttggtataaattgtgaaa

SEQ ID NO: 53358 - DNA, 65 bp, Heterodera glycines
  Genomic contig location: Contig_ID=SeqID_4144; Location=11..75; Strand=-
  SCN-specific regions: Sequence locations=1-65
atgaaactcgtaggcctcgactcatactgtttgttccgaaaaacgagcaaagaaagtttgaaatt

SEQ ID NO: 53359 - DNA, 1638 bp, Heterodera glycines
  Genomic contig location: Contig_ID=SeqID_4144; Location=1096..2733; Strand=+
  SCN-specific regions: Sequence locations=1-156,183-490,512-709,785 -809,843-1101,1182-1451,1473-1638
atgtcatcctcggctgctgccaatgcacaaatgagccatgccgccgccgccaacaataaccaccatcaattcgccccacacgctcccccgccggtgccggtgccaccacccactaatttgttggcaaatcctggcgcaccaccaccgccggcaccaccaatacaacaacagcagcagcagaacacgacaacaacggcacaagtgggagttttttttgaagaagaagaataaatgtttaattggattttgggcttacattttttaaatgcaaaaaaaacgatggggatgagtaattaagttttggggtcccaataacttttttttctacaaatcgcatcccaaaaaggcggtgaagctttggcgactaaacaaataccaaaatgaagcataaaaaagtgccgaaaatataggacaaaacggcatttcatccctcaatctgatccatccctcggcgcatgtctgtttccttaattctctttttaatcgcaggttcttccaccgtccgagttcaattcgttgtccaccgctcatcaacattcgcttgtcgccccacctgttgggcctccaaatttggcacttccaccacccgtcgagatggcacaccaccaacaaatggcaccgccactgaccgcggcactcggcttttccgccgtcacatcatcgtccatcatcggcggcgtcagtaacgggcaccaaacaactttcaaagaaaattttaaaaaaaatttgagaaaattggaaataaaatttaattagaattacatttttttttcaaaaaaaaaatcagaatgatgaagttccctcaactgaaaaattttaattgaaattataattttttttttgtaccaaatgccattgtacgaactgccattgaccctgtggttggacacaaaaaattaaaatttcgcaaggacataaactaaatttccaatgagtttctaggacaaacaagtggatgacagcagcgatggcaaagctggacaacaacaacatccacaatcggagggcgaggacgacgagcaacacaatttcaggcattgtgccgaaacctactcggatgaggagacagcgtcagcaaataatggtgagaaggcgtcagcgtttaatttaatgaaatttttttttgttttaatggaaaaattttttttttcttttaagaagatttttttattcattttattgcaatccctctccagaaataaataatttcggtcggcaaaaattaaaaaatttttccaaattcagtaaatttttttcttttaaaagttgccgagtattttagggttttttgttacgtaattttttgggatatgataactttgttatcactttttaaactatgtctgaaaaatgtaaactggtacaatttattcaattttttttttgtaaaaaatttttgttgctcaatcgcctttattcgaaaattttcttcttttttagtattccattattttattgattgctttcacaatttcagtttggtgggcaacgacgtttggatggacattttccccgtttttaaccatgctcaactggcctcaaatcggcgcccttttcaatgcgctggtgggcaaacattttgatggcaaaagcgaataggcgcccaaaaacattctcggtttcaaaaaccgctgcgaa

SEQ ID NO: 53360 - DNA, 2073 bp, Heterodera glycines
  Genomic contig location: Contig_ID=SeqID_4145; Location=60..2132; Strand=+
  SCN-specific regions: Sequence locations=1-542,566-1649,1692 -1694,1716-1881,1905-2073
atggcacttctttcgccatgtttcgaactttggtggacaaacatttcgatggtaaaaagtgattgttttttatggtttttgttgttttttaatgattttgtgcaaaaaaggggcctccaatttcaaacactttagcctaaaagcaaaattcggtttttttgtaaatgtgaactattttagtgtttttgctttttttttgtaattttatattcttaagattttcagcaaccgccaaaatgtttggatggacattttcccactgttgaccgtcctcaactcggtttaaaattggcactgctttcgcccgtttcgatgttttagtggacaaatattttgatggcaaaaaaagtgattttttagggtttttaattaaggattttgtgcgaaaaggggcctccaatttcaaacgaattttgcttaaaagcaaaattcggttttttttgttgtaaaagtgaacctttttttttagggtttttgcttatttgctgattttttatgttagaaaatcacatacatttttaccaactccagctagacagatttatttacctttttcatgtaaaaatagtaactttttttagggttttcgttaatcatatttttgtattttataaaatatttcgttactttttcagcacataagcaacaacgtttggatggaaattttccttttttttgaccatgctcaactcggcctcaaattggcactgctttcgcccgtttcgattagctggtggacaaatattttgatgaaaaagcaaaatgactgtgggccacaaatcgaaaggactaacttaaatgtggtaagtatttagttttctcggttctatggcccgaaaaataaaaaaaattcaaaattcgtaattttttttgatttttttttgtgtcagtttttttagtgtcttattgttacgtatttttggatttaatgatttttaagctgggccttacatttatatttttccattatagtcataaatttctttgtttggcaattacatggcataaaaaatttttttggaaattttgtatgtttttgcatttttaatagaaaaatttttgtttcgtgtaaaattgctcagagtttcggtcaacaaatttttgtccaaccctattgcttccctttccgctaaattattaactttcataatttcagttggtgttcagcgatgtttggatgggcagtttcccactttttgaccgtcctcaactcggcctcaaattggcactgatttcgcaccgtttcgatgttttagtggacaaacatttcgatggacaaacgcgaattttttcaaatttcggtaagtcttttgtttttgctttttttgtaagtgattggttttttttgtttacttaattgaagtcgtaagtttcatttttttcaaaaaattgaaccttatgaatttaaaattggtctctaaaatcgcagaatttttaagtttctgtggcaaaatcataaattatttaagaaaaaaatcaattacaattagcagaaaccttgcttgattttaaattatcacgtaattatagaaactttaatttttagaaagtttttcattttaaaagataatttagcaattttttagtggaaaacccccataaagccagaaagacaaatatatttttactttttttcatttaaaagtaccaatttttttatgtttttgttaatcattttttaaaatttttttggattttaggagtttttcccttttttggcattgctcaacttggcttaaattagcaatgctttcgctcggtttcgatgcgttggtgaacaaacatttcaatggcaaaagcggattgctgcgcaagttttttttcacgaattaaccggttaaatatttttatgctctaattttttggatgcattcggcaattaaaaaattgaaattttcaaaattgtattttcaaacatgaaaatcaattattgtgaatttttgaaaatctcaacattgttgcggtgatgctgtttcaatcccgcaaactttttgtgagattaaaacaattctctcaggatattgctgtatttggccggttaaaatcaaattcatcgatttgaccatgatttga

SEQ ID NO: 53361 - DNA, 367 bp, Heterodera glycines
  Genomic contig location: Contig_ID=SeqID_22675; Location=915..1281; Strand=-
  SCN-specific regions: Sequence locations=1-2,24-367
atggaggaagacgacgacgaagacttgcaggaagaagctggcacagacgttcagtccggtaaaacaatgactaaaggatgatctgcatccccttaacaataactcctttaagggcccacgcaaaaggctaagaagaaaactttggcccaagtgttggcgccgcctaagaatgcaggcaaagacgtgcagtctggtaagtagttttaattttcttatgtgtccatccccctgcactatggtatgggtacggtgtcaaaccatccacataccaccagctatgtgaatggataccatccacataacagatgaaatgagcatgattgtcttccaactacatgaattggagaaaggcaatatgaaagattaa

SEQ ID NO: 53362 - DNA, 993 bp, Heterodera glycines
  Genomic contig location: Contig_ID=SeqID_22676; Location=46..1038; Strand=-
  SCN-specific regions: Sequence locations=1-773,810-924,946-993
atgcccaccggcagcagagtgccgttaattgtggaaagacgaagtgatgagacggaggaggacacgtggacagtttatccgacggcgggcatttgcatcaaattcaaagaggtgacggtggggaagggggggggcaacagcacgccctgcttttgcgggtcgtctcacaaaaccccgggcccgaaaacataatgaatttgacaatacaaaaacgtgctggtttcgggcatccgatattagcgcaactccgagtcttacactatcactgaaaagtcgcatttaggcccatttctccgccgcttcgtccgtctccggcccctccacctccaaattcttcatcaatttggcccattgcactgagctgccgccgccccatcggcacgccgaattggacgaggacaaagtggcacaaatggtggaagaggacccggatgcttttcgcattccaatttgtgtgggcgaattggaccgatcggcggaggaccgcagcggcgaagcggtggcaaaagttggttggacaaacaaacacatgttggacaattggccttgaagccgcacacctaacgcattggtcgaattggcaatggaaaatcgaagcgatggggccgaaattattagtcaatagaacttctgtccatccgcgccattcgtattagccaagggaataattatcacccattacactgattggcattgccaatgcgttcggcgtgtggaaaccgtttgtcacaagttgtggccggtcattcgctttctcacaatcgacggtcgggaaaaataattttttttataaaaataaataaaaatttcttattgttgtcaggtcgatgtgctggtcaattcggagttcttccacaaacgcatcagtcaatccgagtttttccgtcagctgacacttcgaatcgtttgccaggcaattgaggtgaaatggttaaaaatggccaacatttatttttttattcagtgaattagccccgttgatttcagattaaa

SEQ ID NO: 53363 - DNA, 1731 bp, Heterodera glycines
  Genomic contig location: Contig_ID=SeqID_22677; Location=1..1731; Strand=-
  SCN-specific regions: Sequence locations=1-362,385-714,737-868,926 -1250,1273-1693,1728-1731
  Gene Ontology: Cellular component=membrane; Biological process =regulation of protein activity, epigenetic
gtgtttggaatgccggagaattgagtcccagagattgaattgctggtgggtttagtttcagtgattggaatgtcattgaatgccggagatttgagtcccagtgtttggaatgccggagaattgagtcccagagattgaattgctggtgggttgagtcccagagattggagaaaagccaagaaaatgatgcgagggcgcgaagcggccgagccagtcgattttatcattcataattctataacacaatcgtactgcctagcgggggatgcgccgaaggcgctgaccccgctagttatcaaaataagaaatcaaaaagaaattgattagattttaaaataacgcgaaaattaaatatggggttatgttcaattgtttcttttaaactttgagtccttattccgcgaggaaaagctttattaacgttgtggcaaaaaaggaaaaaactttgcccttttaattttctgccaatgaccgacccttacgcctatttttatgacaacaaagtcagcaacagaaagggcaccgcttctccctttcaaagcccacagcagccgcaagacatttggtacagcggaggaaacgccgcgacgaccggcgaaacggcgggggccacggaatttgggggaacgcaacagcaaagtgcgaagaggggaaaaggcacaatggaaaaacagagcggaagaatatgccaaaactcgaaactaatggaaattgtaaattaaggctttttcaatgggcaaattgacccgcaaaatgcgccctccccgccaaaccaacaaccgttttacccgaattacttcgctgctcaacagcagcagccgaacttgttcatcccgtcgatgccctcccaagaaggtgtgcttttcacttttatttataaaattaaatttctgtaaaatattttttaatgttcaattaaatttaagcgctcaaaattgtgattcagcgctttttttgttaatatgtacataatgttggctcgtatttctactttaatattgttactctaaatttaagccgtgatcatattcataaaaacaggcattttttgcccttagattgccccccccccctccagtaaatttccctttgttttagccaaaggattcgacagcgaattcgacgacattgccaatgagccgcctctgttggaggaattgggcgtcaatttccagcacatttggctcaaaacgatggctgtgctcaatccgttgggcatcgcatcggccgaagttggaaattttgtgccattttttgcctttgtctctttccctccaaattcattgtttttaatgccctctatttgttgaggtgatcgccgaccaagacttggccggtcccctcgtcttctgtttgctcttcggcgcctctcttttgctgcatggaaaagtgaggggggcgaacgttttggcatccgaacttttgggccctttcaatttggatttaagtttttgtttcttcgtaatcccctccctccccctgttttacaccatttcccccattttgggtccatttcggccacatttacggcatcggtctgtgcggctgtgtcggcatgtacgccctgctcaatctgatggcctcccaacacaactccatctctttcacttgcaccgcttctgtgctcggctactgtctgctgcccatgtctctgctctctctgttgggcgccgttctctcattaaatgtcccgtccgtctcttttttccccctttccccaaaaaatcattt

SEQ ID NO: 53364 - DNA, 862 bp, Heterodera glycines
  Genomic contig location: Contig_ID=SeqID_22678; Location=199..1060; Strand=-
  SCN-specific regions: Sequence locations=1-309,340-862
atggaacgacaacgagttggagatgtacaacaggtggaaggcggagagtgtgcatctgatcacactgctcgaggaggtcaaacgactgcacgcttctcaatgatttgtgggaagtcgggaggatgtacaaaaaattcatgaaatggctatgatcttctattcttaccatgtttttttgatgtaatattgcattgaaattaggtacatattgtacactgtattcaagttaaaattttgtttaattaattttcacacaaatacattgattgtcctgctggcgcgcaagtttcgctaaacaaaatgtcatagaaaacccaaaaaatgaataaattgaaaaattgtcttcacacaaattaagccccttccctgagcttccaaaagaacccaaattcacttccctccctccgttctataaaaaataatttatgggagcgggtgtccaaacttttccgggaacgggaatcccgtaaaactcccgctggtcctacttaaaaccgctaaattgctcaaattagagggcgaattggttttttttctttcttaaacaatattcagtgacacaaaccaaataacaatggccaatttgggaatttctttatcgagcatcgtacaccatcattttgcggctgcgcttcttgtacagaatacggtaaccacactcccggcaacggatcgggtctttgggccggatttcgttttccttgtggcaatctgtgcaatgcgcgggaagcaaatgaataccatcaaacaaatcgggcaaaacccaccgccgcaaatgtacgtgacggtgccaagtgaaacagtgccaatgccgccgcccgtcgatgccctcgtcggcgccgtgccgccaccaaacgactga

SEQ ID NO: 53365 - DNA, 374 bp, Heterodera glycines
  Genomic contig location: Contig_ID=SeqID_22678; Location=151..524; Strand=+
  SCN-specific regions: Sequence locations=1-374
ggcttttctttgccattttatggacagtgcagcgacaacccctcaccatcagtcgtttggtggcggcacggcgccgacgagggcatcgacgggcggcggcattggcactgtttcacttggcaccgtcacgtacatttgcggcggtgggttttgcccgatttgtttgatggtattcatttgcttcccgcgcattgcacagattgccacaaggaaaacgaaatccggcccaaagacccgatccgttgccgggagtgtggttaccgtattctgtacaagaagcgcagccgcaaaatgatggtgtacgatgctcgataaagaaattcccaaattggccattgttatttggtttgtgtcactgaatattgtttaagaaa

SEQ ID NO: 53366 - DNA, 1681 bp, Heterodera glycines
  Genomic contig location: Contig_ID=SeqID_22679; Location=1..1681; Strand=+
  SCN-specific regions: Sequence locations=1-183,205-268,311-549,576 -799,830-898,937-953,982-998,1023-1069,1096-1099,1127-1155,1181 -1380,1404-1413,1437-1681
  Gene Ontology: Mol. function=methionyl aminopeptidase activity; Cellular component=cytosolic ribosome (sensu Eukarya); Biological process=proteolysis and peptidolysis
aatttcaaaaattcctggcattctaattcaagctgttgtgactgtgttccatcgcggcttccatggcgatttgaatgaaacttttctggtcggtgatgcggtcagtgaggagaacttgaagctgatctcggttggttttccaccattggaccaaatcaaaccgaaaattttattacgcttttttaattaaatttggtttttgggactagaatttgtgttttaaaaattggtaaacaaaatgagtaaatctccaattactagaaccaacaaaattttacaataaatttttttaatcttgaaaaaaaattttcttaactctacgtaatttttttttcctcactaattttcgggggtgggaaaaagcacgctgacgtttattttaaaaaattccgagaaaaaatggcacattttttgaaaatttaaacaattttctcacaaattgcattaaaatttctagaaacatttttccctggtgaaacctaatgacatcgacggatcttcattcacccattttgccatttttttttgaaaatttggccccaaaatgacaaaaaaaaaaaaaaaaaattatttttggcggaaaaggccactaattcgcaattttctccccgtcgtcgaaaatgttaaaataacactgaaaaaaacgcatcttccactcattgtcaggtcacctacgaatgtctgcgacaggccattgacattgtgcggcccggtgtcaaattccgtgacattggcaacgtgattcaaaagcatgcaaacgcaaacgggttctccgtggtcaagcgctattgtggttgtcaaaaaaaaattttttttttttgaaatttaacgattggatgaagagaatgggtccgacattgctgaaaaattttatgaattctactcaaaacgtcgtcggaaaacaaaatacaaattctttaaaaaattttcttaaagaaatttccagaaaaggctaaaaaatttttaatttttttaaaaatactgttcaaaatttcaaaaatttgtccattatctgggatttttcatgttccaactagtgaaacaaagttttttcgttttttagggccatggcatccaccggctgttccacacggcaccgaatgtgccgcactatgccaaaaacaaaaacgtaggcgtgatgcaggccggtaacgcgttcaccattgagccgatgatcaacgccgggtcttacggtcggttaaatttcatggctcggaattcgggacgagtcaaatatctggactcggacgcccccccacactttttcccttttttctagaaatttttaacaaaaaataaattgcattcaatttccttaaagacgatgaccaatggccggacggatggactgcggtgacaaaggatggacgtaagaaaatgaatttttattatatatattttttgcggggttacaatttttccccaaaaattcaaaatgctttcgcgttacttaatttcggataaaaatgtaaaaatttttcgataaatccaaaaaaaaaaaattttccccaggcgcttcggctcaatttgagcacacactgctggtcaccgagacgggctgtgatgtgttgacagaacggtcagtggctggcgctcctcggccatggttccgagaccagcttgaacaattgggttacaacagaaaaaagcggcagcagtagtgccactacgaatgcggatg

SEQ ID NO: 53367 - DNA, 1251 bp, Heterodera glycines
  Genomic contig location: Contig_ID=SeqID_22680; Location=9..1259; Strand=+
  SCN-specific regions: Sequence locations=1-2,30-81,105-947,979 -1193,1217-1251
atgagaaggaaaagaaaaagggaattggacaagcagcaaagcacgggcgagggggactcggtgtcgacaagtacagactcagagaagaaggaggacagtgaccaaacgattacgaaatcaccacaaagcgaaacatcagaaaagtcagagatggtggccgaggatggtaacatttatttgtaacagatttagggcagaaaatcagttttaaattcaacgaacaaaagttgaaacacatttacacaccgtccgaaaaaacgagatgtgtaccaataaatagagtgccagagaaaaacattatctttttttctctaattttttgtctccttttggcgtactatctaatatttttattactaggtcgttgcataaaaaagggcgctttttgaaggaaaaaaatttatgaacaaaaaatgaaaaataacaatcataacaaagccgatcaaaaagctacttaacaaagtaattgccctgactgtctacaaccttttgccgccgagatgggagtttaacaatgccctttttgtaaaattctgtgccattctttgaacctaggtaattttcactggatccacgaccttgccatattctttaaagagcctaccctataaggaatttttgagagaaataatttagccataaattaagtctatagggtccagggaataagacgggtgacgtagcatgtcctataagttgttctcctgtcagccatgggccaatgaaatttggtgccaaaattagggacttggccataaccagaaaattgagtgtaactttattaaaagtgtaacaaattctaataaatttaatatcatctgatgcagaataacgagatgaattgaatggcgtcaattttaatgcactcaaacaatttttaaaaaagttatggccaaaaaatcccaaattttcccacttgaaaaatggccaaaaaaggctttagggaagttgtttaaaattttaaaaaaggatttaaaacaaggatttcctacggataaactatgctggaataattttgcatgtgttcaaaaaatataagaaaaatcctttgtccaaagacaagtgttttctccttggccttcgttttcagaaattcgaataatcgcccataacacaattttggaaacttgtgcgattctgtaattttttatattatttaagggcataaaaagcctcaaaaccccgatggaattattttggattttgtttttgactttcggtttggccaatagatttggaaacttggccaaa

SEQ ID NO: 53368 - DNA, 1080 bp, Heterodera glycines
  Genomic contig location: Contig_ID=SeqID_22684; Location=248..1327; Strand=-
  SCN-specific regions: Sequence locations=1-206,412-918,957-1080
atgacaacatttttgaaacaaattaaatgtataagtaagtatttataaaattaatgaatgggtaattaattgctttaaaaattgaacaatttttgtgaaagtcttatcgattaaactaaaaacgctagttagaaaattttaaatgcaataataaggaaaaatatacccctaagaatcgcagtgggacatttgcggacggacatttgcggacggacatttgcggacggacatttgcggacggacatttgcggacggacatttgcggacggacatttgcggacggacatttgcggacggacatttgcggacggacatttgcggacggacatttgcggacggacatttgcggacggacatttgcggacggacatttgcggacggacatatgcggacggacattggcggacggacatttgcggacggacatttgcgtacggacatttgcggacggacatttgcggacggacatttgcggacggacatttgcggacggacatttgcggacggacatttgtggacggacatttgcggacggacatttgcggatggacatttgcggactgagtatacttactaatgagagtagtagcatgccaaagttcttaagtagggttggtcgggcccgggaccaaaacacggacaactgagtaccgaagtcccggttttgacagttttgaccgggaaattcccgggttttgccggtttttccagccaaaaagtcccggtttacctcaaattcccggttccgaccaaccctatttttaaggagtaaataataggaacaaataattgaggagtggtattactcttatctccgtgatcgcctcggtcggggttccagatcaccaacaattttgcgacaaacgaccccgatcagaccaatgaagattaagaaaaatagcgaccaaaagttgtgggaaaaataaataattcaaaaataaaagaaattaaaaaatcattttcagaaattaaagattcaattaggatttccatggtcgctggttactaaaataacatttattttgacacctaatttgatctgatcataaatttgacatattctatagtggaaagaataaa

SEQ ID NO: 53369 - DNA, 1109 bp, Heterodera glycines
  Genomic contig location: Contig_ID=SeqID_4146; Location=525..1633; Strand=+
  SCN-specific regions: Sequence locations=1-144,166-517,539-661,693 -710,737-900,923-1109
atgccttcagaagtgggaatttcgaagcatctcgatttgttacgcaaagagcacgttcgattgcaggttcgccatgccgagttacaacggtcctacgacgctttggtagtgcattttcaatcaaacatttttataaaatgcacgaaaaatgtttttcagttatcagcgaactctttggggtgcgccgatggaattcgaagtgctcaaaatgtttccacttcaaattttatccacgcccttctgcacattgtcacccaactttacgacaaggatttgtacaggtcgttcattcttaagtcgcttatggactttgtttttttgtggatttagtgacattaccattcattttgatggtcatcaattgcgtgggcatcgaattgttatcgccgcaaggaccgacttttggggcgacctttcgacagttgaacgtttagagttgacgggtaaatttcaattgggcagcagagattgtctccactgatcttagccttttgaaatttcagaaatccccggcaaagtggcaaaagtgatgatgaaatggatgtacacaaacattttggacgaaagcatcggcgactccgtccttctgccgttgttggaagcggcactcaaataccattttgaggaccttaaaacgcggtaaatggtcgaaattatgaccaattatttattcatttaaattttttttatttcaaatttgatccaactattttaaaactcttttaatttctcttgaagctgtgaagagattctcattgtgcgcatcgatgtggaaaattgtgccaaggtttaccaatttgccgaattgcattcgctggacagaatccgcgacttttgtgccgaagtcgtttccgaccggtggagcgaatttacgcctgaacattttttggatatgccggcccaactgttgtaccgactgttgaagaggtgagtcctaccaacaacaaaaaatgtttgttttttttcctcaaaaatgcggcaataatttttttttttgtctttatttgaaaaaaattttaaggaaaagcggtgccaatttgctcggctctctgatccgactgcagcgcgaagatgtgctttttctgtttctgattgagaacgacgcacgg

SEQ ID NO: 53370 - DNA, 65 bp, Heterodera glycines
  Genomic contig location: Contig_ID=SeqID_4146; Location=166..230; Strand=-
atgcttccgtctaatcctgacgacaaaatagatgaggtcgacaagattctttcaaaacttgatgg

SEQ ID NO: 53371 - DNA, 1339 bp, Heterodera glycines
  Genomic contig location: Contig_ID=SeqID_4147; Location=21..1359; Strand=+
  SCN-specific regions: Sequence locations=1-6,29-360,392-409,436 -599,622-627,650-805,840-851,886-1339
atggactttgttttttcttttggatttagtgacattaccattcattttgatggtcatcctttgcgtgggcatcgaattgttatcgccgcaaggaccgacttttggggcgacctttcgacagttgaacgtttagagttgacgggtaaatttcaattgcgcagcagagattgtctccactgatcttagccttttgaaatttcagaaatccccggcaaagtggtaaaagtgatgatgaaatggatgtacacaaacattttggacgaaagcatcggcgactccgtccttctgccgttgttggaagcggcactcaaataccattttgaggaccttaaaacgcggtaaatggtcgaaattctgaccaattatttattcatttaaattttttttatttcaaatttgatcccactattttaaaactcttttaatttctcttgaagctgtgaagagattctcattgcgcgcatcgatgtggaaaattgtgccaaggtttaccaatttgccgaattgcattcgctggacagaatccgcgacttttgtgccgaagtcgtttccgaccggtggagcgactttacgcctgaacattttttggatatgccggcccaactgttgtaccgactgttgaagaggtgggtcctaccaacaacaaaaaatgtttttttttcctcaaaaatgcggcaataatttttttttgtctttattttgaaaaaaattttaaggaaaagcggtgccaatttgctcggctctctgatccgactgcagcgcgaagatgtgctttttctgtttctgattgagaacgacgcacgggtaaaatgtgggaaaattcaagacaaaatttaaaagcgaaaagccataattttccaagggaaaaggaaattcctcttaaaacaaattaattaatattaattggttttgttgttcagctgaagacaattctgaacgatttcgattgcgacggccaattgcctttgggcatcgcttttgagttgaagcaattgaaaatggccaaatgtttgcttacgcatggggccgatgtgaacaaattggacgaaaggggcaattcccttctttggaaagcgatcgaaaagggtaattacactaattaattaattattgccaactttatcttccaaatttaattttacgaatgccagcatttccagggaacgccgatgtgtgcgattttctgattgaaaatggtgccaatttgaattatgtgcacgaagagagcggagaaacacttttgcacgtgttggccaagagcaaagcgaagtcacaatggacaccaggagaacttaccaattttgatgtgaacgcattgaacagaaacggaaggtggtga

SEQ ID NO: 53372 - DNA, 1235 bp, Heterodera glycines
  Genomic contig location: Contig_ID=SeqID_4147; Location=1660..2894; Strand=+
  SCN-specific regions: Sequence locations=1-148,170-1235
  Gene Ontology: Mol. function=structural constituent of cytoskeleton; Cellular component=membrane
atgcacgacaacgcgtcacggagtgcacttcaaattgctctcttggaacggcacaatttggaaattgccgaaaaattgcttgccatcgatgggttggatttgctctgtgccgacaaaaagagtcagttgttgttgagttattgcatggattgtttgtgtttgattcaattcgaattgctcttctcatttcagctggtcaaactctgattcacaaaacggttgccttttccgatcaaattgctgcccaatttttggctgccaacggagtgccggttgacgtgccggatgccaaagtaaattttgaggaattactgttagacaatctatggcatcatattgttagtcctcactttcctttaatttttcccaattcaattccacccccaagggttcaactccgttgcatcatttgctgaaagcgttgcccgcctttgatgagacaacggcacatcaccaccatcaacaacagtcgacaattgacccatctcttttgtccatccttcaaattctgctccagtccggtgccaatccgtcctccgtcgacggcgtttccggctgcaccgcgttgcattacgccgtctcaaagcctcgggctgtgctcgacgcgctgttgccccactgtgacagcgccaccatcggcaccaccgaccgggacggccgttctcccctctggtgcgcgttgttggcctccaaattcgacactgccgcccttctgattggggcgggcgcggatatcaacgaaaagtcggcggatggtgtgccgttgttgatcaaagcgatcgcgctaaaacgtgacgatatttcgcgctttctgctggccaacaaagcgattgctgcagttacttctccggtgagtgtgctaatgagtcatcccaattagcatatcggagcgagggagagacaaatctatgcaaattttgtcttaactatcttaaactattttcgctcgtatttttcaggatggctttacccccctcaatctcgccgtccagaatggacttacttcgacggtggaccaactgtgcaaattaggcgcaaatttgaaccatcctaacccattgaatggactcattccgttatggacggcactcgaaaacggagactttggcacggccgaagttttgatagcacatggcgctgtaattgtccattccaatgcacgaaagttcgctgtttgtgctttttctgtaggatacagaaggattgtgcgccaacgacgaacaaacgatggatga

SEQ ID NO: 53373 - DNA, 1598 bp, Heterodera glycines
  Genomic contig location: Contig_ID=SeqID_4148; Location=496..2093; Strand=+
  SCN-specific regions: Sequence locations=1-403,467-1118,1142 -1350,1372-1598
atgagctgccgcatcgacgcgcaggacgcggacggacgaaccgcggcacacattgcggtgctggagcaggatcagcacactttggaactgctcttggcccaccccgacccatcgccgctgggcgtccgcgaccgttacgggcacacgccgctggcgttggcaatgcgtgccaaacagaacaaaatggcggaagcaatttgcaaacggttgccccatgccgcgctgcaaatgaacggaagcggcgaaaatctgctccattgcgctgtcaaaggcgctgaccttgaatcagttctttttctgctcggcatccatgtgaatttcaattctttttcatggactgtactgtttaacttttctgatcccaaattggtttggtacaatatttccaccccccccccccaagaaatattttataaaaaaataatcacttaaaaatttttcaagaaaaaaaaattagaaaatttttgttacaagaaaatccaacaataaaaaggattttttgatcgttataattcattataaaatttttcgattttttttttacaattagacaaaaattctctgggagggtaaagagctgctcccattggttttgtcgctttcaccacattcatttcacagattgacgtcaacattgcaacccaagaccaggaacggatcacggcactgcacatttgtagtcgcgtgggcgaggaactcattctgcgcaatttggtaagtgttttttacactttaaaatgctcttcattttgacaattttgccatagattttggccggtgccgaaatcaatgcgaggaatgcgagtggccaaactgcgctggccattgccgcgatgcatggccatgacgaaatatgccgcgcactgttagaaaacggcgctgacccaaacattgtcagttccttttgttttcatttttacattttcatttttaggcaaatgatgacggaaacaatggtccgtttttcatccatcccaatttttgccatttaaaatccgtaacattttttgttagctttgcatgccgcagtttcccgtggttcggtgaaagtcattcgtctgcttctctccgagtcgcaagtggacgttttggcggtcaataaacggtgggtcatttgcagaatctgaattgtttttccatgctaatttggttgctacatctgtggagagcaatgcaattttccgtcttcaattgatcactttttcaggcaacaaaacattttgcacctttgtgccattaacattggccatgtttcggcggaagcgtttgtggagattctgagggtacacccaaactatccgctggaggtggccgatttgtacggcaacacaagtaaaactatggcatggcaacagcagcagccagtttctggtcttgccatttcagtgtttcttctcgcttttatcaacggcaattcggaattatgcaaattggcactgaaaaacggtgcgtgtatgggaacaatgaacagccagggacagaccgtgttcaacttctccaccccaacccaacagttgctcatcggactgctcggtacggatggtttgccatttaatggcttattttgtcattgtaaaaataagaattggtagtcataa

SEQ ID NO: 53374 - DNA, 723 bp, Heterodera glycines
  Genomic contig location: Contig_ID=SeqID_4149; Location=317..1039; Strand=-
  SCN-specific regions: Sequence locations=1-99,122-412,434-562,623-723
atggcattgcatcgtcggacggaacttcggctcttacgtcacgtgagtttttttagatgggggggggattttgaatttaatggctttacggcgtgaaaacccaaaggctttactcgccaaacgatttttacgcgtttaatcagtgaccatccttattttcttaggctacaaacatctgaaagattaaagtttagggaatcttaaatacaagaaaaacacaatgagaatatcaaaagtcagcttttcgagtatattcggcgataattttttgtttattatctttgacacaaattggttacaaaaactttgtagactttaaactttagaaaaataccaagaatgtaggtcttttttatcaagaaaaagattagtgtgtggtcaatggttggacatgtaaactgcaatagaggcaaaccaaaattaaatgacacttttggactttacacgaattttggacaaatggtcggaaagtgtgaatcttttttaagtaggggagaggaaaaaccgaataattccaacaaaaaaagagaaaagacctattcaaaattttataacttttcagacacgagaccaaacacttcatttacttctacttgggccaagtggccattcttttgtttaagagcggctgatccgactttttgagacgaacggaagccgacgatgcaaaaaacttattatggccgtgctgtaagacagttttgtcatttcatcaccaataaa

SEQ ID NO: 53375 - DNA, 461 bp, Heterodera glycines
  Genomic contig location: Contig_ID=SeqID_22690; Location=79..539; Strand=+
  SCN-specific regions: Sequence locations=1-283,305-432,456-461
atgaccggcgacaaaatgaaggccaattatgaagtggcgaagaaagcaaagcgagagcatcagaggcaattcactgccgaagaagagaggcgcgcagcgaaacaaaatttggtcaaagccaagccgaccaaatgccaaagtggtgggttggccagagtcttgaagcccgggttttagtgtgcccgagactgtttcatccggaataaaaaccgagaatttttgaattttaattgctttcatcatttagcgtccaaccaaaaggcgattcagtgctatttggacgaaatgactgagaaagccaacaacagctgggccagggttggaaagcggacggaaatgccgagtgggttgataaaataaaatttgcgaaatatttttattgttttttccaggacatcgtctaatgttggcatgactgatggaggggaaagcgaaggtgagaaaaagggggcattggtaaa

SEQ ID NO: 53376 - DNA, 1436 bp, Heterodera glycines
  misc_feature (1365)..(1365): n is a, c, g, or t
  misc_feature (1395)..(1395): n is a, c, g, or t
  Genomic contig location: Contig_ID=SeqID_22693; Location=72..1507; Strand=-
  SCN-specific regions: Sequence locations=1-12,47-382,404-431,459 -860,894-1261,1283-1436
atgaatcgacggtaaggaaatttttgaaaaattaaaatttttgtctacccaatttttttccttgtttcagttggatttgtggcgacgtttggatggacattctgccatcttttaactatgcccaactcggcctcaaaatggcattgctttccgaccgtttcgatgttttggttgacacgcattttgatggaaaaagcgaattgacaatttggaaagcaatcgcaattcgcaaggacaaaggaccaaaagcgaaactgtctgaatggatcgatggcaaaagggtggaatttccattgccggaccgtccgctgcccaccaaaattcgctttaagagcctttggattaagtaagtaattttagacttttgtatatattaaagcaatttttatatttcttcagttacattgaccattctgtgctcgcatttctccgttccaacaagccaatttgggacagaagaggcaccaaattggaattgtctatatggtcaaacaaaactgaggatgatcagcgaatttgggatgtttttacccgcgaaatttggccactttttgcaacaaacattcggcatttgagctttcctaatggcgatgatttggacaatttgcttcgtttggtttcaccgacaattctcactgatcttgatcaattgaattcaatcgattccggttatctgtcttccagtgcgatcgctgatgatggtggaccaaatgcaatttctgcttggcaggcgttggccaaatggttacacacgccgagcaaagacggacaaccgaagcgattgcgttgcgatgatttttcaaagtccatcaactatttcaaggaggtgaccgaccataatttcattaaactactaattaattgattgccttttgttttgtttagacatttctccatgccaccacttcagtcagctacaaaatttgttttgaagttttactgtggccaattgaaccatttgaattggtgaacgaacggaccaatgagaagctgacactgaaacaggagatcgatgaattcgattggctgttgcaacggtacccaattggggagacggcgccagttaagtggaaaatccgcgaaaatttgggtgccaatttatctatatcaaatttgctctacggcatgccaattattcgggtgccaatttgaacaatatccgatttgaggtgtggggtggaaatagttgcattgggtgagcagcaaaagcaatttttgattgtcgaaaaaacataaataattttaggccattgtcgctgccagcggaagaagaagaagcggatgaaagcattgaaaaataattataatttgagaaatgatcgatctcgccaataggaagctgatttgatgctctcgttttctcanatgcttttgttgatttcttcattcgattanaacatacatttaatatcaattgaaaactactaattaataaa

SEQ ID NO: 53377 - DNA, 793 bp, Heterodera glycines
  Genomic contig location: Contig_ID=SeqID_22694; Location=415..1207; Strand=-
  SCN-specific regions: Sequence locations=1-158,184-329,353-407,499-793
atcgtaaagttttcaaaattgctgagaaaattgacaatatgaagcaatattataagatgaaaaaacaaaattctgagctcaccgaccacgaaattgccacagaattgggaattccaagaagctcattatacaaatacaattccaaattaatgggcgatgaaaagaaattttgaaaattataaaccagggcaagatttttactgaaaaaaatagtaaagtcactttattcataaaggaattcaattgaaaaaaacataaattttttaatgcttttaaatataatacatacgaatttttataaaatttttcagtaagttttgtccattttttgtagtgatttgtatctatttatgaaaccaaagaaaatcatttaagaaatttaaacaggatttactataggaaaagtgtatttttctttaaaattattgatttaaattttaaaatcattaaaagattaacatgtttttggtaattaattaaaatcatttaatttattttgtaaatcgaatcgacctttctaattaaagcaaaaattgtaatgtccaaatccgataaagcgttaatatgaattttttttttatcaattctgggccaagaattttatttgtcaattgccggcccagaattcttgtttggccataaccgtttctgaattcccaactaaaatattttacatcatttccgagttgaaattcatctccccaattcaccgcgtgctcatttggatttgaaatgtctgataaatacaaatatcacttcttcctcgaaattattaaattatcttataaataaa

SEQ ID NO: 53378 - DNA, 1921 bp, Heterodera glycines
  Genomic contig location: Contig_ID=SeqID_4150; Location=1140..3060; Strand=+
  SCN-specific regions: Sequence locations=1-459,481-831,853-1262,1286 -1800,1824-1921
atgcttgaacaagcaaacaaaaatgctttagaagcgcgcaaacaaaataaattatggtttgactctcaaccacgcgtaacagccaacaaatttaaagtcggagatcgcgtaatggtcatttttcccgggctccaccgccggaatccacataaaaaactcatttggtcaaatttcggtccattcttaatacttgaaattggcgaatcttcagctaaagttgtgccaattgataagcaaaaagatgaaccaataaaagtgcccattgaacgattggtcaaagtcccaaaagggataccggacatctcaactttgcctaagggaaaaaacccgttcaaaaatgaactcaaattaatggctctatatgctggcataaattggaaattcaaaaacgcctacaaagagactaaatgttgtaaaaatgaggccccactgcaattggggacaattgcttttgattgtttgggggtggaattgggaaaaccaaaattgatttcagctcgagtgaacgtcgaaaaaggcatcatgattggctttggttggtcatccacttgtgccggagacatcccaggccatgatctgtgcgaaccaatcacccttggcagcctcgatcccgttctcggcctcacgaagcttggatcgatggtggccaagactcctctgcaagcgctcctcggcatcttcctccttcgctcgggcgttgcttcttcgctgacggcagcacagacgttggttgaagtgattgtaaaggctcagccaaaattggagctttgcatgtattttggaaagaggggtgatcagatcagttcgggcaaatacccaacggaggaagaccagcgaaaagccctggagaagtgggctgggtcatgttatgtggccagacaggctttggcagccaccggattcaacccgctggaaatggaggagccagaaggagtcaattcccttcctgaatccgaaaagctgaagtggaaagaagtgtttggccaaagcgcttgggccctcgaatgtgtgcgggcgacggttgtgcacaaagcgggccgctttttggcacaccagcgcgttttgctcggagattcatcagctgccgccctttcacaatatatccccaattcattttgcattggacaggaggggtcaatggcagacatcattcgacaatttcagccgaccattttgtcaagtcgagtaaaagcgatgcttataatcacaggccgtgactcgcttgtcgccggagaaactgccgaatccattgccgaacaattcgaaatggtggtggagctgtgccgtcgcttcagtcatgtcaaaatttattggtgcccgcccccgtatgtccacaacaaatccgctgaatatgatcaattgatcgacaaaatgagggccttaataaataatggacccattatttcaatttgcatcacagaaaaaggccgctctgttttggaaattttccgttttggaggagccagaaggagtcaattcccttcctgaatccgaaaagctgaagtggaaagaagtgtttggccaaagcgcttgggccctcgaatgtgtgcgggcgacggttgtgcacaaagcgggccgctttttggcacaccagcgcgttttgctcggagattcatcagctgccgccctttcacaatatatccccaattcattttgcattggacaggaggggtcaatggcagacatcattcgacaatttcagccgaccattttgtcaagtcgagtaaaagcgatgcttataatcacaggccgtgactcgcttgtcgccggagaaactgccgaatccattgccgaacaattcgaaatggtggtggagctgtgccgtcgcttcagtcatgtcaaaatttattggtgcccgcccccgtatgtccacaacaaatccgctgaatatgatcaattgatcgacaaaatgagggcctta

SEQ ID NO: 53379 - DNA, 1193 bp, Heterodera glycines
  Genomic contig location: Contig_ID=SeqID_4151; Location=672..1864; Strand=+
  SCN-specific regions: Sequence locations=1-138,299-1193
atgcgggaggaagcgaacatttcgccggccgatcatttggcactccaatcacttcgatcgtcggcattggcaaggaaaactaacacaaccacaaaactgacacgtgattgccggaaattgttcgccgatttgatgacgggagaagaagacggagaagagaagcagaaaaagtcgaatgagaaaaaggaaaagccgaaaatgaaagaagcggacgaaaagaaaaaggagcaggcgaattgtgagaagaaagagcaaaagagagaggaaaaaggaggggagaatgagcgggagagagggagtggcgcggaactgatggctcgtggtccgatcagagtgccaccggtggtgggccggtaagcgtttattaccatcccccccccccaaccgatcgtccatttcattccgtcactgttctccttcagcggtgctccgtccgccgttttccacccttacgcctcttctgctgctcatcccaatgcgcagtcttctcccaccaacgactttatgtccgcatccgtctccttcaacgccactgcgcttcagtcaacagtttttgatcaaagcagttacaattccatggctgctgctggctatggctacgagtgcgggctgccgagcaattggagttgcgggggagggagtttcgggtgctattcgggcctttcttcgccgagcactacgcctgacacagtgtcggcgatgtctccgggcgatcgtagcgaaaaggtcggtcgagaagtggagaagggtcggcgtaactgatgatcattggttgcagagcgagttgcctgacgacctttctgacttcattttggaatactcgcgccgttattcgcccgaactgtcgcggaagtgttcgcttggctcgcaaggaattgccgggggcagtcccctgtcggactcgtcgaccgacgacgaccgactcagtctgtccagcggcaattcgccgctctgtgccccccaaacgtattccacccacaacctctctttctccaaatttgaccgaatgctttttgagttcgcccgcagcgcctcggggcggaattgcaaataatgaaaattctccgcagttcaacacaaaaggcacagcgaaagcgaaggaaaagccgcgaccggcgaaagaacggctgagagcaatgattcgaagcgaagacatggacaacgcatgggcatggacatgcaaatgcattcag

SEQ ID NO: 53380 - DNA, 840 bp, Heterodera glycines
  Genomic contig location: Contig_ID=SeqID_4152; Location=319..1158; Strand=+
  SCN-specific regions: Sequence locations=1-73,104-840
atgtctggatgtgagacagtgtataatgagatcgtaagcgagtcagtaataacagttgccagagaaggagggcaaatttttaaaattttataactaatattatcgggagaagtgccatttttattcggaagttttttcaggagattttgggtctcgatgatgttaaaatttatagttgatatataagcatacatcaaattctataagattggacgccgtcctggaggtgtgttttttccacttttcatttatttctaaatgaatttcccttaggccggggcttcgccaaactctcaaagtttccgcctccaacgcgacatgccattgcatttcgctgctgcgcatggaatggtcggagtttggcgggggcggacactcaccgaccttctgacatttccagactcaaatcgtcaacattttgtgcgctcactcttcgatttcattgaatgctcagaatggaaatgtaagtatgggggggagggacaatccgtccgaaattacttattttgttttatacttaatttccattgccttgcaaagccttctcatttatcttttccatccccagggccttacgcctttactaaacgcgttcaaaaatcacgcggagcgtagtgaagagtcgcagagccaaataaacaactttggcacaatcgaagctttgctccgtttcggcgccgatgtgtcattagccgactcggccagcggaaagactgtggtgcattacgcggtggaaaagatggatttacaactcattgaggtggtgcattttatccattttataactatacatagaacttgcacaaagaaagtcaaataagaaggcgtaggggagctaaa

SEQ ID NO: 53381 - DNA, 267 bp, Heterodera glycines
  Genomic contig location: Contig_ID=SeqID_4152; Location=1264..1530; Strand=-
  SCN-specific regions: Sequence locations=1-267
atggagaagggtcacaatgtttggataaatgaaatgtaagtaatggttcaagggatattctgaaaaacgagtgggatttccgattttaggggattgtcattgcttagtgccagtgtttgctccgcaagtgatcagtgccaaacacatttgttccctttgggatttttccacgcggtcagtcattccgctcaaattgttcattggtgtctcaccacaaaaatttttctgatcaaccaattgggccattcgatgctcactgacatttga

SEQ ID NO: 53382 - DNA, 707 bp, Heterodera glycines
  Genomic contig location: Contig_ID=SeqID_4152; Location=2452..3158; Strand=-
  SCN-specific regions: Sequence locations=1-222,244-467,498-607,629-707
atgaattctttaattttgaatatagggttgttcaaaaaaagtaaaaatggcaaaattggaatttgcttagtgtgcaaggagcaaaatagacaaaagtctgaattctcaatcaacgacagctccacgaagagcctaattgtccacctcaattcgtcgcttcataaaggatcggaatatgacaaaaaattccaacaacttgagacagaatggaaaagcgccaaacaaaagcaacagaaggaacagccaaaaattaccaacgtgatgaacatgacttcctccggtagaattatccattaattttattcagtatcagtaattagtaattaggaacgattaccattgccgacaaaaaaataatgcattacattatctgtaacaacattacatttaaatcaattgaccatcctacttttcatgctcttatgcaacaggaggttaaaaagaaagccattataggtttgtttacgaatacattgaaatataaaaattaatgaatctccagaacagaggtcgtcgaccccaactaattaggagaatgatttgcataataattaaaggaggcaatataaagattcaattcaaaatttagcgctgctattttataactaaattaaaaattttccaaattattcgcttaattttttcagacttttaccaagaaatctcgtttccaagagctaaataattttgtcctaaatataaataaa

SEQ ID NO: 53383 - DNA, 403 bp, Heterodera glycines
  Genomic contig location: Contig_ID=SeqID_22697; Location=2166..2568; Strand=+
  SCN-specific regions: Sequence locations=1-20,89-107,155-172,379-403
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggat

SEQ ID NO: 53384 - DNA, 185 bp, Heterodera glycines
  Genomic contig location: Contig_ID=SeqID_22699; Location=133..317; Strand=+
  SCN-specific regions: Sequence locations=1-89,112-161,183-185
acaaaccctcgtcctcctcctcccgtcggtcgtcgccgttgcccgtccaagtgggccaagactatgtgagcaccattgaactcagcaaacggggaggcggcgccgctgctggcggcggggaccagcgtggatggccactgaagtcgccgacgacgatgaccgcctccacctcgtccgcctgttag

SEQ ID NO: 53385 - DNA, 217 bp, Heterodera glycines
  Genomic contig location: Contig_ID=SeqID_22700; Location=1228..1444; Strand=-
  SCN-specific regions: Sequence locations=1-134,157-217
atgtcggcacatccaactgcgtactgtccgttggcgagcagcggcaacacattgccaaccggtggcgacggtgacggagccgcggcgactggcggaggttgctgcggcagcgatggagtcgtgccattcggcggtggtggtggtgacggcgatggtgtcgttttggatggcaataatcccatagcaaataaagacatgaaaatttaaacggaataaa

SEQ ID NO: 53386 - DNA, 158 bp, Heterodera glycines
  Genomic contig location: Contig_ID=SeqID_22700; Location=1263..1420; Strand=+
  SCN-specific regions: Sequence locations=1-26,49-158
atgggattattgccatccaaaacgacaccatcgccgtcaccaccaccaccgccgaatggcacgactccatcgctgccgcagcaacctccgccagtcgccgcggctccgtcaccgtcgccaccggttggcaatgtgttgccgctgctcgccaacggaca

SEQ ID NO: 53387 - DNA, 110 bp, Heterodera glycines
  Genomic contig location: Contig_ID=SeqID_22701; Location=56..165; Strand=+
  SCN-specific regions: Sequence locations=1-110
ttcatgcgttggcgaccggactccgagtacatggttggggtggcaaattaccagggcgtgagcatgttcaagatgaacctcttcctcgattgggtcgtcggcgacaaaaa

SEQ ID NO: 53388 - DNA, 56 bp, Heterodera glycines; identical to SEQ ID NO: 52733
  Genomic contig location: Contig_ID=SeqID_22704; Location=710..765; Strand=+
  SCN-specific regions: Sequence locations=1-56

SEQ ID NO: 53389 - DNA, 1053 bp, Heterodera glycines
  Genomic contig location: Contig_ID=SeqID_22705; Location=92..1144; Strand=+
  SCN-specific regions: Sequence locations=1-1053
atggccaccgcgcagatggccgcgcatatggccgcggcatccgccgctggcggatttggttggtgtactattattgcaatgatcggctctgatcagtttcttacctttcttgtgataagcgattatcattgctttctgctgattggtagtaattgccaatgattatggtctgtccaattaagctttcattaattccatatgatcaatattttggtagtaattaccatggctaagatttgcccaatcaatcatcaattgatctcatatgatcaacatttttcactttaagattgggagtaatattatcactgatatacatatatctgctatttattatcaaattgatttacttaatggattttggatttattgccaggttttctggatatgctcggccaagccggcgcctttccaaaagcgtcgcccaccgccgaagaacaaagtcacgctttccaagcagtgccagcactgtgtgcagcagactcatcgcctgccgaccatgggacgaatggcgtcaacgatttgctgaccaatggcaccggtgccaacggacgccgcgccaccgctgctgcaacaatgcgcgcttccgcgccgccaaacgacgaagcggtcgtggacggaagcggtggcggcaccaacatcggtccgcctcgggcaaagcgtgcgcgtgccggaagcacaccgttaattgctggcggcgcggcactgcagcaaacgacgacgatggcactaatgggcaataatgagggcgccacgacgaacggaagcggacggacaagccgcgaatccggcggtgggatttaaatgtgccatttaaaatggggggggggggaacgagagcacttcattaattaatggtatcaaaattagattcgctttttctcgaactctcggcttaattgacacttctacaacgaaattccattcgcatattttgcgatatgcatattttacgtgcatattttggcatttttttaaacatactcaaaaatttgaaaaaatgggaattatgccaaacataatgtccaaaaatctcaattttcttcaaaatta

SEQ ID NO: 53390 - DNA, 1025 bp, Heterodera glycines
  Genomic contig location: Contig_ID=SeqID_4153; Location=1..1025; Strand=+
  SCN-specific regions: Sequence locations=1-309,331-391,413-462,488 -553,576-934,956-1025
  Gene Ontology: Mol. function=dodecenoyl-CoA delta-isomerase activity; Cellular component=peroxisome; Biological process=fatty acid beta -oxidation
agaatgcagagagctgatagaaagccggaccaaattttggtccattttggcaggcgttggttcctatttctgtgccggcaatgatttgtccaattttacgcgcggcgtcaaaacgagcgacgatttgcgtgctatggccgaccgtggggagcgcgtgttggagcgttacgtgcgcgcgttcattgagcatgaaaagccgctgatcggactgatcaatgggccagcgattgggtggaggaaaaatattatttttcgagcaaaattaaattcgactttatacgacattacatgccccgaatctttcagaatttctgtcactgttttgcctctgttcgatttggtcatcgcttcggataaggtaacaaaaaatgccggcgatcgaatcaaaatatggcatttttctcctttttcactcgctttaggccactttccacgcgcccttctcttcgcttggccaatcccccgagggctgctcctcctacacttttcctctgattatgggcacgtcgaaagtgagttttgttgaattgaattgcaataattttgctgcactttttaatgccattccgtttaatttccattaattccttaatttgttaggcatctgaactccttttgttcgacaaaaaaatgtccgccgaagaagcattggagcgcaatttggtctcccgcgtcattcccaacaacagttttggcaccgaaactgaacggatggtacagcacttgatgatgagagccatttttcttttaactttttggaatatttctgaaaaattcattaatctcgaaaccataactcgagtttcactaatctctaactgccccacccccatctaattaaggtaaattcgctggcgtcccttccgcccgagtcgctgcgactgaacaaatcgctgttgcgggacgtgcaccgcgacgcattgctggcggtcaacacgcgcgagtgcgcgctgctcaagtcgcgatggttgtccgaggagtgccaaaacgcactgcgaaagttcatgacacggaagagcggtggc

SEQ ID NO: 53391 - DNA, 424 bp, Heterodera glycines
  Genomic contig location: Contig_ID=SeqID_4153; Location=1415..1838; Strand=+
  SCN-specific regions: Sequence locations=1-424
caaaattcatatttatgcgacaaaagtaattcaaattcacgaactgtcaacaaaactttaagtcattatttcggaaaaacatgtgcaaaaaccaacaacaatttattacaactccaaaacgcttaaatgtctcatcaacaatactttgcaacaccaattaagcacacattaaatactaaattttcatcaaacaaatcgctccgctattttctcatcgacggtggcacgtacttggacttctgaggctgctgctgcgactgtgctgcctgttgctgttgttcgtcctccttcgccttcttgggctgttgctgtgtctgtggcgtttgctgctgctcgacttccctcggcttttgtggctgttgcgtctgtctttgctccttcgccttttgcgtctgcgcctgtgctgcctgttgctgttcggcct

SEQ ID NO: 53392 - DNA, 76 bp, Heterodera glycines
  Genomic contig location: Contig_ID=SeqID_4153; Location=3702..3777; Strand=+
  SCN-specific regions: Sequence locations=1-76
gttccatccccaagtccgcgtttcgtttcggcactttcgaatttctaaagggtcatgcggtggatgagcgcggcaa

SEQ ID NO: 53393 - DNA, 270 bp, Heterodera glycines
  Genomic contig location: Contig_ID=SeqID_22707; Location=1061..1330; Strand=-
  SCN-specific regions: Sequence locations=1-170,212-218,240-270
atggccaatctctttggcctcaacaaagacacgatttacctgagtgtttgtctttacgctacaaacaatttacaaggcgaaccgcagcgaaatgatggagaggaattgataatgttgggatgggtaagcaattggcaatttggagactcctctctatttttataatgtttacttccccgctattagttaaatttcattttttgttcatttattcagacgagtgtttatgtgccgggactcgtcgaggactgttcggtttgtcacctgtaa

SEQ ID NO: 53394 - DNA, 295 bp, Heterodera glycines
  Genomic contig location: Contig_ID=SeqID_22707; Location=1452..1746; Strand=-
  SCN-specific regions: Sequence locations=1-149,172-223,245-295
atgccaacaaattttggggaattgagagagcgtatttgtgaggagatcggctatggaaatgacacaatgaaactcatacacaaaggtaaatgataccaatggcagtgagaaaaggtggtggatgggttttgttgaagtttggtatttaccaatgaaatttattgttttattgatattgccctgaattttgagacgggggacggtgcaaatattctataaaactttaacattaaatcaatttttaggcgtcaaaaatttttttgataaaaaatggaaaaaggcaattgatttctaa

SEQ ID NO: 53395 - DNA, 1149 bp, Heterodera glycines
  misc_feature (1145)..(1145): n is a, c, g, or t
  Genomic contig location: Contig_ID=SeqID_22708; Location=1..1149; Strand=-
  SCN-specific regions: Sequence locations=1-225,248-417,447-815,837 -970,993-1149
  Gene Ontology: Mol. function=hyaluronoglucosaminidase activity; Biological process=glycoprotein catabolism
atagaattcaaaagagcgctctttgcaagtagcgccattaattgcttcattttccgcttttttacaaaaaaaggcttttatggccgaccatggactgctgaacagcggaagcatttgttcacactgttgcgaaagttcggcatgaacacgtatttgtatgcgccaaaggacgacttgaagcaccgggcggagtggcggttgctgtacacgccggaggaagcgggtgggttgggcaagggcagaagcaccgcaaatgaatgaaccaatcgttttttgttgtttagcattgttggagtcactgatcagagcggccaaagacaacggaattacttttgtatacgcactttcaccgggcattgacattgtctattcgagtgccaaggagctgaaggcaattcgcgagaagctgacccaggtttacacccaaaaaacaaaacaattttcataagatgcatttttaggtaggttatttattggtttgaaatatgcttttctcccttttttctatccgtccctcgcattttcggtcttttccctcggctgcaccgctttttcgcttctcttcgacgacattgaggcgtcgatgaacgaaatggaccgcaagcagttctcctcgttcgccctggctcagctgaccgtgtccaactccgtcttcgagtcgctcggatgtccgctgtttttcttctgtcccaccgaatattgcgagtcgtccgcctcgccttctttgagcgagtccgattacctcaatttgctgggaaccaaacttcacccggacattcacattttgtggacaggtccgtcgataatttattgttaacccttttttcaaatattattaaggtcctcgcgttgtttcgcgttttctcaccgccgaccatcttcaaagggtttcgactgttcttcggagaaagcctttgatttgggacaatttgcacgcgaatgattacgacccgaaaagagtgtttatgggtccttttttgggacggtcggtgaccattaaaaatgtgacttcgggacttttgctgaacccaaattgcaaatacgaggcaaattatgtgccagtgagttttttgttattttttgcgatgaattaattagtttgtatttttcaagttttttacgctggctgattgggttcaaagtgngtaa

SEQ ID NO: 53396 - DNA, 837 bp, Heterodera glycines
  Genomic contig location: Contig_ID=SeqID_22708; Location=787..1623; Strand=+
  SCN-specific regions: Sequence locations=1-116,139-363,406-547,581 -617,640-804,826-837
atgtcaatgcccggtgaaagtgcgtatacaaaagtaattccgttgtctttggccgctctgatcagtgactccaacaatgctaaacaacaaaaaacgattggttcattcatttgcggtgcttctgcccttgcccaacccacccgcttcctccggcgtgtacagcaaccgccactccgcccggtgcttcaagtcgtcctttggcgcatacaaatacgtgttcatgccgaactttcgcaacagtgtgaacaaatgcttccgctgttcagcagtccatggtcggccataaaagcctttttttgtaaaaaagcggaaaatgaagcaattaatggcgctacttgcaaagagcgctcttttgaattctatcaaaaacaaaaggggggacccttttgttttgcaaaaaatttttgagatacaaatccatgaaaatttgttatccgggggttttagaggtcgctgatcacgaatctgacatctaattcgaggtcttggaccccaagaaccccagggaataaattttcatgactaaatattaaaaaattttgcaaacaaaagggtccccccttttgtttttgctttttgataatttcaaaaaggccctctttgcaagtatcgccgaaattgattttcatttgcctttctttgaattttcccttttcaggcgaagtcaaattttggaaaggcatccggaagtgaaggaattctttggcattggtcggtggtcattcaaaccttcagaagacaaatgccacctttttctgactgtttcagaccaaagcttcaaatatgtcgttgtttcgatggtccttttccaattgctcatggccttctttctcaggg

SEQ ID NO: 53397 - DNA, 488 bp, Heterodera glycines
  Genomic contig location: Contig_ID=SeqID_22711; Location=810..1297; Strand=-
  SCN-specific regions: Sequence locations=1-211,233-330,352-488
  Gene Ontology: Mol. function=asparagine-tRNA ligase activity; Cellular component=mitochondrion; Biological process=protein biosynthesis
atggacgaactcattgagcaggcgggaggaatttcagttaatcgatgcgttcaaagggccgcttttcgtcacgcatttccccgcagcggaaaagcccttttatatgcgccggtgcgattcgagagggcaaaactttgatgtaaatgggggaaatgatttgggaaaacattttcacatatccctttttctttttgatgtttttggttaagaattgcccctttaaccaaaaacaaaaattcatttttctaaggccaccgagtcgttcgatttgctcgtcccccaagtcggtgaattggctggcggtggtgtgcgcgagtgggaagcggacaaactttcggagcgccttccgcccaactcaaatttggattggtacgtggaactgcggcgccggggccacccgcgaagtgccggtttcggacttggcattgaccggctgatgcaggcactgtttggcattacgaacatccgtgacacaatcgcattccctc

SEQ ID NO: 53398 - DNA, 66 bp, Heterodera glycines
  Genomic contig location: Contig_ID=SeqID_22715; Location=155..220; Strand=-
  SCN-specific regions: Sequence locations=1-66
atgttgtgcgaaattttggaacgcgacgaattgcaaatccgtgaagaaatttcaatgtggaatgca

SEQ ID NO: 53399 - DNA, 93 bp, Heterodera glycines
  Genomic contig location: Contig_ID=SeqID_22715; Location=695..787; Strand=-
  SCN-specific regions: Sequence locations=1-93
acattgacgaaaatgccgacactttgatcaaatcggatggatttttgcaaattgaccaaaaaatgttgtgcgaaattttggaacgcgacgaat

SEQ ID NO: 53400 - DNA, 1757 bp, Heterodera glycines
  Genomic contig location: Contig_ID=SeqID_4154; Location=825..2581; Strand=-
  SCN-specific regions: Sequence locations=1-22,44-91,113-820,842 -861,883-1283,1305-1735
atttctgccgactagcagatatttttcatattgtgacttttgaaaagtttgttaaccccgtcctaaaacataagccctctctgatcagtgggctgtaaagatgttaaatcagtccaaatcccggcatttcaattcccccccccccctttcccaggagatttataaattgctcgagaatgaccaattcccgcgctttcgccgttcgccgctttacctgggctttctcgaggcgctgctgccccgctcgtatgccgaacggtggacgacgtcatttgacgcattgttgggcaaccaagtgggagaggggataaagggatcaaaggggataaagaaagggcaaaatccaagcaaaatgatcagttcaatttattagtgccataattcaacaggttggtcgccaccactttcgtcaatttttgttcaatgttcacgcggaagaaaatctgcgcttttgggtgagtgaaagttgaacttatggagaaaaaatgccaaaaatttgaatttttcctcgagcgataataaaaagcaataattactaaggcattacaactaatgactagggaccggatttatatggacaaaaaaatccaaaatatggattataatattgaaaaattcgcaaaatatggacgaaatatggacaaaaacgctgaaatatggacaaaaatacgaaaatatggacaaaaaatctctgaaaaattggtttgaatttttgaaaaaattcataaacccataaattttccggtcaagaaagaaaaaaatcattttaatacatgaagtatagaatttgataattgtggcctcctatttattctttactaaaaaaattgaatttacttagaaaaaaaacaaaacttagtaaattacaaaaaataatttttacacgaattttgctgatgaaaaattttttgcacaatttttggaaattttcccaaaatttttcgattttagggcgtattttccaaaaaattttccatcttaaggggtgtattttcgaattttttgtgaaaatgccgaaatatggatgtcaaatatggacaaaaatctgaaatatggaagtaaaaaggcatcctagaagcatcaaacaaagctaaaaacactatttacgtagtttttaagccgaaatgagtgtgcaaaaaaaaaatatggaaatccatgcaaatccggtccctactaatgacccttaattggattttgcttataactaattaaggagtccgtcatcgaattccgccaattgaaaaacaaaagcaccgcaatgcaggcaaatgctggaaaaagaaattcaatattatgatttacatttgcagaacatgggcaaaaccatacaacaacaatttttgcgggaaggcgcccacaacgaggtactgtaggccaactacagtaggaatgaatgttcatggaaattgtgttaaatcccgttctgccgcaggtgtttttgccgtttggtcttcggcaacgggtggagaagagaattcgggaaaaggacgtggacgaaacacttttcgacgaagcggtcaaacacgtggaacagatattgaagtaaactacctaattaggtggaccaatgttaaaaaatagtcaaaatattccagcaaattaattttaaaattctcgacggattaggttattgtccccagtgactcacttttataaaacgattggatttatttcatgataattttgatcacagaaatgatccgtacgtgcgatttctgcagtccaaagaatacaacgatctgttggccaaactgcac

SEQ ID NO: 53401 - DNA, 172 bp, Heterodera glycines
  misc_feature (86)..(86): n is a, c, g, or t
  misc_feature (98)..(98): n is a, c, g, or t
  Genomic contig location: Contig_ID=SeqID_4155; Location=2812..2983; Strand=-
  SCN-specific regions: Sequence locations=1-172
cccccccccctctcaaattatgcgtcggttatccttttcattgtttgttacgcttaagaaaaggtatcattagcgcagcagttgcncaggttacttgnaaaattggtgccattaaacacaatgccaatattgtattttccttcgacacgcgaaaaaaaggcacaaaaaatgg

SEQ ID NO: 53402 - DNA, 464 bp, Heterodera glycines
  Genomic contig location: Contig_ID=SeqID_4157; Location=2512..2975; Strand=-
  SCN-specific regions: Sequence locations=1-90,150-464
atgactgccgctttgctggtgggcggtggtgccgctggcggcgtggcacagcggcgaccctccgcaactttggttcttgaaatgccaaatcatcaaccccaacagcaccaacaacaacagcaacagctgcggcaccatcagccgcaacagagtattgtgccttcatcgtcggcattggccaaagatcatggcaatgcgtcgggtagggttttttttgaattggcacttttttcttttgcttggcgttttgccaaaaaagcgattcccgtggatcaaacgcaatcactgattagactaattaatgcatttcagatgaagggcagcagcagcaaggaaaagcagtcgttgagctgccaaactcgacccaacagcccaaaaaacagctgaaccaaatgaataagctgaccggggacgattttccgttgaaagtttggcaacggattggcttaatggtgggccattaa

SEQ ID NO: 53403 - DNA, 376 bp, Heterodera glycines
  Genomic contig location: Contig_ID=SeqID_22716; Location=447..822; Strand=+
  SCN-specific regions: Sequence locations=1-176,307-376
atgttccgatcgcccgcacttttcgcgatgtttcttctgatgctgattgtttttcagctgtttggggttggaattgtgcaggggtcgaagcgaagcaaaggccgcgcacggacaaaagaaagcgaaggcatttcgaatcgggggaaagaatcggcaaaagaaagtgagagaatttggaaaaaggaagggaaaggaagggagaaagaaaagaagaagcaatttagaagtggacgaattggagggcaaaaaaacgcagaaaaaggaagaggaggagcaaaaggaggagaaggaaaaggcaaaaaaggaccaattgacgggagagggaattggaatggcaccgacggggggacgaagagcacgtcgagaaggaggagaa

SEQ ID NO: 53404 - DNA, 1916 bp, Heterodera glycines
  misc_feature (1916)..(1916): n is a, c, g, or t
  Genomic contig location: Contig_ID=SeqID_22717; Location=67..1982; Strand=-
  SCN-specific regions: Sequence locations=1-273,296-853,876-971,993 -1057,1079-1438,1469-1559,1582-1916
atgatgtttcatttcatgaatgctttttacgccgatctggtcctcctcagctgtgtgccgttaatgttgcactcggagctgataaatgtggatttgacggttgacaatcaaaactatttcgacagcggaaaatatcgtaccttttcaaaggatgcgacagcactacactttggttatagttggaatacagcatgccgaatagcgaagtgtgagcgtgacagcgaatgggccgtttcacttcaaattgtgtacactttgcacagctatcagagtgtgtttttcaaaatgaaatcactggtgaaaatgtcaccattggcctgttttgaatacaatgggtatagttttaacctttttgaagacagagaatctggtgagacggctatcttccgtggtcaccagcagaagattgtgcaacgactgtccaaacatggacgggttgtgtttgatcccctctcgggtcgcttgtttctgatcgataagcatcagaggcggatcagcgaaatagagcttgaatacctggagcatttgtggcttcgaaaaaaccaatcttccgcacatacgattttgaagagcaactttgtcgcctttcttccaccagataaaagcgactttactttggtggacaaccatgtgtttgtgatcagagaccagcgcatctataaatttcacattggcgactatgcaaaagggaatcgtgcgctaacttttgtaaccaattcaagtgacgtccgctttaattatctaatttataaacccaacgaccaaaacattatcggtggtgtttttagtcatttacgcatgtcggacgcttggataccgatctcgtatctgttcaatttgtttctaatagtactgtgcacatacatacttaaacagctacggcgagtgaaccgaaagaatccacttaatgggtctggtagcaccggttattacagcaacccgttcattgacgacgcctattcgtcccaacatcaacaattgctgaatatacagtatgaaactgcgacagcgagtgatcaaaggggtggagccagtagccggagtatttaaagaatgcttttttgttgtttgcattcagttggtccgcttttttcctaaattttaataaaggctattttcatttgccaaaactgacacaccatatttacctacttattgcatgcaaagggcaatccgttatttgatcgacagttacgggctaagcagtgtagacgatctgtacacctgtttgaaagacgaaattaaaagtgggcctgaaggtgggaattgtctctatcccaacccactttgtgctgtcgactgtgtacacatcgcaaacgctgaccatccgaaccaacctgtgcatattgaaggttctcttgagctgatcgctgacgttgaactgtactcaacatgctatccgaagaagaagttcgaggggatagtgtggtaagttttctaaatattaatattttcatttgcattttttaaggagcgaacctctgtatgtggagctgaaggacttgaagatttgcccgggagactcgccgctgtgtctgtcacgccattgcgaactatcgaacagcagcagcaacaacctgatagtggacgagctggatctgatcaactattggagcgacggcgaacgcgaaaacgagactacaacctggtgagagtgctgtgccgattcaacaactgtggcccataccgactgacgaagcaactacagaaacgacggactgagaaccttgcctatctgagccaattggacattgagactgtccatcttagaaaaaatattaagattattcccgatgctttgtgccccatcggtgcaaatcaggtgtttgcataccggggattcctaggaatcacggttcagcaacacctttacactcgtcatcgtgtcatgttaaagtacccaacccttccatgtn

SEQ ID NO: 53405 - DNA, 390 bp, Heterodera glycines
  Genomic contig location: Contig_ID=SeqID_22719; Location=134..523; Strand=-
  SCN-specific regions: Sequence locations=1-90,122-390
atgtataatagtttttctttagagaaaataagcaaaagaataaaaaaatgtaaaggatggaaattaatagaaagtgaaaaaagctcgacgctgctctatccaatgataccaaatttatacccactttttgataacaattcgcgtggttcacttgttatgtggcgaacggtatccattggctacagtacattgacaggccatgcaatgcaacgggtttatctgtaattttttgtattgattttgccacaaaagccaagccattttgaccatagggaggttgtaacagcttcggtcatcggacagagtgatcagtgatcagaaagagcgtaaaaacagcaaaaacataggaaaaattcaagcaagcattttttgttgaattttacgaataaa

SEQ ID NO: 53406 - DNA, 182 bp, Heterodera glycines
  Genomic contig location: Contig_ID=SeqID_22719; Location=952..1133; Strand=+
  SCN-specific regions: Sequence locations=1-182
ctgtcctgcgtcgattcggagggccgtgcccgtggcatgggactgatctccgcgcccggcctcgtcctgtcggtgtcgcttggctacgcgcgccgtctgctctcggcggactgcaaaattttggccgagctaagcaagcagctcaagttcgagacaaccattggcatgaacggcacaatttg

SEQ ID NO: 53407 - DNA, 240 bp, Heterodera glycines
  Genomic contig location: Contig_ID=SeqID_22719; Location=133..372; Strand=+
  SCN-specific regions: Sequence locations=1-240
atttattcgtaaaattcaacaaaaaatgcttgcttgaatttttcctatgtttttgctgtttttacgctctttctgatcactgatcactctgtccgatgaccgaagctgttacaacctccctatggtcaaaatggcttggcttttgtggcaaaatcaatacaaaaaattacagataaacccgttgcattgcatggcctgtcaatgtactgtagccaatggataccgttcgccacataacaa

SEQ ID NO: 53408 - DNA, 1183 bp, Heterodera glycines
  Genomic contig location: Contig_ID=SeqID_22721; Location=721..1903; Strand=+
  SCN-specific regions: Sequence locations=1-7,31-96,141-221,328 -586,608-633,656-755,777-987,1010-1183
atggacgtaattttaataaataaattaattgtggtcattcgaaaattcaaaatttatcttatgaggtaggcattttattttccgcaagatttatgcttttttaattttaataatttacaaaatgataaataaatttttttgcaaaatgatgagttgggttttcattggcggatgtgctgactgacgaacatcgatttacgaaggaatttgttggaaaaaagaattaataaaaatattttttcattattaataattttctttcttaattttatatttttcttatccacttattaatgtatataatatatatatatttttttttattatgtgtaatttagcaagtgaacgaaaatttaaagtcactgaaaagctaaaattaattttattattccgtcaattttaatgtttcgcaaaaaactgatcaaaattttattgtttaattttcttttattgccaatattatgcaaaaaaccacaacttcacttcggtactcaaattttaatataaatgattttatgtaaaatgttaaattcttgatacttttgagaaagaaagtctcccgagacttgagccttatttccaaatgttaaatttattaaatttaaatcttttgtatttgtcagtggatttctttttaaaattaccacccttttttcatgtcattagcacttaaaaattctcgccctaattgccaaatttaatttttggtcataatttggcgccacgtccttctgttttaggcatcgatccgctgcatttggacttggaatattgccgtttgtttttcgacccgactttggaccattgcgcccgaagcgaactgagcgcgaaactcagtgccgtgtccatttgcgcaaccatcgagacggatttgaagtacatcgaattgaaaatggaaattttgcagaagtcacgaagtgacagcttcggtttgaacataattcgcggggcatggaaaaattacgaggaaattatggcaaaaattgaggagaaaagtgggggcgaaaggatgggaatggtcgtagtgtgccaattgtggaatttcatggacggcttaaagaaattggtcgaatttatgagcagagacgcggaaaccacgaagaaagagatggacagaacgatggaacagctgagaaagatgaccaataacagaaggtgccgtttaaaacaaatgcaaaattaa

SEQ ID NO: 53409 - DNA, 469 bp, Heterodera glycines
  Genomic contig location: Contig_ID=SeqID_22722; Location=251..719; Strand=+
  SCN-specific regions: Sequence locations=1-469
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaattttgcggtaaaaaaatgagaaaaaa

SEQ ID NO: 53410 - DNA, 857 bp, Heterodera glycines
  Genomic contig location: Contig_ID=SeqID_22724; Location=106..962; Strand=+
  SCN-specific regions: Sequence locations=1-272,294-300,351-393,430 -488,527-543,565-569,593-770,794-797
attgtgccgcctggaaagtacaggttgattctgtgggacaaactttctgcggatggccaatcccttcaaaacaatcgttggccaaatgttggcgaccgatcgctgtgccatcgcgacgaaattttctgttattattgtgcagagccggataatttgttgttctacactgacgtcattaagtttcgtctgaatgaattggaaaaatgttttgtgaatttttacacggtcgaaacggacgaaagaggccattttttggtgtacaaaaggaacaaaaaagcatttgatcaattcaatttttacattttgccattgaaaaattcggtaaaaattttttttaagtatttaaaaaagtgcaggaaatgagaaaaagaaaaacatttttttatgattatgaaaaaatctaaacagaatttttgttttacaatttttacgtatttttaaaaaaatgttttcgattattcgtctgcgttagtataacataatatgacttatattgtaatttaataataatgatatatttatatttggctgatatgttttccaatatatttaaattatttgcttatttctattaattttttgaggttccaatcagtggagatgattttgttccatacgctgaacataaaataattgtaaaagaaaatctaagaaaaaattttttcgaccctctcaatttggttgactattttgaatcgtcaaatgattggaaaatgaatgtgctcgatttgctgaaccattggttaagtgacgaaggattttcctatgaattatcggaaaaggcaaactcaaataactaattaattaaaatgttttttgaaatttttaaaattaattttatcttttttaatttttaa

SEQ ID NO: 53411 - DNA, 1367 bp, Heterodera glycines
  Genomic contig location: Contig_ID=SeqID_22724; Location=1053..2419; Strand=+
  SCN-specific regions: Sequence locations=1-373,401-478,500-795,817 -1072,1094-1143,1189-1270,1292-1367
atggagacgacaaaagcgcaattgctcggcattttctgggactttttctccgaggcagcaaaagcgaatttattatggaagagattgcgatttgcggaccagcgaattgtcgagttggtagaccaattttgcagaattgacaagcaatatttgttgtcacattcccaaataacactggcattacgagtaagcggcgaattgaaatgataagaacaaaattttatccgaatttttgtaatgcctgagaaaagattcccgagaaataaggcggaaaataaattttctccagaaataccattttagaatcgcaaaaagcaggaaaagaaatttttagaaacttaaagaaaaacaaacccttcgctgcatttgttacacaaaattttaaaatttatttagttagtattgcggcgaatatgtgagggaaaacgacctaatttttcacaaaagttccgaaataaatttttatcataattaccacttttatgaccaattttaattaattggttcaatttgctcccaattttgcttatctcatagaatgtggataatgcaatggcattttgccaaaattggcttgttgcgtgtgctaaagcagcaaatgccatgcaaacgaccattgtgatggacgcattttcgcattggatttacagcggaagaccaccattaaatggggctattgaaattgttcatttttggattgaactgttcagcaaaagaacggcaacaaatgacatcagacgaatgtgccgatggcccgaaatcgataagaatcttttccggcgaatcggtgattttggcactttttgaaagtttttacaaaaatcgaaaaacttaggcattctctttgtcgaagccaatgaaaaatatgcactcaaattgaaaatattagaaaaaatcaaaggagtcagacaattgttggacgaaatttgtgccaatgtaaatcatttgtcattgacatgttgtgcacataattctttgcaaattgcgatggaccaatggaaaacgacggtttgcccaaatggccaatttcgagtgggttttctgctgatttgggtagaaaatctctttgttctttcttatgcatttaataattatttgtggaggggggggcacaggaaggggagggataggaactaaatctccaaaattatagtaaattaaattatttaaattattataaaaaattaaggcttttttgagctcattgttgctgattgtaacttattttctttcttttctctttttctggtgaaattggtagcaacaattgttttgcttcatgaacagctttcgaatgatagaatatttgtcaaattgtcaaatcaaatgaatgccctccctccgctacttctcgaacatcgagtcga

SEQ ID NO: 53412 - DNA, 152 bp, Heterodera glycines
  Genomic contig location: Contig_ID=SeqID_4159; Location=926..1077; Strand=+
  SCN-specific regions: Sequence locations=1-152
gttattgaggctgttgtgactgactgttttttgttaacaaaagtgcaatttactacacactttagccacatttatttcttgttatgatggccatggaagctcagcaacaattagcaattaatggtgccattttgggaatgccgaaaaatgaa

SEQ ID NO: 53413 - DNA, 3755 bp, Heterodera glycines
  misc_feature (2509)..(2510): n is a, c, g, or t
  misc_feature (2512)..(2512): n is a, c, g, or t
  Genomic contig location: Contig_ID=SeqID_4160; Location=1514..5268; Strand=+
  SCN-specific regions: Sequence locations=1-137,205-216,238-259,281 -286,311-342,368-390,448-479,501-581,609-844,875-1238,1274-1685,1714 -1774,1796-2250,2286-2336,2358-2445,2467-2527,2632-2753,2792 -2799,2821-3416,3438-3495,3517-3755
tgcgagttcagccatgagccgttgcaattgcccgagcccattggcgaagtgaccgttcgccaggagaaagtgttcgtgcccgtcaagcagtacccggaggtgggggagagataattacaaaaaaattgaggacaaagaatttttctaaaattttaatttatttttcaaaaactaaaaattattttaaagaaaatttcaaaaatacaatttccaaaattctgcaaaacttttaatttttcttaataaaatgtcgtcaaagcaaataatttggtttttaatactaaaaatttttaaaagaactttttaatgattggccgagaaaattaatttcaagattttgagaaaattttgtaaaatttgaaaaatctaccaaataaattttcaatattccccttttaaaaaactctcttctttacaggccttttttcataaattttcttaaaaatctaaaattacctaattacacttttttcactacatatttttcccaattatttttcgcttgtttccatgcacaatgccttcttatttacaatgcaatttatttttcacaaattcaattttctttaattaaataaatatttatttgtttgtttgtttgtttatttaattaattaatttgatttgtcagtataatttcgtcggtcgcattttgggcccgcggggaatgaccgccaaacaattggagacggagacgggctgcagaataatggtgcgcgggaagggctcaatgcgggacaaaaagaaggaggaaatgaaccggggaaagcccaattgggagcatctgagcgaggaattgcacgtgatcatccaggtggaggataaagaaaatgctaatcaaatgtattaatttaaataaaaatagaaaaaaaatgtgggggggggagtcaatcttttttcttttttgctttacaaaccgcttttttacatagaatttgggtgtttttgtttaggacaggagatgccaatatgcgccgccggcaaaattttaatgttcatacttaaatgggtcttggctgacccattaccagaaataaaagaaaattgagtaaaattttaaaaaataccaatttttcttggaaatttttttaaatttttcgtttcggggagtaggggcggcacgtgccccacttcctcccatacggacgggcatgggtcttggtgtcagaccatagttggacaaggagggaggcgtcagaatagttagggtcctacgaagtacgaaattgttagccaacaaaatttattaattcaattttttaatgtttttattgtgtttaaagtgtgaggacgcgccaaaccgtgccgaagtgaaaatggcacgtgccgtggaggaagtcaataaattgttggtgccagctgtacgttttcatcaatttttaaacacaatataaaacgcttattgttttttgttggtccgtttaagcccgagggcgaagacgacttgaagaagaagcagctgatggagttggccatcataaacggcacttttcgcagcacaaatggcaccgcgggcggtggcgcgtcgaaccgcgcgagtccgtcgtcatatggcaaaggcggcgccgtcgcgtgcaatgcttccgccgccgcagcggccgcttcattgctgcgtgagtttggcggtggcattggcattttgaattgcgaaattgtgccgatcgacgacgtttattttgttgaggattttagattaaaaaattttttggaattatttgacatcgcaaacttaaaaaaaaaagtaaaaatttgcttttttcctaaaatcgatcactaattaatttaaaattaaaatgccctgcggcatttttcattttgaaaattttttgaatttcctaattatatttgaaaattttcaaattttcttaatttgcgcgatacgtcttttggccgattgatctatgcgtgatttgtccacacaaacaattcttttggcattcagaattagatccccgtctgctcggctgtccaactacggcattttccaacacttccgctgggctcgccggcactccgctgattatgccttcggctgccgctgtaagccttggcggccttaaggccagtaattagggcattaacgcgcgactgtttttgggcaatgccaattggctgactcatagagcaattataggcccttccttttattgatctcgagacccaataatcgatattaagattgatgagacgggcgcaaatgtcccccccccccaccctcccaccgccgttttctcttaccgtcccccctagtattttttctttaaaaaatttttttgtttttttttctgaagaattactaacaatggttttgaaattaaaaaaaaaatttcggcggtgggaaacttcgggggagaggaacgagacaagacccctattttttccgaccagagaccgagacacttggcatcactataattaattattctgctacttgatgatttactcttctgactggaactgacagacttaaaaaatgggtgtgttatgtttccctccgagtcccttcccnncnctatcagttccccggaaattttttttaattttcaaacttaaatttttagaaaaaattcttgaaagttttttaagcaatttttttgaaaaattttgaaaatttattcaaaaaaaatttatgctcgaaattttttttaattttcggggaggaaacgacggggggatgaactgctctcaaaaaaatacagttaccgtatcccccggaaatcctattaaagaaatatttctgctgtaactgcttgtaaaattttaatataattgattttattttcaaataaatcaaatgattttaagaccagccccgtgctgtcgtttcagtccgctgctgcgcaaccgtcgctcgttgccgtcaacaattcattggcggcacaggcattggcacttcaggcaaatgccattaaaaagcgaaaacttgcgaaacaatttttaaataaatgtggcgttgtgtttacgtgttacagtatttgcagttggcgtcccctcacacctcggcagcccaactgttcgccgcatcgccctacagcgccgggttggcatccgttgcgcaagcggcgacggcaccgaatgccattgactaccagcaacagttgctggcactggggtaaacggaaattgctttgtcggcaaagcctagtaaaattcaaaaagaaaaaaggcttcttacaccaaaaaagaattaaatttttatggcatcttaaagcgttgtgatgaaaatacgaaaaaatctttaagagaaaatctggcaaattaataaatcgatattaaaaataaccgaaaatttgaaattctttcgatcgattttttcgctaaaataccgaaaaatatatatcgacgataagtcaatcgttcttgtctaattaataccttttttttcttaaaaacggacaatttttgggccaaaattggctgagaacttggcaaaaacacatattttttgttgtttcggcgaggtttgatttataaaattctatttctccattacagctgttttgcaaaatcctctaccatctcttggtcattaaaatacagtatgccaagcattttcagccaacttcaacagcaacatcagccccagcagtcacaacttgacgttgccgctcagtcccaacaactgtccgcactgttccagcagcagcaactcgcactgtccgcgcttcaacagttcgactacggtagcggtgccgtcgtcggttacggtggcggtggtggaaaaacggactcctccccgtcttcttcagccgctg

SEQ ID NO: 53414 - DNA, 106 bp, Heterodera glycines
  Genomic contig location: Contig_ID=SeqID_4161; Location=2339..2444; Strand=-
  SCN-specific regions: Sequence locations=1-106
taaaaatgacaaaacacccgatcttggcactttgatgcgagcgattgaaatggaaattggccctgtgacttcgccagatttgttccactcctatgtaattgcccac

SEQ ID NO: 53415 - DNA, 932 bp, Heterodera glycines
  misc_feature (875)..(875): n is a, c, g, or t
  misc_feature (924)..(924): n is a, c, g, or t
  Genomic contig location: Contig_ID=SeqID_4162; Location=34..965; Strand=-
  SCN-specific regions: Sequence locations=1-185,207-932
atgcttcttaaggctatgattggaggaatgtgcgcaaacttcacattttcgggcgatgaacacttgattaagagggaaattgaaaaaatttctgaatttgtgaaagatatcacgggcaatgcaactcaatggataagagcggaactcgtaagtagcaattaaaattattatgcgattatagctgggattaaaaaatgacaaaatggtttaatttttttacgatttcatatattgaattctcattttttaattttttacgagatttatatttctcaatttaaatcataatcggactctctataaacttttcaattaaaaaaaagaatattgcaaatactcatccttgtctaaaatgtgatgcgtcaattacaggaaaactcctggccactggaaataattcggcatgtcaagatcgggataaagaatccaatcatcgacccatattcgtacaattataccgcaaatctgatcgatgacattgtttcgccacgtgggcctttcgggtaagtgaaacaatgaccaataatcattgatttctatgaataatcgctctgaatcacttttatataaacttgatcaaaccaatccttaggtgatcggaccgccaccaaaatggcttaaaaccgaaaaaacaaattttcggaacagttttttaatattcagttacgtctcccaaattttggtcacgaatgacttcgacagaatcgaaaatttctggcagaggtgccctgcgagttattgcgcggtcgtaaaaggttacaaagggatcaatttttcattgtttcggcacaaagtggggcatttgacaagggcccacaaggcagagcgatggtttgaaagaaaacgtgacaaaatgtacgacatcatcctgtgangtatgagatgaaacattgcgctgtattgaaatttagaatttgaattgangtaataaa

SEQ ID NO: 53416 - DNA, 333 bp, Heterodera glycines
  Genomic contig location: Contig_ID=SeqID_22726; Location=227..559; Strand=-
  SCN-specific regions: Sequence locations=1-97,152-159,181-312
atgattgcaattccaattattcttatattctttgttcaaccggcgatttgtttaaaaattgtatgcttcacacacagcaaaatggtaatcattgagcaattataattaaaaaaatttaaaagtatttttaataaataataattttaaaaatgcaaaagcatttttgtttagtttgaagcaaattcttttcttcaacaacaaccaaactgttcacatttggtcattaaagatttcgcaaaaattggattaaaggaattcaaagcggatttgaatgcacgttataaggcacaatatctgaagtgaaaattatacaataagaattaattgaataaa

SEQ ID NO: 53417 - DNA, 204 bp, Heterodera glycines
  Genomic contig location: Contig_ID=SeqID_22727; Location=1..204; Strand=+
  SCN-specific regions: Sequence locations=1-47,89-93,124-204
ttgattttttttctttttgattattttaattatattccatcctgaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 53418 - DNA, 355 bp, Heterodera glycines
  Genomic contig location: Contig_ID=SeqID_22727; Location=285..639; Strand=+
  SCN-specific regions: Sequence locations=1-41,71-125,183-198,240 -244,275-355
ggaatcgaaggtgttgtaagcttttttccttttttcacttgtaaatttatttaaattttcaatttttttagcttttttcgaaaatttttttgtctttttttcggcaggcactgcctctgacaatgttttttatttatttagaaaaataaattgattttttttctttttgatttattttaattgtatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 53419 - DNA, 350 bp, Heterodera glycines
  Genomic contig location: Contig_ID=SeqID_22728; Location=200..549; Strand=+
  SCN-specific regions: Sequence locations=1-40,70-125,208-214,270-350
ggaatcgaaggtgttgtaagcttttttccttttttacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcaaatttgcttttttaataaattctcttgtgaaaaggcaaaaaaataggctcttttaaatatgcctatttaaattactttcattgctttcctttcgcttacgaccatacca

SEQ ID NO: 53420 - DNA, 351 bp, Heterodera glycines
  Genomic contig location: Contig_ID=SeqID_22728; Location=630..980; Strand=+
  SCN-specific regions: Sequence locations=1-41,71-126,209-215,271-351
ggaatcgaaggtgttgtaagcttttttcctttttttacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcaaatttgcttttttaataaattctcttgtgaaaaggcaaaaaaataggctcttttaaatatgcctatttaaattactttcattgctttcctttcgcttacgaccatacca

SEQ ID NO: 53421 - DNA, 63 bp, Heterodera glycines
  Genomic contig location: Contig_ID=SeqID_22729; Location=765..827; Strand=-
  SCN-specific regions: Sequence locations=1-41
aaacgggcgcgaagcgcccgtcttgagcctcgatgtggactaaaagcctctaataatttttta

SEQ ID NO: 53422 - DNA, 631 bp, Heterodera glycines
  Genomic contig location: Contig_ID=SeqID_22730; Location=1262..1892; Strand=-
  SCN-specific regions: Sequence locations=1-318,374-376,425-605,628-631
atgccaccgaagggggagaattgggacaaaatgccaaaacagcaacagaaggaattctccgcaggtttctcaattgtgaccaatgaccgtaaccgttcctttaccgtatccgccgtccaaatgttgtgcaacacagccggaaatgccccaaagattgtggaagaggccaatgtcgaagattatctgtttggatggagcgaagtgagcaaacgaatgagcgaacgtttcttttgtacttacggcattgtcgagagtgagaagcggcggaagggacgaattgggggaaaagtcgcaatggagcacctgacaaaagagcaacaaccgatcaatcaatgaaccaactgatcaattttaatcaatcaacccatcaatccacaattattgattgtccccattttatttcatttttccatttcgtaaaaccccccaaattcgcttaatggcccaaccggatgccatggccactctctgatgagcgtctttggccaaatcttttctctgagagtcaaatttcgtcaaaaccaaaggcaaactctttgggaaaaagcacttaaatgcaaatggaaatggaaatattagtggcattttgtgaattgagcgatggaaaaatttaaatggaaaagcaaataaa

SEQ ID NO: 53423 - DNA, 823 bp, Heterodera glycines
  Genomic contig location: Contig_ID=SeqID_22731; Location=1129..1951; Strand=-
  SCN-specific regions: Sequence locations=1-186,209-414,436-446,468 -492,676-823
atggaccgagggaccggtcccgatgaggatggagctgtaaggaagaagctggctgggcggttaaaacgcggaaagcgggggttgataagatccataaaaagaaagggcggatgtgcctcggtagcttaatggtagagctgcccacggaaagggtgcatgagtgggttcgattcccacccaaggtttaacattttgcccatttcttattatattaagttaaaatattaaatgattgagattgataaaagaattcttaatggttatttttcttatttttagcaccttaccagtaccggtaccggtttttcaaaaagaattacagattcaggtttctccagtactgtactaactgataaaactttgtactggtaagaatgtttagccaatttgtaaactaatctaaaaactcgtaagcttggcttttttgaaggaaatcaattagaattttgttatgcctttagttaacatttttgatagatctttaacgagcagttaaaaataatttattttaatcgtttaattttcatttattacttattttattcattttattaggtaaaataactttgatttattatgttattttaaatctatgcttttaatgcaaatttatttatttttattattcacaaaaacgtttatatattttgtaataatttttatttaaaattatttgttctaacctgctaacaagttgattttttattttcatctatttatttttttctcgtctgatgatctctgttttatttgccgttctgagcatgttcgtttatcttcatttatttaatatattccgtttgaacaaatattgataaataaa

SEQ ID NO: 53424 - DNA, 833 bp, Heterodera glycines
  Genomic contig location: Contig_ID=SeqID_22731; Location=1..833; Strand=+
  SCN-specific regions: Sequence locations=1-520,542-576,598-673,700 -782,825-833
ctgccccgaaaacaaaaaaaatcgattttttcaagtgtccgtttaggggtactcaaacaattatcggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 53425 - DNA, 323 bp, Heterodera glycines
  Genomic contig location: Contig_ID=SeqID_22733; Location=280..602; Strand=-
  SCN-specific regions: Sequence locations=1-162,193-232,275-280,303-323
atgaatcagaatttaagggaaattatgaaagaaatcagtttttattggtatgtttccaggtcccgggtaaggcaactgaaaaaatatgcactgataaaaagaagggttttatttgttagcgaaaaattagtgtcgtaaattggatgagaaatttttgaggggaaataaaataattaattattcaaaattaaagacaaatacagtctttggatatgtggcttagtggctaagcccttctgtcttcgtccctttctttctttctttttttgtttttgattccaattaaaatggaaatttttcaaatatttacaaattgaaataaa

SEQ ID NO: 53426 - DNA, 1118 bp, Heterodera glycines
  Genomic contig location: Contig_ID=SeqID_22734; Location=715..1832; Strand=-
  SCN-specific regions: Sequence locations=1-131,160-357,381-470,492 -632,655-822,844-849,871-1118
atgaaaatgaaaaatgatcaaaaatagtgagatagaaagttttgggatttgaatggattaaagtgagaaaaaggtcatttcaaattttactagtatttaaagctgaaaaatgaatcatccattcgtaatcctatttattttttgttatttaataaattagatcgatgcggacaaaagcggcaccatttcgatgaaggaagccattgcatatttggtggacacaaagaatggcacttcggctgaccatttggcaaagaacagtgaatggtttggccacatggaccgcaatgggaacagtcaaattgagccagtggaatttgatcggatgctgatctgatcagaggaaaatgatcggattcatttgaaagcaaattcagtgacgaaagaatgaatgatgggacagagaatttgttacaaaaattactatttaaaactttcgtcaatgaatagttgataaatttttggtgagattaaattaaatgattttgtaagacataaaaacatttctgcaagaaaagattcatttgtggccgaacactcaataaatctcgcaaatgcttttggaatcaataaaatcatttttcgcatatctttatttgcctttcaacaaaaaataaaaaactccaattggaatcagcaaactttccaaatgagtgtgttattctttcatacccaacacctgttcaaactttacggacaatgcatgcagagatgctggccacattagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggaggtagagaaaacaatttcaatagagagcgcaatgggaagggagtcatgtctcttcttcgctgattcttttggtaagagacgcagattcctcgctatgttctctattctcttctctctgtcttaaatctcttcccataacactctctttttaataaa

SEQ ID NO: 53427 - DNA, 339 bp, Heterodera glycines
  Genomic contig location: Contig_ID=SeqID_22734; Location=1982..2320; Strand=+
  SCN-specific regions: Sequence locations=1-339
atgtccatatttccatattgtgcatgttttggcattaaaatgtcaatcccaaatgtggagccctcatatctatggtcctcaactgttggaaaactcaaatttcaagcgctaggacctcaaaatgtcaaatcttcaaatgccgcaccacatctctctatccatactgtacctgctgcttgcgagacgggcatttggcttcttgttctccggacatccgccctcgccgtccttgcggcaattttggcacccttgcggacagtctttggcatattgtttctcgcaacagtagtaacagctgcacgacacatacaatgtacagtattccttggagcgatcttc

SEQ ID NO: 53428 - DNA, 793 bp, Heterodera glycines
  Genomic contig location: Contig_ID=SeqID_22735; Location=989..1781; Strand=-
  SCN-specific regions: Sequence locations=1-55,77-505,527-793
atgaacggcgctcatccaaagtcgcccacgcgagagacagaatatgcaccgggcaaaatggaggtgggaaaatggaatccaattcgtacaattaagctaattgctttattatacttaaaaacactgattaattgtttttcaggtcagcgaaccgccctctctgagccgcgtggaccgccccattgaactgagcgttaccgtgacgaaccctgacgcggttgtgcaggcccaggcatacggtaggacgcatttgaaaaaagcgaaaattccaattgaaatgccctcattcacgctaaaactaaatcatggcacagtccaattgggcaccaccttcacgcatttatttgctgttttcccattgtttctgacgtgttgcaccaaacccaataaaatcgcaccctttgaaaagcaaaaattctttcagaaatttgaggccttggtgtttttgcttaagttttttttttaaacttgaggcgccccaatttattctcattgatagaagtgaacagcagagagacagtgccggtccaaattcaccaggacgggccaaccacgcgacgcattgtgttcactccgcgcagagttggtcagtgcgtttaatatttgaaaggagactaataaatcatttagtttcaatttaaaaaatctgattttttatttgggcatttaaatttgcaggtgatcatgaagttcggttgcagctgaacgacacggaagtggacgagtcgccactcatttgccgagtctatgacccagcaagtgagggaaatcaaaatctattaatttaaataaa

SEQ ID NO: 53429 - DNA, 1616 bp, Heterodera glycines
  Genomic contig location: Contig_ID=SeqID_22736; Location=1..1616; Strand=-
  SCN-specific regions: Sequence locations=1-738,760-983,1005-1044,1066- 1616
caccgattaagcagcttttctgacgcttttaccttctttttgccaggttttgcccgctactttgggcatcaatttcccaccggcatttgccatgctccgtcacattgtcccactcgaaaagggcgactttttggtccaaaatgcgtcaaattgcggggtcggccgagcagtgatccaattggccaattgttttgatttgctttccaattcatttgcttaaacgacggacggaccattcagactttggctaccacaccattaatttggtgcgaaacagaaaggaaatcgacgcactaaaggacgaattgaaagcattgggagccgactttgtgtttagcgaagaggaatttgaaaagtgaaatttaaagcgaagcatcccatagattttcagaccaaaaaaaagggtttagggcagatgctaaaagcctccctaagccgcggttggcgttggattgcgtcggcggtcgaagtgcccttctcctctcctccgctctgtctaaaggcgatacgattatttcatatggtgggaaagcgacgagcacttcaaaattgggggattaaaacaagcttatttaggacaattgtcgaataaaagtgccgaaattgctgagggtatcaattcgcatttcttttccattggaaaatgggtcggaaattcggcgaacggagaaaaagtgcgaaaaatgtttggagaactacagaaattggcattgagtggacgaattaaagcacagccgcacaaaataaattccttggaaaattacggaaaagcgatgaaaaatgcgattggtaaatgaacggaggggggggggcaataaaaatgaaataaaattgccattttaaattaaaaaatgcctttgccttaatttttgtgtttttaggctgtggcgtcaaacaaattctgatgatttcgccagagaatgaatgagttaataacggaagcaaattgaagtgaaatgtgaccatttataacataatataacataacattgtttccatggaaacccttcccaaactttcgaataaattcgcaattttacctaattttgtgtgttgaaatgggcaaaaaggacgttgccgcttcggactcaatttggcacgaccgggacgtcctgttcgacttggacacccggtactgttgcggtgttcgcttttggcttgccatgtgtttgggcaaagacttccaaattaaagacccccccccccctctcgcccatcggattaattgatgaccctttcagattattacgactaatcgccggcgaatttatcgtaagttggtttatctgctggtgttaaaggtcgggctggcgagttcaaggccgtagggttttgcttaggtggaacgaattgacaatgtggaggacacgaagggcaacaacggggaccggggactgttgcgcatttcgaacctacgcctcatttgggttgtttgtggccaagtgttggttcatccgctcactttgctcttcgtcagcacgccgtctcggcaccgcgcattaatctcagcatcggatacaacacaatcaatggcattaccaccagaattgccaaatcggtgccatttatccaattgagtcgagaatttcactcttgaaataatttgacagaaaatc

SEQ ID NO: 53430 - DNA, 123 bp, Heterodera glycines
  Genomic contig location: Contig_ID=SeqID_22737; Location=932..1054; Strand=-
  SCN-specific regions: Sequence locations=1-123
atgaacgaggcgaaagagaagggtattcagcaaaatcgaagccatcagctgatagccgacgtttggaagttcgacatgaacaccgcccaatgggtccgaatgcgcaacaacttggcgaaggcg

SEQ ID NO: 53431 - DNA, 1762 bp, Heterodera glycines
  Genomic contig location: Contig_ID=SeqID_4163; Location=121..1882; Strand=+
  SCN-specific regions: Sequence locations=1-84,134-401,424-1168,1191 -1328,1350-1762
  Gene Ontology: Mol. function=metallopeptidase activity; Cellular component=proteoglycan integral to plasma membrane; Biological process=pathogenesis
tccgtgtctccccattcgctgccaatggccaaacgcgccaaatcgtcgtcccccgccctctctctgtcccattgtcagttgtactgctcgctgcttctgttcctcctctccatcctcctctccgtcctcatcacctttcttctcacccggaatgccattcgatctcaaatagaaagggtcaaccaaaatgaagcggtgacggcaaaactcgtcgccccccacggggccattgcttcgctgaacgcgggtcatgacatgtgagtttttggaaggagttcaacccgtaatttgatcgatcagaacacggctacgcatgccgggaaagtcactgttggccaacgcacggccgcgcggaaacgaaacggcggacgaagcgaaggaagagcggccggaaaagcggaaggagccgggcgcggaggagctgagattgtccggagaggcgcgttcggccgatgcttcttcgttcccttattttgccatttcagcttttccccatttggtacaatttgtctctgaaagttttcgtccccggctttggtgccgaaatttcgccccaactcaatttgacctttaacggagatttgcttctgaattttgccgttaatcggacaacccgaacaattgaattgaacgcgttaaaactgcgttttgatccgaataatttgatggcgtacgaattgaaaaggacggacaatttggcaactggggacgaggtggacagaacgccgaaagtgatcggaattcgggtggatgaagcgcgagaaaaggcgagcaaaagggcgggcaaactgtcgatcggagtgccaacatctgttaaaaacggtccttttgaaggtgttcttcgacttggacggcgatttaaccctgggaaatcattacgccctgcgggtgatcggagccaacgaatgccccgctaatgctcacctttctctccttctcgtcagattccttattcgggcccaatcgcctccaaattgtccggcctttacctgaccacgtacacaacgctttccggagagcacaaatgtgcggcagtcactcaaatggagccgacggatgcgcgcagaatggtaaaaaaagggggagggtggaagaggtgggcctaattggacaatttggaagtgattagaggcgaatccatttgtggttatggttggtgagcctaattagtttgctaatgaaggtgccctccttcgatgagcccgaattcaaagcgatctttcggctgagtgtcactcatccgaaagggtcgcgggcggtgagcaacgcgaaggaattgcgggagcagcagcaaacgtgggggaggggtggacgaatttgcaaatggatgaagcgttttccagggaagagacggaatggattcggacggacttcgaggagactttgccgatgtcctcttatcttttggcgttggtcgtttccgacttcgaattcgtcgagggaaacacttcccgtggcacccgcgtttgtttttcctttccattggcactttgttctcattttgtttttcatttagtttcgcatttggtctcgtaaagatgcacttaatttggtcagtcccaccatttttctttggcatttcgttttgctttgctcagacttcgtatgcccttcgggcgggcataaaagtgttggagttttacgagcagtactacggcattcccttccctctccccaaacaggacatggtctgtctgtcccatctcaactcttttctattcgctttgtccttccctttcagatggctttttcccgattttgc

SEQ ID NO: 53432 - DNA, 469 bp, Heterodera glycines
  Genomic contig location: Contig_ID=SeqID_4164; Location=110..578; Strand=+
  SCN-specific regions: Sequence locations=1-469
atttacctcacccgcttcaaataccgaaacgcggaacactccgacctttgggacgcactgaccgaagcggtgccggagggaatgaaggattggaagggcaacaaattcagcgtcaagcaattcgcacgccaatggacagaacggacgggctttccgattgtgcaggtcccttcggccaaaagccaccaaattccgtccccctctttttgtccaggttaaacaaatcgacgggcagcgagtccaactgagtcagcagcgattccgaatgaatgcggacgcggcagaaacgggcgcagggggaaacagcagcggcacttgggaagtgccggtgtggtggagcaaagacggacagaacggccccatggaatggctgaaggacggtgggtcccccgcctccgtttgcattgatcacccaattcattgtcagagtcgtccatcaacgcgtccgactccgccgttttggtgctga

SEQ ID NO: 53433 - DNA, 820 bp, Heterodera glycines
  Genomic contig location: Contig_ID=SeqID_22740; Location=159..978; Strand=-
  SCN-specific regions: Sequence locations=1-196,218-350,372-820
taattaaatccattccttcggggaccgtgccgagtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaatctccatcttcctttttgatactaaagcatcagagtgctaaaattaagttgtaaataaaattttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgatttttt

SEQ ID NO: 53434 - DNA, 1584 bp, Heterodera glycines
  Genomic contig location: Contig_ID=SeqID_22741; Location=21..1604; Strand=-
  SCN-specific regions: Sequence locations=1-1417,1439-1475,1498-1584
atgctggcggatcaacagaaaatggtgcaggaccaatcacagcaaattgctcaactgattgcgatcggacaaaacgcaccaaatgcggcggcacagcccaatcaaggagcaaattcagtgccaatattgccggacatttcaccattcgagccaacggacgacaagagccgaatttcggaatggattgagcgattcaaattcgcgttggattgcacagcaccaacggcggacgacgaagtcaaggttaaatgcctgatgaataagctgagcgaatcggcattcagtgaatacagcagatcagttctgccatcgtcggtcacagatttaagttttaaagtgacgaccgaaaagcttgagaagctatttgccaaggctcagtccatattcatcgaccgctacgagtgtttaaaagcggtgagaggagaaggcgaacaattcaggcagttcataaatcggcacaaaaaattgctgaccgattttaaattcgatgagctgacaaaagagcaatttaattgcctcatgttattgatggcactcaaagcgcccaacgaagctgcattgcgacagcgaattctgacaaaattgtcagcagattgcgccaacatcagctatgatggagtggtggaagacttaatcagcttccaatccacaatttcagaagcaaaggcaatcgaagcgacaagttcttcgaggccagtgaattcgattcgacaaaattcaaagccgaacaattcaacgaacaaatacgtcaaggaaagtccaaagccaaataatttgccgaacaaattcaaagaaaggaccaacactgaggcaactacaatatgttggcgatgtggctttggcgtgcatcgacctgacgaatgccgttacaaaacgagcaaatgccgcaagtgtgagtttgttggccatttggacaaacaatgcgagcgtgtccaagagtggcgcagacgccaaaatgccaaaaagaaaggcaacaaccgcgttggccaccttcgtattggaatgaccacgcatgccgtcaattccatttcgctgctaaaaacagcggttctgttcaacaagaagccagtcgaattccatctcgacacggggtcggacattgtcgtcattgatcaattgacgcaccaatatgttggacgaccaccgatcgaaaaatgcaacgaaattggcaaggctttcgacggcacaaaaatttcctttattggaaaaggattcggtacattcaaatttggtaaaattgaagtggagcaaacattttttgttgccaaagcaggctcactaaatttgttgagctgcaaaatgatggacttatttgggcttttagacgaattaaagctgaagatcagcaaccctgcagtaaatgcatgccacgcgaatggcaaaaaggctgagaattttatcccgaatgaagcaacgcagattgctgggacaggaaccgaaattcaagccctggaaaaagaatttcacgaaattttcagtgaggaattgggccattgcctaaaggagaaggctcatcttgccctaaaagatgacgcaaggccagtctatcgcaaagcccgaccagtaccctacaattcgttagag

SEQ ID NO: 53435 - DNA, 812 bp, Heterodera glycines
  Genomic contig location: Contig_ID=SeqID_22743; Location=505..1316; Strand=-
  SCN-specific regions: Sequence locations=1-339,361-812
atggccgaacttgagcaggaagtggccgatgatcagaaaaatgcgcagcaaaaggacccatcccgcgcttctgctcccaaacgtatggaattggccaagaaattggagtcaaagggtaattacctctaattaggcattaagcacacagtaattaaactaataaatttccagggatactgtacgttcgtcaccatcaacaattgaagaatgctttgtgtggccaaaaaaagagtggcaaaattggacccacggagaattttgtccttttcagcaacaaaccgaattcctcgcccgacactttgaagcagttttttgtaaaatcacatttcaaaatgctcctaattatttttaaattcgtttgtttttcttttagttggctcttcactatttgttcaaattggccgaagcgggcaagaattgtctgttcgtggatttggagctgttttcggacgggcacaaaaagacgcaaatgccgaaagtgatcagcaattcgttggacattttcccactgatcggcgcccgactgatcaaaatgagcggtgatcaattggtgacagacgattgggttgccaaaaagacgcaaacgttgggcgtgtgcactgcgcgggtgggtgaaaaaacatttgggcatttttgtaaattccgattttaaatattaccatttcagtcctctgactctgaaaagatcccttctcctgctgaccaacttttatggccctgtcatttgccgtgtccttgtgccgaaaaattcggtggtaaatgccgagacgacgaccatttttggggatgtgaacaatgcggacagactttaa

SEQ ID NO: 53436 - DNA, 541 bp, Heterodera glycines
  Genomic contig location: Contig_ID=SeqID_22745; Location=506..1046; Strand=+
  SCN-specific regions: Sequence locations=1-457,494-541
atgaagaaattttccatcatcccaatgccgcttttgctggtggtggttgtcctgctaataatcccgtttgtcccttttacgctttcacaactgtgcttgtacgacagtgtgacggagagctgtctgaaagtcaattgtctaaatgaatgttatgttgatagtccgggcacgtgcggatgcaatgcgagagtaagcaaaccaaaggcgcctaattaggcacagaaagtttaggtcattatcgacttgagtgtcgagaaatttttcgagtttttttgtctttgttttcttgaaattcagtccaatgatgccaaaattcggtccgaaaaaatgctggatagcgggattctggtagccatggaacatacatgattcagtcccgtaacccgaaggcttctagattgttataaattttgtagagatatatcgaatgatactaaaagattgttcaatttgatagattttttgaaatttttatttttcattttattattatgagccacccttactggaattaattaatatcaattcttctaaagttcaa

SEQ ID NO: 53437 - DNA, 1913 bp, Heterodera glycines
  Genomic contig location: Contig_ID=SeqID_22747; Location=94..2006; Strand=+
  SCN-specific regions: Sequence locations=1-94,123-445,475-750,772 -1428,1463-1860,1882-1913
  Gene Ontology: Mol. function=transcription factor activity; Cellular component=nucleus; Biological process=central nervous system development
atgaccgccgccgccaatggctttgctttttccacggattggtcaaacggcggggcgccgccgcgatttgggtgcgaatttttgcgggggttcgaaatttaattaaaaattgtaatttatttggaacgatttgattatttaccataaatttgcaggaaacaacgccgggagcggaccaccttctcacgcgcccaattggacgtgttggagggcgttttcaagaacacgcgctacccggacattttcgtgcgcgaagaaatggcaacgaagatcaatctgcccgagtcgcgagttcaggtgggaggacacgggcgagcagggcaatgatcggcggataaaaccccgggggggggactgatgagtaattacctaattaaggggaggaaaatcccacaccccccccccctctaatttggcaatggacaatgattgacaataattgttaaggtttggttcaaaaaccgaagggcaaaggcgcgcagccaaaagaaagcccagcagatcaccccccccccaccaggtacagttggggtgttcacacttcccattcgtcctgtttttcttagtccgcttcttcctcctccggttcctctgtcgccggctccaatccgtcctcagccgtcgaccaccacggcaacggctcctccaccgcctcgtccggctccaactcgtcgctggagagcaatggacactctgacgacacacacttggtaattaggacaaaattcgcttttaatttcttaattttgctcattttagcttcaaatcaaattggagaagatcgaagacggcactttgaactcatcggcacaaaacggcggcatcggctcgggtggtatttcgcccggctctcaactcgaagtgggcggaccaccacagagcggtgggctgtcgtcatcgtcggcggatcatttgtcgaaaatgggtggttgttatttacccggcacggctggcatttcgccaagtaattttgaaagcgcgtcaatccgagactccctcgactgatcaatgaatttttcagtgatcggacaatacacctcatattacagtccgttccgcaacggtgccgcccatccgtacatggcggcgtacgccccgtccgcctgctccatggacatgtacacagctgcagtgagttttgctcttcccatttcgtacaattccattttatgagtttaatgaacaattaattcccaattaaggcgtaccccgcggtgacaatagcggcggcggccaacatgaacattaattattcggcagcatcgaacatgaacggattcatgaatggttgacaatgggaaggacagaatgtgaagggacgacgcagtgaaatgatcaaaattttacaattttttcaccgatcaaacgaaaattcttacaattagcagcacaaagaacacttttgatcggagaaacattgcaaatcggaaaaatctatcttttcttttcttttcccactacattttccacccgtcgattgatgcaatattccggaaagtccaaatgttctttaaaaaataattatcgagatttatcccttcatttgaaaggctgagattttaaacgagagaaagagagagagaaaaaacagtttaatggcaattcaaataaattttatggcatttcagactttggcataaaatctcagaccgtcaaaaatatatcagaaaatgtataaaaatgtagaagacacataattaatttaaaaccatatcattgtcattcgtccatttcgtcgtcacatttgcacttctcagcccatcccaatcattcactcgtcaaaatcgaagaaaataacaatgaaaaagggcaaaacgaaatgggagacggaaaaaggggaagaaagtgaaaaggggcgcattttgttaatttttaaaactgcaacttatgtaattaagaagcatttgtttaaa

SEQ ID NO: 53438 - DNA, 421 bp, Heterodera glycines
  Genomic contig location: Contig_ID=SeqID_22748; Location=840..1260; Strand=-
  SCN-specific regions: Sequence locations=1-26,113-421
  Gene Ontology: Mol. function=cholinesterase activity
gcttcctccggtgccgatgccgtccgctcttccgctttctcttccgttttgcttggccctgcttttcctcctcctcctctctccgtccccatgcttttcctcgtctcctcctgacgattcgccaattgtcagcaccaaatttggcaaaatccgtggccaacttttgcacgtcgtcgaccccgtcgatggccaacccgtggcactcaccgcctttttgggtgtgcccttcgcgcgaccgccgctgggcaaattgcgatttgaggcaattgaaattgtggcaattaatcaaatagctgaaattttacagaagcctttgaaaccggaaaaatggagcggagttttcaatgcttctgaaatggcacccgcgtgttggcccattgcgcgtgccgaaatttatgcagaggttcacaatgaatgttga

SEQ ID NO: 53439 - DNA, 1233 bp, Heterodera glycines
  Genomic contig location: Contig_ID=SeqID_22749; Location=128..1360; Strand=+
  SCN-specific regions: Sequence locations=1-16,93-171,193-505,548 -569,608-629,661-782,804-1038,1061-1233
  Gene Ontology: Mol. function=ubiquitin-specific protease activity; Cellular component=nucleus; Biological process=pathogenesis
atggtttcttattagcaataaaattaaaactaataataaatttaaatgtttctatttatattacataattgatttaaaattaaagttataatcggaaacattgctgattttcatgttaaaaaaaattaattacaatatttgtcaaatttttgtatctcaaaataaatcactaaaaattaaggaattgttggatccgggcaaaggattttacgacaaagacgagaacaaagtaaaattggccattgatgtcattgtggatgagccaaaaactgagaaaattatttccgatccaaacaaatccaacggcacactttcgatggaaattgaaaaactatcggaatttgagcgagaaatcgaaggaagtcatcgtaaaagtgaaactgctgtgtacataaagggaatgccatggaaaatatttgcatatatcaaaatgaaaaatgaaagcactgagaaatggttgggctttgcacttttgtgcgacgcttctgaaaaaggtttgcttatcaaattatataatagaaataataattattttttctataaaattggtgtaattaattattgaaaagacttatgtaaacagtaattttttaacataaaattagaagtgattttttaaaggaaatgcgttaaaatataaatttgattattatttaatttgctttaagatggaaattggagccgcaaatgttcgggaacacttcgaattgtctcgcaaaagaacggtgtggaggattttaagaaagaactcgatgaaacagtttttaacaatgaatcgaagtcttgggggaacaatttcatttcatttgtggtgagtggaaattaattagttaatttacattttaataatgtaatggcaaattaaggaattaatggacccaagcaaagggttgtacaacaaagacgaggacaacgtcaccttggcaattgattttacatgtgaatagcgtaaacatttcgagatggattgaaaagtgaaaagaaggaaatcagcaggatgagaagagagtcttggagggcacaaaattttcttggtgcttaaattttatattttttttatgttttgtaaagtattttggtttcataaagcaacatattccaatgatagggatggatttttatgtgctaaaatcgagaaatatatatacctaaagagttgataaaaaggcagaaaaatttgctaaaatgcagaaaaatgccaaaatagttgccaaaaaattggaaaaaatgtca

SEQ ID NO: 53440 - DNA, 938 bp, Heterodera glycines
  misc_feature (15)..(15): n is a, c, g, or t
  Genomic contig location: Contig_ID=SeqID_4168; Location=96..1033; Strand=+
  SCN-specific regions: Sequence locations=1-563,738-938
  Gene Ontology: Mol. function=calcium-dependent phospholipid binding; Cellular component=synaptic junction; Biological process=synaptic vesicle targeting
atgtcattctgcggnagttttcaacgacttggtagatcttcaaaagatgctcctgaaatggttattgattgggcgaaaaacggtatattatttataaccatttagttattgaacatattttgaaaattcagaaatatgtgcccatttttccattcccatcgaaattttcgacaacgtagaattcacagaaaaaataaaaactgtgtatccaatgttcaaggatgtcaatactgacaaactatcgacccatcgccaatgtaatttttgtagttttttatcttttcactttgaatttttagttgtgtctgacatttgcgatgaaatagaaagacgcaaacgaatgggttgaagacgcgaaaaaaagatcagccgaacgagttcggtgtgaagtgaacggactgaaggtgctgttctggagcgagggcatcgaagatatttacttttatttagctgttgtcactttgaattttgtaatttatatcgttaactttgctgacataaaaattaacacaccgtttaaaaaattagttagtgcaaagaaaaatctcatttagcgagtcacccccaactcatccaaacccaactcatccatacccaactcatccaaacccaactcatccatacccaactcatccatacccaactcatccatacccaactcatccatacccaactcatccatacccaactcatccatacccaactcatccatacccaactcatccatacccaactcatccatacccaactcatccatacccaactcatccatacccaactcatccataacgctgcgagtcatcgtcgtggcatggcattttctgcttatgtggtcttgaccgtggacatttttgattatgccggtcttgaccctggcattttttggttgtacggtcttagtcgtagtattttttggttgtacggtcttagtcgtggca

SEQ ID NO: 53441 - DNA, 760 bp, Heterodera glycines
  Genomic contig location: Contig_ID=SeqID_4169; Location=310..1069; Strand=-
  SCN-specific regions: Sequence locations=1-6,45-142,165-296,318 -374,396-460,482-527,556-760
atgcaacgcaccctggccgactacaacatccagaaggaatcgacacttaaactgaaaaaaacgcggctgtccagccgaggcgtggacgcgatcatcacgaaggtcaaccgttcgccccctcatcgcttcacggatgaggtagaaaaatttttgagtttttcaaaaattaattttcccccttttttttccccaacagatcagtgacgatgaaatccgccagctctcgcaaagcggcaacggacgtcttccgaatgcagccgacgctcgtcagaatccacccgccggccgtcatcgtgggcgacatccatggacaattcgcggacctgaagaagatcttctcaacgcatggcctcccgccggagcagcagtacgtcttcctgggcgactacgtcgacagaggaccccagtcgttggagacgatcatcctcctcttctgctacaaggtgtggtttttgggcggagggggccccaaaaaatgaaactcatttcctcccatttttcaggtgaagtacccctccaacttcatgctgctgcgcgggaaccacgagtgcgccaacatcaacagagtgtaagtgaaaaagttttttgtgtgtttttttgtgattaatcattcccccccccccattttcagttatggcttctacgaggagatcgaccgccgttacccgcgaccgggcgctcgtcgactcttcgacctcttcaatcaagtcttcgcctggatgccattcgtcggactggtcggcgagaagatcctctgtaa

SEQ ID NO: 53442 - DNA, 3488 bp, Heterodera glycines
  Genomic contig location: Contig_ID=SeqID_4169; Location=947..4434; Strand=+
  SCN-specific regions: Sequence locations=1-79,118-198,220-241,263 -290,343-502,524-591,613-634,656-683,736-895,917-984,1006-1027,1049 -1076,1169-1378,1408-1562,1589-1717,1742-1756,1792-1849,1871 -1901,1964-2449,2471-2587,...
  SCN-specific regions: Sequence locations=...2612-2634,2656-2771,2797 -2940,2989-3280,3303-3386,3417-3488
atgagggggcgaacggttgaccttcgtgatgatcgcgtccacgcctcggctggacagccgcgtttttttcagtttaagtgtcgattccttctggatgttgtagtcggccagggtgcgttgcatatgtttaccaaacgcacaaataaatggtgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagatttttttatttttcccatgatagtctgctaatatgaagactgatttacataaatgtgatttatcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagatttttttatttttcccatgatagtctgctaatatgaagactgatttacataaatgtgatttatcggcacaaagtataaattaattaggagaaaaaactgttgcgaaaagaaatctaaacccaaattacattctgttgtcccaattgttgactgtgacaaaagggtgggagattaatgaaaattgcatatatttaccaaacgcacaaataaatggcgcacatgtcttttatttctatgcttgtttaggaacagaaacatttaattgttttatttagtgtctgtattttattggaatatctcttccagaaagttaaaaaatttgaaatgtgaccggaaatgccaaaaatttcaatctttttaataattaagagaaaaaaattttcatttaaaagataaaaaattaattttaaataaaaaattatatttctttttaactaattttttttcatcaaaagctaattcgaccgttgctgtacgcttttgtcgccatctcagcagtcacccaattaactttgggcacagatgaaggtgtgaatttcactctatttatttataacgtttgcccatagtcaatagcgtgcttaattaagtggctgtcatttgcagaaatattgtcaatcatccgagatgagaattgagcaatacattcggaaaagatttatttggatatttaattttgccaaatatccatataaaaatgagcgtagtaaagtgaataaattgcaaaagcccttataattaggatgttgcgaccaattaaattaatcctcttccactaattagcaggaaaaggatttccaggatttttatcttttttttcgcggattgcattttacgacgtgagattcacaaaaatattttctccaatttcgagaataaaattcaaaaaccccaagtcggcgcttatcacaccgccgaacccaactgacaatactgattgacatcatattaaattatgaatccaccaaaatgtctcctttaattgattcaatttgttaaatataaatttatttataattgtctctattccatacaaaaatataaaatatatttaattaatttttttttacgtataggaattatttggttgtgcccaactgctgagagcgcgtcacctgttgcaagcagttcacctgcagcagaacaacccaaactgggaatcatggtggtaagtgtaggaaaatttttaaaaaattaattttaaataaaaaattatatttctttttaactaaattttttttcatcaaaagctaattcgaccgttgctgtacgcttttgtcgccatctcagcagtcacccaattaactttgggcacagatgaaggtgtgaatgtgggggactgatttaatccagaaaaaaattgttgtggtactgtcatactgtaccattacagtaccgcagcatttaaatttatttgcaaattatcttcagatatcgacacatttcgaaaattgatgaacgagtacaacactttgagcgggccagcatttgatgttttgggcaacctgctcagtgttagtgaaaacagcaaattgttgatgaagctaactggcccagccggaagtttgcttgcggcatgtattgagatcgcctttaaggtcaacaaaatattcttctatgccgggatggtcccaggattttgatttgggcgagtggtgatttagccaccctctgggcgaagaactttttttaaatttgagtgcaatttgtctaagaaattttgtccaaaaaataattgtgaattttttgaaaatttcgccaaatttttttatttgttgagaacaaaaaagccgggacatgcgggaaccgtaacataaaaaagtggaataccgtctcggaaccggggtcattttctaccctaattaattaatttggttaatccattcttttcaagcccgaaagtcccactctgaaagcacttgcaacatttcacgactgggcggaccgaaaattcacggaacagaacaatatggttgagattgccatgaacagcatcagagtcgcgcatgacttaaatgattttgacaatgttagcaaactcgagttgttaataacaaataaatgtttttatttaattagaatgttgatgtcccattggcatggttgtccgacatttttgaaacagtgaccaacccaaagaccgtgagaagcgccaaacaagaattcatctcagcgtgtacccaaatgttctcgtcgccgaaaaaaattttaaatgtgcaatttaaataaaaataataaatatatttttcatttttagtatattaatgaaaaggtgaacgacaattgcaacacaatgccacggagaattatgccaattctaagcgagctgagggctctttttgctggtgttttttggcgttacgatgaacagaaactgacgattgagtacaatgaattaaagaaaacgtatctcagtaagtcaaaaaatttagattaattaaaattgttcctttcatctagagctggtcgggaccgggactggtactgaaaacaacgggtacaactgagtacccagtcccggttttgaccagttttgaccgggaccgggactagtcccgggtttttcccggttttccagccaaaaagtcccggtttttcaacccgaaaattcccggtcccggtttttgtcaaaaatcccggtcccgaccagctctactttcatcgaataaataaatttatttattttttaatattcaggagtgctcgaaaaatttgcaattgcttctgaagaagatgcacgagaaatcttcatccaaattcgtgatt

SEQ ID NO: 53443 - DNA, 1799 bp, Heterodera glycines
  Genomic contig location: Contig_ID=SeqID_4170; Location=176..1974; Strand=+
  SCN-specific regions: Sequence locations=1-85,113-238,320-522,545 -569,591-804,828-950,972-1087,1109-1332,1357-1435,1485-1543,1565-1799
atgagatggggagcattggacgcgcgagaaacgctaaaagatggtttgacaattggcggttgaatatcagcgaaattataaggtgttttattattaaaaataaaataattatggttaataccgtatatgctctaattatagcccagtctctattaatcccgcagtctccaattatccccctccccttctgaggagtttaaaaataatccccctagtctccatttatcccccatgtgggataaatagaatttttaatttttcaaaatttttttaaaattttaataaaaattaattaatttaaaatcaaaatcatttaaatgtttaatgaacatgaaaaaataatacagccgaaaaatcacttactttaccgggatccgaacctgacccacctccccctcataataatgcctcagaatccacatttatgcagggattctgatgccttaacgaagtcttaaccaaaatctaatttcaaattctctatcagcgcctaaaataatcctaaagatatatttttggagattttgggacaaaaaatttttccactcaaaaatcatatgcaaccccactttggtcccgaatcccaaaatgagtttattgttaaaacttccttcaaaaaagaaaaatattaactaaaatacctaccccttataatacaaaaaattgcggatttttctagttttttaatttataaaaacatcttttttcagaattgagtgctgaattttttctcaaaaatgaaaaattttcaaaatttaaaaacaaaatcccattttctgaaaggttcatatgtgtatctgaatatttttgagggttttgtcaatgttttgtaaatatctttggaatttttcaatttttcacgcaaaattcagaaattttttaacaaaaatgcaacaaaaaataatttttttgacgcgattacatttttggcgacatgttcaaaacaaaatgttttttattcataaatcagtcgaaaaataatccctcagtctccctttatcccgcagtctctaattatccccccttttctgaggaggttgaaaaataatcccccatgggctataatcagagcatatacggtattttattccaatctcagtaccaacgacaaagcccctgaattgggcacattgacgaaagcgattgttgagaaagtgggcccaatcacttccgatccattctaccacagttttgtttttcttcacgtcagcgctttttcttcatcaaactgcaaaataccgaccggaatttcaagcggttcctatatgggacaagaaggatttagttttttggaggtcaatgaccatcactgggcaccgcgtaatgaagaatgttttaagttattcttttttctatgaaggattaaatttttgcttaaattagatgttattttaatgattctgaattttagaccgatttatcagaaatttcgacaattttgaatgcatttttccattttattttaaataaatgttaaaaaactgaaaggtgtatttatcgaggtcagattttcataaaatattatctgtataggatttacaaggaatatttgtctatcaacatgaaaatcagggatatgactgggcgtcaataacaaaagtctttaaagaacctgtgatcattaataatagattcaaaaacatagtgatcaagtgttattaaaaagaatgtttttgaattttttttataatcaaaaacccaaattgtgattatgtggacatggcgcccccacaaaatgaccaggccacgaaatgtccaaaagagtaaaaacccacgaaatgtgcaaaaaattaaagtta

SEQ ID NO: 53444 - DNA, 58 bp, Heterodera glycines
  Genomic contig location: Contig_ID=SeqID_22752; Location=42..99; Strand=-
  SCN-specific regions: Sequence locations=1-58
atgagcgcgctgtctgatacattatttggctctctaaaaattattaattttaagaaag

SEQ ID NO: 53445 - DNA, 335 bp, Heterodera glycines
  Genomic contig location: Contig_ID=SeqID_22752; Location=593..927; Strand=-
  SCN-specific regions: Sequence locations=1-198,220-335
agccctcgtggaatgtttggccaaatataaaaagcccgcgtgcaaaaaaatatgtccaacaacgaaaagcctcgtcagaaaagtcggaaccgttaggaggaaagtcagcgcattgctttggcttaaaattggtgaagaacaatctgaacaattggacttatgcgaagaaaacaatgagacggatttcggaattgccaatttgtttaatgacaattaattgcatttaattgttttatgcattacataacacaataagcgtattaaatttgttgattgggacaaaaggtcgaagccgtggattaagaagttttatgagtcggtctcttttaaataaa

SEQ ID NO: 53446 - DNA, 338 bp, Heterodera glycines
  Genomic contig location: Contig_ID=SeqID_22754; Location=429..766; Strand=-
  SCN-specific regions: Sequence locations=1-6,52-338
atgcggtaaattaaatattataaattacaattatttattttctaaaattaaggcactccgttggtccgacgaacagtgccgtcaaaaaggcatcgaatgttccgctgaaaatcgacgaaaaatgcttgacccagttttgtccaacattcgttttccactcataccaaaagaggattttacaaaaagcgttggtaataaataatattttgatgattagagagtttgctatcttgaaaatgcttgaacctggcttggattccttgttggacctggacctgtaatggttccaagtctggattaagggcttttcataattataccgtatttcctcgaataaa

SEQ ID NO: 53447 - DNA, 988 bp, Heterodera glycines
  Genomic contig location: Contig_ID=SeqID_22755; Location=555..1542; Strand=-
  SCN-specific regions: Sequence locations=1-4,26-146,209-298,332 -575,598-769,793-850,879-988
atggaggagaaagaaatggaatggacggagagagagaccgaatggacaatgcgattggagaacggggagagagagttggcaatgatgagagagctgggaagagaacagcggggacaacagagacgggtgggtcagtggaaatgagaagagaaagagaggagagagagagagagggagagaaaaaaggagaaagagagagagagagggaaatgtgagaaatttaagaacttcaaatgaccggaaagtacataaaatagagaatcgtggtgagccgaagtaacaaaagtctgaatgtttgtaattaaatttaattattattttaattaaatttgctaaataattaatcataacttagcctaaactttgtcaaattaatgaaatttagtatttagcgacagctcaaagtatcctctactatttatgtatttttttaaaaattttgcaaaaatttacaaaaagttgtaaccaaaaaagtacgaaaaattttgacttaacaattttgaccctaactttattgaagttcaataaaatttttcgaaatttaatataataatagagaaatctttgggctatctaattatataaacaaaattaaaattcattcattcagaaaaaagttatgaaggaattaatagtgtcatatttttatggctatccaaaaaatgtatggtcgtttaaatgcatgaaattgtttaaagatcaattaattcacactgcactttatatgaaaagatagcccaaagatttctctattattttgctaaatttcaaaaaattttattgtttcaaaaaagttacggtaaaattgttgagcccaaacttttcgagcttttttgtttacaactttttgtaaatttctattaaatttttaaaaattacatacctccatttagaccatttcaatcccggacccgaattcgaaaattttcttaaaattcataaaaaatttgttgtagtgttgcttatgcattgatgctaagaaaataaa

SEQ ID NO: 53448 - DNA, 981 bp, Heterodera glycines
  Genomic contig location: Contig_ID=SeqID_22756; Location=125..1105; Strand=-
  SCN-specific regions: Sequence locations=1-277,299-686,714-981
atgattatttcctttttgacccgactcgtccttcttctcccacaaatttcctacacggactctgtacgtctcgaacaaatcgctgaaggaggcagggaacgacagaacggtaaaaaaaggcataagaaaaagaaagcaaaagaaataccaaaaatggaaaaccaatcggcagaatttgccaaaggcgcgccgcccctcgcggcgtttgtcggcggagcgaatttcactgctgcaacgacggaattgcgaaaagcgtatttggagcgaaagaaagcgcgcgaggaaaaggcgaagaggacaaaggcaaaagtgagggaaaagccgacgagggaatgcattccgatcgatgacaaccgaaggaaggcactgatccaagtgggtggtaggctgatcagaggcaacgcccgcggggaggagacagggatggcacttgccgaactgagtcgcacaaagcccaatggcatgccgccattaggcccttcccatccgctaattgaccaaaatgccgacactcgctccccccgtcccatttagggtctgttcgccgagaatcactacgacaagaacaatttgccgtcctccaaccacacttcggtgatcgtcgagctaacagtgcagagcataacggagatcagcgaattctccagcagtttcaaagcggacgtttggttcaggtgaagcaaccgaccgatgaatgaatgaatgaattggtgcgtttgtgccgaaatgattttgccgtttagccaaatttggagggacccgcgcttggacttctcttcgctgaattattgtctctccaacatttcgctgccttctcacaaattggtcggtccgtttcgtttcctctaaaaggggcgaatttaatgccatcccctcgacctgtccattaccgtaccattttctcaccgtaaccgtgccattaccattactttctgatccttttttgttaagagttctctttggactccgaatgtgtgcttt

SEQ ID NO: 53449 - DNA, 343 bp, Heterodera glycines
  Genomic contig location: Contig_ID=SeqID_22760; Location=636..978; Strand=+
  SCN-specific regions: Sequence locations=1-225,247-343
atgccacaaaagcgtcggaaagaaacccgagcgatcaatcgaattcgaaaacgccgtgcggagttggaattgttggtgagcggcaacaaggatggtggacaaaatatggacagcaaaacggacacaaaacgggccaaagagacgaaaacggaggacgaaggttagcggcaaattgtggggttgatttaacaaaaagtgccacggataaggcaatgattgggtcaatgaattatgatttcaaattcatgggatttgctcgatagtgtcattttcagagcatcttttcgcggaactgcgccagcagcatttgatttctcgcgactttttgagtttgatttgctga

SEQ ID NO: 53450 - DNA, 136 bp, Heterodera glycines
  Genomic contig location: Contig_ID=SeqID_22760; Location=215..350; Strand=+
  SCN-specific regions: Sequence locations=1-136
tatgtttctgatcagcactgtgctgttcagtgtgccttcctatttgttcgccatacgcaatgatcgccgactgcgcgccgtgacgccgtacggcggtgtgttggccatgctcgcttggttcagtttcgtcctttga

SEQ ID NO: 53451 - DNA, 580 bp, Heterodera glycines
  Genomic contig location: Contig_ID=SeqID_22761; Location=285..864; Strand=+
  SCN-specific regions: Sequence locations=1-97,120-353,375-580
  Gene Ontology: Mol. function=3'-5' exonuclease activity; Cellular component=nucleus; Biological process=DNA replication
atggatgagctggtgaagccttacaacaaaatcattgactacatcacattcaaaagtgggattaccgagaaaatgctcagcaaagtcaacgtaagagaaaatgaagaggaattttacttttaaatgctaaaatcattaaattgtttattactcattaaaaatcatttttgagccatccaatttctgctcaaagtcgtgccatttttatttttagactcgtctgaaggacattcaaaagcgtttctgtgccttgctcaccgacgatgccattctgtgcgggcacagtttggagaatgatctgctcgccctgcaattgtcccacccgtcagtcccccccccttcatttcgatttattcccccttttcctattattagtatttaattgtatgattaatttcagtttttgcattgacacttcgctgttgttcaacttttctggccgtgcctttgtgcgcagtggcctcaaggcattggcggacatttttctgaacgaaaaaatccaaaactcgcgccagggccattgctctctgcaagacgcaatggccacgctaaagttgctaaagctgaagctggaaaatgg

SEQ ID NO: 53452 - DNA, 84 bp, Heterodera glycines
  Genomic contig location: Contig_ID=SeqID_464; Location=921..1004; Strand=-
  SCN-specific regions: Sequence locations=1-8,31-84
atggccaactgcggcggcggcggcgaccgatgtgctaaaggatgcgatgataatgaccctaattatggtgataatatagggatg

SEQ ID NO: 53453 - DNA, 1991 bp, Heterodera glycines
  Genomic contig location: Contig_ID=SeqID_465; Location=4737..6727; Strand=+
  SCN-specific regions: Sequence locations=1-258,280-333,371-1032,1059 -1218,1243-1363,1408-1845,1870-1991
atgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcgtttcaaagaattttttttgtttagacatttaaaagtcgtgaatgctatgaacaccatgccaaatgtacaaactacagggtcaagcgtgacaacgaacatgaaattgtgggaaaatcaatttgtaaaagctcgaagaaatgcgtcgactgtggcgtgatttaccaaattcgggttattataaaataaaatttttttattttattaattttctctttagcatcaccaacaaaaagagcatgtttgcggtcaaaaattctgcaaaatttgtctcggcttccatgccccgcgagactgctacataccataccggcctaaagtcaagaaggagaagcgcttcgtcttctttgactttgagtgcactacggatttcaagcccgacccgcaactcatgcggttcaagcaccaggtaattatttttttttgaattcaaacaatttaaaaaaaacaaaggtcaacttctgcttcgcccatgtgacatgcacccgctgcattgagaagggcatttgggaccaggagctggagcgggcctgcgctctctgcggccgattccgaacttatgcctggtctccgtttgagttctggcacacggacgtggaatgccgcaaggtcgtcgaggacccactggctaccttcaccaagtggttgctgaactttgaaacggaagtcctcggcatggagcccggagcgaagaagcgcagaaagaggaaaaacattgacaacaccgacggcgatgccatggagggtgaagaggacgaggacgccgtggatgaggacgccgagaacaactggatgttgggctatgaggaagcgggggaaaagcccgagtcggtgacgtcgtacgcatacgcacacgccggtaaattgaagattgaaattattttttaaaataaaataaaacttaaaggttcccgctacgaccatgtgctgatttatggtgaaatgctgcgcatgggtgtacgccctgaactcatccgccaaggcaaccatctcctggaaatgaaggcacgcaaaacgggagtgtacacaaccaccatctttcgcgacaggtaaaagtttgaatataattattttttaaatttttgatcgctttagctacaagctgatcccgatcaagcttgccaattttgtcaagacgttcggccttgaaattgagggagtggacaacaaaaagtacttcccccacaaattcaataaggtaagggtaatttatgaaattaattaaaaaaaaaaaaatcattaaaatttaggcggaaaattacggcactgttttggacactctcctgccaatggaggactactacccgggtggtctcttccctgccgaacgcgcaaaattcgagcaatggtacgacgagaaccgggaaacagggtttgagctgaacgaagtgatcgccgactactgcaaaacaggtaaaagttctggaaaaaaacatgcaaaaatattcaaaaaaaaattttgaagatgttcaaattctggcacatggtctggtaaaaatgcgacagctgttcttatctgagactcggcatgacatcaccgattcggtcaccatcccatccggctgcatgaagtattgggttcaattggcacaccacgacaaagagcgcgtcgccattattccacatcttggctatgagaagcgcggaaaacagagcactattgccagaaaatacttgaaggtgtgccaaaaaaaaaattaaatttattttaccttttcatttctctctcagtggcgtgccgaagaagagttgcgggagaatggccgagtcctccgccatgtcgaaagccctggaggggaagtcaaattcggcactacagctttggacggatga

SEQ ID NO: 53454 - DNA, 1541 bp, Heterodera glycines
  Genomic contig location: Contig_ID=SeqID_466; Location=1027..2567; Strand=+
  SCN-specific regions: Sequence locations=1-89,112-164,186-391,414 -533,555-726,755-890,914-1084,1106-1221,1243-1541
atgtacccgcgcggcttgatcgaccccgagtacaattgcgatcattttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttgaaaaacttaataaaaaaattaaacaaacaaaattttaagcaagcggatatccagcgtcttgtacggaggcgggcatcagcgaggaggagtcggcacggagaaagcaggaacacatcgacaaggccaaagaaaaggcccaagtccctcttgaggcggaccgaatcaaacacaaccccggactccgctacctgtccaagctgtgtttgaattcgctgtggggccggttcgcacttcggtaaaattttggttaagaattatgaaaaaatacaaattatacagaaaccggcttaccaaaaccgaaatcgtcgagtgccatgccgagctggccaaactgctcaacgactcgaagattgaggtcagcagcattgatcagctgacggaaaagttctggatggtctgctacaaggccaaagatgagcatgtggtggagcacagcacaagcaatgtaagaaaagttttaaaatatttaaaaaagacaattgaaattttctcaggtggccattgccctatggaccacctctgctgcgcgaatccacttgctggaatcgctgaaaaaggtgtatggccctgcaccaggtgtagagcgctacgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggagctcgccgacgagtaccgaaccacacgattatggaattcatttgtggtaagactcattaaaaatagatcaaaataaatggaaattttttgtttagctgggcccaaggcgtacggattgtggctgcgcaacaacgcaacgggggaggacgagtacaagctgaagctgcgcgggatcaccctggactcggatgcctgcgagcgcatcaccttcgagaagatgaaggagatggtgcagaacaagctgggacagccggacaacaacgtccgcttcaactacccaacgaagaacttccggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgtacctgtctgttcaacccagacctcaatgtgaacatgttcacagaagaggagctgaatgaccccgacattatgccataa

SEQ ID NO: 53455 - DNA, 1093 bp, Heterodera glycines
  Genomic contig location: Contig_ID=SeqID_4171; Location=496..1588; Strand=-
  SCN-specific regions: Sequence locations=1-166,188-267,289-458,481 -576,598-662,699-797,819-985,1031-1031,1053-1093
atgacaacaatcgaccaagaaatacagttcatcaaaaatgaaattgttaaaagatggaaaagggaaagaaaaattgttcaagacgcaaaccatttagtgacatattgtaataaaatttctttctatgcaaaaacatatatgatcatcgcatttagtgctccaggaatacatgaaatttatgaaaaatttttagaattagcacaaaagattagacaactatatctacaaatttcaaatgaatataaaaatatttcgaaaattcttggtgaatttgagaattgtttaaaatataaaaacattcaaagatgtcatgaaaatgagaactcttcaaaacatagcatggcaacctgttataaataccggaagcagctgagaaaatttcgtatagaaatagatgatttgttccaaaatattgtatcattagctataaattatttaaatccaccagaagaacctatcaaagagcaaaatgaaaatcatcaaaatgaaatattttatacgccatatcgtaggaaccgaattatacatggacaattatcagaaattttttatagtccctataggaggaattgaatcataaaaatatatttagatttttctaaatgttttttttaccctgataggaaatacgcgttcgactaataatctatctggtcatttgttacatgcttttactatttttattttgttcatttgaatatgagttgtgtgctcgagggggggtttacaaaatgtaactgattgtgagccgacaatgcgtgtgctaatttgctactctttaccacctcacgatgcacgtgggcactctaattcaatttaggtggataagtattttattggtgagattcatttcagaaaacttttcgattttattttgggaggggggtcgaaaaaagtcgacaagaactaaattataacgggaggcaaaatgaataattttctcaaaactcaaacaattttgaatattcttttttttcacattctcataaaaaatatttaaacaattatttataattaaattttttattttctttttcttcaaatttcaaaaattttcgggttatttttctcttttcctttgtcatctaataaa

SEQ ID NO: 53456 - DNA, 470 bp, Heterodera glycines
  Genomic contig location: Contig_ID=SeqID_4171; Location=1605..2074; Strand=-
  SCN-specific regions: Sequence locations=1-147,169-218,240-470
atgattcaaagaacagaaaaaggaacagcaattttgttggaagcgctcaaaaaagaggctgaaagggcaaggaaagaagtttcagtattggcagatgaagcggatgagtatgcgaaatccgcccgtggagcccttaatcgggcaattaaatcccgagaaaaggccccctatgcccccggggttcgtgagtggttcgttaaaatgtcagattgtatctgggaaattttcaccattttggaccaaatgaatgcagagtttgaaacggtagagtctatttggcgtgaggccgaacgttctaaagattacgaccaggtaaagaagctggaggagagagtacttaagggtttaagcgaagcaaagattctacacttagaatctcggcggattcacaccaaaattttggagttggaaaacagaattcaatctgtagtgtgggattttattgggcttcacgaataaaagagaataaa

SEQ ID NO: 53457 - DNA, 1440 bp, Heterodera glycines
  Genomic contig location: Contig_ID=SeqID_4171; Location=2116..3555; Strand=-
  SCN-specific regions: Sequence locations=1-681,712-804,867-1043,1066 -1351,1376-1440
aaaaacagagaacttacacgattcacaagcccatcaggaaaagattccctagactaaagacaataccgagtggcttccacaccgattggcagtgtgatttatgcatatttgatcaattgaaaaaacataacgacggttacaagtatttattggtctgcatcgacgtgctgagtcgaatgatctttagtgcaccagccaagtcaaagaagagtgaggacatgatcgaggcttttgatcgggttttcgaaaagtcgaaaattatcccgatgaagatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaagagcgtttgtacagatattttacaaagaaagacactctacgatgggtcgatgtaatagacaaaataataacaaacattaacaacagtgtaaataggacactgggggtcaagccgtcttcaattacttttgaaaatgccggaaatatttgggataagttatttggaaatttggaaacagaaaaaaagaataaatttaaaaatggtgatttagtccgaattacaaaagaaaaaggaaaattcgccaagggatatcttccgaattttacggaagaaatttttaaaatttataaaataattaaatcagacccaatcgcttatcgaattgaagatttaaatggagataacattaaaggaatattttatgatgccgagttggtaaaagtttcgaaaaatcaaataaataaaatataaaagaactttgactaaaaaataaataaaaatgaataaaataattttcttcgtagtttttggtttggtatttgaccaaacaaatggcaattgttgctgtctttcgaatgaagaaaaacagcaattgaatgctgcgagaaaaaccattgaaaaagcatttcgggataccaccagattaaataacgaagcacgggattttgctgctgcttctcatagggcaattacggaggcagaaaaaattaaagttcgtcatcctgaggcaccgggtatgaaaacgtggttcggtaggttattagaaggggtgagaaaagtacaaggaatttccgaaaaaattaacgaagaaaggcagaaaataggccacattagaaaagaaatggataagtgtttggaccgaaaagatgttttaatgtgtcgtgaattggcagacgaagcgaagggagcatttgaaattgttaagcagtatagacaggacgtcggtactgcgtaccgtaacgcctatactcaatctgacctcgggattggggaattggccgataaagttaaggaaacaatgaaggaatatttataccgccccggaccttccccaagaccaacatttaaagaccaatttatatctgattaa

SEQ ID NO: 53458 - DNA, 188 bp, Heterodera glycines
  Genomic contig location: Contig_ID=SeqID_4171; Location=4685..4872; Strand=-
  SCN-specific regions: Sequence locations=1-188
atgcgtgtgaatcatcggaaagagaaaatatactcagaaaatgatcagagtgagaatgagtgatcaaatgatcagaagatgatcagagtgcgaatgaatgatcaaaataacaagcggcccctatatcttaatgatttgtaggtgatgtgatggggcttgtgagtgagcatgtgtttgtgtatgagtaa

SEQ ID NO: 53459 - DNA, 326 bp, Heterodera glycines
  Genomic contig location: Contig_ID=SeqID_4172; Location=234..559; Strand=-
  SCN-specific regions: Sequence locations=1-223,280-326
atggataaacaaaagaagtcaaggggaagaccacctaaaaacacggagaaaagagaaattcctcaaaaagaaaacttggagaaaaaagaaattcctcataaagaaaaaattaaaattctaaggcccaagataaaacttaaaggaagaaaaatagaattggacactgaaaacagtacaaattcagttccaactaaaataaaacttcctccaatttatgtaagactataaaaatattatattttaaaccataataattaaaaaaactttttttcaaataatgatagatattctttagtgaaaaatatgtaataagcggtgattactga

SEQ ID NO: 53460 - DNA, 492 bp, Heterodera glycines
  Genomic contig location: Contig_ID=SeqID_4172; Location=667..1158; Strand=-
  SCN-specific regions: Sequence locations=1-54,80-165,191-222,245 -410,432-492
atgtcaaaagaatatgcggattcaaaaatattagaagtagtttgtgcgggtaagaattaataaattaataaaattaattgagaattttagggcctaaacaatatgctttgaaattacaaaatcaaaaaggtgaaatttggtataagacaaaaattagaggaatgacccaaaataaaaataataaaatcgattacgaagagttcaaggacatggttttgaattatgaggaagaaaagaaaattcggtttacacacccaaacaaattcgggtaagttttcaaactttaacaaaaataataatttctttaggccgacaagagaaagttacgtgatcagccgtaatattactaaggattatcgaccaattcaaaagaaggggtttgtttgacaggtttttattaccaaaataatatttcaatttaggattattttggatgatgagaatttaactgttttgccttttggttattggtgattttttattttgaataaa

SEQ ID NO: 53461 - DNA, 789 bp, Heterodera glycines
  Genomic contig location: Contig_ID=SeqID_4172; Location=1345..2133; Strand=-
  SCN-specific regions: Sequence locations=1-273,299-462,496-651,673-789
atgatttattattatttacaaattgtacttcgtgtgccaaaaaatcaaaatgtgattttgtttttgccaaaaattccaaaaaatgtagacatagtgccgaacagcgggcactaaccgtggaattttgttctttagaattaagaaaaggtgaaataaataattaaaatgaatcatgctcgtttttttcagcattagaattgggggcagtcatcgatcggttttatcgcggttaccattacgaaaattttgatggaaatttgtttaagaattatgtgagaaaatttttaaaattgaaggttgaggctaccgggtggcctcaggatgttaaaactgaagaagaaaaaatagaatttgtgaaaacatatagagaaacatatgaaattgaattggacccaaacaatatgaattttaatcctggattaagacatattgccaaattagcattaaactcattatggtaagaaaaaataaaaataataataaaaaattattttagggggaagtttagtatgcggaataagttatgttcaacaaaaatgattagcaaaccatcagaattttttgaattaattaatgattacactattgaaatgggtaaaccgatcagatttaacgacaacactttacgggtcatattttgcaaaaaggacgagtatgttaaggagcataaatgctcaaacattatgatttcgatatggtaattatgtgaagttttatcacaactaaataataatttaggactaccgcacaagcgaggcttaaactttactcatacatggaaaaaataaa

SEQ ID NO: 53462 - DNA, 424 bp, Heterodera glycines
  Genomic contig location: Contig_ID=SeqID_22762; Location=328..751; Strand=-
  SCN-specific regions: Sequence locations=1-237,259-424
atgaacgtgcaattcgctgctgtgctgatgcgggcaattgttttgctggtttgtgtgttgttgccaaaaatttgtgaagcgagtcccaagaaagaaaagcactacaatgttcccaaagaccagttcgctagcagtgtccagttcttaaccggaactgatacaaccaggagcaacacaaattttcaagacagatcaactcttttaaagccgacattagattgggctaatagttcatcctttaaatcatggctcatgccagttgaacaagcaggtggctcagcatcatcagcaacatcaccatcagactacttccagccccatgaaatagcaaactcatccattggcaatcaaattaatggcatggaaaaacgcttgttcatgccacccaaatggcttgaggatgctaacaataagaaaaagagtg

SEQ ID NO: 53463 - DNA, 440 bp, Heterodera glycines
  Genomic contig location: Contig_ID=SeqID_22763; Location=561..1000; Strand=+
  SCN-specific regions: Sequence locations=1-91,113-440
atgtcggaggagatttgtgcgaccatttctgaggtgttcagggccgattttcaactgcaaatttctgcccatgggacgaattcaattgctcttttggttaacaaaaaggctgcttccgtgccggcggcacttctcgcaacttttttggcactgaatataacggtgagcgggaaaaacattttcaagttacacgtttttattatttctgttttaaggaaaatgaagcgaatataactgagaagaaaaatcagaggcaaataggaggaaaatggaaatcgaaacgatcgaaaaaggcaattttatggacaaaaaaagagtaaacaacaaatgattttcagtacgacaagcaaatcggaaagattgatgcggaactgaaagaagcgattgagaccgaagcgaagtcgacgaaaacgcaattggtaaaaagacgagacgattga

SEQ ID NO: 53464 - DNA, 818 bp, Heterodera glycines
  Genomic contig location: Contig_ID=SeqID_22765; Location=119..936; Strand=+
  SCN-specific regions: Sequence locations=1-192,216-358,380-818
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaa

SEQ ID NO: 53465 - DNA, 859 bp, Heterodera glycines
  Genomic contig location: Contig_ID=SeqID_22769; Location=30..888; Strand=-
  SCN-specific regions: Sequence locations=1-112,135-201,225-322,345 -501,524-591,614-711,734-859
cattcaatcactgggactcaacccaccaacattccaatcgccgggactcaacccaccagtatttcaatcactgggactcaacccaccagtatttcaatcactgggactcaacccaccagcattccaatcactgggactcaattatcagactttccaatcgctgggactcaatccaccaacatttcaatcactgggactcaatccaccagcattccaatcactgggactcaatccaccagcattcaagtcactgggactcaacccaccaacattccaatcgcctggactcaacccaccagtatttcaatcactgggactcaacccaccagcattccaatcactgggactcaacccaccaacatttcaatcactgggactcaatccaccaacattccaatcaacgggactcaatccaccagcattcaatcactgggactcaacccaccaacattccaatcgccgggactcaacccaccagtatttcaatcactgggactcaacccaccagcattccaatcactgggactcaacccaccagcatttcaatcactgggactcaatccaccaacatttcaatcaccgggactcaacccaccagcattccaatcactgggactcaacccaccacattccaatcactgggactcaacccaccagcattccaatcacttggactcaacccaccaacatttcaatcgcctgggactcaacccaccagcattccaatcactgggactcaacccaccagcatttcaatcactgggactcaatccaccaacatttcaatcactgggactcaatccaccaacatttcaatcactgggactcaacccaacagcattccaatcactgggactaa

SEQ ID NO: 53466 - DNA, 1969 bp, Heterodera glycines
  Genomic contig location: Contig_ID=SeqID_4173; Location=669..2637; Strand=+
  SCN-specific regions: Sequence locations=1-290,312-410,467-627,670 -696,719-851,877-947,985-1271,1341-1343,1365-1579,1609-1627,1682 -1923,1945-1969
atggtcacctgccggatgggaagaatgttcgctatgccattgatgacaacgaattccccaacttttcatggcgaggctttgtcgtgttctccacaattcaggagggtcagtcatcattcagtttttgggatggatgaggatttaatgccaatgccaaacttggcattttgtaaaagatttcttcaaataaaaaacagggacaatgtctgtcaaggtaatgcaaatggcactaaatgatgccctaagcaatctgatcgcaattctttcattgattaattcgatttgtggtaattaaattgtccaatagattatgaatgatcaatgaaaattctgatgatttcgcaaaaaattttaaaaaaaaaagtccaaaaatttattcgtattgtcggcgcgtggtagggggagggcgctaatttagtattattttttcaaaacaaaaaaataattatttaaatttttattttttgaaaatcattttttgcagagattgtgctggacctgaacatccacaaatcgtcggtgtacaaactgttggcacactatcgcaacccgaccgaagtcaacgtggaattggaggtcaagctggtcccggtgcagacccaaacgccaggtcagttaataatgttgaatattatttaaaaattttttataattttcaaaaattttattggttcagatcttatataggaaaattctatattttaaatttaaatgttttcaaaaaaatatgactcgaaaaatatttgccaggagagaaaaatttgtcaatttgtcaatttttgtattcttttcatttaaatattaatatcaatattgaaaaaaaaaactcagaacagttcatcgccaagggaaaagtatttcaattttcaaaatttcaactcacagatttaaaaaaaaatttcttttttttatgactcggaacaattcgccaagggaatatcaataacaataaaatttaaaattgaatttaattaattaaaattagcaaacactttgccaatggaataatgaaaaaacaactttcaaattttcagactccgaacagtttgccaaggccgtgttcgcgcccagcggtgggcacccgcaaaatgcgtttgtcgagaccaatcccgagcacacatttgtgctgagcccgggccgttggaatttgcatgtgcgctcaccgaagcggctgtacttggattatttggtgctgatcccggctgactattaccagggcgaggcgctgaccgaacgtatcattgaggtggggggtggcgtcaaatttatggaaaatttgaaaaaaaaaattttttttttttttgaaatttacactaaaattttgttaatacaatttttaaggtctgcattttttaacaatatttactgaaacataagccccggggggctcatattttcaatacacctgaaagggatcgcttatattaacagggcatgaggggtggggggggggttctaattaaatgggttttttcaataattacgataattatgttgtatgattatttttttcttctgattaccatgttatgaatttttttcaaaatttttttttactaaattccaatgctcaaatatgtaaaaaatacaaaattttattattaaaatgagtccttgactagtcaaattaattattattattattttttattctaattatttttgtttttgctttcattttaaattgtctattttcaaatttgtaagaaaaaaatactgaaatttgaaattctttaatgaatttttggtcaattaattcattttaatttccttgtaatcttttttaattgtcttttagccctgtcgtgccaatgaaacagaaaattgtgttgaactgttgtatccaccaatcccaattgcatccaaagtggatgcgatcacggatttggccaaatttgaggaggtggagccgggcacggagaatgtccagaacatcctgagccatgtatgaattaattaaactcaaata

SEQ ID NO: 53467 - DNA, 609 bp, Heterodera glycines
  Genomic contig location: Contig_ID=SeqID_4173; Location=5083..5691; Strand=-
  SCN-specific regions: Sequence locations=1-99,121-204,226-609
  Gene Ontology: Mol. function=structural constituent of bone; Cellular component=collagen type III; Biological process=histogenesis and organogenesis
tgcttaaggcgttcccggaccgatcggaagacgagggaaaaatgggcgaccgggggcggatggaaagccggggccgaaggggcctcccggcgattatggcccagccggccccgcggggccaatcggaccgccaggccccccgggcacagatttgcacagctgggccaggggagttgaactaaacataagatggattgataacccatttttacatttagtattggtactaaaggcgtaaaaggaccgtctggtcctccggggtcgcccggagatgccggacagccgggaacgaacggcgaaccgggccaagacggagagtccggtccacccggacaagttgggttggtgaaaatcaaactgcaaaaacggcgaattaaatgtgattttcaattttgaagactccgaggcgacgatgggacgccaggcaaaccggggaatgtaagtgaaaagaaaataaataatttgaaatgtgacagttaattttgtcatagagctggattcatgcgtaactgacctgtctttctttagagcggctctcctggaaagccgtcgcccgatggcaattattgcccgtgcccgccccgttctgacgcggcaaaaagcggcgcc

SEQ ID NO: 53468 - DNA, 2405 bp, Heterodera glycines
  Genomic contig location: Contig_ID=SeqID_4174; Location=44..2448; Strand=-
  SCN-specific regions: Sequence locations=1-311,341-919,941-1119,1141 -1294,1327-1443,1465-1817,1853-1949,1972-2007,2029-2201,2223 -2373,2396-2405
  Gene Ontology: Mol. function=transmembrane receptor activity; Cellular component=plasma membrane; Biological process=N signaling pathway
ccgctcagaaagaacgcactttccaccgccgccgcttcatccccaactcggccgtccgcttccgttcccttctcaccgccgtctccttcagtcgcgcctaaaaatgtttgtgcccgaaggaatccgtgccgaaacggcggcgtttgtgtgtacgacgaattaaccgagaagtcaatttgcaaatgcgcagcaccatttaccaacgacttttgcacagagagaattggtcagaaataatcggaaaaatgccaaaattagaagagaaaaatgcaaatggaatataaaattaatgaataaatgtgccaattatcaaaataaatcaaaaaatttaattttaaatgccttttcctttcatatttcgacccgtgctccccaaatccgtgccaaaatggcgccacttgctcagccattgcgggcactcagcgcaccgaattcgattgcttttgcgctcgcggattcgcggggcggcactgcgaattcagtcagcgattttttacagaaaattttttgcaatattcctctggaaataaacaattgttgaatgaagggccatgtgaggacaatccgtgcaaaaatggtggcacttgccgcaccacgcgggcgcaatcgttgtttttctgcgcgtgtccgcccggatgggctggcaaaacttgcatggtcggaggaggtggtgaatttgcaaaaataaatatttcaataatgattgcttaatttgataaggcgttcctttgagtggagaaattttggagagcaatggcaaattattgcttttgcaaaatgccaatttgacacggcaactttcgagtgggaaagcagaatggattgaagagctgaagcgggtcactccaaaaatgccaaattcggaggaattcgtcggagaaggacgaccaaacgccggtgaaagtattcaaacgaaatgccaacataaaacaaaaaccatcttccacctctaatgcttcatttgcttttaagatgggcctggcaaaaatgccatttccaatgccccccgcggactcttctctcccgccgcaaggaacggcactcggactgcgctcggtgacttttcgcgcctctcttccccacattctccgggttccgttatcggacatcgtccggtcaccgcctccgttcttctcccccacgatcaaatcataggccacgaattgcccacccggaccctcaaagggacaacgccaaatgcggcgacgaatggcgttgaaatggccaaaaaatggacgggtggaaggggacgggacagctcagtcccgtggcaaattttggcaatttactgttcattaatattttattttatttcttatttataaactcaacaatctttgatcattcccatagtcaatatgtgtatttcgttatttttctttaataattcattcttttgcttttttaaatattatgtttcaattgtgcaaaatctgaattaaattgtgattaaagaacattaaatgagaaaaatgataaatatgctaatttcatctgaaattgatgaaattaaaagatgagtttcccattaaaagttagtcagctaattgtaaaggaaagaagccgctttctgggaaccggtaaggaaggcgatcaccgatcggtggaggagagcatatcgccaaaaccacacaatgagcagcaatccatttataagcatcgcgcaataggttcatcgaccggttttgcgccttggccaatgctaatttcccgtccattaagaggcggcggaccgcaaaaaggaataattactcccaaattccattaatccccttccactgccctgtttatctttttccgatcagtccgtcgttcatttttcacactgtccttatttttcttctctcttttcaaatgtccgcttccgtggccccaaaattcggcctttcggacgaggaagtcaaaattcatcaacttatcgcaacaatacgacgcaaaaatgttccaattatttttgttggtttcttctgttctgtcactctctttgttgcattgaccgtttcgctatttttatactccgaaatttgtcaaatggacgaagaattgaaattgggggcggaagaattcaaagtaaaagagaatggtacaaaaacaaaaggaataattgctaaataaaggatttgactgatcgctcttggcattttttgttcttcagcgacgcgcaaagcgaaggcggcgaaagagtcgccaaaagaagcgcctatttcccttcgctttcatttcccgcgcaaaaatgtcgtaaggaataattgttaaagggataaatagttcttacgagatttgttaaactttgacagaatgtgccccgagtgttcagaattgtccgtccggacccccgggggttccgggcgaagagggcgagcccggaggtggccaagaaaatgcttgcccagaaatattgcaat

SEQ ID NO: 53469 - DNA, 400 bp, Heterodera glycines
  Genomic contig location: Contig_ID=SeqID_4175; Location=244..643; Strand=+
  SCN-specific regions: Sequence locations=1-9,33-48,70-75,127-400
atgaaacaattccttctcctttcccttcttttgtgctgtctgttttttgctgttttctctctttcttttagtaatttatttatttaattgattaattaattagttaattattaattataattaatttttagattttttactaatttttattttttcagatgatcaagtcgaacttccgaccttttgcagtgggccaaacaaagaaaacgcgcgggtgctcagctgttgcgaggcggtgaaggcattcgaaggttcggaaatgtccgagtcgggcggagcggcgccgcccgaattgaaagagtgcgttcagtgcggcacggaattgtgtccgcgcgagtgaaaagagcacgaaaattgggcaaaagcggaaaaagcggacggataagaaagcaatttgtta

SEQ ID NO: 53470 - DNA, 426 bp, Heterodera glycines
  Genomic contig location: Contig_ID=SeqID_22774; Location=32..457; Strand=+
  SCN-specific regions: Sequence locations=1-115,137-426
  Gene Ontology: Cellular component=chromatin; Biological process =establishment and/or maintenance of chromatin architecture
atgccacttggactgcccgactcacgcgcacgcgaaagtggcgaaacacaattcgactcacgccttttcaaccaaaccggggtgggtggactcgagaaatgatttggtgcaccgtttgcctttaaaattgcttttcacagggtctcgacagcggcggcatcgatgacgaaacgtacgccgcctacgataagccatggcgtccccaggatggcattcagcagcacatctaccgaccccgtaaatccatttttgttcacgatgggaatcatccgttctctctcgaattcaggaaaggacattgacagcagcatttatggcgccgatttggatcgaattatcagcaccaatcggtttgtgcctgacaaaggcttttccggagcggatggagccggcaaggagggtggacaacgaagcggaccggttcag

SEQ ID NO: 53471 - DNA, 1280 bp, Heterodera glycines
  Genomic contig location: Contig_ID=SeqID_22775; Location=219..1498; Strand=+
  SCN-specific regions: Sequence locations=1-440,462-941,976-1043,1067 -1280
atggccctgaagatccacgcaaccgggttcccgtcgtggtgcgagagcgaagagcagaagagtgaatacattgaggagtgctggatgaaatttgcaattaaactcgacaaagaaaagatgaaagctgaaccggggaagcggtacatcgccaagctctgcctcaactcactttggggccgcttctccatgaggaatctactttcgaaggcggtaatcaacaatgacccttgtgttctccgccaatacaccgacgacaagaaaattgatattatggacattgagctgatggatgaggacaacgacgtattcatgctcacctacaagccgaaagaggagtttgtcgacgaaaataaatactccaatgtcgtcatctcactctacacaacatcaatggcgcgtctatacctttacgaagtgttaaaaaaagtggccgacactcccggatgtgaaattctctactttgacacggacagcatcatctacgttcaccccgaggaaaacgacccactcccgacaggaaagggacatctcggtgagctgactgacgaaaagccggaccacaacattttggagttcatcagcgctggctgcaaaaactacgggctgaagttggaacgtaaggacaatggggaaattgagtacgacttgaaaataagagggataacactggatgaacaaactgtgcaaactatccattatgacagtgtgaaagatcaaattatgcgttatggttccgatgaccccgcggaccctattattgtaacatatccccattttattcgtcccaaccttatccaaggcaaagtgtacactcaatctctaactaagcattatcaacctgtcttcacaaaaggtattattaatgattcattccaagtcctcgaatttggttatcgcaaatgataagtatgcattctcaattaaattttctaaatattagttttcttatggttcccttcttttctttctctctgtttatatcactcatgtgggacggaatgacccctggttgatcctctccaacactccaggccatccatctgagatgaaggtggacgagctgttcattattgtaatgcacagcctggtgcgtgagtgtttggattggggaccgaagggtgaagccgttccctgggtgtgtttgctcacttttttcaaagggaactctaagaattctgatatgtcttcaaatctatcaaaagagttgcatactttctttttataatttcctttattctctattttacacttgtatttttcatttgaatgtttattcagaa

SEQ ID NO: 53472 - DNA, 677 bp, Heterodera glycines
  Genomic contig location: Contig_ID=SeqID_22776; Location=166..842; Strand=-
  SCN-specific regions: Sequence locations=1-105,157-292,318-361,388 -447,476-677
atgccaccaccagcgaacacctcggctttaccaacaaattattcgcaaaagagaaatgagttcgatgcattccaaaaggtgccaacatcggagacgtgtcggaagtaaaaaattttaattaaaacgttaaaaatattttgacttttaaattattttgcggttttattagtttttgcttggggatacaatttagggttttacctattttctgagctcttctcagctgcctagtgcctgttttatgagtttatattttcaaaaatacacccctaaaatgaaaaaattttccgataaattgtctcaaatttatttattttcgtcattgaagaatttttgattttaatattggtttggcctaatgttgttacaattttttaaaaaatttgtcattttaggccccaagcctaccaatttcatttattaaaaaaattccaattttggttgaacatattttaaattttcataaaaattttttcccattaatgttaatgtgttttaattgcatttttttcacatcagttcgtatgaattggttgcctgtttcaaaagcaaacggcccccattggtactcaacaaagcgatttcacaaatctgcaaaagacacctcggcaatgagccaaattcggctggatttcgaattcgccattgcgtgcgtcgggatgccagagcccaactga

SEQ ID NO: 53473 - DNA, 1394 bp, Heterodera glycines
  Genomic contig location: Contig_ID=SeqID_22777; Location=402..1795; Strand=+
  SCN-specific regions: Sequence locations=1-148,170-204,284-418,440 -522,571-586,608-663,695-730,809-829,852-927,949-1055,1077-1092,1114 -1135,1157-1188,1210-1225,1247-1294,1316-1340,1363-1394
atgagggtttttgtacatatttccatggtgcgacttttgggatttgcaacttggggacccgacatttggggatccgacacttatggaatccgacatttggagacttcatttacgacatgtgtgtggagttttaatttcttcggatttatgttatttaatatttaaatgtagactgaattatatatacatcattatcatcttctgtatataaagtttttttaatagataaatttagttaaattttaaaaatttaacacattttttaattatttatctaattattccatttatcatggaaaattgctatatattaaatatttaaacacaaaatgacctcaaatattttaacgcacttgctttgttagttatcggaaaaataataccaaatgaaaattattttcatgtacacactttttttagttgtttttattaaacatttaattcaagtattttatattattgtcatatgcgtaaattacaagtattttacatttaagcgattttttcctcacttgggttttcatatttttactaaattcaaattaatttaaattttacattatatatttagaattttgttatgcatagctcaaatttttacatatcatattaattatgattgtttgttgatgttcataggatgcgaaaacaaatgatattctcatttttttaaatagtaaatttttatatttttctcaaaatgacagaatgttgttcttatatttcattcattaaaatttattttttagatgaattttttcatttatttgttaataattttttttaattttgcttaaattttttaattctttgccttatatattatttatatacaatgtgaatgtttcaattaaattgactcgacgcctttcaattcttctatttttagtgagaaaatattttaaaaagctcatttaatttagggcatttgtaattttcttgtaaaattttcttttggctaattttctaaattttcaagaaaactattaaacttgcattttggctattgagtgcattaatttggtcttggagaggtcatagaaaagattttttcgtttaaattgtcttttttattgtataaatattacagattattgttttatttacatattcttataaaaaagttagttgcttttaaacttttacattgcaaatattttgtattgaatatatttaaattgttataatgtcttctttaataataataatccagaaaatagcagactatatgtgatttcatttaattatgtcatgtttttattacgacattgagactttgtccctttaatttgacatttcattaataattctttttagcatattttttcaaactttaatcgtttaaatactttatttatctttttggctatgtaatagctatattcaaaaaatca

SEQ ID NO: 53474 - DNA, 1029 bp, Heterodera glycines
  Genomic contig location: Contig_ID=SeqID_22779; Location=688..1716; Strand=+
  SCN-specific regions: Sequence locations=1-71,94-183,206-766,793 -797,820-1029
  Gene Ontology: Mol. function=profilin binding; Cellular component =cytosol; Biological process=cell growth and/or maintenance
atgcccacaaatgagcaggaaattcttgatgcttttgaagcagttttggtaaatcccatgaaattattttaattttcctaaattttattgttgcaggcgaaaaaggatttgccgcctgacaaaatgcgaattttgagggactgtgatctgaagaaaaaatgggatttggtgtgtgatgagcaccaatttacacacaatcagtgcatcacagaaccccacgtttacctcaaccaattgatggccataatggacaagaaaaagtcgacgaaaaaggtgcgttttaataggaaaacaatactttcattaatttatcactattaggagcacttgtatacttttattggcgtgactttttcttaaaatgaattttttttttaaattttctatgttacacttattttatgctaacatccatttacatgaaattttgccattagcgattaacggaagaagggactcaaaataaaatgataaaacatgccattgtttatagaccagtgatagattataaagtccatttgaaactgcgcagtcacagattacacggcaatctttttgattttcacctaaaattcattaactcacgttaaaggatgctagcttaaaataaaagtcagattccttttcagcgcttaaaatatcacaaaaaaaaattcttgaggtgtgcacaaaaggacaattaccgacttttttaatggatcatttggtttaaaaaattttcattaattttttcacaaattttttttttccatctgaccccatgtacaaatatatataatttatttatatattctaactgtttttatttagaaaaagaagattttggccggtgattcgcccacccaaattctaaaacatttggaaatttcgttgaggaccaattccattgaatgggttcgatcatttttgtcgccacaaaacaatggtcagtctcacaatcagtcattgttgttgtgccaacaaatttttccttttaggactccaagttgtggtggaatatctcagccttctgcagcaatcattgagtaa

SEQ ID NO: 53475 - DNA, 358 bp, Heterodera glycines
  Genomic contig location: Contig_ID=SeqID_22780; Location=1342..1699; Strand=+
  SCN-specific regions: Sequence locations=1-170,192-194,233-358
atgaagaagtcatatagatcttacaatttgaaaagcccgaatcaggatcaaaaatttggaaatcggtaagtcaaatttcccagcactaattattcattcgataaatgcttatgaacattatatcttttccgaaaaaatattagaattttcataaaaaaaattctgacagcattcttatggttatctatgttttaaaagagagagaatacagaaaaataatagatatttatttgttttcagaaagcttttaactctccaaaaatccgccacaaatcaatgggtaaccgaaaaaatgaaaattactttaaaagctttaaaaatttttattttgacattcttaccatttctaattttgtaa

SEQ ID NO: 53476 - DNA, 156 bp, Heterodera glycines
  Genomic contig location: Contig_ID=SeqID_22780; Location=173..328; Strand=-
  SCN-specific regions: Sequence locations=1-156
atggccacccttctcgaatatccggcttctgttgtggagcaaatttcggtgaagctgtcagcgccaaacttgaacaccatcgcaatggcatacccaaaagttgaagtgccaaaatattcgcgtgccactctttcggccggcattgtccattttggc

SEQ ID NO: 53477 - DNA, 657 bp, Heterodera glycines
  Genomic contig location: Contig_ID=SeqID_22781; Location=254..910; Strand=+
  SCN-specific regions: Sequence locations=1-314,345-534,572-657
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 53478 - DNA, 1220 bp, Heterodera glycines
  Genomic contig location: Contig_ID=SeqID_22783; Location=181..1400; Strand=-
  SCN-specific regions: Sequence locations=1-242,264-493,515-616,640 -706,728-918,941-967,989-1220
atgacccaacctcaaaaagcattgactgagcccagcgccaatgaatcaaatattccggagaaagttccaaaggccgaggtttggtaaaaattttagaaaaccgccaaaacgcattttaatccgttttttcaattttcagcctcacagtgagaagaatgagttgtcctcctcgaaattcgaagcgttgtgtgagccgccgactccagaccaggtgtttatttattttgtcacaaaatttagtgttttatttttaagattttgtacggaaaaatgaaggcgcgggcgcgtggctttcagctgacaacgaaacccaacaatttgggcgagtgggaacgaacgtgggaacggtggcgcaacgacaacacacattggagtaagaaacagtttcattttttggaaagcgcaacagaattctaactcgggagtggaatcgtttttatgacatccatttcgacaaacttcgaacccggatctgaattcgaacaaaaagtcggactcaaaaaatgtaaaatttgaaggtttgaattaacgtttcgaattcggtatacgaggttcgaaatggatgtttaatcaataatcccgaaacatccgaaatatttttattcatgtaagtaccttttttggcattttaaaatgtataaaattgggcctgttgtaaaactagaaaagtaccaaaaaaacattttgtccatgtttaaatggtattcaatgttgaactgtaggatgaaataaatggcttatatttaacctaaaaattaaattgcaggaaaaaaaattgaaaagcggcccaaaattttttgccctacgccgttgcagcgtaaggcgcttgtctggacgggagtttacgaagcggtagaacaagtcccggcacatgtgtcgtatgtttttttagtttaaaatatctctttaattgtcgtctttttaatttaaaattttatcatacctatttcaaaaaattgcaaaaaaataaagtttttgttttgtggtgccaatggtattgtaatttcagaatgcacactgtgaagaggtccgttatgcgaaaagtgcgtttttcggttggcactgtcctcgcctgtacgttaatcacttggtcactgttcgcccattgggcgccgccttaattcattttttgttgactaagaaagagatctttcattagattttttgtgtattgttttttggttttttgtcgtcattaaataggtatttgttacaataaa

SEQ ID NO: 53479 - DNA, 299 bp, Heterodera glycines
  Genomic contig location: Contig_ID=SeqID_4176; Location=855..1153; Strand=+
  SCN-specific regions: Sequence locations=1-32,100-158,188-299
atgggtccagcagtaagtacggtaaatgtcgcgcagcagagacagtgacgcggtgcgacggcggcgaccgctgcggcgatggcggcggtagtggcgccgtttgctgccaccgtcgtcacttcggcacatttgtcgccgttctgtctctattttttcgctaaaattaattattttaaaaattaaaaatgtataggccgccaaggttgaaaaggctccggataatccgtctgtagacaatccgtcagtgatgaacaatccgtcaacccttcagcaaattttgtatttaaaataattgaaaa

SEQ ID NO: 53480 - DNA, 66 bp, Heterodera glycines
  Genomic contig location: Contig_ID=SeqID_4177; Location=3289..3354; Strand=+
  SCN-specific regions: Sequence locations=1-66
atgggtgaatttcgtgtgaaatttcgtcaattggaggcggacattgaggaactgaaaggcaaaaat

SEQ ID NO: 53481 - DNA, 204 bp, Heterodera glycines
  Genomic contig location: Contig_ID=SeqID_4178; Location=202..405; Strand=-
  SCN-specific regions: Sequence locations=1-204
atgagaggaaatgaagcggtggtacgtctgctcctttttccccaatcgttcgccattcttcgtcagaatgatctctttgctggtcaaattcagtccacatccgatgacgtcaccggcatcgaatttggccaagttttgcttggtgctgcctacaattctgtggccacgtacattgccatcgttgaagtaggcaaaagtgccggg

SEQ ID NO: 53482 - DNA, 685 bp, Heterodera glycines
  Genomic contig location: Contig_ID=SeqID_4178; Location=1..685; Strand=+
  SCN-specific regions: Sequence locations=1-48,80-429,476-685
tgaaattgtttactacgaagtgaaaatcttttcagcggagcaaaaggattttgatgggttttatttctttttaattgcaattccttttgagaattttccaattttattacttcaaaacaaaatttaagaacccaaaatgactcaattggcattggctttgcacccaagtcgatgccattaggcaccaaggttggcacgcaccccggcacttttgcctacttcaacgatggcaatgtacgtggccacagaattgtaggcagcaccaagcaaaacttggccaaattcgatgccggtgacgtcatcggatgtggactgaatttgaccagcaaagagatcattctgacgaagaatggcgaacgattggggaaaaaggagcagacgtaccaccgcttcatttcctctcattacggcagcgaattgtttggtgggaaaataaataaattaattaaaaatcgaaaaataaaatactaattatcccccccctcatcccttctcacaatcagataccaatttcttcttcgcatcaaaagacgccgacgatttatatccggcaatttccttgaacaaccccggagacgaagtggaggccaattttggaccgaacttcaaatacacacttaattaaatgacatatccctttttccgatttatttatttgtacttgaaaaattatttgttaaacagt

SEQ ID NO: 53483 - DNA, 1855 bp, Heterodera glycines
  Genomic contig location: Contig_ID=SeqID_4178; Location=1520..3374; Strand=+
  SCN-specific regions: Sequence locations=1-4,74-520,542-996,1018 -1033,1055-1069,1095-1175,1284-1316,1357-1465,1503-1515,1558 -1657,1680-1699,1734-1734,1761-1855
atgggcagcagcagcagcagtagtagcagtagtagttcaaactataccagcagtagcagcagcagcagccgcaccaccatcaaaatcaactttatggacttttcatcgaatgacaacggcagcagttctggctttatcgaggagggttactgttcatgtccttggtcgcatcttcgttccatcagcattactctggtaagtagcagtttacttaatacggtttttcgaggttctgaccatcacttcctttcctaattgcctgtatttcatatgttaatctgtttttataataagtcgtgatattccatgtttcagttagagtatcattttgctggcagtgacaacagcagaagcccaattgaaacagcaattggcattggctcttctttgcttagttccattgttccccttatcgatgatgaggacaaagaattgaaaacaattggaaaacttttgggaattccttcagtaatttgtggtaaagtttcgaaaggtaaaaagcccgtgtaaaaactgtatgaaaaaataaatttctctttttgaacagtgtctgaaggttcgacttgttgggccgtggtggtggagtacaaatgcgacgggtgtggccgagttgtgcacgtcacttatggcatcacccctcaaggaaagtttaagcgttttggacggatgaccaacacagaaaattcgaccgtctggatggtgagcagcgcttatccggacatagagcgtgtttatgacgacatgcattcgaactacaatttcggcaccaccagggcttgggcggaggaaatgattcgccgtgttcttaatcagtgacgggggaataattgtcgaatttcgaagcatcccagctcattatgatcatgttaaagtggtcattgtcattctgatatattatcgaatttatgcttttgttcttttttataaagaatgttcgttttctgagaatgcattcaaattataaaatatttttgctgaaacattaaactaacattaaaatttatggtatttttcttttaaatcattgctgatagttgttcattatgttgaattaaatctttctataatgcaaaattattaaacttttaaatgaaaattgggcaattttatatgacagctatttaaattaatccattaatcacagtacttaagtataaactaattagaattgaatcaaattatttataaatatattttgaaatatcattaatatattttttacgaaataagaagataataccaataatttaattaatttataaataataagtttatttattatagtaatgactaaaaaacgaataaatttttacaacaaaaaacatttaaaatgggaaactgatttatttcaataaactcattaacggatttttagaaataaacattatctaatagtgtcagtttgttataattagggaacggattttaatcatgaatttgacaattttatacaaaattttaagcaaaaactgaacagctgcaaaaaatttcaaaaattttctcgaaaacatttgcaattaataaaattatattattttaaatttatttcatttatttgaagaaacccatgccttttgcattgattgccttgggaaatatacaaatgcggcacatgaaacgatgccattcgcacacagtgcgcttggtctgaaatgtatggcgaagaaatgtgaaaatccaattccatggcgtaaggatataatttaattaaatttaatttattgatttaatttcataaattaaagaagaaataaaaaattggctcccgaaagaactcaagtcaataggagctttggaaaattattgtgcagaattaagtgtggaaatggctggtcttagctatttggaacggtaa

SEQ ID NO: 53484 - DNA, 912 bp, Heterodera glycines
  Genomic contig location: Contig_ID=SeqID_22785; Location=1..912; Strand=+
  SCN-specific regions: Sequence locations=1-118,140-147,169-232,254 -306,333-436,484-628,690-802,824-912
atgcttttataccaagtttttcaatgcaaaataatcgataaattaaccagaaagtacatagtttttcatgaaaggacctggttttttgtaaaaacctaggctcaggtttaaaatatataaaaaattcagtggccttcaagaacaacaattactacaaaatgttgacaaaactgaggaagttgtaccaaaagcagccgtggaaattgatcaaaattcgcagcaaaatgtggtaatattttatatgagaatttttatgaatttctctcgttacatgactggactgcaaatatttgaacacgatacaaatccttttttgggtggttttttggaataaatccatttctgtaaatttgaggttttagtctatatttggaatttttgcaaaattttataaaatagaaaaaagcgaaaagatttttagtgtaaaaaagattacaaatttatttaaaattatggtaataaaataaattttcattaaataaagccacaacggcccaactattcgcgtgatcaactgaagaaattggaatgtgtgtttgaagggaaaaattacatttcatcaaacgaaagtgaacaattggccaaggaaattggccttacgaaagagcaaatcgaagtaattgggggcaattaaatgtttataatatttaaaattttctattttattttaatataaatttaattatttagaaatggtttaaaaatcgtcgagcaaaacaaagagcacaaaaacgtgtggaagaagtaatatccgaaacaattaaatcttaaaatatttcctaaataattttgaatttcaaaaagtttgctgctgttgctggtgccaaagtttgtgctcaaattggccttacgcaaatacaagtcaaagtgagaatttgccaattaatatcgataatttcaagaggataaata

SEQ ID NO: 53485 - DNA, 1071 bp, Heterodera glycines
  Genomic contig location: Contig_ID=SeqID_22788; Location=328..1398; Strand=+
  SCN-specific regions: Sequence locations=1-198,225-229,253-435,465 -589,611-650,672-848,884-1071
atgagcaaaatttactttcactatttcaaattaacaattcgtaaattagtccgttcggtttggtgctgtaacatttcgacagtggctgatttcgacagagaataaaattattgtttttttattattaggcattcacacgaacaagccggaacccacagttttgccgaagcaaactgcctcagggtcaaactgacccgaaaagtcatttttatttaaaaaattcactatgtttaatgaaaattgatatatgtgtgtagtaaaaataaagcttttttttaacctttgttatctaatttgatgtcttcaaatgttccaaatggcaaagttaactaaaccagatacaataatattctaatgcccaattaaaattcaaatttaatttcattagtacagtaaacagtaatttttttaaaaataacatttcctttttatgcgaataataataataaaacaataattttattctctgtcgaaatcggtcactgtcgaaatcagccactgtcgaaaattcctggcacgttcggttttacacattttaaacttgaagtgccaattttgaccaattgtaacatgggggtcaaaaaatgagcttttccccactttggcacctatatttaacacaatgtctttgttaaaaaaagacaaatattttttctgaaacaaaatgcattcgatagaagaaagaaagggctaaaaattgatataaataaaatacccaataattgtcgtattttagagaaataatcccggagtactcatttttatcaatttggaggtccatattcaaaaatcaatagctgcacgaaatcccgatttccaacgtcagattcccgtaatttttgtgccatggaatttcggttttcctttccaaaaatttttggggtctcgaaatgctatccaattgaacacgagagcaagagttatatatggttcttcccctactatctgggaaaaaagtcggggaactggtatcaaattccccgaggattatctataaggctaaaaaaaaattttaaatgttgggggggtcaaaaacttggtcgtcaaatagaaaaaaatatttttctaaaa

SEQ ID NO: 53486 - DNA, 272 bp, Heterodera glycines
  Genomic contig location: Contig_ID=SeqID_22788; Location=1727..1998; Strand=-
  SCN-specific regions: Sequence locations=1-126,151-272
attttctaagaaaaaatagcagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaagggtgtaaaagtcgcttttcgcgccaaaaagcgaaatgcgaaacgccaaaaaatgcgaataatgcgaaaggcaaatgcgaaaagcgaaacctaggcacatccctg

SEQ ID NO: 53487 - DNA, 330 bp, Heterodera glycines
  Genomic contig location: Contig_ID=SeqID_22790; Location=106..435; Strand=-
  SCN-specific regions: Sequence locations=1-83,105-279,318-330
atggccaaagaatttgccaattatggggagaataggcacggggaaagcgaaggtcaaatggaaaagccaaaaagtgaaattgaaatggcaaaaacaaattcagacaatgaggcggagccaattgtgacgataatgaaagacggacgaatcgaagtggaagagacggaacggagggaaaagccaaagacgaagagaaacgcggggggaggggcgaagaagcggacgatgtcaccggacgcaatggacgcggccgattcgatgctcaaattggcatttacggaacagcaaaaagtgaaaaaacggaggggaaaggaaaagcaaaaaggataa

SEQ ID NO: 53488 - DNA, 128 bp, Heterodera glycines
  Genomic contig location: Contig_ID=SeqID_22790; Location=595..722; Strand=-
  SCN-specific regions: Sequence locations=1-128
ccccctcccccccaaaatgcccccctctgttcctcctcccttttcccctcttcgccccgtcgttcgaccccaaaaattcgtcgctgtcgttcgaccgttcccttcgctttttcgccctcgaacaaaaa

SEQ ID NO: 53489 - DNA, 742 bp, Heterodera glycines
  Genomic contig location: Contig_ID=SeqID_22791; Location=72..813; Strand=-
  SCN-specific regions: Sequence locations=1-220,250-742
atggcgaagggaacaccgcggaggaatggtaaaaaacaaaaaataaaattacgatttttgatttaaaaagaaaaagagaaatgcttaacatttggtaaaatggaaaaagagagaagggaattggcaaatgttaagcattcaccgaatcattctttgcttctttttttaaaaatattatcagttaaatattttttgattctttttttgttttcacaattcgattttaaatgatttaataatttttattttggggggagcgcgaggcgaacgaccaaaatttggaggaaaacgaaaaggaaaaagaaagggcggcggacgacggaggcgaaaaaggggcaaaaccgtacaaaaaagattgtgacaaatattgcgtaccatgcaacagggaattgagcagcagacattactacgaattgcatatgctaaaggtggcgaggaaaagggaaaaaaatggaaaaaaagaaaatccgaaatttaatttaagggggataaagcatttgggaaaacggatttgggatccttttcttttgctcagattcacaacatttttgtgggcgattcgaaggcgctttacgaacttttggagtcatttgggccgaaacgcgagaagaaaatcatttaccggtgaatttgtcgaaaaaaacaaaaaaaaaaaaaacattttgccatttttctttttcagttgcgacgaatgttttggaggcgaattggactacgaattgttggaggtaaagaaaataaa

SEQ ID NO: 53490 - DNA, 804 bp, Heterodera glycines
  Genomic contig location: Contig_ID=SeqID_22793; Location=13..816; Strand=-
  SCN-specific regions: Sequence locations=1-378,403-463,489-583,621 -672,720-804
atggacatgttccggttcaacgttcataacgctgtcaaagacaccgacgacgccgccgccgactctgctgcacacgatcaatgtcaacaacgccaacagcgcgaggttgcgtctcctcgcacaatgccgttgtcgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctatttagtgagattgaaccgacgcagcagcagcagcagcagaaaaaacaacaggtttgctctaaattggtgtcggttatttaattttttatcaagaagattcaggggcgtacagcggaaatcatcgcaccgaaagtggagctgtccgtcgaggacaatggtgatgatgatgatgatgatgaggctggacaacaggtcaaacaggaggcggacaggaacggcatggatgcacatcattcaaattgtgcaaaagggccccttttgttcattgatgaacaggagaatgaggaggaggagagtgaggaagatgaggacatttcaacaacgcatcgaaggcaaggcatggactcatcatttgactacgaagacgacgacgatgatgatgacaatgacgatgatgatgatgatgatgaaatggaatcagtcagcggatgtgcggaatcggacaaatgtggtcactgtcaccacccgcatcagctaccacgaaatgctttggag

SEQ ID NO: 53491 - DNA, 1198 bp, Heterodera glycines
  Genomic contig location: Contig_ID=SeqID_22794; Location=580..1777; Strand=+
  SCN-specific regions: Sequence locations=1-215,241-343,365-573,596 -1198
atgcttaaattatcctttccatttttgcctataattatgatggattttgcgatcggacgcatagcattaaacgacaagtgccaaaaaggtgtggacacatttttaaaaattttcatcatctatcaaaaggtttttaagacttttttgcaacggctgatcaattgcaagaaatggcatcggaaatttttgcagcggcggacaaacaaacggaaaatggaaaattttttgaaaagggatttgacattttctgttgtattgcatttgaaattgaaaaagatgctttaaacaaagatgagttggcaatgattgaagattttgaagcaaagcaacgcaatttttgccaccaaatgaaaaagggccaaaatatttgggaagcgatggaaagtccggcagggaatgccattgtaacagcggcgaagaatttgaaagtgaaccctcaaacatacgaagaaggactccgtaaattgaagaaaatgcaaatttgagccctgaaaatcaaaaagaaattgaaacatttgccaaacattgctttgccgcgttgaaattgtttcaacaattcatcaccggtatttgtttatataaaataattaaatttcagttaggagcaaaatattcatcaaaattgcaaaaaacgcttattctgggctctattgcactttatgaatataaagttacaaaagaaattactcaacaattacttaattaatctaatcttttttggcaattgcctaacgctgatattttatatatttttgcttcttaagacttttactttcgaatgatactaaaaagataggggtttgttcgaataggacattacggtggataatcgatcatatgatgttagaccgcggcaaaagtatgcattcaaaactgctaaaaagtagaatcagaatcccgcggcgttaaaaccgttttcccaaaacctagggattgaccgggatcggtaatccggttgagattgagtgttttatacaacaacaaattaagatgagcgattggctcagactttgctcgctggtggaggacagactgtgtctgatcaaagttcagccttatcagctcaaccggcgcccactcgatctgatcagctgccgaaggggaaatctcacggcgaaggaaaaggtcgagtaaatggccaaaatgccttggtgcttttgcattggccggcttttccggctatgtgtgcagtatattt

SEQ ID NO: 53492 - DNA, 1209 bp, Heterodera glycines
  Genomic contig location: Contig_ID=SeqID_4179; Location=475..1683; Strand=-
  SCN-specific regions: Sequence locations=1-32,56-459,482-644,680 -691,716-716,914-1209
  Gene Ontology: Mol. function=hedgehog receptor activity; Cellular component=integral to plasma membrane; Biological process=positive regulation of growth rate
gaaaatgcgcgccgtttgtgcctaactttgtgatcagcttcacctttttggcactgttctgcatctgttgctcattcacttttttgcccgccactgatggcacatcgtcacggcacgcatttgccatcgattggattcgctcaaagccatacgtcgcatgtgccggtgtgtttcacagtgtttgtacagaaataaatatgccatatccgttaattttttttagtggaaaaatggccaaaaaattttgtgccggttttttgccgtgtttttgaaaatttttaccgattttttcccagctgtttttgaactcatgcaccgagtttttgaccatcgcatccctgatcgatgctttaccgctttaaataaaccaactaatcaataaatgatcgctcgctgatcactcaaaaaataaattgatcaattattatttaggtttgttcaacaccattttggcactgatctcttcttttggcttcttgttgttgctcggcattccgtacaatgtgatcaacacaatcatccctttcttggtacatagaccaatcatttcatgagaatggactcggcaataaaaccgaaataaaaagcctttttttggccaaaaaatttcgagaaaacatgcaattaggccagatcaaaccaacataataataataataattatgaaaaacattttaatcttgccaacttaaaatggaatttttaagccatttttcataaaaaaaactaaaatttaaaaaaataaataattttcgtaaattttaatttaaaatattttttacataaacttaaaaaataataataaatttattctttttttaattcttttaattataatttcttattttttcacaaaatttttttagaaaaaattttctagattaaaaataaataaatgttctaaaatttatatctgctatgatgtaatcggacaaaatctccttttcctgctgatcagatcatcgctgtcggcattgacgacatgttcgtgatgaactcgtgctgggaccagtccgatccggcactttcgcctgatcagcgcatggcacaaatgatgcaaaacggcggtgtggcggtgtcgatcaccaacatcaccgacattttggcatttctgatcggctgcgtcaccgaattgccgggcatcgaactgttttgtctgtacgcatttgcggccgtgttgttctgttatgtgtatcaggcaagtttttt

SEQ ID NO: 53493 - DNA, 2731 bp, Heterodera glycines
  Genomic contig location: Contig_ID=SeqID_4180; Location=506..3236; Strand=-
  SCN-specific regions: Sequence locations=1-376,398-414,463-525,548 -1088,1127-1161,1206-1279,1301-1331,1354-1387,1426-1461,1512 -1999,2021-2029,2051-2230,2252-2354,2376-2402,2424-2484,2521-2684
atggacgacccgggtaagtctatgtaattgccctttatgttctgctgataattttggctgctgattagcgtgattgatcaggctgaccaaaaaattataaattttcgtctgatgtaaccgtttagcttgtacatcaaaacccaaatttaataaataccccgatactgatcaatcccgatgaatttaaaaaagtttcgggatggatcccgagtgtcgggattccgagaaattcccgcgggatcccgaacatgtccggtctctagttcgaagcaacgatttttatgctcaccaagtcagtgatcagatcaggcaattgttgatcaaatctgattgcatcagatttgatcatttacagaatttgaaataaaatcacacctaatttaaaattagtggcaaggtgcagccaatagattcataattttttattctaacatttttttttaattacttaattaataatttgtcccaattaactctttgatccgcaatataattttcttaccattttttcagcctatgttttcactcctcgggatgccaggtgattttcatatcattttgaattttggcattcaaatttaaaaccttggcactttgttcagatggaaaaaggaattgggcactttctcaaagctttggccgctggaggagaacaaattcatccccggaaagtcatttgagatgaagcgttttgtgaatgttttgtgcaaagccaaggacggtgagtcattgttttaagaagaaggcaatttccaaggacacttaacgataaggacagaatttcatggttttgggggctctattcccaaggacgccatacgaattaatttttatagaaaatccaaggacggttcaaccaaatttcaagtgacacataataaggactttttcaaaatgccaaactttcatccgtaatgatcagatctgttcttaattttttaaggattcaaatttgattaaatttattgatcaagctaagcatttcaaaaatttgatcggaatgatcaaattaaagatatttaaaagtttttgtttaaaagttcaaccaggaattaattaaaaactgaccaaaattttagaatttttcgtataaaatttaaatttttaaattttcaaattaaaaattcgaaaaaaattcgttagaaatttttcagtttttcctttaaaaaactaataaaatttaaaaaatcctaaaatttttaaaagttttatcgaacttagctctttctataattaataaaatcgcaccaaattttatttgcttttccattttttttttgcaaaaattaattcctaaatatttttttgcagaaaattgtctgaaacacaccaaattttattgtcatgttatttgcaaattaaaaaatcgaaaataaattccttaaaattttccaagcttttcctttaaaaaaattccaaaaaaaattttttttttgataaaaaacaacacatcaaacgaagaaattaattattttttttttaaatttaatttttgaaattctaaaaaatttccgaaatgatcaggccatttctttccattagactgatcaaaatcactcactctttgcttttgcgaaattcaaaaaaatgccattggctccttccttctcccattttgaggcggcaacattttgaggccccaaattttggacgaaatttcgctgctcaacaaattcattgcggagaatgtgacggtgccaaccgtggaccggcgcttcaatttgagctaccaagatttgtgcctgagctatgattgggtgtgtggcaacaatgaacacattgaaatgttccgacaaatgacccaagtgggacgagtgatcgacttgcgctaccccaagggcggaaacaaggtggacaaatgaacacaacgactcaaggaccgatcagggggttttcaaggacaaacattgggaaaggacgcgtaattttctgaacacaatccgtaattactagtatatagatgaaggtggacaaaaggacacagggacaatgcatcaataatacagtatttctaaaataaagtactgtagcattgaatatgttttataaaaggtcaaaattgtaaaaaaaacttccttttgaattttttcaattaagtttttttcaggacttacccaaacctctaaacataaatagattgtaaatggattaaaaaattttcgaaattttaccggcgctatccaaagggcgaaaacaaggcggtcaaatgaacacaacaaggaccgatcggggttttcaaggacaaataaatattggggaaggacaatatatgaaaaaagggggatgtgttcggcgccatgtaaatcggcgacttttttttttgtttttcaaagctttttcaaaaaaaaaaaaaattttgggggaacagggagggggtccagcggtgccgaaggcgccatgggaaaattttttaaaattttaatgtgatttgttagcagattatgtccaaagagccaaattttgaagaaaaatgccactcttgccattattaattttaaaaaaataaaataaatattaaatgatgtttaaaggacacgccggcatatttgggcactgcccttggcgacatcgcattgaacggcacggacggcacggtgatggaagcaaaagtcacacagctgttctacttcctgaaacaggacccacccgtcgtacgacagtactccacgggtgattcattcctctttttttttttttttgtaaattccaatatttttaatttttaattaaa

SEQ ID NO: 53494 - DNA, 57 bp, Heterodera glycines
  Genomic contig location: Contig_ID=SeqID_4182; Location=931..987; Strand=-
  SCN-specific regions: Sequence locations=1-57
acttggacatttcgtgggctggacattttgtgggtcagcgaaaaacagtgatcaaag

SEQ ID NO: 53495 - DNA, 60 bp, Heterodera glycines
  Genomic contig location: Contig_ID=SeqID_22795; Location=618..677; Strand=+
  SCN-specific regions: Sequence locations=1-60
cctttctgtacagacggtcccagtcaattggccggaagaattcggtggcttgaatctcgc

SEQ ID NO: 53496 - DNA, 890 bp, Heterodera glycines
  misc_feature (37)..(37): n is a, c, g, or t
  Genomic contig location: Contig_ID=SeqID_22795; Location=614..1503; Strand=-
  SCN-specific regions: Sequence locations=1-178,217-245,267-312,334 -638,662-687,716-890
  Gene Ontology: Mol. function=protein serine/threonine kinase activity; Cellular component=intracellular; Biological process =insulin receptor signaling pathway
tatatgtattagttttgctattgttttctaaatttcnacaccgaagctcgagagtcttggtttcaagaaatctcggcgtaccacccaatttgacactttcatgtccacccatttaatacaaaatttctgctcattgtcagattatggccgttccgttgattggtggggcgttggtgttgtgatgtacgagatgatgtgcggtcggctgcccttctattcaaagtgattaaatgggcaattaatgctactacatatgaaaaataaatttgatagcaaaagcattgacgagctattcctattcggtcccaatgtttggccatggaaaggcgtgccgtgccgccccctggcgacgacttttattttttgtttttatttttttgcttaaaagtggccgatatttgcccgctcaattttctaaccaaattttcgagaaaaaaaactgattaaatttaaaaaatacactattctggccaagtcatgtaatgggataccatcaaagatcgcaatcagattaatgaatgttattcaaatccacccttttccccatggagttgaagttttcacggattttccgagggaacttcgagattcggtgaaacggtgcatttcatttcccctttaacggcgccgaaatttcgaaatttatactttttaaaatttaatttgtgtgcccatttgttcagagagcacgagaagctgttcgagctgatcctccaatgtgcgctccgttttccctcacgactgtcgcccgaggcgaagattctcttgtccggcctccttgtcaaggatccaaacaagcggctgggcggcggtccggacgactatcgcgagattcaagccaccgaattcttccggccaattgactgggaccgtctgtacagaaaggtacg

SEQ ID NO: 53497 - DNA, 605 bp, Heterodera glycines
  Genomic contig location: Contig_ID=SeqID_22796; Location=1124..1728; Strand=+
  SCN-specific regions: Sequence locations=1-294,323-605
  Gene Ontology: Mol. function=structural constituent of cuticle; Cellular component=extracellular; Biological process=cuticle biosynthesis (sensu Nematoda)
atgaagcaccaatatcagaatgagctgaatacacagtccagcagagctgtgacatcaccactcgcagatgatgacgaaacgctggacgagtcgcgcgagcgtgcctacaaattggtggcgtacacggcggtcggcttctcgctggtcgccatcctggcggtggccatctgcttgccggtggtgttcaactttgtggaccacatccaacgccagaccaaacgggagctcgacttttgcaaggtgggataacaacggtgatcggacaatgacaaatcagttcaaaggcagctaaggattaattaaaaaataattataataattagagaatcccgctgtgaggtcagggaaaatggctttgagaatcctgaaagcgatgcatttgctctaggattcctgatcaaacattacaaatcagtatataagtgatgaaaaatgacaattctaaaaaatagagaatcccactttgggtcaggaaaatggcaagtgatttgagaatcaagaaatcggtgcatttatcctaggaatcctgatcaaaattcggtggcaaatttcggccgtttggctctgctctctttagcacttggattttaactgatcagaaacta

SEQ ID NO: 53498 - DNA, 345 bp, Heterodera glycines
  Genomic contig location: Contig_ID=SeqID_22797; Location=450..794; Strand=-
  SCN-specific regions: Sequence locations=1-224,247-345
atgaatttaatgactacttttttgacaacaaaaagaaaatcttgggttcttatttcatttcatttccagtgagtcacaattaaaatttcccttaattgacccaattatggctaattaaggaactgtggacccgagcaaaggcttttacgacaaaagcgaggacaaagtgacattggccatcgatgtgacagtgaaagaagcaaaaaaagagcataaataccaacataattttgtaaagtaaatgtttcggtttgaaatttacttgacgacatattttaattccgaaagtcattagagtaaatgttctcacattttgatggcttattttatttgagattcaataaa

SEQ ID NO: 53499 - DNA, 502 bp, Heterodera glycines
  Genomic contig location: Contig_ID=SeqID_22798; Location=1089..1590; Strand=-
  SCN-specific regions: Sequence locations=1-27,50-101,141-191,218-502
atgaagccgtcaaccggcagagaactcatgacaatgacagaaagtaagtgtgggttgatgcactaactctacaccacactacacatcaataaacagcagactaaattatactttatttaataaaatttggtaaaatggttaaaaaattcaaaattttgtgtaaattttttgcttttttctcacacgaaaatgccattgttttattttaaaaacccaatctttaggggtgtacttttttttcgctttttagctcaaccgaaagatgttgacataataatcctttgtgggattatattagcggacgttagtgctgctgtcgagagtctcaacgagataagactcgggataatgtcagggtctcgtgaaattctccatttatcgaatggcataaccagccaaggctaaactgtgcgacttaataagctcatttttgtggtgattaggaattttttgtgattctcactattaccatttttaaatattctgaattatatacaataaa

SEQ ID NO: 53500 - DNA, 742 bp, Heterodera glycines
  Genomic contig location: Contig_ID=SeqID_22799; Location=837..1578; Strand=-
  SCN-specific regions: Sequence locations=1-27,51-76,98-247,270 -273,312-742
atgcccctctcccctacaagggcacaagtgctgctgctgctgccaccagcggaggtcgtggcacgcgtggtcgtggcgctggcggccgtggtgctggtcaccggggcggtgtggcgccgggctttggccgtggtcgtgggcgtggacgcggcggaatcctcgaattccctgccgacatcaacaacatgaacttggaagacattttctatgatctcctctaattgtttagccggaaattcgcgcaaacaatttttaattatttttattatcctcgaatttaaataaaaatgttttttgaagaatcttaaaataggaaggaacatctaaaggcagcgcacaaaataggttagttttcactgggtgagttacggtttcaggattggagtcagggaggtcgaactttggtttttcactttttactttacaagttaaatgcaccataacgttttctaaaagcatccaaattaaacattcttggtattctttcaaaaaactgattttctaaatatttttgacaataactgttttgaaacacaatgaaattttttgaaattttgtagattaatagagtactctcttagagctatagaaaggtaccaagaagatttaatttggatgctttttgaaaaagttatggtgcattaaacttgccataatattttatggtcctgtgaactgcagtagagccgattcagaagaccccattggaaaatattaattcaaaatgaaaaaaatcaataaa

SEQ ID NO: 53501 - DNA, 426 bp, Heterodera glycines
  Genomic contig location: Contig_ID=SeqID_22800; Location=623..1048; Strand=-
  SCN-specific regions: Sequence locations=1-224,247-269,291-426
atgccaccgccgccaatcactttgtaagtgttcacttgattgatgtcctcataaccaaacccggcagcatggtagcataaccttttgtaactgaaacatcgttttgtaaaagtgtgtgccaaccagggaaatattgcccaaaatgatggcctaattagactaatttggtgtcatttggtcgtcctaagtgctctctgttagcctgcattttgaagtttcattaatttcaaaaaattgtggccaaaagattccttatttttggccgtaacttttttgagagttaaattatttgaaatattccaggctgctaatagagacatttatggctatcgagtgttggcaacaagttcgttcaattaggacaaggtccaaaatttctaatattctaattcctcactacttcatttaatgaatataaaaattaaa

SEQ ID NO: 53502 - DNA, 1366 bp, Heterodera glycines; identical to SEQ ID NO: 22800
  Genomic contig location: Contig_ID=SeqID_22800; Location=1..1366; Strand=+
  SCN-specific regions: Sequence locations=1-579,646-758,780-802,825 -1029,1051-1298,1337-1366

SEQ ID NO: 53503 - DNA, 478 bp, Heterodera glycines
  misc_feature (457)..(457): n is a, c, g, or t
  Genomic contig location: Contig_ID=SeqID_22803; Location=4..481; Strand=-
  SCN-specific regions: Sequence locations=1-178,200-238,297-429,455-478
atggataccggattcatggtctgtacccccgaaaacgcaaggaacttgttgaggggatggaaaatgacaaatgctggcatccccccccccttccaacccgttaattttccaattttcctaatcatcaataaatcaggcgttgacggaggatatcgacttctacgttgattcgtcgtgtgaagaggatgatgatggtgacatcgtcctcgaaccgccggttgctgctgaaactgaacctgaggaatcgcagaaggaggaggaacagagggaggagggaaaagccgaagaggaggcggccaatagcaaagcaatttgagtgacaattaatgatacgataatattttgataacgtttctaggcagtttattttatgttgtgtatcttttgctgattgtgaacagatttctttctcctttttgctttaccggtgatcatttatttattttattttcccctnaaaatatggcgatttattaaa

SEQ ID NO: 53504 - DNA, 348 bp, Heterodera glycines
  misc_feature (25)..(25): n is a, c, g, or t
  Genomic contig location: Contig_ID=SeqID_22803; Location=1..348; Strand=+
  SCN-specific regions: Sequence locations=1-27,53-185,244-282,304-348
atttttaataaatcgccatattttnaggggaaaataaaataaataaatgatcaccggtaaagcaaaaaggagaaagaaatctgttcacaatcagcaaaagatacacaacataaaataaactgcctagaaacgttatcaaaatattatcgtatcattaattgtcactcaaattgctttgctattggccgcctcctcttcggcttttccctcctccctctgttcctcctccttctgcgattcctcaggttcagtttcagcagcaaccggcggttcgaggacgatgtcaccatcatcatcctcttcacacgacgaatcaacgtagaagtcgatatcctccgtcaacgcctg

SEQ ID NO: 53505 - DNA, 533 bp, Heterodera glycines
  Genomic contig location: Contig_ID=SeqID_22803; Location=764..1296; Strand=-
  SCN-specific regions: Sequence locations=1-417,476-482,504-533
atgctctacacgatagaagtggttaaaaagtgatttgggcacatacagtcggcatgttcccttgttagcttaatcacaagacccgacaccgatcctacatcgtcaaaccagtcgccgttgtttatgtgcagccacaggtaggatacatgagcggcctcatggagggctgtccgcgccgtatcctccccttgtgccgcctcgtccacctctttcttaaactctttaactttttctcgatgctgcgccgcaaatttttgttttaacgtcatctaaattaacataaaagcggtggccattgaattgttcaagcgcaaacgcatttcgcgttggcacttgattcggtaaattaaaaaaacacaattttttatcaaaattttttctagaaaatttggccgggcaagaagcgaggccattcttgaagtagaggatgaggaagaagagcaggaagaggacatggaatgggacgaagaagaagcgtgaccggaaaatcggtcagtggaaaatgcgtcagtgataaaaatactttaaataaa

SEQ ID NO: 53506 - DNA, 203 bp, Heterodera glycines
  Genomic contig location: Contig_ID=SeqID_4183; Location=560..762; Strand=-
  SCN-specific regions: Sequence locations=1-10,38-203
atgaatgcctaccaacagcagcaacaacagcaacttctccaggcttactacagccaattccaaccccaaggggtggcaggtgctgacggacaagtgccggccaagtataagagcacactgtgcaacatttggttgatggagggcatttgcacgcgcggaaaacaatgccattacgcacatgggatcaaagagctgaactacag

SEQ ID NO: 53507 - DNA, 88 bp, Heterodera glycines
  Genomic contig location: Contig_ID=SeqID_4183; Location=87..174; Strand=-
  SCN-specific regions: Sequence locations=1-88
gctgattattttcgtttgtaactttcttgaaatgttagaattatcttgttttctcgtattattacattattcagactttgtgctttcg

SEQ ID NO: 53508 - DNA, 203 bp, Heterodera glycines
  Genomic contig location: Contig_ID=SeqID_4184; Location=1376..1578; Strand=-
  SCN-specific regions: Sequence locations=1-203
acagatcaagcggaagaaggccagggagtgtcacgaagaattggacctgcctcagcattgcattcatttgatgtattcactggccgagtgcaaacgaaacaacattgatcctcgagcccgttttcgtggacggaagggcgatttgtgattgaaatactgcatacttttcatcgctgttttagaataataaaaagtttttctcg

SEQ ID NO: 53509 - DNA, 747 bp, Heterodera glycines
  Genomic contig location: Contig_ID=SeqID_4185; Location=99..845; Strand=+
  SCN-specific regions: Sequence locations=1-549,582-702,724-747
atggtttccacaaaatttcgagcagctgccattgacgaaatggtgcccgagcgaaggacaaagattgaaaggaggccttgcattggagttttgacggtaagcgacccgatcgcattgcttccaaggactgggtccaactctgccaaaagcaatttttagcaaaattcatggctttccgatccagggcaataggttgaggtccagccgagttctgtaaaatgaatttctccaattttttaattaatttcggatcgtttcgaatcaggtacttgtttgtctctacttttgtatcgtaaatgaagccatgtctaattattatggaagaattggacatttggttggcttcaatccgccgtcaaaccgtaatgaagctgaagaaatgataattgaagaagatgcaaggcttttgcttgaacaaagtttggatgaaaatgggctgcttgttgatcaatactttgaagaaatgggtttgaatgaagtgcaagatgaaaactcgcatgatgttaattcagaggatggagaagtggatatcatgaattaattcatatgaatttttatatttttatttaacttttatatttgaagatgcttaaattttacattgttgttaaaatacatgaaaattgggtcagaatcatttagactgcaattcattagcgctgagtcttgttttattaagcggtagcgtgtaatacataaaaattttcattgaaaatggtttttaaacaaaaaaaacgaatcgggata

SEQ ID NO: 53510 - DNA, 1520 bp, Heterodera glycines
  Genomic contig location: Contig_ID=SeqID_4185; Location=1113..2632; Strand=-
  SCN-specific regions: Sequence locations=1-166,196-344,366-863,885 -1027,1050-1267,1291-1491,1513-1520
atgccagctgttgactgtttgaatgggtatcgcagttacactgatcgctgtggggagttttttatgggggacccattggacccaaatatggagacagacttcgattttgctggaaacttggcgctttttgacaaggctgttagtaattaatatgatacttgtgcagttttaaattaatttttttttaaataatatctatttagtacaaaaaatacgctggtctcattttgattcctttccacctgctaaattaaaatcttcgtttcgggataatgttattcaaaaatatctacttgtaacaatgtagtttttaatatcaaagattgtatatatccttccttttatttttgaaccgtaaacacacacattaatagctttatttttgaaaaataggaattcaaccgagaaactgaaaacgtcttccatgggcttgactcggccggcgattgttctcggaactatcgcaatgatgagaatgttcttcaggtatgtaaattattgtttacttctgctctattcatttcgcttaaggattcttcccgtgttatctcgtggaccaaaaataccactgctgatgatgatgacaatcaaaacaattctacctcctctccgatcgactgacctcattaaacgatttgaacatcgcccaatttaggttgtttgttgcctcgtgtaattgttgtcgtttttcctaaacattatacctatgtggatagaatccgatctaccaaaatcttatggtgcctttgttgattttcgtttccatataatgtcttacaatgagttgaattcattgttttttggaattaagacaaaacgacaataataattatgaaacaacccaatgttttgattaaaatgggaaaatttttattaaataaaatcttccaaatttaatatggaacattgtttttaatatgttttccaacgtgtctttggatgtttgttgcgggtaaacgaattctctaactcatcgaaattcaatattttgctcttctttggtcaaatgacttgtttttttcaagttgaaaattcaaatgcatttttaatttaaagaattgagtatgacatttggtaattcaccgactcaagagagaaaattaggcgaacaggagacgcaatttgatgagactattacgcggactgggattgcgtgtgatcggatacgactacaattgaagaagtgcattaaagaatctgattgcatacaggtggataatttagttttgcgactagatcacgttcccttcatataaaacaaactataaaattttgacttaaaaatgcttaaaagcttcgggtgaaccgataggtgtcattacaactcgtacaaggctgtctaattgtaagcctgaaaagggaacattcggaactgtcactgctcagatcgctttaaaaccgcctttatcgtgtagagcatagtcgatttcctattgtcaatttccggcttttttggctccggtgtcaaaaatgatcaaatgaaaaacccagcagaattgtgttattcttcagttattaaa

SEQ ID NO: 53511 - DNA, 285 bp, Heterodera glycines
  Genomic contig location: Contig_ID=SeqID_4186; Location=330..614; Strand=-
  SCN-specific regions: Sequence locations=1-89,112-285
atgtttgttgcgggtaaacgaattctctatctcatcgaaattcaatattttgctcttcatttggtcaaatgacttgtttttttcaagttgaaaattcaaatgcatttttaatttaaagaattgagtatgacatttggtaattcaccgactcaagagagaaaattaggcgaacaggagacgcaatttgatgagactattacgcggactgggattgcgtgtgatcggatacgacaacaattgaagaagtgcattaaagaatctgattgcatacaggtggatatttag

SEQ ID NO: 53512 - DNA, 455 bp, Heterodera glycines
  Genomic contig location: Contig_ID=SeqID_4186; Location=672..1126; Strand=-
  SCN-specific regions: Sequence locations=1-455
atgggcttgactcggccggcgattgttctcggaactatcgcaatgatgagaatgttcttcaggtatgtaaattattgtttacttctgctctattcatttcgcttaaggattcttcccgtgttatctcgtggaccaaaaataccactgctgatgatgatgacaatcaaaacaattctacctcctctccgatcgactgacctcattaaacgatttgaacatcgcccaatttaggttgttgcctcgtgtaattgttgtcgtttttcctaaacattatacctatgtggatagaatccgatctaccaaaatcttatggtgcctttgttgattttcgtttccatataatgtcttacaatgagttgaattcattgttttttggaattaagacaaaacgacaataataatagtgaaacaacccattatgttttgcttaaatgggaaaatttttattaaataaa

SEQ ID NO: 53513 - DNA, 550 bp, Heterodera glycines
  Genomic contig location: Contig_ID=SeqID_22806; Location=68..617; Strand=+
  SCN-specific regions: Sequence locations=1-209,231-360,382-550
cagcaaagtcgtccaaattccccagcaaatggcgtatccaaattgatacttccgagaagccgagtcgcttcaatacgtcgtgagtcggattgcaattcagagaaaggatttggtgaggcggaagcggcacacgaaaaaatggtaaaatcggcacagcaagtcgcgatgggttttgaggatttttgtctcgtgagtgcaaatatattttttaaaatctatctttgtttttaaggacgacaaggctttcgaggagcgcaaaagggccaagtcgttgtctgagcctatttgcattttcaccaatgcgttccttccccaatgttcgtcaccgtcgccgagtaggggttcaatggatggacagaaagtaaggacaactgactctgattttgaccgccactccgttgtcattcgctcagcaatgctattctccgtctgcccagcaagtcgtccgcagcaatttggcgtattctccgagtccgagtccaactccgtctggcactcagtcaatgcaccgaatgaggtcttgcgagagtcaaacgcaccttcccgatga

SEQ ID NO: 53514 - DNA, 1660 bp, Heterodera glycines
  Genomic contig location: Contig_ID=SeqID_22806; Location=905..2564; Strand=+
  SCN-specific regions: Sequence locations=1-24,159-204,333-369,473 -523,638-1328,1350-1660
  Gene Ontology: Mol. function=fumarate reductase (NADH) activity; Cellular component=cytoplasm; Biological process=energy pathways
attaattcacaaacctattaggtactttagattattgtcattggcggtggactcgctgggatgtcggccactttggaggcactaagtaatggtgccaaagtgattttgatcgataaggagccgactttgggcggcaacagtgccaaagcgagcagcggttttggattgtcgttgcttttctttcaatggcatgaaggcaattaagggatcaatggttgtgggacgaaagtgcaggaaaagttgggcattgacgacacagcggaacggtttcactcggacacaatggcagcgggcgacagagagaacgaccccggcctcgtcgaccttttggtcgtcctacccgctatttgttatgtcacatttcttctaggttcaccagtcagcgtcggctatcgattttctgacagaaaatggagtcgatttggccgacataaacctttgcggaggacattctgtgcccaggactcattggtcatttcgcgtttcaatggtttttgaagagacaatttgccctttctctaaaggctgctctcgccaaaagaaggaaaaccgttgccggtcggagttgcaataattcgaactttaaacgcgaaattggaagaatggaaagcaagggatcccgaaagactgaaaattattctcggcactgccgttttgggtttggtcacatggaatgattacgtaacgggcgtacggatcagagacggagacaacaaaatcagtgcattaaatgcatttgtcttaaatcgtttcttacacttttagtggagattaatggaaaggcggtgattctgaccaccggcggattttcttccggtagaatttgtcattgtgatccacttctaacttttcttgttactacaatataaagatcgggacaacgagacttccttgttggtcgaatttgcgccctccgttctccccttgccaacgaccaatggcccattcgccactggagacggcgtgaaaatggcccgagcgatgggcgctggtttagttggaatgggaaaggttcaaattcatccgactgcattcgtcggtaggcaaaacagtttttgaattaatcgcttaaactctataccaattcttccaacagatcctaaaaatccaacagcccacacaaaatttttggcagcggaggcattgcgcggaaagggcgcgattttggtaattagggaacttaattggtggcatttccagctaaaacacaaaagttttaggtcaatgaaaaggggcaacggtttggcaacgaactcggacgaagagactatctgactgagaaaatgaacaaagtgaaccactgttgttgttgactgagaaatgagcaaatggctttcctccttctgcagaattgtgctcgacaaaagtctgtggctgatttgcccattgcgtggatgctaatgaacgaccaaatggctgattcctttgggcgtcccgcgtttaatttctatgcaaaaatcaaaggatttttcactgtctttcgatgttctcgttaacaaaggaaaatgccagtttttcagcattttgcgaatgtcgacgaacttgcgactgagattggctgttctggcgaaatgttgcgcaaaacactcgccgaatgcaacgaatacgcggagatgagcacgaaaagtgacaaattcgtcgatcccttcggaaggagtaa

SEQ ID NO: 53515 - DNA, 744 bp, Heterodera glycines
  Genomic contig location: Contig_ID=SeqID_22807; Location=9..752; Strand=+
  SCN-specific regions: Sequence locations=1-54,80-550,572-683,705-744
atggcaaccgatattaaaactattttacttcgactgtcttcaattgaaacgttattatcaaacaacaacaacaacactttggcaacgcaaatggcagaacaattcaacgccattgctgaacgcctcaacgaaattgagcgcaaaatcaacagcaacaataacgacaattccagtgcggaggaaaaagaacgcaaacgaagcctcgttttgattggcctgccggaggctgtggctgaaaagccgtcagaacgcgccaaagaggacgcggaaacagttgcggaagtgttggacgctttggatgtggaggtttgcccgcagatggtgtatagaatggggcggcggattgatgagaagcgaaaggggccgcgtttggtcaaagttgtcttgccagcgacgacgttccaacgttttgcattggcacaatgggggcgcaaccggacggaactgaagcagcatgttggttggcagcgacttctcgtcaggccctctctgacgaaagaagaattggcggctgagcgggagattcgtgaacagaggcggatgaattatgaagaaagcaaaaagaatgaaatggtgacgacgcggcgtggaggcaacatgggaaaaaacttttgaggtcacaaaattttctcaattgtctttattttaactcaagaagtttagtgaacaaaatgaatgagtttaagcttttacttttagaaaataggtataaaattatcgcgataaccgaaagttggttgaata

SEQ ID NO: 53516 - DNA, 889 bp, Heterodera glycines
  Genomic contig location: Contig_ID=SeqID_22808; Location=428..1316; Strand=-
  SCN-specific regions: Sequence locations=1-416,438-561,583-583,607 -864,886-889
atgagcaaaagcggtgccaaaggcctgtctcgcttcgaaatttcgtcatccaccggcgccgcggggaaacggcgtgggtcatccgccgaagagctgcccgcaaatctgaaggggctcgccgaagtcgttgatttcggctcggtaggcgtgttttatgtacgcgccaaactcgtcaacctccaatacagcctttacaatgtcagttttcatcaatattttattaaatttgttgttgttgctgatggttccatccggtcacaggcatgcccgttaaaattttctggcggactgttctgcagacgtaagctggattctgagcttcgatgtccgtcgtgtgatcaccgtgccaaaaaaccgctagtttgcatgtactgccgagtggagctcaaagacatcgagaatccggaagttacgcagtgtgccaccatgttcagctacgttgctgagaagtacatcggtatcaaagcggcatcgatgctcgacatgcgtgaccaaaacccggacaaattggagaaactgcttgaagcaaaacttgaaaaggagctagtcgtaaaaatgactattaaggtacaaaaaatgtgtgattattattattattattattatacaacgatgtacgcaatatgtttttttttgtatgaaggaagccactgccgaagacttcgaaggccaattcgattggctgatttcaaaggtgtttgcctctgatgacgaagctgaaggcagctcacagaccgctaaaaaagccagaattgttgaggctgaacgagaagaagacgaagacgaaattgttgttgtcgatcacaagaccgccgtcactgctccatccacctctgctgtggacgagcaggagggaaaggagaaaccaaatagtgaaaaaacaaaataa

SEQ ID NO: 53517 - DNA, 1961 bp, Heterodera glycines
  misc_feature (91)..(91): n is a, c, g, or t
  Genomic contig location: Contig_ID=SeqID_22810; Location=87..2047; Strand=-
  SCN-specific regions: Sequence locations=1-32,54-477,506-612,634 -784,813-1586,1608-1961
atgggacgcgaaaatgtagtgccgatatttttggagaatggccattgggatggtctgaagaattatgtctgctttttcaaccgtgggaganaattctgtattgattgcgagtgcttttacgacaaagatatttaccatactttcgactgccgggcaaggtgttattattgtaacaaagtaggaggagtaccatgccaaaaggagagtggagtgaagattgagtgcccgaagtgttgtcgttacttttacaatttggagtgttataattaccatcaggaacatcagacttgtaaattatggaggcgttgcgttatctgtgacaagacttatcgatttaacccgaagaagggacatgaatgtgaagagacttattgccaactttgtagtgtgagccatgaccccaagcggggttgttatattataccgatcgaggagaaagaggaaaaggccgtctaccgaattgtcgtttgggtaagatttaataaagaaaaagacaaaataaaacctaactttcaggatacggaaacatcacaggattcgatttataagggggaccagaaagagcatgtgatcaattatattttggtgagagttacatgtacggagtgctgtgatgataaaaataggacgaattgcaaaatatgcggggaggagaggaccaaggattggagcgaggctgaggggcatgagccgacgaaggcatttgtggagtggattttaacggcattttcaaattacgatacgtacatatttgcgcacaatgctgggcgttttgatggtaatgaaaaaaaaattaatctaaatttttaaatcctaaaatttttaggtcattttgtgtttaactacctctgccgtaccgggaagaacccgataccgcttatcaatggactcaaaatttatgaattcaaagtgcgaaactcgaagaaacattcaatgctgatatggagagactcatgcttattgatgccggtgaaactcgagtcgctgaaggcgaccttcaacttgggctgtgaggacaagccctttttcccctattactacaataagaaagaaaattatggagttcgattacaacatctaccaccgatggaggactattcgccgggatctatgaacaagaataaatacgaaaaattcgaaaaatggtaagaaaagaaggacaaaattaacaataaataatttttttcaggtacaacgaaaacaaggacacgcctttttatttgaatgacgaattgagaaattattgcagaaacgacacagagatattgctgttatcgattattgagtttaggaggatattgattaacgatattacgaagggatttgaccccttaccgaggagttgtacgaatgcgggggttgcgatgaatatttttaaggcaatgtttttattgactgagcagttatcgattgtgccggagaaaggctatgagcggtgtgatagagcgagtgttatggccattaagtatttggagtggcggagcaagcgtgatgagattgagataaggcacgcggggaacggacgagaagttaaaattgggaattacaaattggatggatttattgcgaataacggagctagggacaagtgcattgaagttatgggatgctatatacatggatgtatgaactgttatgacccggcagcggaactgattggaggaaggacggcccaggaattgaatgatgagacgcaggagagattggcggagctgcggaagacgttggacgtcgaagaagtttgggtaagtttatttgacatttacatttttattgtgaatttttagggctgtcaaattgaggagttgaaaaaggatgaggaaatgagggacttcttcgacgatagagggaatgagaaggggccgattgatccgcggatggcttatgcgggagggaggacgggaccgatgaaattgtttgcgaaatcggatgagaagaaaaaaattagtgtttatgatatt

SEQ ID NO: 53518 - DNA, 486 bp, Heterodera glycines
  Genomic contig location: Contig_ID=SeqID_22813; Location=213..698; Strand=-
  SCN-specific regions: Sequence locations=1-201,223-257,280-486
atggttgggcaacggcgttttggtcagcgacggggaccattggcttcgccaagtgagtcccataaatccataaatcagccgaggattactaagatttaggattttcggggcttcggtgggggggcacgcttgaaaaactgtctttcggccaattttcgggctttttgtcttttgcacccggatttcatgaattttcacatatactttttcgaattatcagtcatctctttttaaacaagtttttttcaatatttagataaaaaattgtttattaaatgaaatttaccgtatcgtatcccttctaattaccgtatcaaaatacattcatttaatttagcgccgaatgttgttgcccatctttcacttctccatgttggaacagtacacgcccaccttcaacaaatatggacgaatgttgacaaaaaatttggccgaattgcagggacggcgcgaacttgtggacctgtcaccattgtgtaaaataaa

SEQ ID NO: 53519 - DNA, 417 bp, Heterodera glycines
  Genomic contig location: Contig_ID=SeqID_22813; Location=896..1312; Strand=-
  SCN-specific regions: Sequence locations=1-37,74-141,175-254,276 -347,369-417
atggtccaactttatgttggagcatgcaaatggtaagaaataaaatttaaattttataatgttttaaaaaattggttgattatttattaattcagaggccatccgtaatggacaccatttgatgagatggttaaacaattcaaaaaaataataaataattaaattaaaataaatccattattttacatttttcaatttcatttttaggtgggtcgctaataaatttattattatcatgttggatggagagaccgcaaaagtgattaacaatttaatgtttaaatacagtatttgcttttcctaaaatagctttggtactaattaattttgtatcccattttggtcattttttatcattttaaaatattcttttaactggattaagaattataatgctcgatttttgtttttaataaa

SEQ ID NO: 53520 - DNA, 714 bp, Heterodera glycines
  Genomic contig location: Contig_ID=SeqID_22814; Location=284..997; Strand=-
  SCN-specific regions: Sequence locations=1-19,41-372,402-605,651-714
atggccattaatatttcggacaccaaatcgcttttcaatcaaatcctcgcccagtccgatatcaccataaccacaagcggcataactgtcagtggtccacgcctatcgaccccccgttttttgccgtttgacgattgtggacgctgccgcgtttgcaaagcaaccgaggccgaggtggacataatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccgggacgtgtgccaaaagcaaaccgacagaccaccaacaacaacaacaacaacaacaacaacaggatctgaagcgcaaggcaaaggtagcacttgacctggtggaggctgaactaatggccgatgctatgcaggacggcacacggtggaagaaggccaaaaccgctatcaacgtgcttggcaatctccaattggctgaatcactggactccaccaaccgcaattccactgatgtcccgacgcaggcaaatgaagccgctgacatcaaggaagaagaggaaaatgtgcagggagaagaagaaaacaaagaagacattggagacattgacaaaactcttgacgacttctttaacagccttaatgcttcaacctcaaat

SEQ ID NO: 53521 - DNA, 1271 bp, Heterodera glycines
  Genomic contig location: Contig_ID=SeqID_22814; Location=1191..2461; Strand=-
  SCN-specific regions: Sequence locations=1-18,40-75,112-155,177 -242,264-321,344-372,394-440,462-544,566-892,914-1107,1130-1271
atgaaaacccttcgcaaccaagtgggtcgccaaacgatgccaatggtggtgaattttgatcaggtgagtaaaaactttttaattttactattttaaattttcaaattatttcagactggggacgcgcaaaggactggacaagtcgggggccgccgatcgatgccaccctctgttgtgccggcgaatttgggcggcgggccgccgtaccaggtacaaacacaacaaagcccttcgcttcccttttttataccattttttaaaaaaggagccacaaacgcagcagcgcgaggtgatttatgatgtgccagcggatggtgtgccggaagacgacgatgacgacgacagtttttgaacgatgagccgatacaacaatgagctttaattcctcataaatttttataaaatttgggaattttcatttcacattaaacaatatttggcaaataaatgtaacaaaatgacaaattggcaatttataggagaccactaaataggagaaatttcaaatgttttactgttgggtattcagatcgttaggcgagattaatgaattttgaattttaaacatgcgatataatctttttgaatgattaatgtgtgatatagtggagtaaatctgtcggtacatcaaatgagcaatttgtttaaaaatgggtcacatccattatcgggaattcgggatgcgttggtgtataataaagctgcctcccatttggagaataataataaagccgttgtgcaaggtcaacagcgcaccatttaaatgcatccctcccgtctcgctctcattatttcttcacatcacttgctcaatattttcacatttatttatccgctttacattttgctatatcccaaatcatatcatttaagcacacaaaatttacttcaaatttttgttttaaaaatgtccgacagtccaacgcccgaaaccgaaataagcattgcatgggacatcctcgaaaatgataaagatgtagtgaatttttttctttaatttgaattcaaatcttatttatcatttctgcagtggtacaactggttcactccaacgaccgccaaacaagcatgcgtcgaggcattggcattcgcgcgagaaggtggactaaagcacgagaacattctgaaaataatgaagacgcttgaggagagagaaaagcgtgacaagaaatgaaatgtcgatcgatgaccgatttgttgatagtgatgtggatatatgatctttttttttgggacatttaaaaaattggtgatgaattttgtcaaataaa

SEQ ID NO: 53522 - DNA, 586 bp, Heterodera glycines
  misc_feature (19)..(19): n is a, c, g, or t
  Genomic contig location: Contig_ID=SeqID_4188; Location=75..660; Strand=+
  SCN-specific regions: Sequence locations=1-185,208-247,271-297,321 -326,358-375,397-586
atgatttttctcttaagcnccgtaattgacattgaactttggtccgagtcgtccaacacgtcttacacttattcctcaaccgacaaaatccttgccacaacaaccacggctcatccggctttccaacctttggtcaaggcgacacagttggaatggcgcaaacctgaacacgatggaggcaatttataccaaaaatggacagccattaagtgagtcatcaagagcaaaatcggaatttgaaaattgtacccgaaagggttttgttttatgatagagaaccgacacttaaaattcccgaaaaaataataaaaaaaattattgctgagagtggataataaatttaaaatgctaataaaaaagggttattaattctcttttaaacatattttagtgacaaatggcttgttgtacatcagtgaatctgatttatttccacgggttacgctttataattctggcgatgtgatcctagcaaattttggccataattttatgcacaatttcaacgtcgcttcacgaagccaacgtttggtaatgttattaagaaggagcttctgatttatgcagcccccccaaaaaaaaaata

SEQ ID NO: 53523 - DNA, 3804 bp, Heterodera glycines
  Genomic contig location: Contig_ID=SeqID_4188; Location=1648..5451; Strand=-
  SCN-specific regions: Sequence locations=1-359,383-449,471-533,555 -747,815-892,914-948,1011-1384,1408-1474,1496-1558,1580-1772,1839 -1916,1938-1946,2012-2298,2321-2348,2370-2403,2425-2463,2485 -2514,2536-2990,3012-3086,...
  SCN-specific regions: Sequence locations=...3169-3283,3305-3452,3496 -3582,3618-3627,3649-3732,3769-3780
cccccaactaccaaggcttcatccactaaaaagcccccaactaccaaggcttcatcatcggccaatgacgagccgtgcgatgaagatgccactaatgagcacccaactaccaaggcttcatccactaaaaagcccccaactaccaaggcttcatcatcggccactgaagcaacctcccaagcttcgtcctcggtcactgaagagccgtgcaatgaagagacatcgacttctccatcttgtgcatttgtctgcagtggttttggatggaccatttacaatggcaattgctacaaagtgatcgaaggattgatgaatcagaggtgtgaacacgaaatgaattcattggaggcgaagcccttaaacaaatttaaagaatttattattgaaattgccgtttaagccaagcagtggccgcttgtaatgccgaggactcaaaagcgcaacttgtaagcattgcggatgaagccgagaatcggcttcttggccgaatcattgcccagccgcttgctcgttcacttctgacttaccaattgtcatcaacaattttcaacacattttggttggatatttgtttaaattttgttgctaataatatattattaatccatgataattgattgcctaattacaatgatatcttttccaggatcggtcttcgccgtgtccgtgtcggcaatctctatcaaagcacatgggcaaacggatcgccagcaacgtttggcaatgtggtaagtcaacagaattgcctaattaataataattattatataattgtttaattaataataatcaaaaaaccaaaattataattatagcccgaaattacaactgctgcaacgacaaccggcaccaaaaaccaatacccatgggcagaaggacaaccatcaggcaccaacaaatacactgacccaagttgttacagttatattaagaaatttaaaaaatcgcatttttattgaatactttaatatatttttatttttttttatcattttaattattcttaattacaattccaaatgcttttagctggcgcaaatgaggaatgtgtgcatatgataaatgcaaatggccaatggaacgacgcgcgctgcgcaattcaaatgacaggcgcaatttgcaaaaaagcagctcaagcagttggaattgggtcacaggccgccgtaacacccgttggaacgggccaaatccgtgtgcaaagtgccggaagttccgcggcaccaccccaagcctcgtcatcgtccttcgatttgtgtaatccgagtgtatcggtgtgcggaggctttgggtggaccattttcaatggcaaatgctacaaagtgatcgaaggattgatgaatcagaggtgtgaacacgaaatgaattcattggaggcgaagcccttaaacaaatttaaagaatttattattgaaattgccgtttaagccaagcagtggccgcttgtaatgccgaggactcaaaagcgcaacttgtaagcattgcggatgaagccgagaatcggcttcttggccgaatcattgcccagccgcttgctcgttcacttctgacttaccaattgtcatcaacaattttcaacacattttggttggatatttgtttaaattttgttgctaataatatattattaatccatgataattgattgcctaattacaatgatatcttttccaggatcggtcttcgccgtgtccgtgtcggcaatctctatcaaagcacatgggcaaacggatcgccagcaacgtttggcaatgtggtaagtcaacagaattgcctaattaataataattattatataattgtttaattaataataatcaaaaaccaaaattataattatagcccgaaattacaactgctgcaacgacaaccggcaccaaaaaccaatacccatgggcagaaggacaaccatcaggcaccaacaaatacactgacccaagttgttacagttatattaagaaatttaaaaaattgcgtttttttatttttatatcattttaattattcttaattactagggctgggatttttatgttttaacatattttttttgcggcttagttatggcgagagaagcccaaaaatagcattttctccgaacaatttttgatttagagcgacttataaaaacataaaaacacatattttggcgttttcgcacataaaaacatatcgcacatatttcggggtttggcacatattttgcacatattttggcatttttgaaaaaaatatctatgaaaaacacaaaaaattcaaaaatgcacccctaaaaatcaactttcttgccatttttataggctctttcaaaattttctttatttatttcgtgtaccgaaaatcgaattcttcattaattctttactggatatcgaagtttattgctggcacttactcaactgatggaaaaattatctttaaaaacaatttatcaaaaaaggactaattttacccccaaacacctccaaatgttttttatttgcaattgtgcgggcaaaaatgataaagaatgagttttttggaatttttatgcaaaaataccattggtttttccaatttttagcacatatttttgcattttttaacacatatttaggcctttttttggtttttagcacatattttattacatatttcaggatttttagcacataaaaatcccagccctaataattacatttccaaatgcttttagctggcgcaaatgaggaatgtgtgcatatgataaatgcaaatggccaatggaacgacgcgcgctgcgcaattcaaatgacaggcgcaatttgtcaaaaaacagctcaattttaaaagcctacgattgatggatggattttgaagagcctaagaaagcaatgagtgaccaattaatgctatttttgtaaatattgaattgctaattttcaatatggaaaagcgaaaaaataaattcttcggtttttgcttttatctccgatttactatttatacagttgaattcttacagcaattaactcaaatataaaattaaaattaatgagttcaagtgattttaggcttattttcaaaaaaaaaaaactaattttaatgcttcattttatctcgcatttatctaaaaatatttatttgaaattttaaagaattttttgatctaacaataaagaaaaaagaaataaaaaaattcaatttaattttgatcaatacgcagacgtaaataaatgcttattcatccaaagtgaatttgtccataaattcctcttttttcattacttttgtcttgtgagtggttaaaaagggctattaattctcttttaaacatattttagtgacaaatggcttgttgtacatcagtgaatctgatttatttccacgggttacgctttataattctggcgatgtgatcctagcaaattttggccataattttatgcacaatttcaacgtcgcttcacgaagccaaagttcgtaaacaattggcctttataattttaaacaaaaaataatttaaaaagtaaattattagaattggctgaaattgatcaaacaattacaaaaatgaaggacaaaaaccggaataagcgaagctgccgatgtagtggtattacaatgttataattaaaattattaaattaacttttttaatagattgatacagttcattttttgctaaggaatttgttaaattaaatactacaaattagcggcagtctatctgtttatgataccgggaaaaggtaggaaaattctgaatgatatagttatatatatatatatatatatatatatatatatataccagcattagcgaaataatttattattttaaataaa

SEQ ID NO: 53524 - DNA, 671 bp, Heterodera glycines
  Genomic contig location: Contig_ID=SeqID_4189; Location=94..764; Strand=-
  SCN-specific regions: Sequence locations=1-671
  Gene Ontology: Mol. function=chaperone activity; Cellular component =nucleolus; Biological process=nucleocytoplasmic transport
atgacagctatgcgcgggataaagataaaggcaaaaataacgttggagtgctcaccaatagaagatgaagggaaggggtcctcatcatccaaggaatcggcttcatccgaagaatcatcagcagaacattgttcatctgatgaagattcatcaccagtcaccaaagagcccccaactaccaaggcttcatcatcggccactgacgagccgtgcgatgaagatgccactaatgagcacccaactaccaaggcttcatccactaaaaagcccccaactaccaaggcttcatccactaaaaagcccccaactaccaaggcttcatcatcggccaatgacgagccgtgcgatgaagatgccactaatgagcacccaactaccaaggctttatcatcggccactgacgagccgtgcgatgaagatgccactaaaaaacccccaactaccaaggcttcatccactaaaaagcccccaactaccaaggcttcatcatcggccactgacgagccgtgcgatgaagatgccactaatgagcacccaactaccaaggcttcatccactaaaaagcccccaactaccaaggcttcatcatcggccactgacgagccgtgcgatgaagatgccactaaaaagcccccaactaccaaggcttcatcatcggccactgacgagcc

SEQ ID NO: 53525 - DNA, 1453 bp, Heterodera glycines
  Genomic contig location: Contig_ID=SeqID_4189; Location=1486..2938; Strand=-
  SCN-specific regions: Sequence locations=1-234,256-320,348-758,780 -990,1019-1110,1135-1453
aaatgcgcgagatgaaccgttgcccaagagtaagctaccaacaggtcaccacaatgaccggtaagacaaaaatcacttgggcgaccttcacgaagttcaaaatttttaaataactatattttagccttaaatgacccgtccactgacaataagccaatgattgtgattaatgggcagcgagcgatcacgccgactattaacactttaatgagggaagacgacgccgacacctccaaacagcagcagcaaaaagaacagcagaggaacagttcaagtacttcaaacgaggcataaaccattatttatatgaattaataggctaattaattattaaatatattattaaaggtttttttagtccaatttaattaccaaaattaaatgaattaccgaataacttttccccacttttcagacacaattattggtgtctgccattcgccatcgtcagtcctcctcctatagcgccaaatcaaacaggtgatcggtcggtccttcatttatgactaaattttgcatttatccattaatattttcctcaaattttgtcactaattactcccaatttacaccactaattaattattcttcagaaatcgcgctatccgtgtcagttttttgctggttgtcggctatttcgcctgctggttgccctacaattttcttgcactgattcaattcgtcgacactgacctgttcagtcggcacgcaaatcaagtcgggaaataaatttgtattgaaaattctgcaaaacgataatatattccaaattggaaatttaatttttgattttctaccataaaaaatcttatcatgcaaatttataagctgataaaagcattcttaacaggagaattatttttaaataatctttttaactttgtgttaggtgtactttctgcacgggatgatcgtgttcaactccgtgatcaatccctacctctacggtctgtgcggcggactgtgccgacaaaggcgaagggattcttgaaattaatttcattattattattattatcatcttcttaattggtctcaaacaacgaatctttttcctctatttattgtatcttcataaatgttttaattaaggcatttataaatgaaaggaaattttaaaaaattatattaaatgagcgtcgaatggaaccagcaattttcacatcgaccaagcgagagtaacccggaaatgaaaaattaaaggaagatgggtgtaaggcggtgccaacatacaacgccgggaaattattttgacaatttgattagattattaaaagattttgtccaaaatgccatttttgtggattttacgcaaaaaaaaaattgaaaaatttcagaaatcttctataattctttaatggatacgttaattagagtgctcgcaactcgcaatggcaattcgtggcaattcgaattgatggaaagttctcgtgatgaactaaaagtttactga

SEQ ID NO: 53526 - DNA, 3018 bp, Heterodera glycines
  misc_feature (10)..(11): n is a, c, g, or t
  misc_feature (39)..(39): n is a, c, g, or t
  misc_feature (51)..(51): n is a, c, g, or t
  Genomic contig location: Contig_ID=SeqID_4190; Location=398..3415; Strand=-
  SCN-specific regions: Sequence locations=1-227,250-309,331-364,390 -391,421-421,443-469,492-537,569-924,946-1082,1106-1134,1157 -1341,1381-1441,1465-1620,1642-1687,1723-1876,1914-2266,2288 -2355,2418-2593,2615-2714,2743-2978,3000-3018
atgcgcgganngaagcgattccttcgtcaaatgtcttcncacaaccgtgtnggaggtggagggtctattggacgtgtgccgtgagcattttggcatttggtggctgccggcggcacatttgtcttggacacggattggatttttaaatgcgaagtgaaaactgatggacaataaatgataaaaaggattgataatcattagggacgtgaattttagtgaagaaaaatcccgaaatagttaactaaaatagtgagtaaaaatgccgaaatagtgacgaatagtgacataattttcagccaaaaattgagcaaaactaatttttattcactatttgcagttgcaaatgagttggactgggatttttaagaccaaaaaacccaaaatagttacctaaaaaaattttttaaattaaaaatttttgccaagaaagtaaatttttgagaaaatttttttttgatttcataggagtatattttgaaaaattttagctcgattcttaggggtgtatttttttaaaaattttagctcgattcttaggggtgtattttttggttttattgcatttttgttaaggaattttgcccaaaaatgtcaaaatagtgaaaaaatagtgacaaaacgccaaaatagtgatttttaactattttagtgacgaagtcgccaaaatagtgatttctagtgaccgataatgacatcagaatcgaaaaatttttatgcggaaatgcgtttttgagctcctttcttcaaatcaattgagcaaaaaaaatagttgtccaaaaaatgaccaaattttgtgattttgagccatttttagcagattttcattaaaaatttgtgcattttttgaaaaatttagcgacatttcttggaaaatttgggtgtggctaggtctgggggggggggggggggtgctgcttgcctgagctaagccaagatgtacagcaacagtttcgcttgtgtaaatcactttgccttcacagtcaagaacgatcacaaaaccgtccattgcctttttttaaatgagtgattgatattagaatcatctgctgatctacccattttctattatttaattgtgaatctaattaattatatatttaattatggaatagggtccaaaatgcagaaaattaatttattctgtattaaattttttagcatacagtaacagggttgttccgggtcacccgaatccagaaacccgaatcccgacatttttctcgtcccgaaacccgaatcccgacccgatgattttgatcgggattcgggacaaaataagcactggtaagaaaggggtctgggtgaaaattgagtagataaagaaattggttgagaaaggagaatttttgaaaaaaaaattaataatttatttcttttaaagcattttattcttatgtttttgtggtctattggctataaattttcttattgatttttgaacatatatttaaaaaaattttaattgacccgaatcccgaaacccgacatttttctcgtcccgaaacccgaatcccgacccgatgatttttcggccgacccgacccgaatcccgacccgatatttttctcgtcccggaacaaccctggtcggtacctttgcgttatttttaaatttaattcgaaattttttgaaattttgaaggctactagagaatggtagcactatcgtactgtgtcaagaatgtttcatttaaataagcaaaatttttaattttaatgatttttgattaatttcattgacctttcaagatttcttcaaatgtgattgtgtgtattgcgcttgatcgccttctctccgtgttaagcgcttctcatcgaaaccctgaccaggtactcccctaactgagaaatgtcagcgaattttcgtttgaaatttataattaatttctgtttaattttgttgtgtcccatttttaggctgcccgtcgcatgcgactgatgcttttggtcgcgtggctaaccgcggcactcatttctttgccccaatttgccatttggcgttctttccaagcctttgacaatccgccatggaatcaatggtatacaacaaaatgataaccatttaaaaatattacctaattgcattttacagtatgcaaatttgggaaattcaacgcgcaatggcacaacaaagtgacccaacgaccaaagcttctccaaaaatggtcagtcagcttgtggcattcacaattttaattgttcactttttctattgtaattaaactcaattagccaaaagcatttaattctattttaaattttcatccgttcattttttagctaaaaaacgaagaatcactgtacgtgattgcgcacatgatgctgatcttttgggtgcccgcttttatcattttggtaattttttttttgagaaaaacaaatatttttaattgtttatattatattcaatttttaattcatttctctattttactaaagtagtttatttaagctctgttacgtgctgctctcctgctgggtatacattaatagtaagccgtcactgttcgaattgacaacggccggcaaaggcattgaaagtgccgggggcgcgggcgccggtgaggggcccaacaaagcgggcgcgggtctacttctaatagaattttgactttgggttaccgcagaggaaatttttttgcttggctgggattttgcatttttcaaaagaaatatttagctatgggcgaggggggggggggaacttgggaatcgtataaaatttaatttttttttatatttagaaatgcgcgagatgaaccgttgcccaagagtcagctaccaacaggtcaccacaatgaccggtaagacaagaattcacttgggggaccttctcgaagttcaaaatttttaaataactatattttagcattaaatgacccgtccactgacaataagccaatgattgtgattaatgggcagcgagcgatcacgccgactattaacactttaatgagggaagacgacgccgacacctccaaacagcagcagcaaaaagaacagcagaggaacagttcaa

SEQ ID NO: 53527 - DNA, 765 bp, Heterodera glycines
  Genomic contig location: Contig_ID=SeqID_22817; Location=12..776; Strand=-
  SCN-specific regions: Sequence locations=1-443,465-499,521-680,707-765
  Gene Ontology: Mol. function=GTP binding; Biological process=signal transduction
agtgttgctgcttcgtacgaattcaccactttgacatgtaatttcattttgggcttaaatcagtgcgaaatgtttcatttttcctgtttacttttaaggcattcctggtgtgatagaggtaggcgttcattttgctgcaatttgtccacaaacgctttcgccagtacgaaggggcgaacatccaactgctcgatttgccgggtatcattgagggggcagcgcagggcaaaggtcagcagttgagaacctttttaaaaaacaatttcggcatttttttcaggccgaggaagacaagtgatcgccgtggcgaagactgccgacctcattctgatgatgttggacgctaccaagggggagatccaagtaaacagttgacttttttaaacctgtttgcatatgtcaataaattgtaactcatgcacttataaataaatacccaagggttgtcttttcctaaaaatgcacttttccgggagttttatttgtcaaagatctgatcatttatgcaactttctttaaattttccgctagcgtctaataaaacctcaaaggaattttcataatttttgccatttccccccgcccttcaaattccttgtcatttcattggcatttttcagaaaacgctgttggagaaggaactcgaagcggtcggaattcggctcaacaaacgccgcaaacatttatttcaaaagaaaaaatgggggcggactgaaatcactcacacagtgccgttgacactttgcacgagaactgatccaaatg

SEQ ID NO: 53528 - DNA, 217 bp, Heterodera glycines
  Genomic contig location: Contig_ID=SeqID_22820; Location=49..265; Strand=-
  SCN-specific regions: Sequence locations=1-217
atggatatgggattcgggatcattcaacgcctaatcccaggaaaggtaaattacaaaatttagtgggtgcaaatgactgcgaaaaggaattcttattgtattcttagaaaagtgagacccatcctgccgcttgttcgcttacgagagattgcaaattgagaaagttgctagcattcagaaagtcaccaactcttcaacttcgacctaaaaaaggaag

SEQ ID NO: 53529 - DNA, 1666 bp, Heterodera glycines
  Genomic contig location: Contig_ID=SeqID_22820; Location=655..2320; Strand=+
  SCN-specific regions: Sequence locations=1-113,135-412,452-1096,1119 -1201,1223-1544,1570-1666
atgctcattgtcattaaatgtttgctcggatttgatggaattattgccttatttgttatattcgtgttccttaatttgggtattcgtacattgccaatatcatttacttttgggttgaactcttctgaagtgttagtcaattttgctttttgatgtgaggctgctaattcgactatgactccaccttctgactagtggctggactaggcgctcgagaaagcactttgatgaaaaagatataaataaaattcgtcagcttaacaccgaggtcggcaaaatacgcacaaaaataaaacacatgcagcacaatttgaccatctttgaaaatgctgcgcttcagcgcgaccaccaaaaatctttgtcggaatatgaggagctcatccaccagcagaatagtgcatttgttgaggaattttttcaaaaacatcccaaaaattattggcaaattattcacaacaattataggggtcttacagaacattttcagaagatagaagaactgcaagcaaaggcagtagggttaaaggataatgcctctttcgaaaagcaaatagagcgagcaaaacagatgattgagtacagacgaaagagattcgctgcgctggaatttgagggccaaaaagcgtgatgagcaacaacagtttgttgcagcagcagcaaatacaattactgcaccgactgcgtcggcattgatcggaagagaggcgttaaaaaaacgtacaggcatctctgccagtacggatggtgaagtaggtgataaagcagatgtcggtccacaaacagctaccacaacaacacatggggaggtattaaaagagaaaatactggagcagcaaaaacacacggacaacgatgataaagcagatgtcggtccacaaacagctaccacaacaacacatggggaggtattaaaagagaaaatactggagcagcaaaaacacacggacaacgatgataaagcagatgtcggtccacaaacagctaccacaacaacacatggggaggtattaaaagagaaaatactggagcagcaaaaacacacggacaacgatgataaagcagatgccggtccacaagcagctaccacaacaacgcatggggaggcagtacgtgagaaaatattggatcaacaaaagcgcacggacgatgatgataaagcagctgtcggtcagcaaacaatcccaacagcaacaaaaacacatggtgagacgttaaaagaaaaaatatcgcaagagcagaagcacctagttgacgataagtcaaattctgccaatgcaaaacaagatgatggtagcggtactgatgagaaaatcgcgcatggtcaaacgctaattgcccgacttaaacagagcgaggagcagaaaaaagaatggggggacccatcccaagataatgatgatgatgggcgagcgccgaagcatggagaaatgctgtggaaactgttgcgatcaacggtgccgactaaccaacagcaaatgggcgatgtcatccaccaccaatttgctgatgctgaacaaacccgtggacgaggtactgatggagctgttgaaaaacattttagaagaaaaaactgacactgcggatgcacgagcgaaattatcaccatctacggaaatcggcctatctttcttcaacactgcgaagaggtgaagcgtgaaggaactga

SEQ ID NO: 53530 - DNA, 1217 bp, Heterodera glycines
  Genomic contig location: Contig_ID=SeqID_22821; Location=36..1252; Strand=-
  SCN-specific regions: Sequence locations=1-111,134-269,291-431,454 -860,897-1083,1106-1217
atggtgttatgcgaattttctgaacttccgaactttgcaatacgccggcgatgttcgcaaccaattggccaatgcgatgatccaaagactcaacatccaagtgaatgaaatgttttatatttttattttcaaatgccgttttgttagcttgaaagtttgaagccgacttcgccgctttacccccacaacattttgaaggctttgctcgccgcttcgttcatgaaagtgagtgaaagctttttgaaattggaaatccatcttagacagggttctcaagttaatgaaattttatgggcaaattttgaataaattagtttttaaaaatgaaaaaatgccaaaaatattttcatttttttgtttacatcaacgaaacaaaaaccaattcgtttggagatggcattcgtaaaaaatgcattttgttacttttaagttggcatatttctattcttctggcaccggccacacgtctcaggcgcgcaaaggttattatgtgacggtggaaagccaactgaatagaaatgggaagcaaaatgctgtcactgacgaatacatgctgcacggctcttctgtgttgtataaggtggcaccacaaacaaaaacaaaaaaggatgactcatcaaattcgaacattcggagccattagaaaaataatgcaattaaattatggacgctaatgatttttttttaaatacgaaataatccggctaatgattgcctgtttgctttcttcaattagcttatttaacgggatttttaattgggttatttaatacaaattgtcccttaagcgccctttgttgacattttttttaattttgaggtgtaagcccaaaacggaaaataccacattttctttcccgaaatttaaataaaaaatattttttttatttaaaaaagcaaaaattttgccaaagattgtttttgttatttaaaggtaaaaaaaaataaataaaagagaaatttgaatgggattgcgtatccaattaaacaaatagcatttttatatttttgattgaacgcactaattaatctaattaagccccccccccccaatattcaagggcaacaaacagtacagcaatcagaagccggcctgggtgctgttcaacgaggcggtccaacgcgaccactccgaccgccgctttctgcatacggtgagcattgtacgcccaggatggctggacgagttggcgccgcactatcgcatcatagaaggg

SEQ ID NO: 53531 - DNA, 238 bp, Heterodera glycines
  Genomic contig location: Contig_ID=SeqID_22821; Location=1328..1565; Strand=+
  SCN-specific regions: Sequence locations=1-81,115-238
atgacgaagcgaaaaaagtatgcgtgtggggcgatcggagggggtgggtcatttcagtacggaagagttgttctaatgatcaattaattatttaaatttttaatctattaattagatttgttaccataattataattctattattctctatttcagtttacacgaccacaaaaaaagacacgaccatgttatattttgataaatttcaggcaacataactttttatagaagcacacaa

SEQ ID NO: 53532 - DNA, 2250 bp, Heterodera glycines
  Genomic contig location: Contig_ID=SeqID_22822; Location=167..2416; Strand=-
  SCN-specific regions: Sequence locations=1-29,52-58,80-102,125 -498,534-718,755-1366,1388-2250
atggaaggtgggaccatttaaataatgcaaaaaagcaataaatttgaaaaatgaacaaatttcaaacattgtaatgcataaattgaaaaactgacccgaagattttgtttttgtactttgccatcgccgccaaggccggaggcattgagcacgaattgattgggctttatgttgatctgatcaccggggattgcctttccgaaacgatttgtggccaccaatttgacatagcccggcctaaaattggaccaaataagccatttccccggggaatgccaaggaataaagccacctttggccccgattttcaaactccaaccaaaaatggttggggtcgtccggccgcagcacaattgcctgactcgaagccgcctttttggcaatgccatcctcgtaatttgaggcggacagtccaacgcaggcgctgcccccgtggccgatgagttggaactgaaaaaggtggcacaaacaatgcaaaaacgcgacatttttgaaaaattctctcccaaattttgttttccaaaattttttgtattggtcccccaaaaaacgcacactcttcttgaagtgttcacaatttgtccgctccagcaccaaatgcgcaaaattggtctccactttggtcggttggtattgcacagcgatttcacactgtccgccgggctccattattggcgcagtgacttccacaatctaacaaatggtaaacttggagcagtttttttaaattttaaataaattttttgaaaaaaatccatggtaaacgaaaccggcgttcggtgggagactttctcaaaacagtctatacttattaagcagctacttttataaaatttgcatattagagaaagtgccgccgataaaacggaggaaattaacaaagaatttatgacgaatacgtctccctcctgtatcgtttcctgttcggaaaattagaaaaataacgatattttccaaaaatgtttccaaaaaatcgctgaaaattttctttaaaatttttttttctcgacatttcttagttggcgtgggaggggggacgaccatttcccggcgggtgacagaccttaaagtttgactgtcgcgttgcccccgtttcgtccgttatttcgcatttcagtcgcatttgcattgtgtccacattccaaactttcagtcgcagcgtcaaacagtcgccgaacggcacacaataaaagttcagtttgtccttgccccgctcaaatgccaatttgctgcgtgaggaggaactgaattaaatgggtgtgccgattgtattcaaagcgagtgaataatcgggctaagtttggctttttttttattcatgattggtgccacggcaccaaaaaacagaaattggaccgactcaatgccttattaatgaatgagaaaatgcgttacgccaggtccatttccgacgcgcttgagacgggtcgcgaattgcgcggttcgtcgaatttcggcattttcctataggcggcgatcaattcggcggttgtggctgtgtcccggcaactcgacaacggcaaatcgtcacgcacaaaacgcttgttcaaaatgtccaaagtctgctgatctctgagcgcggcggcgtccaaagcggcgggtgcttttgccttcatccgcttttgcagctcattctcgagaaaattgcagacgcggtccttctcggaaatgttcaaggcctgctgaaagcaaaatggggagggaagaagtcaaattcaaaaagcagggcatttaaaatgttggtgggcgacagccatacattaaaaaggggggtgggtcggtaaaaatttttgcgaaggggggtcggccgccgatgacctttattttgcttttcaaaaaccgtttctttcggcgcgctttttccaaaaaacttttcgggaacaggggggccggcggtgccactaggcgccgccgggaaatttttgatctttgggtgtgatttgttaacagattttcaccaaaaaatggccaatttttgcgattttgaaccaattttttaagaaaaataggaattttggggttcggcggtgccgccaggcgccgccggggaaattttttggatttttaatgaatttgttaagaaaattttcaaaatttccggtttctatttccttcatttttttactgtaatttacaggaaaagatgacgacgacaaaattacggtggaagagttggcacgtaagaaattctcccagcaaggaatggctttaaatgtgagatggcttattgttaacaaaagcatgctctag

SEQ ID NO: 53533 - DNA, 767 bp, Heterodera glycines
  Genomic contig location: Contig_ID=SeqID_22823; Location=417..1183; Strand=-
  SCN-specific regions: Sequence locations=1-390,414-597,628-711,736-767
atgaacccatccattgaagaagtcgacgggtcagaaattgagatgatgaatgacactgaacttttccggtgagtattttaaagctttcctttgttaattgatcacttttgggtttttattgggttccaatttttgccattttgttacgcttgtccaaaaatcaaatgatttgggcgattctccgatcgatttgcttttcttttcattaatgcgcttttcagcaaatgctttgggcagttatcgcccgcggcaattcctttgtttaattcgcttaattctatcagtcagataaaagtgaaaagaaaaggaaaaacggagaaaaaaaagaaacaaaacaatggttactttttcccattttgctgtggaaatgcggcatttgccacgtttctcttctgttttaatctttcttttatgtgccaaagctcaacttacattatttcattgctaaatgttaaaagagtctaaaagtggtaatacaatttgtttttcgattttttattcattaattttaaaatggcaaaaaatgatttattaaaaattgccgtgttttggtgatagaaatccaaacaaaactaaaggacaaaaagagaaagagccaaaaaatgaaaattattaaaaaattattatgaacaacaattgtatttgtattagcatgaaaagaatcggtggagcaaaggtacggcaaaaccaaacgaaaatttgaacaaattgttggccctcccctttcccccctccgaaatttaaggaaaacaattgtggaaaataaa

SEQ ID NO: 53534 - DNA, 672 bp, Heterodera glycines
  Genomic contig location: Contig_ID=SeqID_22824; Location=623..1294; Strand=+
  SCN-specific regions: Sequence locations=1-255,277-672
atgcgtgggcgccatctccgcaatggtcaaggcctatctgccggcactgatgtatgtcagccgccggtgtttcggtcctctcccaccccgaaaaatttttctaaaaaaattcataaaaaaaaatcgctggaaattttttttccaaattttacttcaaattttctaagtcccgacactcgttaattgcagtcgcttcgtggagcttgacgggcccgcccggctgatgcgctgttttgaggacggtgtccaaatgggcgcggcgcccgagggcagcggcgtccgcacaaagttggcccaccggtgcgctgtggcggcggtcgcgttgaagcgcagtttttccgtcgaaggtgggcggaaaagacctgctccggcctcaaacagtgaccagcggacccaaattttatagtgccaattttatagcccgtttcccaacaaagctttttctcgcgcatgcgttcgattcccacccaattcctgcatatttttttcaaacttgcaagaattttgcaaaattatttgcaattctcgaatgaacaatcagaatttgatttcagtgctgaatgccaacccgagctttcgccgtgtggcccaatgtccggccgaaatgcgtgccgtgttgtcaaatgtgaatgaagacggcaaatggaacgacacacttgaatttttggcaga

SEQ ID NO: 53535 - DNA, 542 bp, Heterodera glycines
  Genomic contig location: Contig_ID=SeqID_22826; Location=519..1060; Strand=+
  SCN-specific regions: Sequence locations=1-3,25-319,341-448,470-542
atgccgccaagaggaaaagctgaggaaaaccgcacaaattgcacggcaattcagcgaacagcaaaaccaaatgagccaaataaacgaatggtaaggcaaaaaaaaaaatgaaaagtggacaaaaggaaaaaacgaaacaatgtcaggcgaaattaactggggaagaggaatgccaattggaagcattggagggacaaatggtcgaactgttgggccgaattgacacggagagacgggaagcagagaagagtgaaaggcaaagtgccaccagcagacaggtaaaagattaaagcgatgaaaataggtgccaattgggaggaaattaaaaaaaaaattttttcgaatcatcaacaatttcttaattttttttgaaaatttcttaaattttctggggtaaaaccctgcttcctaattaagtaattatcatatggaccatatccataactagaaaacaatagaaaatttaaaaagatttgatgacataaaacaataaggttttttggggccggcggtggataaacgccgcagggcagggccaaaaa

SEQ ID NO: 53536 - DNA, 2606 bp, Heterodera glycines
  Genomic contig location: Contig_ID=SeqID_4191; Location=30..2635; Strand=+
  SCN-specific regions: Sequence locations=1-241,271-836,887-1152,1174 -1184,1294-1413,1438-1448,1470-1797,1819-2170,2193-2212,2234 -2384,2406-2606
  Gene Ontology: Mol. function=protein binding; Cellular component =axoneme; Biological process=N-linked glycosylation
atgacctcaaacggtgcgttggtggcggcaaagacaccgccggaggtgcagcgcgagttcgcctcgctcgcccaagtgccggtggtcgccgggacggtcaaccgcggctcggaactgatcggtgccggctgttgcgtcaacgattggatcgcattcacaggcgagtggtggtggtgccgtgccgtgacataccaattcggctttttcattccaaattaaatacttccccagcatttttcaaactggttgggtatttttaaataatttcttcgatgaaacaaaaatctcggagttggggactttatttttcaacgctctcatacggaactttattaatcggattgaagcaaactatattcagaaaagacataaatcccaaaaactgaaactcatcaagcgaattcggccgaattgtttagttttccaggaattggcgacggatgtgggcggggctgtcactttaatcaacaatttttatataattgtaaattccgttttcccatttgcaggcctcgacacgacctccgccgaactgtccgtgttggagtccatcttcaaattgggagacgcggcaccgagcgcaatttccaccgatttgcgcgacactttgatagaatcgatgctttgaatgacaaatttcaaaacgaaggcggtggaggacagacacaaaaacgctgacattttttccgaaatttggtaatagtaccgatggtagtcccccttttttgaaaaaaaagttaatttatttgttttgtttttttctcaaacaaaaaatttaaggagtcagagaacgtagatgatcttagagcgtcatgcgagcgaatgtcggctgagttggaacaggaaaagaaggagaaggaggaagaaaagaagcaaaaggaggaggcaaaagcccgtgttgccgagttggagaatgaaaacgaacaattgaaaaatgaaatcgaacaattgaaaaatgcgctcaatgcagagcggagcaaatcaaaggtataacagaactgattcccttttcattggtgaaacgcactttgtcaggcggaaggccagcgcacaacacacacggacgaaccaatgtctcgcatggagcgagacttcctggccgctcaaaatgtggtcgatacgctcgaggaggacgtcgattttttggtaatcaaaagttttaattgaaaaaatttaatctttgaagaaggaaaaggaaggaaaaacggacgaaaaggaggagaaagagaagcaaaaggaagaggaggaaaagaaaggcggagaagtggaggaagaggaggaaaatgagaaggaacaagacgatgaacaaaacggaggaaacaaacctaagcgagctcgtttcatgtaaatggttatgtaagatcttgttggcatggaaataaatttaaggctgcaaaggtattaatttgttaattgtgatttatgtaaattgaaaagtccaataactctaaaaattgatgtttaaagccgcattttgggaacctaaaaatgattccggcattgggagacgttcattcagaggcgcacaaaaacgagtaatggcgagaagagttggagttggaaattgacgagaacgaggtacgtaggtggacgggaacggacatttgggcccaattttatccgtttcatgcaatttaaaacggtagctacaacgaaaaaaggcatataaaggcgttaaggtggccgacttacaattagtatcatttttcgacgggggagagcggtaatttcgaacaaatgacgcgggttttaagattaaaatatgatttttcattcgtagtcctttaaatctccaactttaattttattataatataacactctattcgagtcgaaaaatataataaaaatagtcaaaaaaaaccaaaatttcaacgccatttcagggacttcgatcggaccacatttgaacacagcgagcaattttcttctactgacaataccacggtgtttcttggtgcatttttgtgacattcatgtgacgagacgattcatttcccctttttacaaattgaggcaatccttacacagcaaggcatttttatatatttttcatggaggagagattttcccaattttagtgacactttcaagaaatacttggttttctacgtatttaatgactttttgaagccatttttggatctcatttataataactaactaactgatttttttataatataaaataactttcttccaaattcgaatcgaaaaattattttaaaaaataggcaaaaatttaaatttcaacgcaattatttcacccctcgccgttcagggacttcgatcggaccacatttgaacacagcgagcacatccaatcgttgcgcgacaaccccaatttgtccgcccaactcggcgttccgttgggctgtgcccgttcctccggcctcccttcactcagtgccaaattcgccgctgccgtacgccatgacgccggcggcatgtcaccctcatcatcggccatgccaaccgcgcaacagctgcgtgccgaacagtcggccaaattggcgatggcacacgtgcgacggggtgccgaactgacgcgggacaacaaatgcttcgaggctatccaggttgtccatggcacgggcatcggataa

SEQ ID NO: 53537 - DNA, 1273 bp, Heterodera glycines
  misc_feature (1168)..(1168): n is a, c, g, or t
  Genomic contig location: Contig_ID=SeqID_4192; Location=972..2244; Strand=+
  SCN-specific regions: Sequence locations=1-209,231-662,684-897,919 -947,969-1053,1075-1273
atgcaaaacctgcaacaaattcaaagtcaacgtgccgaacagaaatatactcttaatgggtatatgtacgtcaaagacaaagtcagtgcaagtggaatggtgcaattctggagatgtgaaattcgtggctgtcgtggtcgtatatggacgaatttggaagatggctttttagtttcagagcacggaaaacatatttgttcagaagccggcgatgctgtaaacgttgaattggcaaaaattcatacagcatttcatggacggcacattttcggcttctcctccgctttttcaacagatttatgtcattctttctcgacgtggtgacttcgtttttccggtgttctcttttgtcttcttcgaaacaaagatgcagctacatatgcgaaacttttccaaatgatcaaagatatttggccacaattcaacccagattccattagtgtggattttgagcacagcattcatttggcaatctgcgaatttgctgagaaattagatgctgttttttcacctcatacaaaacctacgcaaacatttgtcttcagcacatcttttaggtcgttacaatacggatgcaaattttgcacttcattctcgaatgattactgcgattgcattcattccggaagaggatataattcggtccttacaggaactcgaagatcatactcttgatcattatccggaacttgcgcctatttttgaatggtttactaacacttatgttggaagaggaacaagggcacccccaaatttttcctatgatatgtgaactgtttttcagcgtactttggaaggcagcgaccgtaccaacaactatgccgaagcttgcaatcgaaaattgaaaatcggatttggctatgctcacccacatatttgcgttttattgacgatttaagaaaaattcagaaaggtttagatcagattatgaagaatatgttagaggtcaggaaggtccatcaaaaaggccaaggtacaaggaaccgatgagcgaatactgagaaaagtgcaaaattatgaagtcggcaatgttttggagaaaggttgcaaccccgaccccgcccctgaaccccgacatttttggccatttttcggggaaaaccccgaaccccgaaaccccgacgcttcataccccgacaaccccgaaaccccgaccttaaccccgatncgggtcagggttaaatatacacccctaagaatggcatttcgtgggagaaatgcaaaaaagttagacgaaatttgattttttttttacatttgccaaattttataa

SEQ ID NO: 53538 - DNA, 56 bp, Heterodera glycines; identical to SEQ ID NO: 52733
  Genomic contig location: Contig_ID=SeqID_22831; Location=511..566; Strand=+
  SCN-specific regions: Sequence locations=1-56

SEQ ID NO: 53539 - DNA, 313 bp, Heterodera glycines
  Genomic contig location: Contig_ID=SeqID_22832; Location=257..569; Strand=-
  SCN-specific regions: Sequence locations=1-156,178-313
atgtatccgcttcaactcaagctaaatttcttggttatttttattcgagaaaaaacttttagaagaatttgtttttaattttttataggaaaaatcagttttttgatttttacacttttttaggaatcgaccaaccacggttaaagcgttcatcagatttaaattttatttcatttaggccattgtctgtgcaaaaggcgggcaaaatgaacgcaaatattctttgaaaatgagtcccgggccagcggaagaaaaagtgaatggattattgggaaatgacaaatgaacgataattgttagggcatgtaataaa

SEQ ID NO: 53540 - DNA, 654 bp, Heterodera glycines
  Genomic contig location: Contig_ID=SeqID_22832; Location=682..1335; Strand=-
  SCN-specific regions: Sequence locations=1-354,376-532,586-654
atgcaactgctcggaaagtggtgtccaaatggttgcacactccgacaaaagatggacagccgaagcgattgcgttgtacagacactgatatatcaagaaacataaaatggatcaacgatttcaaagaagtacggtccggcgggccacacacttcgccaaaaaacaattacctacctaattgcattttggtttttgtttagaaatttatcggtgccaacacttcagtgaatttcattgttcattttctgctgtacccgtcaacgccaattgtgccatttgcactggtgaacaaccgaatcaatcaaaagctgacactgagcaaagaaacagattattattgggtgatgaagcgatgccaaattgggcaaattgttcagtgggaggagcaaaatttggcggacaatttgaacaatgtcaactttatgctttatgcagattacattgggtgagtgagaacagcttttgccattgctaaagtggtgctatgtcaattcttaaaagtgcaaaaatcaaaagtcagatttttcctatgattttttaatcaattttttaattataaatatgttaaaatttaattaaattaatgcttaaatatacgttcttttaaaatttttttagatctcgaataaaataattaaatttgccttaaataaa

SEQ ID NO: 53541 - DNA, 366 bp, Heterodera glycines
  Genomic contig location: Contig_ID=SeqID_22833; Location=46..411; Strand=+
  SCN-specific regions: Sequence locations=1-16,52-366
catttgctgaacaatacttcttcgtcttcgtcttcttctgccgatgatgggccatcgtcgtcgtcgtctccgtcttctgtttctgctgccgacaacaccaacaaaacgccaacatcatcatcttcgccatcgccaattcgtttctgcatccgattgaccgtcaacgattggggtgagccggtgcagcggttgccgttccgttggctcggcagttcgctcagcggacagtgtgtggtgttggtggagcgtcggccggtggacaacctgaacgtggagctgtgcattgtgcgatgtccgtacatggaggcggtgcagcgcgggctcatggacaacgcggtgacaatgaacgacttggaggcaagttga

SEQ ID NO: 53542 - DNA, 367 bp, Heterodera glycines
  misc_feature (31)..(31): n is a, c, g, or t
  misc_feature (55)..(55): n is a, c, g, or t
  misc_feature (73)..(73): n is a, c, g, or t
  Genomic contig location: Contig_ID=SeqID_22833; Location=1291..1657; Strand=-
  SCN-specific regions: Sequence locations=1-86,109-197,219-229,252-367
aaaattcgtggcagtgcccaaaaatactccncaaaaaatgccagttttaatgacncatcctccatttgtttcncaattaaatagctcgatgccatttgccactgccaacattgtcctgtcgcctgtgtatggcatgtggctggagctgctctcccgggacatgccaccaatgcttttcggtaaatttgtgccctatcaaaaaagaaattttaattaactgtaaaaatgccaattctcccccattcaatttttcagtgcgcggcaaccgcacatccgtgatcacacacacttcatgaaactcttaattattgtgtgtattattgtttttttttgtctcccagtaattatgtataaacgaaaaagagaa

SEQ ID NO: 53543 - DNA, 851 bp, Heterodera glycines
  Genomic contig location: Contig_ID=SeqID_22836; Location=14..864; Strand=-
  SCN-specific regions: Sequence locations=1-623,645-734,764-814,836-851
atggctttctcaggaatcgcttcaactttattaaaaagtggaagaacaatacacaatcgatttaaatttccgctaaatttaaatgctcagactgtttccggtgttgtccaaggcacaaaggctgccgaagaaataataaacagtgatttttttgtgattgatgaagctcctatgacaccacgatttgcacttgacgttattgataaaaaattacgtgaattaactaaatgtaacctattatttggtggaaaaactattattcttgctggtgattttagacagaccttaccaataaaaaaatttgcagtaaaaagtgaaattgttgatctaacaatcaaaaaatctgttttatggaacaattttgagcaattgaaattaactataaatatccgagccaaggacatatttgcaaaacaaattcttgatataggcgatggagttagtccaaacagcttcattcaattacctccggagtgtattttatcaaatgaatctgatttaatcgatgaaatttacggtgacatttttttaaagcataattttaatgaattaaaaaatcatataattctaaccccatacaacaatttgaccgataattataatgaaatagctttggataaattcccaggaaaatgcgttacttatcttagtattgatgaagttgaaacaagcaataattttccaattacaccagaaataatgaactctttcaattctcccggttttccattgcatgaattaaaattaaaacaaaattgtaaagtaatgcttatgcgaaacataagtattgaaaatggtctttgtaatggtacaatgttgcaagttatagaattaaaagataatatgttaag

SEQ ID NO: 53544 - DNA, 1020 bp, Heterodera glycines
  Genomic contig location: Contig_ID=SeqID_22838; Location=323..1342; Strand=+
  SCN-specific regions: Sequence locations=1-1020
atgacgcccaaggtttatccatgctccgcggagcttactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgagatcgaagaaagaagtgaatgagttggccaaggtctgggagccggagtcccaagtgaaggtcttcaaagaattgggtgagaagcattttgctttgggagtggtcaaggatgttgaggtgctccacgcagagtacgaaaagttggaactccacatcgtcatcttcttgaacaacatccaagaaaggaagaatgtcgacatcgcaagaaaagtggatgagttcatccagggtggcagtgttgtcatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaagggccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcgattgccttattttccggttttgccagatgcaaatacacggatcaaataagagatgtccaacgacacacgctgcccaataaagtaaactctgaggagttcgtcaagcagttatcgcccaatgtacagaagcag

SEQ ID NO: 53545 - DNA, 62 bp, Heterodera glycines
  Genomic contig location: Contig_ID=SeqID_22839; Location=769..830; Strand=+
  SCN-specific regions: Sequence locations=1-2,26-62
atggaaggaagaaagaaggaaagaatggcacgtctgctgaacattgtgccgaccgtcgtgtt

SEQ ID NO: 53546 - DNA, 2213 bp, Heterodera glycines
  Genomic contig location: Contig_ID=SeqID_4193; Location=849..3061; Strand=-
  SCN-specific regions: Sequence locations=1-52,74-205,227-249,273 -1221,1243-2113,2135-2175
atggtaattttgtgccattttcgcccaacctcagataactgaattcatacaattttttaaattttgacagaaaaatgattattcggatgaaaaagaattcaaatttttcaaaaaccgctcggaagagatttatgagaattatccggcactaagccaattgttggagggattatttgctgctgtagtttcagcaaatgaggcgatgaaaaagggtaaaacaaaaattagtcaaatttttattggccgaaattttgtaaatttttcagaaaataacaacaccttatcttcgcgaaagaatgaactcaaacagagtttggcatatgccgtgtttttcatggcaaaacgtggccaaattccactggaaagccccctaggggagaaggaaaaggagccaaaagaaatttcgattgagctaattgacatttatgatgagttgcaaatggacgatgggattacggtagaaagttgccaaaaaagcgacgaaaaagaaagaagagaaaatgggcaaaaaggaagaggaaaatatggccaaaaagaacggcgtattgttcaatttgacgcgcgatcattggaaattgaatggaacgcaaatgcatttattgctgatggacaaaataaggacggcgacgacaatgatggtaattagaaaatatctgttttaaatgatcgggataccccctaaatacactgaaaatcggggaaattttcaaaaaaatccagtgtcgcattttcccgctctcaacgtggtgtacctatacattaatttaagacacaaatcgtcgtcggagacgcggcaaacggcgcaatgcgccggcgccgggatacgccgaatggtgctaggtcacttcgcgaatcggcaaataagatgacgtcattaaaaggggcacttcgcgaatcggcaaataagagggattcctgaattggtaaaaaaggatgacgtcattaaaaggggcacttcgcgaatcggcaaataagagggattttcgaatttgacaaaatagaataagttttatgcgaagttagacgaacaaattgccgaagccgttgatgaatacgaagtataaataatgaataagcaaaattagttatgtttttaaggggatcctcgaaacaaaatttcatgaagacgaagatttccaacaagtgtcagatcattatttaagtcgaatttcgtttttactccttcaaatgaactctaaagggacggcaacaagaaaagaagagaaaattagagaagttaggggcggtaatttaagggtgaaaccccaaatattttagagaaagcgccaatttaagagttcggaatatgattcaattgagtattcttcatctgaaccagcattggttgaaagtggatcatctgaaaattatattagagctgaaaccccggatatattgttttctgaagctcccactaaagaattactcgaatccatgtgagaggaattagcgggtctcagggtggggcggagtagtgatgctcgagagtctcggtctcgactcgagaaaagtctcgggtttttttggtctcggtttcgagtctcggtctcgggttttcagtctcggtctccgagaccgagactgacttttttatacaccgcgaaaaaaactaacgaattttttgtttggtgcgtttttggattgataaatatgaaccaaattgaatcaaaatcaaaaaaagcaaaaattagttaagaaaagagtcaaaaaatttttttaacaataacgagaggaggaaggttcgtcgaattgagtcccggagtttttgagtaaattggaagggatcgtgggtttatacaatacaaaaataatctcaaaattttgaactattgagcctaaattaaattgcttttcatacacttcacggttgtctgctgatgatatttttacattcaatcgggcttaaaatcagcataattttttagtagctgagtttgctcagttttccaaagtgtccctatttttatgaacaccccaattgaaaaaaaaactataaaaaaatttcccctccttgttccgctttctcacttgctgtgcttaagattttcagaattgctatgtatgttacaaaatttcagctccatcggtccatggcaagtggtcaaactcccggaaaaacgggcgcccctattttaaattaacacacaatataattcagatggtaaaaaatgaaaataacttaatatatttgttattaaaccaaaacaaataaa

SEQ ID NO: 53547 - DNA, 191 bp, Heterodera glycines
  Genomic contig location: Contig_ID=SeqID_4194; Location=22..212; Strand=-
  SCN-specific regions: Sequence locations=1-191
atgccgaacgtttattttttatttttcgtttgcctcgcggccatggcaccggcggcaacagcaggcgacagcagccttgggaaccttgtctatggaccgccaaactgcggaccgtcgccggcaccacaaccaccacatgcggaaaagttggcaatggaggacgacggcacaggcaccaactttggatggtg

SEQ ID NO: 53548 - DNA, 574 bp, Heterodera glycines
  Genomic contig location: Contig_ID=SeqID_4194; Location=3709..4282; Strand=-
  SCN-specific regions: Sequence locations=1-143,177-191,214-391,416-574
cgctttcatatgatcagcaaaaggcgacaccaaatgaatcattttggccgaattttcattgaatttttctgctttgatgtcattgagaatggtgccaatgccattaacctaaatttaattaaattattggcaaatgccattggtttatttaatattaattcattaaaaaataattagcaaatgcaattggcttaattttatattaataaaaaagcgatgttttcacattttcattcaattctccgttgatcactttcccattggctttttctcggattgcgctttgctggagatcgatgccaaattcgagaaagaaaatgggaatggtttcttttatctccataatttgttcaacggaaattgggaaattgcgcgtcattttgatgcttaattaacccaattaagtaaaattaattaatgacatcattaaatctctcattatttggccatacaattcgtctgtggtagaaaggttcaagaatgtttcaaagacaagcttctgttccttttcatcccgatggatgcaaatttgtacagaaaatccggcaacattcgtttcattaagatggtcttg

SEQ ID NO: 53549 - DNA, 1930 bp, Heterodera glycines
  Genomic contig location: Contig_ID=SeqID_4194; Location=1953..3882; Strand=+
  SCN-specific regions: Sequence locations=1-118,143-309,337-347,397 -397,442-670,710-900,922-973,995-1026,1065-1241,1263-1930
atgaagaagacccaattttcaatgctttatcctatcaaagcatttatcaacgtcaaattgtccgatgcaaaaaagtggtggaaaatttgtcggattatttgtgatgatttggccaataatttgtaaaaataaatgaataaattacttttgtcatttatcggtgcccacaatctctgctacaaaatgtgtggtcgttcgtccgctttttcttctgttggtgccttttccccacttttttacttttttacacatcgacacagaaaattcagtgattggtccaacgacggaattcactgcttccatcccgacactttcattcattcattcatttgatttgatcatttgtgaaataaatttttttttcataaaataaatcgaataatttttttttattttcattaattaaatagtattaatattcattaattaattaatcaattagcaaatgaattgcttttctctattgaccgtctttctttgcttggtcattaattgttcatctcctccaatacggtagtttcttaaatgaaagtaaattatttttttgtaaatttttcaaaattttcaatttttcagccctttgtcatccgacgttggcatttggaaattatgcaatggcaaaaatggaacaattttggtggaaaatggatgtacaaagtaaaatatttccaaaattttattttaaattaattattttaaatcatttttaggctcctcctctgttaccaaagcgaaatggccacaaacagaaaaattggaaaacgttttggagtgggcaaaggaaacattggcaaactgaaatttgtggaatgtgccgaagagattgccgaagaccaatggcacggtctgatcattacgaagcaccaagacggagtgataagctacgaatcgaggcaaattgagagaaaaaatattctaaaatatcaatttaatgaattaagccatggattcgacgacattttcggcaccgaacaaacgaaacaaacggaaaaatatttggaaattaatttgaccaaaagtaaagccaaattaataataatattttaatagcaattattattttacagatgctgaaccactgggaaacgaacttcaaaaagcgctttcttctgcagcattttttgacgattttatgccatttgttttggcatttgaatttggcgcaacattttgcgcagaaaacggcggaggcacaaaattgtgcaaagaaaaagtccaatttcatatttaaaattctcaatttaaaataattttgatttttagtgcctttcccaaacattggtcgccccaaaaacaaaggcaccgtttgttggcacaaccaaattccatggaaaaacaaaaacaacaacaacaacttcaatcccgaccaccaccgaacggcaaacatttgcgtttgaaccgttttccgaatttgtgtctcattttggcactaattgttcgaaaatcgttttccccgtggaagtggccaaattcattttgaacatcaccgctgtgccctaccgaattgcatgcaatgagtatgaacaagattacgagatcggacaatcggtggagctttatttggcaaattcaaacaaaagttttttcaatgcttgcatggaagtgccgacaaccaaatgcgcaaagtgattgaaattccggcacaaaatttggtgccaaattctcacaaattgtttttaggcatgtggaactgagcgcatgctataaaagcatgaaaacagtggggccaaacgacaatgtcgtcgccaaattatgccaagaccatcttaatgaaacgaatgttgccggattttctgtacaaatttgcatccatcgggatgaaaaggaacagaagcttgtctttgaaacattcttgaacctttctaccacagacgaattgtatggccaaataatgagagatttaatgatgtcattaattaattttacttaa

SEQ ID NO: 53550 - DNA, 73 bp, Heterodera glycines
  Genomic contig location: Contig_ID=SeqID_22840; Location=52..124; Strand=+
  SCN-specific regions: Sequence locations=1-73
tgacgcggcgaagccgcgtccctgagcgcgaagcgctttccccacagcaacagaactcaattgataatgtttt

SEQ ID NO: 53551 - DNA, 1052 bp, Heterodera glycines
  Genomic contig location: Contig_ID=SeqID_22841; Location=550..1601; Strand=+
  SCN-specific regions: Sequence locations=1-1,23-167,210-703,726 -849,871-914,963-994,1024-1052
atgggagagaaaaaacaaaaccaaactttgcagaaactgactcaaacgccgccaatttacgttcacaacgcatcgcaacagccgcgccaagtccgtctttttgtggtgcaaagatttgttgatacaaatggaagaacaattggtaacaaattacatcgtaatttttgtatcttgcccccttttttgcattttatttctattagtgatggttttaccataaatttaagctcaacatttcagaggaattggtgtccgccccttcgcccatcgccgtgtttagctctttgaagacaccgaacgaatcgcccaaaaagcggaatttgcaaagccaacaaccccagcaagggatgagcagcaacaaagcgacgggtgagcgaaaaatcgggaaaacaaatcttaatttaattccaggaagtgccgtcgtcggcagaaagtccgccaatccctacccattgcccaaggagaccaaaatgagtttgggcaagaaggttcgacgcatggcgagttggctgcgcaagaccgtgtcggagaaggactgcgcactgattgttttggtgggtttgcccatctgatatttcattttattgctggacaatgcgaaattaaggccattttcgtcattcttgcctttgggatcgcaattttgcttaacaacttttatctgaactgaacgccatgcatatttggtgaaatgagtcatcgcagaaccaacgaacgaacgaacaccttttaagactaaataatttatcactaaacatacataacatattccatttaaccctttttatattccgatcacattatttgcatatcattcgttcattttcctgccgctttttccttttcctaatttaattgatttttctgtactataaccacacacacacacacacactgaacagtttgtaaatgaatttggttgtctattgtcattttcacaatttctatttttcttattttaagaatatattacagatttcatacataattaattaaatgatagtttattttgtttggttttgtgcggtggtgctccccccccccttctgcta

SEQ ID NO: 53552 - DNA, 1287 bp, Heterodera glycines
  Genomic contig location: Contig_ID=SeqID_22846; Location=501..1787; Strand=-
  SCN-specific regions: Sequence locations=1-109,170-309,354-408,434 -466,513-649,671-840,862-1287
atgtccgcaattttccgtccgctaatgtctgtaagccgtataatgcagagtacgaaaaagtgcaatgacattaatcggcacaattcggcccaaaatgatggcttaaaccttttttattaaattgaaaattcattcaatttaattatttaagaattattaaataattatagaagcaaataattatttgtaattgttaattaattactcaatgatttttaaacaaaacctaattggttatgtttttctaacaaatttaaaaatttgagtttttggttgtttagttttctcattaagataaaatccataggcaaattttatttttaactttttttattatgttaacatttttttttgttgcttaaatcacttaatattaaagtaaagattttcctttttatcactttttactaataaacaaatatatttttaaatggcaatcaaatgagaagaagaacacacttttgtgttattttaaattataaaattttacgaattttttaaaatatttaatacctctgcaaatttctcattctttaaaaaaggcttttcctctttaaaagtccttgtaaaagaatgttaatgctgcacaagagagacagaacagactcccacacttcttaagtgaatgcctaacactgccatcccatgcaaattattattaccaaaaatgtttttttaaagaaatatttaaatttacagagacaacttggcaaaatgatgcgaatcaaagaggcaattcaacgcagaaagctcatccaacagttgaatgaggactatttggtgtcccaaattgagtcggaatcgcacccatttttgcgcagtcgaagtttcaatttgttgatttatcgttaaattaaaaacactaaatcccggtctaacaaatcaacaattccaagccagaaaacattgaatttgttttgctttttacttttttttttggtgtttcaaaaccactaattttgtgggtcggtgctgggacgttagtcaaaaaacaatcaaaatgaaaaattttgacagaaaattattcaaaacttcgcctaaaatgcacaaattttaaaaaacttgttatcattcgctaactttaagttttttctattatcatgcataatttcaagaaaattcgtttattttcaaaaaagttatgacctgaaaaactcaataaccttttttgtgaatatttttggttataactttcttgaaactttttgaattttgcaagataatagaaaacactttatagcaagaattaaaaatttggttgcttttgagcaaagttatatcaataaa

SEQ ID NO: 53553 - DNA, 1124 bp, Heterodera glycines
  Genomic contig location: Contig_ID=SeqID_22848; Location=491..1614; Strand=+
  SCN-specific regions: Sequence locations=1-366,388-886,923-1124
atgggacgatttaaaattactaaattttttatttctccattttttattattggctcaatttctctgctggtaaatgggcgaaatgacaatttgggcccaaattccgattttaaaattggaatttcgtcagctaaaaaagggcaaattggtgaacagaatgttaagggaaaatcacaacaaataattgaagatggcacagaaaaaagaaatgatttgttctcaattttcaagaaaaaagaaatatttgacgaattaattgaaaagaaacgaattgaaaagggaaaatttgacgaatttgtggaggaaatgagagaaaatgaccaactgatcaaaatggcattcgaacctcaacaaagtgatgattaccaagaagaaaaggtaaaagtggtcaattagcaaatatgttatgaagatcactgaaagaaagcgactcatttgtgaaaaatttgcgcggtttctgacggtatttggtttttaaatagaagtgatcggagaattttgaaaaaattaagtaaaaaattaaagcgcttctccaggggactcggtggtttcagcaccatcgttttggtgccagcccgagtttttttgggttgtaactttttttcattgttgaccaaatccaataatcttggtatcattcgaaagctttacatgtttagaagctgtttctaagctattgtttggcaattcgacaattaccaaaaaagttgtaacatgaaaattgcgaaaaaatcgaagttaaattttctagcatatagaaaagttattatgaaaaacttcaaaatttcgactttttcgcaattttcatgttataccttttttgataattatctaattgccaagcaatagcttagaaaaagcttccatttttttaaaaatgtgcagcattaatatttaaataaatttagaataaaaaatttaagctagaaaaacaaacgattcgggcaatttcaaaaggtcttaacaatgtaaaaatcgacaacgaaaaaataacagaaactcaacaggaaaaacaattcaaagagaaataccgcgagtttagaggccataaaagaaaaagacccggcgttgtgtcgattaatggaacaattaaattcgtaccgtactcaaatggagtcgggtga

SEQ ID NO: 53554 - DNA, 1314 bp, Heterodera glycines
  Genomic contig location: Contig_ID=SeqID_22849; Location=23..1336; Strand=-
  SCN-specific regions: Sequence locations=1-43,65-82,124-150,180 -187,209-351,375-389,412-598,620-925,947-1235,1264-1314
atgggccacctcatcgtggtgtgcaagtctagtagccaacaacaaaaatacattgttggtgaagctaacggcccattaggtaaaataatttgtttttcatatgtgtttataaaataaatttctgcaaagagcatggttgataatcattccaaaatattatagaaaaaataaattaaaaacttgcttacagatttattcaatatttaaacgatgcaaaataacaaacttatattgacttcaactccaaaacgttctgaatccaatgtacaatttatttcaccaaatttgtcgccaataaaaaatagtgagcactcctttgatgcatctcaaatgttttttcgttgccaattatttacaattacaagtttttattctcaataaatcatttaaaaacgctttatttaatatttatttgtcaatcatttcatttacctatttcaattttattaatgattttttttttcagcgaattttgaattattaattatggatcaagaggccattcattcagatgtgtcaaaagatgttcaagaaactgttgcctttcttgttgacaatgttgttgacaacattttcaaggaatataaaaggcaggaaaaagaattgctttttgaagaacggcgaaagcggaatattacgctgccagaactaatggcttatagcaacatgtttaaggtcaatcaaaaaagtattaaaaatctataatgttgtttttatagcatcaaaccgcaactaaaaagccaaaattgcatgatgacgaagatgattcaattgtttttattaaagaggtgcccgcttttgacaaacatgttggacttgacgtaaaattattaaaaatatttcaactatagttattattaaaacaaaaggattcatttaatcgtggagacgacacaaatctaatagctgccctcaaaatggatgaagaagctcaaaaagtgaaagaagcccataatctattgtcttccaattctgaaaataattccactgagcttatcaatttgtcttccgattctgaaaattaaatggttgttttatgtgtaaaactgtaaatcaaaacaattacaaaatttcgttttgttgcaaagctgaagtgtaatttccaccacttcaacaatttgacagacaatcacagatatatagtggcaaaaacaaccatttaaattttattatttgcttgtatctacacttggtcggagtccttactccccagtgtttcatttatgcattcaatttctgttttatttattttatttgttttggacacaacacttggtcggagtccttactccccagtgttgtgtattaaataaa

SEQ ID NO: 53555 - DNA, 967 bp, Heterodera glycines
  Genomic contig location: Contig_ID=SeqID_4195; Location=225..1191; Strand=-
  SCN-specific regions: Sequence locations=1-465,505-699,721-845,898-967
  Gene Ontology: Mol. function=arachidonic acid epoxygenase activity; Cellular component=integral to membrane; Biological process =eicosanoid metabolism
ttttattcatttttcgattttaaatttttaagtgaaaagcaactgaaaatgcttctgctcgatttgttttttgcgggctctgagacgacagttaccaccacaaaatggggcattttgctgctgctccatcaccccgaagtgcagcagcgatgccacgccgaactgatagaacaactcggggaggagggcgaagtgcgacgagtggggggggggaagaggatggcattggcattggcacgccttaattgccctattttacttaaactctcataattattccgtttttcggtggaattgcgccatcgttcccgcttcgtttatctgaacgcgacaattgccgaaattcagcgattggccaacattttgcccattaatttgcttcgcacttgcactgaaaatgtttccctcgacgccttctttttcccctcgggcacaatggtcctcccgcaaatttcaagtcaccatttgccaattcgttcactctttgcaaaatgcttattcagtcactttgaatgaccccgcccatttccctgagcccgaccgattcagtcccgaaagatttatcgacccgctaaacggcacactgagacgcatcgacgcatttttgccattttcgatcgggaaaaggtgaggtggaggaaaggccaaagctgtgcgaattgtgccgttcccgggtcggcttggctttgtgccgtgcccaatgaatgattaaaatcctttaggcaatgcctcggcgagagtttggcgcgtgccgaactgttcctcatcttctcatcgctcattaggcacttcgaattccgcacggatcggccgccgtcgcggcaacgaatttacggactaacggcaaaattttgaaaaaataaataattaaatgtttgtcttttatttttttttttaggtttcgccgttgccatttaaatgtcaaataattcgccgaaaaatttcctgaaacagcgaaagaaaagaa

SEQ ID NO: 53556 - DNA, 1589 bp, Heterodera glycines
  Genomic contig location: Contig_ID=SeqID_4196; Location=1..1589; Strand=-
  SCN-specific regions: Sequence locations=1-189,217-536,558-634,656 -698,722-770,793-1589
  Gene Ontology: Mol. function=cytochrome P450 activity; Cellular component=microsome; Biological process=electron transport
atcccatcgcttcttgtccaggcaactctttggctggtgctttccccgttgacttttgctgttttggcatccgtttttgctgtacgtatgctatcattttaaattccctctatttggcgttctgttcagtcctctcactctcttttcgctctgccatctctcattgccctcctcccctcatacaatgtctcgtctttgtttctgtttcttctcttcggctcgtacgttttccacgagttgtattggaagcgtcgtttgctgcccccggggccaattccgtggctaattgccggaaatatgccgcagggtaaacgtacaattaaacagctaatgaaacgaccgattgaccttcgttctttcaaagtgcttcttcacggtgcccacaacatcgatgccctcctgcaaaggtggcacgtcgactacgatggcattttcaccttttggatgggtccaattccggtcagttgctaaccgaacgaaggcaaaccttttgacgtgagaaggcgggtgacgaagaaagatacgaacaaaatgccaacaaacacaaaaacattgccaaataaaagggccgttcgttggatgcccccaccccctccacgctctctcagatttgcatggtctctcgcgtggatttgctccgtcgctttttcgtctcccatggcgaggcgttcagcggtcgttggcagaatttcatcacgcacacattcatgggcaagattaaattggatgataattatggaaacaattacaacttttgattcgctaattggcaaaaacccaaaggcattgattggtcaattgcccactaattgtctattaattgattcactttaatttttccttttttgacagatggccacaacggagtggtgcaaattcaaggcgaaaagtggcgcgaacagcgacggtttgcgctgcaccttttgcgcgattttggactcggccgcgcattgatggaaaagaaaattcaggacgaagtttggaaaatgattggccaatcgatcaatccccagtgatttgatttgtcaacatttcaggtgaaatcattgatcgcccatttggacgcattgattccggaaggtaattagcgtaattatcgtgatcaatgaaaatatggacaaaaaagtgaccgaaatctgcacaactcgtcatcactttgaggatggctctttttttggcacttttccaaattcgtttaggctcccgctgcagtggtccgttggacatcgtgtaagccggtggcggtacggcatcgccaacataatcgataacattttgttcggttgcacttacgcccatggtcagtgggaccaaatgggcaaagtgccaaggccgtcgaaccattccttccaggatgatccggcatttatccgtgtccaacaaatggtggaccgccaatcctcgctggtggtccgtccggtgagtgcttcctcatcgccgctttgctcagtcggcctccgctacgtcaggggatgggcctttacctttgcgcacctttcaccactcgtctcccattggatttgctccgcttggcgccaatggctcgccatccgcgacgatttctgggcttttctcgacacacacattga

SEQ ID NO: 53557 - DNA, 171 bp, Heterodera glycines
  Genomic contig location: Contig_ID=SeqID_4197; Location=483..653; Strand=-
  SCN-specific regions: Sequence locations=1-171
atggtcggtgccgtcaactcgctgttttaccctcacaattcaattcgcttctttaaggtggcttacccccgtggctgtggttcgttggtgttcgattcgcttaatgctgcccaactttgtttggctgccggtgaaaaacattcggtcaacggacattcaatcgaagtcaaa

SEQ ID NO: 53558 - DNA, 835 bp, Heterodera glycines
  Genomic contig location: Contig_ID=SeqID_4198; Location=1242..2076; Strand=-
  SCN-specific regions: Sequence locations=1-140,162-835
atgggcagtaacgaactgtcgggtggatgggtcgggagatttatgtgccaaacattggacaagtacatcaactcgatgaccttgctcatgagtccattctcttctctcagtaagttatttttgtgtgtgatccgtcttaattcatttatacatgaaaaaagagtgggatcgacccccttccctctccaatcactcgcaaaaaaattaaattatttcattgtcttcccccattttcacgtattttcatttgctgttttttgcataattttcataggcattgtgcccgttttgcctgcctctctcccggcctcttctgtctgcaaatgggtcgacttcaccaacaaacatgggttcggcgtcacttttcgtgatggcactcggtcgttgctattcaacgatcagtcgtccctttcaacgaggtatcgtgaaaagcagcctttattttaacaattccacacaaaaccgactggaaaagaattttcatttactgtaggtcaaaaagttttttgcagttattgtcaacgatactttacctatcgagcacaaaaatttgttggcaattttgtcgaatggaattgtgacgacggttgtccatcggacgaacttctcaaaaaagttcacctttcttttatttgtttctgatttgtaaattccttttaggccaccattatgcgctcttatcgtggttacatggacagggaattgcgttcgtcggtgcccattcaggagaattcgttcagctcactcggcacagcttttccgaactcctctcaaagtcacaatcagttcaacttgctccacatcgtcgactttcatcgatttcccgatgcactga

SEQ ID NO: 53559 - DNA, 1484 bp, Heterodera glycines
  Genomic contig location: Contig_ID=SeqID_22850; Location=11..1494; Strand=-
  SCN-specific regions: Sequence locations=1-13,40-253,276-741,768 -1009,1037-1316,1338-1381,1403-1484
  Gene Ontology: Mol. function=zinc ion binding; Cellular component =nucleus; Biological process=pole plasm RNA localization
atggagcggtataaacggcaacaacaacaacaacaacaagctaaagttagtcaactaataaaagaaaatgccaactggctttgcgcactgtcaaaggcaaaatgtgtgaaacgatgcgggagactgatcagaaaggcgaacactgatcagctgctgtcactggtggaagtgtgcttgaacattattgcttcccgattccgactgacaactcggcagaagaaacgactaatgccctacgtggacacggtgcgccgcgtgagcagagcgaggagcgagaggggtgcgaagcgagcgcttgtcatccagaaaggagaggggtttggcggactatttgcagcccttttaacccccgtcttaattgaattggccaaatcggttgtgacccgaaacacataaataccctcgtaaaattgtctcacacacgcattcattcattaataaaaatggcaaacaaattcattctcgtaccacaagaaatttatcggggtctcacctccgtctcgcagacgggagacctcaatttggacgcggttcgccacgacctggaccgggccaggggtggacagacaaatccttcggcgaaaaatgtgcattataaccagcagctccgacgttatttacagatgagaaaggaacatgcggacagaccaaccaaagttgagctgaccaagggaataagtgtactgatgaatagaggtggcgaagaaggcgaggtggttgataccccacgccgtcctcccgctcctccaccaccacctccgccgcctggaagacctcctcgtcgtccaccgcccagtcctccgggtggtcccgggggtccttcgccaccaacaagtcctccgcctcgtccacaacgccccccgagaccgagcaggacttctcggagaggtggtcgtatggagcaatggcggaaaaggcgatacgatatacaacaacagcaacggcagccgccgccgctagtggtgcgggacctccttgcggaagcagctgcggcgccactgcccgaaagtgatgatgatgatgatgatgatgatgagtatatgctagagaatggattcgcgctaccagcaccatcacaatactatggcgatttgcctgtgctgcccgacaatgcggaagaaattgaggaaatggacactgctcagcgcaggattgccatcagaagaaaattgaaaaaggacgaggctgatgctgatgatgatttgcaacgcaaaaaatatatgatgatttatcaacctccaccactgcctcgcgcaaaagtaaaagttgagcagccgaggcctcctacaccccggccgcgtcctaacgtcaagagagaacaacaacaaaagccaaagtcagaattcaaaccgccgtcgacatcaaaaaaaaaccggtcaccccactccggcaaaaagagtgccagagtttggtgatctcgatccacgaccatccacatcaaggcaggccgggtatagcccgcctcccccgacgcccaaaataaa

SEQ ID NO: 53560 - DNA, 687 bp, Heterodera glycines
  Genomic contig location: Contig_ID=SeqID_22850; Location=2230..2916; Strand=-
  SCN-specific regions: Sequence locations=1-251,273-290,313-555,580-687
atgggcggcataaccttgagcggaccccgcctgtctgttccccgtttcattccgtttgaggaaaacgggcgttgccgcgcatgtaaaggaactgaggctgaggtggacacaatggtcaccaaggagggaatcaccttatggtgcacacgcatagaaaaggctcagtttgtcccttttgatgttgtctacgagcttcccggtcactgtttctttcgcgtgaagaataaggcaagggtgttcagcgttccgtacagcgaactgccgtcctcagacaggtgcgcccagcctctaccaccaccaccaccaccaccaatgacaacagcaaaacatcaacggacaccggacgacgaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgagcaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatag

SEQ ID NO: 53561 - DNA, 625 bp, Heterodera glycines
  Genomic contig location: Contig_ID=SeqID_22852; Location=1738..2362; Strand=-
  SCN-specific regions: Sequence locations=1-376,410-625
  Gene Ontology: Mol. function=pre-mRNA splicing factor activity; Cellular component=nucleus; Biological process=embryogenesis and morphogenesis
atgcctcctcctggcatgatgcgtccaccgcatggctctttcatgcttcctcctccgccccccggcgcctctgttggcgatgagccgccaaacaaacgcccgcgcgaagaaacgctggaaccggaagaacgttggcttcaaaaggtgagcgccggtctccaccgatatttgctaaaacgaggaaaaaaaatctttaattgcttacaggtccacggtcaaatcgctgtgcaaatcgctacgccgcaaaatgatgaatggaacctgaaggggaacacagtacaaattcagttggacatcagttcatcggtcagtcataagttaggatgatcaagcaatgcgttattcgcagggctttttgcaagtattattttactggttttaatttttcaaattttttaaatattttatacgtgcttttaaaaattttttccacttttttaaaaattaaagctagttttttaacaaattaatgactattttggggcttgcacataaatcgatttgtattcaggtcactgcgttaaaatcgttaatccaagagcagatcggagttcctgcaaccaaacaaaaattagtctacgaggtgaacacaaatttaattcccattttaagtcatttgcattaa

SEQ ID NO: 53562 - DNA, 1106 bp, Heterodera glycines
  Genomic contig location: Contig_ID=SeqID_22854; Location=781..1886; Strand=-
  SCN-specific regions: Sequence locations=1-604,626-871,900-984,1006 -1081,1103-1106
  Gene Ontology: Cellular component=Golgi trans face; Biological process=neurotransmitter secretion
cctccacaagactcgataattgcggaccttctcagtttggacatttctgggcctcccgttgcgggtaaggttattctctttctttgttatcactttttggcctttgtttcagccctgccttctcaaaccgcgaatatcatggacatatttggcattccttcggccccttctgctgatacaaccgcttcttctgccgcccccgctgtccctccaccaaatattttcgatgcgcctccgtcttcgtccgtttttgacaacgcaccgcccccacttcaaccacaacatccattgactactctttcgtccgccaatgccaccaacccattggatcagattttttgcgcttctatttcacaatcatcggctataaccacttcgcaatcccctgaccaattcgccaacttgttcggtggttcgagtgccggcactggcgttgctccttcactgcaaacactcggaccctttgttccgccctatgaggtggcattatttctcgaaatttgcataatcttattttatatcataaggcatggctcgatgcttccaagggtaaaggattacaaattgagggccgttgggtccgtcgaagcgggcgaataattgcggaaatgaatttaacaaacaaagcgctgcaaccgatgaactcttttgccattcaattcaacggaaacaggcacttttcaattagcactcaatcttttaattccaccccactttgttgcccaattaactcattttcagttttgggctcattccctccgaaccgctaagtgtggccaccattttccccaaccaaagtgcgtccgcttcgcttccctgcaacaccaacggacccatccaacgaatggaaccactcaccaatttgcaagtctgttgttgttgttgttgttgttgttgttctttctcgcatcaatctgttgttaattttaaggtggccgtcaaaaacaatgtcgacgtgttttattttgctattgttgtcccgcttaatgtgttcttcgaagaaagtggtcaaatggacaaacgcgactttctgcaactttggaaggaaatcccggaacaaaatgaggtccaattcaccgtgcagaacaacagaaatttaactgccg

SEQ ID NO: 53563 - DNA, 88 bp, Heterodera glycines
  Genomic contig location: Contig_ID=SeqID_22856; Location=77..164; Strand=-
  SCN-specific regions: Sequence locations=1-88
atggaatggtattctggtgacgttactactgctctgaacatttaccaagagaagaaaggcattcttatcgtctatgttttttctgatg

SEQ ID NO: 53564 - DNA, 94 bp, Heterodera glycines
  Genomic contig location: Contig_ID=SeqID_22857; Location=1593..1686; Strand=-
  SCN-specific regions: Sequence locations=1-94
tatgtaacttgagaccgtcctgtattgtgttccgttttattcatcatcatgaaatgtatttcaatgatcacggaacgataaactcatcaaactc

SEQ ID NO: 53565 - DNA, 1460 bp, Heterodera glycines
  misc_feature (76)..(76): n is a, c, g, or t
  misc_feature (99)..(99): n is a, c, g, or t
  Genomic contig location: Contig_ID=SeqID_22857; Location=1..1460; Strand=+
  SCN-specific regions: Sequence locations=1-732,754-1460
  Gene Ontology: Mol. function=galactokinase activity; Biological process=galactose metabolism
gcgaaacgctttgtcggctggagggcggcggcagggaccaggcgagcaaatggcataatttcgaatttaaaaatcnttttttgtgccattcattagcgntaaggcgtgagaatgtttggcgcatcggagtgaagcgttgcgcattgacttacgtccgctggcatggtgagcagtgcatctgcccgagtacgcgctgttcgctgtgctgcactccaactcggagatgtacaaagcagcgagtgcatattacaatcaggtgggagaagggaggggggggggaagtgattggacggagagacaaaaagtgatcaaagtggactcaatgtgaagcagggagggaaactgattgatcagagggaggggagacatgttgagaagcaatgatagagaactaaagatcagagagagagaggagagatgatcagacaaattgatcacttaaggagccattgctgaggaaaatgatcagaaaacaatggcaaaacaaattaaatttaagaaaattgtatgatcaatgggttatgggtaagaaaactttgatcaaacacataagttcattgatcggaaaaacaatgatcggcactttgttcctaagagggttgtcgagtgccgaatcgctgcccaagtgattgccaaacaaagcgggtgtttgccggcggacactgattggcgttctgttcgaaccctgcggcagggtataaagttgggtggttagacatgattcggatttctcgggacccgaaaaacttttcttggccaagtttcagttgctgcactgctcggcaaagatggccatccggagcaaatgttgacgctggtggacgagcacttggcaaaacggtgccaacgccaacagcagcagaaattggcggatggcattcacacgagggaggaaatttgtgccattttggactgttcagacgcacaattggcccaatggtcgttgaatgcgaacacacagaacagtgagaagaatgatctcgaattagaacaaatcccagggtttcttggctttcgcaattaaattcgacttctacccaatgatttaaatgccaatttgagacttttctcggcttagaaattggatgcttaatcagaatggcgacattgctttttctctcacttcatttaattcatcccaatttccccaaaaagtgactgagttttggctggccaaacgggcacggcacgtttatgcggaggcggcacgagtgttggaattcgaatgggtgtgccgtgaagggagagaggacaatggcacagtggcaaaattgggcggtaaattgagacaaaattcaacatttaatgaccaacggtttcccgaacagaactgatgaacgcttcgcatttgtcgtgtgcgcaactgttcgagtgcagttgccccgaattggacgaaacggtggccaattgtttgagtgcgggatgcattggtgccagactgacgggtgattttcacggag

SEQ ID NO: 53566 - DNA, 852 bp, Heterodera glycines
  Genomic contig location: Contig_ID=SeqID_22862; Location=2126..2977; Strand=+
  SCN-specific regions: Sequence locations=1-376,398-852
atggagccttatcggattgttgcatttgatctcgaaacaatgcagcaccagcctgttagtcctcgtgagccagagaaaagggagcatcagccaaactttatcgcagcaaaagtgttctgccctgagtgcattgacaacagcagatggcggaacggaactgcgggttgcaaagtgtgcggtcctcaccgaacagttgccttttgtcagcgccgctttgtcaacactaccgtcgacaaacaagttgtcgctgacaaccctttggaggcctttgtcggctggctcatcaacgctctgcccaaaaaattcgacacatacgcattctctcactttgggggtcggttcgacatggtcctcgtgttccgcgaactattcaaaattgggttcaatcctgaaatgatccgacaggtaacttaattgttatatttttttattgtgttattatttttagggcaataaaatgttcgagatgaaagtcaagaagcagaagaaccgcaaccccaacatcgtgttccacgactcgttcaacctaatgccctgcgcattggcgcagctggtaccttcctatgggctggaggtcgaggacaagcccttcttcccgcatttggccaaccgcccggaaaactacggtcgacacatttacccaacagtggatgactacctcgcaaatggaatgatgccggagaagcgacgacaatttgacctgtggtacgagcgcatcagcatgagccatttcaactggatgaggcattggcttcctattgcaccaatgacgtggaaatcttatcggctgctctcatcgccttccgccgcgaattctttgaagtctcgaagcggaatgactacgttgatgga

SEQ ID NO: 53567 - DNA, 2758 bp, Heterodera glycines
  Genomic contig location: Contig_ID=SeqID_4199; Location=159..2916; Strand=-
  SCN-specific regions: Sequence locations=1-121,168-387,443-601,623 -1315,1340-1491,1514-1634,1660-1767,1790-1953,1986-2225,2252 -2273,2296-2367,2389-2411,2451-2569,2593-2758
atggaaatctttgacggatttattattgttgacgaaaaagtgatcagtataaatctcctaaactgtgacagatgcatcggtacattttgtgaaattacccaatttgctgcactgtaatttcattttttaaaaatttattattacaaaattatttttttcattaaaaagcaaccaaattgatagcatataattaagcaaacatgattttttttttctatattaatcacttacatattttagtgaatttacgataagcgattatcccatattgcaaatcacggacgttggcaatgcttcttcttccaatccgtcgaatgaggagccattggcacaaattgtccgttgggattggggccaaaatggggcacaacggatcaaagaagtaagaaatttaacaaaataaattttaaatttaatttttaattaattaaattaaatttaacgaaaatgatcaaataaaaaatgttaatcaattaaattatttggaaattgccgaatttggtatccactcaaaatggcacaaaaacgcatttttatagggtttcttaagcgctgagaacgatggaacagcttaaaatttgggcgcggaaaagcatttaaaccggtttttgaaccggtttaaaattcgaataaatgaatgaaaagtggggttcatgaccttttggtctgaggcaactgagtcccagtgaaaatggacatttcagtaccagagtaaaaaaatttagttttacttctaaacacctataaaagtgtttttgtgcgattttgagtcgataccatattcggcaattttaccaattatttagacccttacactcaacaagggcagtgaaattaattgcggctccaatgcttcatcatcatttgttatccgaattctcaaaaagcggagcctattcccggcgccttccaacagctcaactgatcacgaccaattgacagtgaaaattggagacaaacaggtgaaacagcagaaagagagcacagggcattcatccactaagatttgatcaggtcacccataacattggtctgatcactagtaaatcccggtcagatgactgacaaatgattttgatcagatcactggttcttgtactgaaaattttgtcagattagtgatatttcttgctcaggtcactgataattaatcatgctcagatcactgattaacttggtcatattactcataattcttggtctaatcgctgacaaatttgttcggatcactgataattaatcttggtgatcagatcgctgtgtccgccaattggctgtcgtccgtttccccggtgatcagtcgcatgctcagcgtggagatgaaggagaagcagcagcgaatgatcactttggacgaattgggcgtggacatggaccaattcaagcagtttttggaggccatcaattatctgacaatgagcggaccttttctgccaaaccgtaattcatgatactgtatttattcaattcaaccccctgaggggttgaaaatataattttaattttctttgtaaatttggacttctcaatttcccaatttttagccaaaaatgtgctgatgcttctcaaattggccgactatttccaggcgagttcctctgatcatttatcacatcttctttctttgtctgatcattttaatttaaatattaaattaaaccaccataatatttgtcacttttttacttgactttccaaaaactaattaaccaaagttaattttaatttgcttgtaatgtttatatttgctcacttaaattaatggccattaaatgatcccaaatttgctaatgaatttgctgtttctaataaacgaactgttctgttttgaggtgaccgcgttgaagtcgcgctgtgaaacgcatctgatcaattgtgttgaaattccgctgatcgaccgtttccttctgattgaacgcttcggactcgacaatttgaaagtgattattatttaaatatttttgaactttaaatcctattttaaattttgattgatttgccactttttagaattactttttgcatttgaatgttgataaattccgtgcctttttcactgcgaacagtgaacagtttgtgccttttatcagtaaagaatttttgtacgctttgtccgtcagactttgtggatgaatttgttaaattatcggctttgatcatattgatttttttggcattttcattaattgtttatttttcaaacaaattgtttttcctctttttggttaaaattatttattttcaaatgggataatttggcgaatattttggcattttttataacaaacaaagtggtgaaaaaatgtcattttacgtaatttttttaagcccaagttacaactgatcaaaattggcactttataagaattgggctgctggggaagttttgcattatccgccaccgtacaatcattttaatttaaatattaaatatttatgaaaaaataaatctagtattttgaatgagacaacgaaccgttctgtgatttttcgtaaaccaactttgtgtttttataaccttttctacctaactaaaattttttaatttggtaggctaattgggactattaattgccatcaaatgactcaaaacttgctaatgaatttgctatttctaataaacgaacttctccgttttcaggtggccgcgttgaagtcgcgctgcgaaacgcatctgatcaattgcgttgaaattccactgatcgaccgtttccttctgattgaacgcttcggactcgacaatttgaaagtgatttaa

SEQ ID NO: 53568 - DNA, 845 bp, Heterodera glycines
  Genomic contig location: Contig_ID=SeqID_4199; Location=3403..4247; Strand=+
  SCN-specific regions: Sequence locations=1-111,133-166,188-530,593 -766,788-845
atggcattttcgagtgtaatgccggcaagggcttttggacagggacctgctgaacaagtgatagtcacttgtggtgccatatccgtacaatattacggcggatatggcaaaacttccccagcccaaccctcaattattttattatagtacatagcatatgctgtgatttattttttaattgaaaataccaaagtattgttcgaaatgttaaaattcgccagtcactaaaatgcgaaaatgaacaccaaaagtgggcaaaaaatgctcagaattaacctttttttattaaaccaaacattttcttttaacccaaataaaaaaattatctaatcgagaaataaagaaaatgttaaaaacatgaaaatgccaaaaaatcaatttgatcaaagccggactcaatcagcagaatttaacaaattcatccacaaagtcggacggacaaagccaacaaaaattctttgctgataacaggaaaaaaccgttgattgttcgcaacgaaaaaggcacggaatttattgacatcgaaatgcaaaaaataattctaaaaattaatttaaaattgaaaataatttaaaatatttgaaaattaaatcactttcaaattgtcgagtccgaagcgttcaatcagaaggaaacggtcgatcagtggaatttcaacacaattgatcagatgcaattcgcaacgcgacttcaacgcggccacctcaaaacagagcaattagtgtccctaataattagcctaatgaatttaaaaatgagtaaaaagtaattttttattgaaaaataagggtgaactctctttgataaaggatattcaaatttaagtatcattttttgaaaacgga

SEQ ID NO: 53569 - DNA, 1156 bp, Heterodera glycines
  Genomic contig location: Contig_ID=SeqID_4200; Location=968..2123; Strand=-
  SCN-specific regions: Sequence locations=1-541,564-725,758-772,794 -859,881-968,1054-1156
ggactcaatccaccaacattccgatcaacgggactcaatccaccaacattccgatcaacgggactcaatccaccagcatttcaatcactgggactcaattcttctgcatttcaatcactgggactcaattctcctgcgtttcaatcactgggactcgaccctcaagcatttcaatcgcagggactcaatccaccaacattccgatcaacgggactcaatccaccaacattccgatcaacgggactcaatccaccagcatttcaatcactgggactcaattcttctgcatttcaatcactgggactcaattctcctgcgtttcaatcactgggactcgaccctcaagcatttcaatcgcagggactcaatccaccaacattccgatcaacgggactcaatccaccaacattccgatcaacgggactcaatccaccagcatttcaatcactgggactcaattcttctgcatttcaatcactgggactcaattctcctgcgtttcaatcactgggactcaacctcagcaacggaatacagaactatttaaaaggaatccagaaattgaaatataacccataaatcaaaacactatggtgtataattattgcccccaccccataaattcaaattaaaactgacctgtttaaaactttccacctaaatttgatccgcaagtgtcacgtcaatatcccaattgcatataaatattccactcgaacacaggcaaaacataagatgtagcatttatattgctttttctatccatcaaaggctttttctttcattttttattactatcataacatgctttttattcaaaacaaatatcaaaaaccaaatcagattcttttcatattataagcaaggaaaagtacaaaaaacttttttaagtaacaaacctttttcattcaaacaaattctaatgcatttttttaaccaaacaattctccattatcgtttacataagcaaaacaaaagctttaagatcaaaatcaaatcaattaacaaaaacaaaatttagaaaaaaaataatgataaacagcaaaacaacaaattttttcttacacacaaaaacagaaccttcatataccggattttccactcaaacaaacacaaaaatgtgctcattcttttggtaaatattttataaaataaa

SEQ ID NO: 53570 - DNA, 584 bp, Heterodera glycines
  Genomic contig location: Contig_ID=SeqID_4201; Location=406..989; Strand=-
  SCN-specific regions: Sequence locations=1-504,541-584
atgcttctcaaattggccgactacttccaggtgggtgccttgacacttatcaacaaatcctcatttgatgtctaaattttctcgctttagcctgtaaaattttgtgaacaaaaatgtcgaaaaaagtgctctgttttgaggttgccgcgttgaagtcgcgttgcgaattgcatctgatcaattgcgtggaaatcccactgatcgaccgtttccttctgattgaacgctttggactcgacaatttgaaagtgatttaatttttcaaatattttaattgttttcccaatttttagaaatattttttgcatttggatgttgataaattgcgtgcctttttcaatgccaaccatgaacagtttttgcctgttatcagcaaagaatttttgtgcgctttatctgtccgagcattggccgggctttgatgaaactgattttggcattttcataaaatgtttttttacaaatttcctcattctcgatttagagagaaaatcaatttaattgcatttttgttaaagaatttgtaaattttacatggacaaatccaaaaatgctaataggaattttcaaaatattgaaataaa

SEQ ID NO: 53571 - DNA, 656 bp, Heterodera glycines
  Genomic contig location: Contig_ID=SeqID_4201; Location=1673..2328; Strand=-
  SCN-specific regions: Sequence locations=1-123,163-208,231-656
atggaagtctttgacgaatttattgttgttgacgaaaaagcgatcaatgaaatctctgccccaaagtgtggcggctgcaactgttcatttcgtgatgtgacccaatttgctgcactgtaattctattttttgaaattaaattataaaaagaatatttaaaatgtaattagctaacatgcttttttctatgtaaatcacatatgtacttatttttagtgaatttgtgacaagctattttcccatattgaaaatcaaggacattggcaatgcttccaagccgaattctgagccattggcacaaattgtccgttgggattgggacaaaaatggggcacaacaaatcaatgaagtattaaagaaatgatcaaacttaaaaaaacatgattaacaaatattattttagacccttacactcaacaagggcagtgaacataattgcggcatctataccaatgcttcatcatttgttgtccgaattcacaaaaagcgggagaaaaagtccaatgaaacgtaaagtgttaaaattttatctaaatagttaaaaaatttcggttcgtattctatcgtttatctctgtcgtctgaattgtcttgtccgatcacaattaacaaaaccccttaggttttattcgatcgaaatgataaatcacaaataaa

SEQ ID NO: 53572 - DNA, 884 bp, Heterodera glycines
  misc_feature (24)..(24): n is a, c, g, or t
  Genomic contig location: Contig_ID=SeqID_22864; Location=17..900; Strand=+
  SCN-specific regions: Sequence locations=1-292,327-853,875-884
atgcctaccaatgtctccgtgtcncaatggaaatggacaagccccgtctgctcaaatccgtactccttcaacgtgttctcttcgtccaattttttcttttggtatttgttatcaaatgcaacagcatccggagtgagtgtgaatggaccgtattggaaggaaaggtgccgagcaacaaactcacgaacactcgcaaacttttcattctcatggaaaatgccctataaaactggttttttatcaaaaaaaattaatatactcaacggaatatgattttaataaacagatttgcaaaataatttatatataataaaatttgatatttaccgctttccggaaatgagccgttttttatttggaccggtaaaaagtagagaccggacaagagggtcggtcggtcggtttcggttaaaaaccgaaaaaaaaccgaaaccgaaaaaaaccgacgaaaaattttcggtatatcgtttcggtttcggtttttttgaatttttatatttttccaaaaaaagcaataaaacatttttattaacagaaaaagctaaagatcacctctgagtaaaattgtaaagctattgaagctctatcgaatggtgtactaattttggaaaattgaaaaaaggaagccaaaaaacatttttttaaatagtgagaaaaagtgccaaaatagttaaaaaagtccaaaatagtgacaaatagtgactaatacaaaacttttagtatcactatgatgaaattaccttacaaatagagatgattgaattttctattcataactctttcaattaataacctaatatgttataaaaatggatataaattatattcttttgcatattttttctgcgcatgtgcaatgaagaaaggggttcaaatttttttta

SEQ ID NO: 53573 - DNA, 1536 bp, Heterodera glycines
  Genomic contig location: Contig_ID=SeqID_22867; Location=107..1642; Strand=-
  SCN-specific regions: Sequence locations=1-1422,1444-1536
atgtgccgccaaatctctcccggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttggaagaacacgaaatgtctatgaagacaaatcgcctggcggcataaaatacgagctttggcagttcccaatgaaagcctgcattcgctatgaccattcaaaaagggtcagggccaaacaatccgcactgtcggcattgatctggaaagggaagtattttcccacggtcaattgtatacggccttctctcgggcgacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagtttatacatatatagagaaaagttgcaactcgtcttaaaaactaatttgagtcgaacggctgtcgggaggggtctgaaagtggtggaagggtcttaatgattcaaaaaatgcgcagttggctgatccgtcatcgtgatcaaaccgcagtttcatacaaccgatttggacggccaggcactccgacaaaataaaattgtttttttaattgaatttttaggggaagaagaggaggacaagcccccgccgacctcaattttagtggcaccattcaatgagaatgctccagagtttatcctgttcaatacgtgccatgttcagaaggcggcggtg

SEQ ID NO: 53574 - DNA, 600 bp, Heterodera glycines
  Genomic contig location: Contig_ID=SeqID_22868; Location=49..648; Strand=-
  SCN-specific regions: Sequence locations=1-275,297-426,449-514,536-600
atgaagatcgtccatttcctaaaaatttgcgtttgcggtgcattcatcgccacaattatcactggcacaattttcatggttcgttcatcggcggatgatcggaatggaaaagttagcgtaaaataagtaaaaaaaaaattctaaaattcaccaattttccaattttgctaacttttatgcatttttttcatgcttactgaacaattttcctacattcttttgcctaattcgaacctcggattagatttttttaaattgtgaaacggaaaattttgtgataaaaaagcaaattttcatcattttctcgccgttcagcagatgaaagcgccccacgaggatggcatgcagaaatccgaggacaacgaatgggacgacaaagcgcactttccggagcagcaaaaggcatcaaaaaaaggagtgaatagtgaagaggagaaacagcagcaggagaacgatggtgatggagttggacaagcaccggcaccaccacaaaaacacccaaaggacatcaaaaaacaggtttttctgtctgaagttttattaggagacattttgggttgggaaattgacaatttttacagattaatgccccaattttga

SEQ ID NO: 53575 - DNA, 304 bp, Heterodera glycines; identical to SEQ ID NO: 51570
  Genomic contig location: Contig_ID=SeqID_22869; Location=469..772; Strand=+
  SCN-specific regions: Sequence locations=1-304

SEQ ID NO: 53576 - DNA, 101 bp, Heterodera glycines
  Genomic contig location: Contig_ID=SeqID_22869; Location=925..1025; Strand=+
  SCN-specific regions: Sequence locations=1-101
atttctcaaaaaaagagatagccatttttctgggatagagtataaatttaaaaattccctcaaaaataaaaggtctattgcgcaccgccctccctatcatg

SEQ ID NO: 53577 - DNA, 1859 bp, Heterodera glycines
  Genomic contig location: Contig_ID=SeqID_22870; Location=309..2167; Strand=+
  SCN-specific regions: Sequence locations=1-602,624-1616,1638-1859
  Gene Ontology: Mol. function=ubiquitin-specific protease activity; Cellular component=cytoplasm; Biological process=protein deubiquitination
ccaacgtcctgaacttctcgacgagaatggccatcgttacgtcggcctcttcaaccaagcgatgacttgctatctcaattcgctgattcaaacattgtacatgacccctgagtttagaaataaagtttacaggttgtgcttaattcctggtaaaatacggacttgagaatttcagttggaaattcgtcgacacgccgacggatgaggacaataaaaacattccttaccaattgcaaagactgttcttgttgctgcagaccagtgagaaagcgtcgctggagaccaaggagttgaccaccagttttggatgggtgtcaaacgaagcgtttgaacagcacgacgtacaggaactgtgccggattatgttcgatgcattggagcaacgatggcgcaaaacggagaacgacgaatcggctttccataagctttacaagtgggtgggttcggcagaatgccgaaaattgctgtgaattttcagaggcactgtggaagactatgttaaatgtttgcgttgcaaaagagaaaatgtgcgaaaggacgactttttggatttgtctttggccgtcagaccgttcggcgccagcgaatcgtttaaatccatcgtaaaaaatttgatttgcaattgggagaaaaataatgaaacttcgaaaggaggaggctttgagtgcgtttattaaacccgaaatactcaacggaaacaaccaataccaatgcgaagtgtgcgcatcaccgcaagacgctgagaaggtgaattatcaatgaaaaaatagaaaaactgccaaaaaaacttaataaaaaagccacataattttggattggttctcgacataaaattgcatcttttgcatttcttttgtactccttcattttcagggcttgcgcatcgtcgaatttccgtatttgttgaccattcaattgaaacggttcgactttgactatgcggctttgcaccgcatcaaattgaatgacagagtgacatttcccgattatttggacgtcaacgactttgtttattcgccttcggcgtcggcccaaccgaagccgagttacgcagaaatggccaaaaagtttttcggtctacgaatttttagaaattgacatggttttgttcagactaccagagcaggacacagcagttcagccatcgacgaatggacagtgcacttccgccacagaggacgaagtcgcggcggactgtccgaatggggaagggccaagcggtgaacattttgttgtgggacattaggcctaatttctgcggcaatttcttaccaccgatggcattttccatttaggtcaaaggcttgtggaagagaaaactcgtgctgaacacattgctcaattattgaagcgtggcaaatacatttacgagttgttttccatcatggtacaccagggaagtgcgtcggcagggcattattttgcttatataaggtaaagaaagacccatttgtcaaactgattgtctaaatgctttgccttagaaatttggaccagaataagtggttttgtttcaacgattcgtccgtccatgtcgcttcgcttgacgacatttttcgaacatttggtggccatgccaacggatggatgaacaatatgaacggttctaaatgctatttgtttcgtgatttgttctcatcggtcccttaaaagcgtatatgttgatgtaccgacaaattgatcacagccaaaacgaacatttcgtcaggagcaccgaacttcctgagcatttgattctgctcaaggacaaattggaggcggaggaggaagaacgaagtcgacaacgacagattgacgagcagaattccgcgcaggtgagaagaattttaagcattttcatgaaaggagttaagcaggag

SEQ ID NO: 53578 - DNA, 1883 bp, Heterodera glycines
  Genomic contig location: Contig_ID=SeqID_467; Location=55..1937; Strand=-
  SCN-specific regions: Sequence locations=1-281,303-334,356-880,904 -1883
atgtatgaagactgcaacaccatttttgcgcgctgtcacgacgcaaaaaaggcgcggctctttatcacattcacgaacaaccgtgagtggccagaattcaaggagaacatttacaaaaatggtcaaatgttcactgaccgttttgacatgtggatgcgagtgtggtgcggcaaaattgctgtcttccaccaagagctctacgagaagggtttctttgggactatccttggctcaggagagtccatggagttccaggggcgtggtggcccacacgcacacattgtagcccagactgacctggacgcaattccagaagtcatccaggaatacatatgggctcatattccacctttgccagataaagatgatgactccccaattgcgaaaatgcatcgcgaagtccgcgaactaatgcatatgcaactgcacagatgcagtgatagttggtgcggtccacgtgaccccaactttgggaggtgcaaaaagggctttcctgcccctttttcgaaatgtacgatactacacccggacaggcccgcgttatattaccggcctagcccaagcgatggtggtgcaaaaattgaggtaaacggcttaatatacgacaactcacaagtcgtgccgtacaacccatacattttgctgcgttatcgagtgcatcataatgtgttgtttgcttacggtaacaaagcaaacattaaatatgcactcaaatacccattcaaagggcccggacattgttatgtcgagtgcaaagaggagtccggcagcaaaatcggtatcgatgagccggctcaatatgccaaaatgaatttccgtggtgctacggaagcttttgcagttgtgcattcaataccatttgcaaaactctcgcaccaggttgttcatttgtccattcatttgccaaaccagcagcccgttgtctacagggcattccaactggtgagcaaagctgaggaaattcagcgaggcgagctgccagagacgccatgctctgcctattggaagcaatggcaaactgaatggcagcatgttccttcgctcaaggacatgctttttgaaaaagtcccagagcaatttcgctgggcaaaagaccgatggcttccgtataaaaggaagcctgccaagaggcccccaatcggtcgtgttgtacctgtgcctccaacggaccgggaaagatttgcactttatgcgttgatgcgtcactttcccggtgatcctgaccacttgaaactggtcaatggccagcagtacaacacctttacagaggccgctctacagcatgggcttcttgaagatgaccaaatttggcacaaaacgctcggtgaggcagccttgcatcgctggccggaccagatgagatggctctttgtgagcatcctcgtctttgggcagccgagcaatgccatagaactgtggaacaagtataaagaccaaatgtacaacccacagggcatcaccagtgcagctatacgccaagcacgcgagctgcaagccttagccgacatagattggcgattgcactactttaacttaagctgtgtgcactgtggcctgccagatccaccaaattcaaaagccaaaaataccaatttggcagttgaagaatttttctttggtgatgatggtctgaatatgccgcatggccagccaaatcaaaggccacaacaaaacaccccacctcccctcaatagcgaccagcaaaaggtctttgatgctgttgtgagggcaatacagtcggacccgaaggaccagactgtgccgcgccgtttcttcattttcggcgatggaggtacaggaaaaacattcctgtttggtcaaattatcaaacgcttgcgaaagcccccatacacctttaaagtgctggctacggcatccactgg

SEQ ID NO: 53579 - DNA, 1868 bp, Heterodera glycines
  Genomic contig location: Contig_ID=SeqID_468; Location=112..1979; Strand=-
  SCN-specific regions: Sequence locations=1-964,986-1278,1300 -1350,1372-1411,1435-1868
atgacatttgggtatgaccccaacgttccggcagaagtcatacttttgccagtacatttccctggacattggactctcattgtccatgatgtccagttcggtactcattttgccgattctttgcctaccccatatggcaggttggatccgcaactgacggataaaattagaaagattatttctgacattttgtcgtcaacagtgttgaccgggatttttaatgtcgaaaatctgacggaacaacacgatggaaatagctgcgggtacttcgtgtgcctgtatgctgagtcatggcttatgaacaatcgcacatttgttctgcctgatttatccattaattatgaaaagaaacgcattttatggcacatcaatgagctttacggctctgataatgtgccgtaccatccgagggaaggagtaccaacaccttgccccattgtctatcgacatacggatgaagcgcagtcgacatccaaggccgctgagtcaatggaagttgatgataaaaatgacataatgatcatcgaaccacagacaagtggacaggctgctaatgccattctcacccaagcccaagtggatggtgaaaaccaagtcgacacgcttggtttggtttcggagtcttgtgttccgcaagagccaattgcgcaggcagacgatgcaatatttgtcagaccgaagacgccaccgaggcgatcatcgcgcataggcagacggcaatcagcttcgattagccgttcgccttcacccgcaccgagacgcagcttatcagcaaaggctgttgagaaagtcactgcatttacgcagcgttgctaccttgcccacaagggttggtgctgtgctgccgcagcagcaaagcattatccaggatattcaaattctggtaagcttggtgaaaagaagtgctctcattgtggagcactactcttcccgcatgaggacagcagagtttgctgtcgtcaaggaagagttgttttgccaaagcttaacccgcacccaaaagagcttgaagagctcatcgtgtgcgataaacaaccccgcgaagggaaggagtttgttcggaatatgtcgcggtacaataatttgctccaatttgcgagtgtttcggctggcaataagccatgccctgctggcggaccgatggcagtaattctcaacggagaattccatcgccgcataagcagcatgcaggctggcacaacccagattcctggctttggtcagttgtacattctggacccagtcgaagccatggagcagcgacgaaaaaatcccacgtttactggggaaaaaatcacaaacgaggaagagtttgtgcagggtcatcagcttaatgatgagacccttgaaatcttggaaaaaatgatccaagaaaatcacccagctgcatctgcttacaagcaggctcgtgaacagctacaagagttgttaagacaacaaaggacggaagagctccggtttttcagaatgactttgttgaatgagcgctctgctccgggtggtatgaaagacccgaagctgcatccccaccagataatcaccccctcaacgggtgaagggatgtttgcaattcatgcagatcccactggtgccccggcacctaaagggatatgggtcgaaaacaagcagggccagttgaacgaaattgccccattcagtccttggactgatagcttgacctatccattgattaagcctaaaggagacgatggatatacaattggcattccatatgccaaacccgcacaaagaaggcggaaaagcaacatgtctgctgatatgcttgacactgaagcaatgtccgatgatgacatgtgcgagactgagtcaattgcagagtcagatgccggatctgaagcatcgatgca

SEQ ID NO: 53580 - DNA, 1199 bp, Heterodera glycines
  Genomic contig location: Contig_ID=SeqID_469; Location=21..1219; Strand=-
  SCN-specific regions: Sequence locations=1-5,30-1199
atgctgaagaagagaaagaaagaagagcacctgcggcgcacggagaaatctgttagtccaggtcgctcacctatcccaaattgccctcctaagggcaattcaaactgtccgattttggacaaaccattggttgcagatgagaatggggtggtatcacacccgggcactaccacgcccaatattggtgctttgcaattaagcaccccggcctcttcgattggaagtaaaaggcggcaatttacatcggccactcaaaatgttgagtcgtcgcctagcagtaaaaaatggaaggtcaacgaagttgacagacccatgtctgctaatgaagcaattgcttcaacgccagtttccacgcaacgaaaccgtggacgacccgccaaaaaaaatcgaggaccaggcaggggcaaaacaaatgattcaatgagcgaaagctcttcaattgatcagggctctgaagctaccacatcagtggccgttttgccaactgtgcctgaaaagataaacttcagcacagtgcaaattaatttcgccacatcgcgaaatatggcctgcaaaattcgcagatgggccgatgttggcctttacgagcgtgatggcgaaacagaacaaggcccacgctctggcccaaaattcattgagacctgttggaatgatctgacacagtttctaaatgatgcctttgttgccgagtatttggcatacttggcaagtatatcagtgcgaaaagtggtcgttgttgatccaattgtgtggcaaattggcatagaccgtgtcatgccttacaaaaacatgacatttggttatgaccctaatgtcccggccgaagtcatacttttgccaatacatttcccgggacactggactctcattgttcatgatgtacaatttggcactcattttgccgattctttgcctaccccatatggcaggctggatccgcatctgacggataaaatcaaaaatataatttctgatattttgccgtcaacagtgttgaccgggatttttaatgcggtaaaccttacggtacaacacgatggaaatagctgcgggtacttcgtgtgcctgtatgctgagtcatggcttatgaacaaccgcacgtttgttttgccagatttatccatcaattatgagaagaagcgcattttatggcacatcaatgagctttacggctctgataatgtggcatatcatccaag

SEQ ID NO: 53581 - DNA, 2388 bp, Heterodera glycines
  Genomic contig location: Contig_ID=SeqID_469; Location=2422..4809; Strand=-
  SCN-specific regions: Sequence locations=1-196,242-330,352-1323,1346 -1527,1550-1642,1665-2184,2213-2323,2345-2388
atgcttggatggacattcttccctcttttgaccatgctcaactcggcctcaaattggcattactttcgccacgtttcgaacttttggtggacaaatatttcgatgacaaaagcaaaatgacggtggaccagaaatcgcaaaggcaattttgaatgcggtaagtttttaaagttttctcggttccaaaaatggcccgaaaattaaaaaaaatcaaaatttatatattttttttgatttttttgtttgtgtcagtttttttttattaaatttactgcaaacattgcaacatcaaagaatggtcatgctgtaatgatacgaacataaaaaccagttttgaaaattttgaattttcgattttttgttagaatccaagtcgggggttcggaattggccaaaacatgtatcattgtcgggatcagcgaccccgaaaaccccgtaatacatgtttttactgggccttacatttatatttttccattatagtcataaatttcttagtttggcaattacatggcataaaaatttttttttagaaattttagaaaagtttgcttttgtgtaaaattcgctcagagcttcggtcaaaaaatcttgtccacccttattgcttccctttccgctaaattattatttttcataattttagttggtctgcagcgatgtttggatggacattttcccactttttgaccgtcctcaacccggcctcaaattgacactgatttcgccccgttttgatgttttagtgtacaaacattttgatgtcaaaggcgaagtttttccaaattttggtaagtcttttgttagtttcttttttttgtaaagttattggtttttttgttacttaaaataatagtgtttttatggaatttaggggcaccaaagctttctccatttcaaaaaatggctgaaaattatttttttttcaaaattaactaattcattttgattttttgtgttagagtgccggcttttttaagggatttttggttatgttattgatttatcaactccagctaagcagatttttttttttgtgtaaaaatacaaaatttcttagtttttcgttaatttttttttggattttataaaatctttcgcgactttttttcagcttgatgggcaacgacgtttggatggatattctcccttttttgccttgctcaactcggactcaaattgccactgctttcgctccgtttcgatgttttagtggacaaacatctcgatggaaaagcaaaatgactgtggaccagaaattgcaaggacaaatttgaatgcggtaagtttttaaaaagttttctcggttcgaaaaatggcccgaaaattaaaaatttttaaaattcgttatttttttgtttctgtcaggttttttagcatttaattgttatgttttttggatttaatgatttttaagctgggccttacatttatatcttccattatagtcataaatttcttatttttatttgggaatttcatggcaaaaatttttttgaaattttgtatgttttagctttttaatataaaaattttggttttgtgtaaaattcactaagaagtttgttcaacccttattgcttccctttccgctaaattattaatttcaataatttcatttgatgtgcagagcgatgtttggatgggcattttcccttttttgaccgtcctaaactcggtctcaaattggcacttctttcgccacgtttcgaacttttggcggacaacattccgatggcaaaaaggtgaattttttttagtgttttgttgttttttaaaggattttgtgccaaaagggggccttctatttctagaatttttgcctaaagaccaatttcggtttttttgttgtaaaagcgccattttttagtgtttttgcatttttttttatgattttaaattctgcattttcagcaaccgctcaacaattcagcaactgcgtaacagtttggatggacatttttccattttattgaccgtcctcaactcggactcaaattggcactgctttcgctccgtttccatgttttagtggacaaacatttcaatgacaaaagcggattgctgcgcaagtttcaattttactcaaattaaccggtcaaacgctttatagtctcgaaaattattgattgaattcgacaattcaaaaattgaaaaatgtaaacatttttcctatagttgaagaaaattttagtttattaaatttaaaattccaaacaaaaatcaattatagatttttttgataatcgacaatcgcttaacattgatgggtgataccatttccatccttcaattttcttataaaattaaaaaattctctcaggcaattgctgtgtttggccggtttaaatctttaaaattcatcgattcgaccatgaaatgaataaa

SEQ ID NO: 53582 - DNA, 673 bp, Heterodera glycines
  Genomic contig location: Contig_ID=SeqID_470; Location=391..1063; Strand=-
  SCN-specific regions: Sequence locations=1-209,231-286,308-673
atgcttggatggacattcttccctcttttgaccatgctcaactcggcctcaaattggcacttttttcgacacattttaatgcgttggtcgacaaacatttcgatggaaaaagcgaatttcttcaaatttcggcaagtttttttttttgattttttataaagctgtttggtttttggttactttttgctaagagtgtttttaaggaatttaatttcccaaagttttaaggattttgtgccaaacaaacgggcctccaattcaatgaatttttgcgtaaaaaacgctaaaaattaaaattttttcaaattcgtttttttttttgatttaaaagcccccgtttttagtgtttaattgttatgtttttttgatttaaagactcagctcgctgagctgagtaaaacagtagagaatacgcgcagaactgttcactttaagacaaatagcagaagtgtcaattttttttaaagaaatcagtgttcaccaatttttttcaaattctgtttttttgtttgtaaaagtgcgctttttaggaattttgctttttttacaattttaattcttaacattttcagcattttccctttttgatcgcactcaactcggcctcaaattggcacttctttcgctacgtttcgatcctttggtgaacaaacatttcgatggaaaaaaatga

SEQ ID NO: 53583 - DNA, 932 bp, Heterodera glycines
  Genomic contig location: Contig_ID=SeqID_471; Location=785..1716; Strand=+
  SCN-specific regions: Sequence locations=1-163,245-331,457-744,769 -769,791-802,836-932
atgagaagaggtacaacagtgatgagaagaggtacaacagtgatgagaagaggtacagcagtgattagaagaggtacaacagtgattcaaagaggtacaaccatggtttaaatgaataaataagagaattgttttattaaatataagagtaaaaattggatgcattaaaaaattttaaaaataaaataataatccttttcattattaaaataaacttttaaatgtataatatgaaaaatttattgaaattgaaaggaatttatttgttgaaaagtctaattaaataaaacttttattcatcaaaaaaattaaacataaatcaaacaaagaatatttaattaattataacaaataaataattaattttaatacaaatcatttatcaaaaattttttatttaaattttaaattaaaatttttattaatttataaatcaaactattttaaattaattaaaaacatgtaaaaataagctaataatatatagaaaaataatatacaccgccctgcttcgaactttcccccctcccaaaaaaatgatgacccagaatccccaatcacacagggattctgaggtcttaagtatgtcagaagtaaaatctgatcacgtattcgtgatcagcgtcctaaattggcccaaaagacatatttttggaatattttcggtgaaaaaatttttccactcaaaaatcctggtcacccccctttggtcccgaaccccaaaatcacttttatttctataacttttttcaaaaaagtgataaaaagctaaaataaaatttataaaatagagcaaaaaattgcggatttttatattattttacttttccaaaatatcttttcagaaccgagttcagaattttttactgaaaattcgaatttttccagaacttctggaataactttttttagtttcatgatagaaaatctaa

SEQ ID NO: 53584 - DNA, 990 bp, Heterodera glycines
  Genomic contig location: Contig_ID=SeqID_4202; Location=173..1162; Strand=-
  SCN-specific regions: Sequence locations=1-990
  Gene Ontology: Mol. function=pre-mRNA splicing factor activity; Cellular component=nucleus; Biological process=mRNA processing
atgcatttgtgtggtttggcacaggctccaggaaatccggtcattgcgtgtcagataaatttggacaaaaacttcgcgttcattgaattccgttctattgacgagacaactgctgggatggcatttgacggtataaattttatgggtcagcaattgaaaatacgacgacctcgcgactatgtggctccaaccactaattacgaactgcttggcagaatgccaggtttgcttttggccaaaacgaaagcatttgtcaaccgtttttagtctctaacattgttgtggacagtcctttcaaattatacattgggggactccctaaccatttgaactcggaacaagtcaaagagctgctgagtgcgtttggacagctgaaggccttcaatttggtgatggacacgaccaccggaatgtcaaagggttacgccttttgcgaatatttggatcagtcgctcactgaccaagtcggcccaattttcacttcttttttgcaaaaatcttttaaggcagttgttggtctgaatggaatgcaactcggcgacagtcgtctattggttcagttagccgctgctggagcacgtcaatcggtcacccatccgagcactgcggttcaaatcgcggggattgacttgtccagaggagccggacccccaacggaagtgctttgtctgatgaatatggtaactgaggaggaattgcaacaggacgaagtttacgaaggtaattttgctcattggatgaaaaacacactgcttgctattttttagacataacggaagacattcgcgttgaatgcaacaaattcggaaatgttgtgagcatggaaatcccgaggcctgggtacgacgagcgtggtgttggaaaagtaggataattggtttatttgtcatatttgtttgtcttaaggtattcgttgaattccaatctaaagaagaatgccagaaagctcaggccgcattgactggacgcaaatttgatagccgagtagtg

SEQ ID NO: 53585 - DNA, 1057 bp, Heterodera glycines
  Genomic contig location: Contig_ID=SeqID_4203; Location=122..1178; Strand=-
  SCN-specific regions: Sequence locations=1-118,140-155,210-301,323 -395,418-1057
  Gene Ontology: Mol. function=pre-mRNA splicing factor activity; Cellular component=nucleus; Biological process=mRNA processing
atggacgacgaaaacactcatcaagcgaatatggaacgagtgagagaggacgaagatgaaaaaattggtctgatggacattaaacgggaaataaaagccgaactcaatgaagcgattggtcgccaaacggaagatggcgaaacggagccaaaggcggagagagagcgcgagaggaaaagcgacagagagagggagcgcaagaagaagagcaagcggacttcgcgagaccgaagccggtcgaagtcgcgggaacgcaaacgatcgttagtcacttttcaaggggctggcattgtccaattcatgtgatttgcttcctgaatctcattaagacgcgaacgccgacgaagtcgctcgcggtcgaaggaacgccaccgcgagagagagcgaagccgagaaaaggaaaggggcgaaaagaggtcgaaagtgaagagcaacaaatattgggatgtgccacccgctggctacgaacacatgagcccgaaggagtacaaagaactccaaggtgggcccaccttccctttggctcctcactggaatttcctgaatttcagtagtggtcgtccattagaattgcgcaagggtgctgaatcgatggattttttagcatttaggtcttctgtacggtgctttccgaagcattttggcggaattttaacttttagcactcaatttggtcgtctcgtcgtttttcagatttaagatactccgccaaatgttaatcgatatgaaagtcttttaggttttaggggaaaacggtgtcctgctgcatttttggattcatcccaacccaatagcttatagggtgaccgagcacaatcacctcgcaacaaacgcagaatagcattcccactttcttgaattcaccacttttattttagctaccggcgccatccctcgggccaccctccaatcgtctgttccggtggtgggcccttcggtcacttgtcaggcgcgacggctttacgtcgggaacattccattcggttcaaatgaagacgcaatgctggacttttttaaccaacaggtcaaccatggactttttaacggatgggattcg

SEQ ID NO: 53586 - DNA, 655 bp, Heterodera glycines
  Genomic contig location: Contig_ID=SeqID_22875; Location=524..1178; Strand=-
  SCN-specific regions: Sequence locations=1-34,157-159,187-194,270 -341,409-544,580-655
ctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 53587 - DNA, 840 bp, Heterodera glycines
  misc_feature (821)..(821): n is a, c, g, or t
  Genomic contig location: Contig_ID=SeqID_22877; Location=870..1709; Strand=+
  SCN-specific regions: Sequence locations=1-116,138-753,775-840
atggcgttattttccatgctactaatgctgctgctactcctgctccatctgtccggcggagaatggatcaacgtagagctgagcgttgacccacccaatttctttgaccgcacctttcgctccctttccaagacatcacccatccaacattggttcggctacaaccggaacaccgcgtgtcacgttgagcgggaaacaaacataaatcgactgtacaacagtgctgatatgtggaacattgccctcactgatgtggacaacttcatgagcatggggcggcaaactatcgagttgttgtccagcgcattgccgtgggcgtgttttggacatgaccgccacagttttgtgatttttgaccttcgaaatgacgcaaatgaagtggcagttgtgcgcggtcatcagcacaagatagcacgaaatttgagtgcgtatggacgcattttgttcgaccatatttccggccggttgtacatggtggacaagcacgagcgccggatccatgagctgctcatcaccgattttgtgcgatggtggactctgaataacactgacggaggtggtggtggtggtggtcataacggcggcggtgagaacagcacggcaacacactcgttgaggagcaactttgtcgggtttttaccagaacaaaaaacggattttttcattgcggccgaccatgtgtacctgatttggcgtagacgtgtatacaagttccgtgttgggcactacttcaatgatccttcctcgcagctacagtttttgaccaactccagtgacattcgcttcaacttcctcatattcgagagagatgatgacgccanaattggaagacagcactga

SEQ ID NO: 53588 - DNA, 411 bp, Heterodera glycines
  Genomic contig location: Contig_ID=SeqID_22879; Location=41..451; Strand=-
  SCN-specific regions: Sequence locations=1-240,263-411
atgatcaaaacattccaatctctactcaatccaccaacatttcaatcactgggactcaacccaacagcatttcaatcactggcactcaacccaccaacatttcaatcactggcactcaacccaccagcatttcaatcactggcactcaacccaccaacatttcaatcactggcactcaacccaacagcatttcaatcactggcactcaacccaccaacatttcaatcactggcactcaacccacagcatttcaatcactggcactcaacccaccaacatttcaatcactggcactcaacccaccaacatttcaatcactggcactcaacccaacagcatttcaatcactggcactcaacccaacagcatttcagtcactggcactcaacccaccaacatttcaatcactga

SEQ ID NO: 53589 - DNA, 417 bp, Heterodera glycines
  Genomic contig location: Contig_ID=SeqID_22879; Location=1038..1454; Strand=-
  SCN-specific regions: Sequence locations=1-250,272-417
atgatactcataaaaaatacaaataattcaacccacctattctatgaccacattcgaaaaaaatcccagaaatacgaggaaagatatgcttggtcacaataaaataaaaaatggctagtatgtaaaaattggcggtcacaaataaaataaaaattggctaatatgtaaaattggcgtccagaaatttttagactaatccgaagcaaagcacgaatgaatattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacac

SEQ ID NO: 53590 - DNA, 155 bp, Heterodera glycines; identical to SEQ ID NO: 51421
  Genomic contig location: Contig_ID=SeqID_22880; Location=907..1061; Strand=-
  SCN-specific regions: Sequence locations=1-155

SEQ ID NO: 53591 - DNA, 98 bp, Heterodera glycines
  Genomic contig location: Contig_ID=SeqID_4205; Location=223..320; Strand=-
  SCN-specific regions: Sequence locations=1-36,58-98
atgcgcagaccaaggctggggggcgggcctccaacgctttttgtcctttctctcttccgcctcactggtgcccaaatggacgccgattttgggcacaa

SEQ ID NO: 53592 - DNA, 2409 bp, Heterodera glycines
  Genomic contig location: Contig_ID=SeqID_4205; Location=3141..5549; Strand=-
  SCN-specific regions: Sequence locations=1-282,304-358,492-589,617 -1185,1207-1227,1255-1460,1491-1511,1533-1557,1578-1803,1825 -1900,1948-2409
atgtggccgtctgatcagccgaccaaggagccccgggcattcaatctccgcgacatggatcatccggacgcggttgctggtaagtgtattttcagtggcaaattttgccaattttcccaaaaatgcccattaaatttcagccattttgccgattgccattaccaaatttttgattaagttttataccttttttcgctcggatcggaatctgattagtgctcattttattcctgatcagttttttcaatcatttattttctctctgacatttccctgtttgaatctgatcaccacctgaaactcattcttcttgattaccttttatttccgattaaatttcattatttttctggatcattttccttgatcatttctttctttctttctctcgctctctcaccctcattctctcccccccccgtctctgatcactctcttgcttccccatttgtctctctcttctctcctccattgcttcttcttttccttttccgccccaatcaccgccaaattggccccgcaggggacaattaacataaacgggcgccgcgcgtttcactttcgcttttccgcgcctcttcaagaagcgtttatttgtgttgtgtatatatttattcatgggtcaacaaaaacatgtttttttttgtacccgtggaacgtcactgaaccataaaatttgttgacaaattttcaaaaaatctaaaaaaaagaggcttatccggaagagggaccgtataaaaaaagataaatccccgctgaaaaagtgtcccattttcctttttttacgacggttctactcgagagtcttgagaacggaatcgaaatgccacaagaaatggatggatttgctgtccataaaaacctctacttcagccactttttggtgatcacatgaaaaactgattttttgaatgtgtttattgttaatccacccgaattttcaacaaaattttcccattctcgagccaattaagtctcgaaacactcactatttagctaattacccccactcgcgcaaaaaaagaaagaataattccctaaacacaaaaaaagtccgaggtcacaactaggcacacatacaatgggaaaatttacctcaaataacctttcctcgcccaaaaattgcagcgcacctaattcctcaagatgccatcgcttttagtagtctataatggacatgactcatcccaccctttttcatcctctgctaatgaatgggactggggtcatttgtccccctttcccccctcgcccatcccggcatttccccggagggggggggggggggacggactttgctaattgtaaggacataccagcagatccgcgtcctccaaaaggacacccaccacaaacatttatctctctccctctcccgaccgacttaccgcgcgggagatgggatttgttgaacagcgccgccaaaaatgggcaattaattaagtgggcgctccgcgcggctcacgctcgcgcgggcgacgggacggaggaggacagtggcaagtgcatgttgttccttgtttgttgttgttacttttgtaccacggggacggggtgcgttcgttcgttcgttcgtttagtgtgcccccgaggggacactttgtcccctcaccgccctccggggccccccgtcccgtcctctccgctccggtcaaggtctgtcccccgaagcgaaaacgcacttctctttctgtgccgactcgcggcgcggaaagacatttcggcgactttttaacaactctcttcttctcttttgaggtgtttatgtgctggaagtgaggaaaatgggaagagagatttggagaaagatgaatgaattgatggattggaacgaattttgaaaatggaaaaaaaacaaaatttaaggcgcgaaaaatttggcattccgtcgacaggggaatttggaagatgaattggaaaatttaaaatatttcacatttgaaaaaacgttctaatagctaatgcgcccatttaaaatggcaaaaacaaaaaaaattcggttccttcggtggcattggaaagcgattcgaaataaaaatgggcgcggcattttaaactcgaaccatgagttcagagttctgttttgcttgtaaaacatggcatttgccgggttttgaggaccctctgggcttgggttttttgtccggtatttgcagggatttttgacaaattttgccagtttttttcattgttttgccagggttgagaatattggcattttaccaaaaacgcaaataaatatgtataacggcttttgaccaattttgttgccttttagcattggaactcggtctgcttcatcattacccgccgctgttaaatgcgagtgccaaccatgacgacgactccaagcagtacttccgcctgttggagctggacggcaaccatttgctgatcggcgcagcgtga

SEQ ID NO: 53593 - DNA, 543 bp, Heterodera glycines
  Genomic contig location: Contig_ID=SeqID_4205; Location=7618..8160; Strand=+
  SCN-specific regions: Sequence locations=1-84,131-172,197-297,362 -374,396-427,451-543
atggcggaaaattatggacagacaaatggtctaattgtggtgccaaaaaggttggttgcttccttggcattttgtctcctcgactaatttaaaattaaataaatgtatcttttttttattaataattattgaatatacgcttcattgtcattttcaaatagagaaataatgcatttaaaaaaataaaatattttttcgccggagttcttaaaaaggaggaaaaaatacgcaagagtaaatatccccaaatttaatcgttaaaatgattaaatttctcaaagtgattattgttgtgccaattattaaaaatttaataaaaaaaattccagtatatttttaaatttttaaatatttttataaaccaaggggcaaccgcttttgcacttttatttgttgttgctcggtgctaattacttataccatcactcatatttatttatgtgtaatttagtctcatatgtcaaaagttgttgtgtgatgaagaaagaaattggtacgtaaaaaacgctcaaattgcctcgggggagaaaaaaattattatta

SEQ ID NO: 53594 - DNA, 970 bp, Heterodera glycines
  Genomic contig location: Contig_ID=SeqID_22886; Location=566..1535; Strand=-
  SCN-specific regions: Sequence locations=1-221,243-496,519-970
atgctttccctcaatggcactttccctcctcagtctcttaaacccttggctttggcatttgttctcgatggcgggattggttcccaattggaggagcttggctatcccatcaatgtgatttttgggcctttctgacggggtttgacttttgaccgcaaacagaactcggtgatttggagtggggaagcaataatcgatgcgcccgaccttttggccaaatgtcataaaaagtaagagaaagtgacggattagtgaaaacgaaattaataatgtgtcaaagtctcaactggtgattacctccgtgtccaaaagatgaagccttcctttcccacatctctcatgccatttttcttttttttaggtttatcgatgccggggcggatataatcgagacgaacagttaccacgtcagcattcagaaactcatggaaagccggggcttttcgctgggacaggccgagtccatcctccacgtactgctccaactttgccacttgccacccttctcaccctcccccttttctcctatttcatatgcctttctcagaaatccgtgctgattgcccgtgaggcaattgctgcttcgggtcgtccggtggccctcgtcggtgccgtcggtccttacgccacctatttgagggatgcctcggaatacaccggtgcttatgtgaaaaagcccgacttccaagagcaggtggtcactttgctcgcaattcgctctcggcaaattattgtttcaaaattcgtttggcactcccttcagaccatcatcgactattatctcctccaatgccgtcctctgattgccgcaggagtgaccacgctgaacttcgagaccattccgtcggtgaaagaagtcgaatgtgtggccaaagtgatggaccaattggacgacactgtgcaggcgtgggtttgctgttcatgtcaggtgaaagtggacaagcagattaaaaggagcaaaagcatttga

SEQ ID NO: 53595 - DNA, 693 bp, Heterodera glycines
  Genomic contig location: Contig_ID=SeqID_22887; Location=169..861; Strand=+
  SCN-specific regions: Sequence locations=1-552,592-654,679-693
cattccaatcactgggactcaattctcatgcatttcaatcactgggactcaattctcttgcatttcaatcactgggactcaattctcttgcatttcaatcactgggactcaattctcttgcattccaatcactgggacctaacctcacctggtccttcggcatcgcaatcatcgagactcaattctgcgacattccaataactgggactcaactaaccagcattccaatcactgggactcaattctcctgcatttcaatcactgggactcaattctcttgcattccaatcactgggactcaattctccatcattccaattcccgggactcaatcccaccagcattccaatcactaggactaaatccttcacttttcacggattcttcggcatcgtaataaccgaggactcaattctcctgcattccaatcactgggactcaattctccgccattccaatcaccgaggactcaatccttcactattccaaacaatgaactcaattttacggattcatcggcatgtcaatcacgggacttaattcagacctgttcagcataattttggaattttaaaaatgtatttcaattatgaaatacaatttgcgtagaaaatccttttcattataaatacttgttctcttacattttaataatttcttttacataaatatctacatacaaaaaaagaacaa

SEQ ID NO: 53596 - DNA, 805 bp, Heterodera glycines
  Genomic contig location: Contig_ID=SeqID_22888; Location=163..967; Strand=+
  SCN-specific regions: Sequence locations=1-110,133-650,674-748,772-805
atgtcacgattatttattttgctcttaccagcggaattaatttttgagatcgtatgcaatattcctaccttatccttatttggtataattataatcgaaagtaaaataaatacttattttagggagaaatggacctccgtgtatcacagggatagtcaacagacaatttgaaacttttagggacttgaaaaaagaaaattttaaaaaattggtaaattatttgcaaaaacttgtaactttttactaatcttctttaattttagaatgatttaattgatatcattagcataaaatgtaagatacaaattacttattggggacacataaaccgaagattttacgtccatgaacatgctgttaaacgagatttggtagacttagtttataatgaacttcattattatgtacgttatggtaggagtgaaaaaaatttattagaaggtgttacatggttttcccccgttaatgaggtaatttatgaaagagaatatagataatattctaatttagaccaacagttttcttgctcttttattcaaaaggacattatatggttttatacaatcggctaatcctttcaccatgagaaaatatatagttttaggcccaattatgtttaatgaattaccgttaatttttgatgaatcggttgacaaaatgataaaatttggtatttatcccggggtaagagacaattacacaggcattttttatgtacgtaataatcactggactgctgaaaacagagtcttaaaaattttttcttattttcatccaaatcctggaactttgtttatatgtttta

SEQ ID NO: 53597 - DNA, 428 bp, Heterodera glycines
  Genomic contig location: Contig_ID=SeqID_22889; Location=324..751; Strand=+
  SCN-specific regions: Sequence locations=1-244,293-428
atggcaacagtgattaaaaaaattcgaatttttgttcaagttcggggccgggatcccgaattgtgtcgaaataaatgccatattcgtgaacagcgacctcgaaaaccaacgggtattcatcattatgtgtaacaaaaaaaatagacaaaatatgaggttattcagtccttcactggtggttatcgtacgaaatccgaagactcaccacggatggccatccacgagtgtccgcttcggtctcatcggatgaggaagaggaacagcaaggaaaagcagaagaggaggaggaggaaatcatcggaggagaacgaatgccaaatcgtagagcacagcaaaccaacaacctttgataaaatagggagattttattaaagatggcatagaaaagtgaagaaaaatcaaaatcagagagaagggcaaaaaattga

SEQ ID NO: 53598 - DNA, 1032 bp, Heterodera glycines
  Genomic contig location: Contig_ID=SeqID_22890; Location=28..1059; Strand=-
  SCN-specific regions: Sequence locations=1-242,264-555,577-941,977 -1032
atggttaatgggttgctttgtacctcattcactgaggctgcaataatgcatggtcttcttgaagacgacaaaatttgggacaaaactctggcggaggcagctctatcgcgctggcctgatcaaatgaggtggctcttcatgagcatcctcgtttatggccggcccagtaatgccgtcgaattatggaacaagtacaaagaccaaatgtactttcctcaaggcattaccacaccggcacaacgccaagcagcagagcttgaagccctagctgacattgattggcggctgcacagctgctttaacttaagctgtgtgcattttagcctgccagacccgccaaactcaattgccaaaaatacaaatgcggcaattgatgaatttttctttggcgatgatgatttgaatttgccgcctggccaaccaaatcctcggcctcagcaaatcactcctccgccactcaacagcgaccaacaaacggtctttgatgctgttgttaaggctattcagtcggacccaagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaatccaacaactccttagcaatgacaaggagttgctcaaccgcttga

SEQ ID NO: 53599 - DNA, 957 bp, Heterodera glycines
  Genomic contig location: Contig_ID=SeqID_22891; Location=1056..2012; Strand=-
  SCN-specific regions: Sequence locations=1-203,225-786,808-957
aatgcatttctgccggagtctatgccgcgcaaaatgaaatcttgaccaccggacgaaccaccaagcagatggacgaattaacatcaaaaactcccatttcacttccagtgccgcagtgtcccatcattcttgtccatcagattgatcgaatgcaggaggacccgacctcattttcggcaacaaatccaatgcaaacccggactgtcatgaagtgcttgactttcctacggccatgtttcaacggcttgattcgcgttgtctgcttttacgctggtcaagcgaaggaaattggaaccgaagtgtctgcgctcaacatgccgaacgtaatggtaacaacagttgatggttgccaggggcacgaggccgaattcgtcttcgttgtcacaacaaaagccggcctgagctccaatgacaacagcggcgccttttggaacgatgaacggcgtgttaacgtggcactcagccgcagcaaattcggcatgatggttgttggcgacttgaagctgttgtggacagctgacggcatttggcggcgattcctgcgcagagctctggataaggctattgctgtaactccggagtatatccatgcgatgatggacccgaaaccgcaatttgtggatggcgtaattgccacctcaaacggatcagtgaaagcattcgacttttacgatgattggcaaggttctgatggtccctctctgcctaggtcaattagacctccgcgcatgttattcgctggcactttcgaggcagcagcagtcagcacgtcaacctggttcagcacatccgaacatgcccgctggtctgtgccactactgtctgcgccctggtcacttccttcgcgactgtcctgaccgccctagcccatcaccaaacatgccccgtccaacatcaagccgcccgggccaatggaccaatcgcacaaatgatggaagaggcagacgaaacgactga

SEQ ID NO: 53600 - DNA, 1377 bp, Heterodera glycines
  Genomic contig location: Contig_ID=SeqID_22893; Location=377..1753; Strand=+
  SCN-specific regions: Sequence locations=1-316,338-389,411-486,508 -664,687-828,852-989,1011-1043,1065-1377
atgactttggtttacccccaagaccaacagcaacaagtgctgatcgagcaacctaatttttctcaaaatcatcaaaaattcactcgccaggtctttcagattccggaaacgaatcaagagcctagacatttccctacctatccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggtgttagaaagcaaagttttcaacaaagcagaaagagcttttgaggcagcaaagtcaacgcagccctaccgatacgagcacatccgcaaagatatgattcagcagttggaagaaaccgactcaaagcaactaaatgcttttgatgatcttatgttgggcgttcggagaagacaaaatgagagcattgatgagttggctggaagaatttctcgcctagtaaagagtgcttatccgggtttgaccaacaatctgtgcgacgaatattcgatcaaatttctgatcagatcgatgggaaatcccgatcttgcgttaaatttggaattaatccgcacaccgggaatgactcttgatcattttgtgtcactagcagcaagggctgaatcaacccaacgcgcttcaaaacggttcagtacacacccaaatgatggctttcaacagcgcgagcaacaacccaaatggcgacaaaattttggtggtaactcaagccaaaacatggcgaaggttcaaaattttgctggaaacataaatcagcatccccagcccaaagaagacactagaaatcaatggaaatgttacaattgtgatgaatatggccacctttcacgcaattgttcacgtccaagaacttttatgcaaaaccagccaataaatcagcaaaaaaactttgttgctattggtgcgaaccgaactcaaatccaacccccaaatcagaaccgaaattttcaaacaccaaaaccaaattcagctaatttcctaaagcaaaattgtttggtggtccagcatgaagaagtcttagccgaggcgagggtaaacaaaattgagttggcaccggaagtaagtgaattttatgaaaaattggaacggatcaccgaaagcaaaaatgaaatttttttgccaacaattggaaaggttatgtcgttgaaacttgaagtgtttggcacagaaaccgacgcaatgcttgacggaggcgcacaaatctcattgattagtggtgattttctgcataagttgctgattgagaaagcgattacgctggaaacattgaaaagttcaaaacgaaaacccaaatttttgacgtaa

SEQ ID NO: 53601 - DNA, 1292 bp, Heterodera glycines
  Genomic contig location: Contig_ID=SeqID_22894; Location=467..1758; Strand=-
  SCN-specific regions: Sequence locations=1-738,760-786,809-852,1029 -1054,1099-1112,1134-1221,1243-1292
atgtgtgattttgaaggcgagttcgcgggtgtcaatgtgcgactcgaacatgcttatggcctgcgcatcgaaggccgattcgcgcggatgacaagggtaaaagtatccgctcactttagcaatagatttttttatgaaaaattcaagaagttcagcgattttttttaaatttttgaaaggactaccctgtcgcgtgtacgtacctcccccaccaaaaaacacccttaaaccgacgaaattttgaggggaaaaggatttttgtcagaaaaatgcacaattaatcgtggataacgagataacgaattcagtgatatttagaaaatttataaaaaagcaaaaaattatttcaaatttctgtttttcatgaatttttcaagcaataattttcgatgaacaatcttatactcattaaaagtttagacattttccatgccctcggctgactgtctctcctccgctttcttttctcggctctccatccttactgaccatcctccgctttcgtttctcggctgactgtccgcctacatcggcatggttgcgttgttgacaggcagagcagtgcgcgccgattggtgtgtcaccggcgaactggatagcgatgaagagtaaatgaagtcgctgggatcccgcaaaaagtggcggcgtcaaattttaaacttaagacatacataagaattgaacgggaaacccaagatggatatgttgtgcatgcgagaatttaaaaacaaaaatagatgaaatcataaagctaatgtattgttattttagaataaacttgctttcaatttctgaaattttttgttttaaaagtattgcgagaataattttttaaggaaaatctaggaatggtatttaaacataaaattattagaaatcaataatatttaaatatttaattgaatataaatttactttattgtaaaagattatttttagaaaaaaattataacaaaatgataatgaacaaattcatttttgttttttcaaaataatatttgtaaatcattttaaatatgataatatttgtccgcttaaagaacggcaactaatcaatataaatttagaaaataaataaaataaatttaattaaattaagtataaccgaaaacttttgcttttcggcgtttcaacgagatcaagtcaattaattacatgcctgaaaaacagaattgcatatgaaaaatgacggaataagagaaaaataagacacctacaataatatggagaatttaaaaaatgaaagagagtttcatagcatataaattacaaattcaattaaaggaaataaa

SEQ ID NO: 53602 - DNA, 1008 bp, Heterodera glycines
  Genomic contig location: Contig_ID=SeqID_4207; Location=360..1367; Strand=-
  SCN-specific regions: Sequence locations=1-3,25-245,270-314,337 -502,524-852,881-1008
atgaaatttgcaaagaaaatgttaatgattcccgaggcggaatatttggctctacggagtgcgatgaatagtggtgattatctccaaaatgaaaaagcaagtttagacgcaaaaatttctcagaatttacaagaccccggcataagcgaggacctcaaggcgaagagacatgattggctctataaagaaagacgtacggtaaaggggatacttaaaaatagaccacagaaggtagtgattgagaatcatgtaccaggtccaaatgttgcaccatatctgggcctcaagaaccaatccaaaccacaggagaccgaagaaccacggaaaataattattcctaggaaaagacttaaagagcaaactcctgatcctgaatcatataatgatacacttgaggagttaactccggagcgccaaacaacatccacattaaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgatttttaatgcatcttatttatttgacctatttatattttcatagggaacatgtttcgcgcatttggggcatagccagaaattatcaaaaaatgatgtaccgaaatgcaaaagactgtgttttttacatctgttacacaactcgtaatgacaggggcagtaatgacaacacttaattttatgtggacagttcattttttcaatttaattttattttttttggttgctatttatagaaggggtatataaagggagtgaaaggacaatttgattggtacattgtatcaaaatgcaaaacccgataatcgtaaatataattgctctcgctaatctcggtaccggaattaaa

SEQ ID NO: 53603 - DNA, 356 bp, Heterodera glycines
  Genomic contig location: Contig_ID=SeqID_4208; Location=1088..1443; Strand=-
  SCN-specific regions: Sequence locations=1-356
atgcctccaaatgaaaattctgaccgtccctttcaacaacccgacaatgttcaaccagatcaacaaccgcatcaacaacaaccagatgaagacaccgagttgcgtgcacaaattgaagacgcggaggaggatttgctcttgaattggtggcgtgaagacccaacaattgtaagcttttttttcaatttagcatagttttttttaatttcatcacatttttcagattcgttttcttttttggacacagacgcgcccctgccatcgaagctgcgcttcgtcaacgcgctgaacgtgaggccgagatcttgcgccaatatgccgagaatcagcaatgagaagtgaccgatcaaaataaa

SEQ ID NO: 53604 - DNA, 965 bp, Heterodera glycines
  Genomic contig location: Contig_ID=SeqID_4209; Location=109..1073; Strand=-
  SCN-specific regions: Sequence locations=1-229,251-544,566-965
atgcatgttgattttgatcctctacaagtggattggtccacattctcgtccgagtatgtgcaatttggtggatacaacatttatcgagggttgccctatcagcgtggagcgggagttggcgcagtgttccgaagccttatgagatacttgctgccgattggaaagcaaattggctccgcaattggacgtcaaggaatagaaagcggaaatcgagtactcaccaatgtgctggagggaaaagacctcaaagagtcgctcgttagtgagagtaagtcgggactaaagaatcttcttgaaaaagcggccaacaacataaacactcagaagggtcaaggttttgattttaagcgatacaaaaaagactcggctcccaaaattggaaaaattgggcgaaaaaatataaataaacttcaatcgtcaatcgggccaccaatggttgttaaaaccaaaaataagcgtctacgtgttgactcactaggaacttactaaaaatgacttgcccacaaaaaatcagcgacagcagtcccctagcaattaacagtggcctgaacattttctcagttccaccgaccaacgtgtccgttgttcgctcattctttcgtcaagtgcttccactagcaacaatcacgcaagaatcgccttacctatttcgactgtacagtgacaatttgtggacagatttatcacggatctacctttatctcgaactgtcaattgaaaaaccgggagcaaacgataaatgggttgcgatagaggacacggatactggtgtctctgccattcaaggaatagggcaaacatttgtccagcaactaaaagttacggttggcaacacggaagtgtacgatagcggaaatctgtacccattcaaagcgtatatcaccaatgagttgagctttccaataaatgccaagaaacgattttctttgttcaacggggtattattacaccgtaaaccgagatga

SEQ ID NO: 53605 - DNA, 1894 bp, Heterodera glycines
  Genomic contig location: Contig_ID=SeqID_4210; Location=66..1959; Strand=-
  SCN-specific regions: Sequence locations=1-1186,1228-1704,1726 -1825,1847-1894
gggtgtcggaggaagggcaagttttgagagctggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggtcaatccggcaaaggaatttataaaaacaccccacttaagtttaagccatcattatggatttgaaaaagcttcgtttgctcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggccaagcggcgctaccgccgattgccaacattggcacccggcttgcatactgaatggcaggccgatttggctatttttgaccgacttgataaacaaaatcatggcttcaagtacttgttagtctgtattgatacccttagtcgacaggtgtttgtcgagcccgtaaagaccaagacgagcgctaacatgatcattgcctttgatcgtatattcaaaagatcaaaatatatcccgtggaaggtgttaacagatcagggaaaggaattcactgcccgcgcagtacagcagttcttccgcacaaaagacgttgaacacttttgtatgctcacttctccccaatttcatgccggaatggcagaacgtgcgaatcgtagcatcaaagagcgcctttatcgctactttacggagcgtaacacgtacaaatggattgatgttgtgcaagacattgttcgtgcaattaaccactcgccaaattcgagcattggaatgcgcccagcagacgtgaactttaaaaacgcagaagcgttgagacaaaaattacatgatgcagctgaaaatgttgtacgacgccagccaaaataccgtgtgggagatcgcgtgcgcattgaaaagtacaagcacgtgttccaaaagggctatctcccacgcttcaccaatgagctcttcactgtggcagaggtacactctgagcgttcgccagttgtttatcgattgcgtgatgaccataatgaaattattagtggttggttttacgcaaatgatttgtgcaaatcactagaagacaaacagcaaaaaatgtatgaaattgaaaagattttggtgaaaaagaggcagaacggtgtggattatgcacttgtgaaatggaaagggtatagcgctcgctttaatagttggattcccgtaaattcaattagcgagaaagatatataaaaaagcactatttaataaatttaacaaaaatgccttcaaattctttttatgttgttgttccgtcgaacaccaatattgaaggaaataggacaaattctttccgagtgcgtttaccgcgcaaactacaattcaattcggaatgggaggtgggtctggcggtgattgtgtatccccactcttggccttccataggcaccgtggagcaacagtttgttcaggttgagtggcaaacgggaaatacggtgcggattgagcttccatcatcaaatgtcaccaacccccatgagcttggcaaaaatttgtacagactcctgggtgagggcagcgatccgttggcaaaaaaggtacgctcaactcagaattctttcatgcttacgataaacaaggctcgtcggtggaccagagaagagtacattaagcgaaagaccaaagaaaaacggggcgtccgtgacgaagagctgctcctacaggccctgttgacagatactgagacagtggttgacctcaacatcatgacccacggccttctggcacgggaaaagc

SEQ ID NO: 53606 - DNA, 1215 bp, Heterodera glycines
  Genomic contig location: Contig_ID=SeqID_22895; Location=962..2176; Strand=+
  SCN-specific regions: Sequence locations=1-124,146-721,745-966,1009 -1182,1204-1215
  Gene Ontology: Cellular component=apical plasma membrane; Biological process=cytoskeleton organization and biogenesis
atgatttgcatccattggaagggcccactggtgttgcaacaagtattaatttttgcatattttccttaataaattgatcgaaactgattggctccccgccggacccaaatccctaattttctgaaaaatatgctaaaaatggcaaaatttactcatttatcaacaaaatatgtttaccaatcgctttccaaaattgttccaccggcggcactccccatgttccacaaaatttttgaaaaaagtgtttcaatctcccatcgtattggcctgcgagacatcccttgaatatgtttggattttttttgtctaagaaataccagttttgaaggtctaagggaattgaagggacccctcttggggaacaccaaaaattaccgttacaattttccattttttttttgctggtggataatgtgcatgtctagaagcgtaagaatttctttgttgggctaacaaaactgaactaacaaaattttatgtttaaattgccaaaaaatccccccccccctctctctttttagttctatttgatcgtcgtttccgctttgatggcattgcttttcatcaaatatttgccggattggaccgtttggacagtgttggcaattctgtcaatttgggtattttttttcactggcattttttggctgcatgacaataactcagtttttgtttggcaccatttaaaagttcaaattctgcatcgaaaaaccgagtgctgaatttaattaaaaaaaaaaaattcgtttaattgcaggatttggtggccgtcctcagcccaaaaggtccgctgcgaattcttgtggagaccacgcaggagcgaaatgagccaattttgcccgctctcatttattcatgtaaaattttttttcttgttataaaaaaattactaggatttctgacaaattttgtttgaaaattaacaaaaaaattcaaagggcggggggagcagtaatttatccaaggtaataaataaatatttaaatatataacatttttaataaaattcagcaaccgtcactgtcctctactcatatgtgctccatggcgttgtttcttccgcttttattgtcgccgccggggtgggcacaaatggcgatgatgaagacgaacagcaacaacggcaaccacaaccgaatgatggtaggcagcagggatgggccaaatcggaaaataaaacgcgaaatttgtgaaagcaaaaaatgcgaaatgaaa

SEQ ID NO: 53607 - DNA, 150 bp, Heterodera glycines
  Genomic contig location: Contig_ID=SeqID_22896; Location=1586..1735; Strand=+
  SCN-specific regions: Sequence locations=1-15,66-150
atgagacgacaacaaataatgctaatggtaattgacaataataataatgatgatgatgcagatgagcccagccagcagcagcggaagcaatgcgcgactcaatcaatgatcagtgatcaaatttctgaccgatcagatcaatgcgccgcg

SEQ ID NO: 53608 - DNA, 233 bp, Heterodera glycines
  Genomic contig location: Contig_ID=SeqID_22904; Location=235..467; Strand=+
  SCN-specific regions: Sequence locations=1-233
ggcgcccccacaaagtgtccaagccacgaaatgtccaaaagagtaaaaacccacgaaatgtccaaaatttttcaaaatttataaaaacaaaatgagtctaatttcgaatttttagggttttcggggtcgctgaatacgaatatatacgaatataccctttatattaccccttgcctaaccttaggcccatctgaataataaaaactcaaattcgagacttggacattttgtgg

SEQ ID NO: 53609 - DNA, 778 bp, Heterodera glycines
  Genomic contig location: Contig_ID=SeqID_4211; Location=325..1102; Strand=-
  SCN-specific regions: Sequence locations=1-66,88-149,180-507,530 -580,602-778
atggataggcttaaagttcagtcgatccacatagaacccgattatggtacaggtattttaaaatcaataaaagagaatttatttcataaaactacaatttaaaaaaaatatgaatagagtttcaaaccaaattcagatttaaaacttaattttttaaaatttcaggtttaaactacatattgccgcagaactactctgtggacaaaattgtgttttttcttttgttgaggatgttgataattaaggtaaatgtgggaaacaaaataatggcactgtaattagtgtatgtttctaaaaataggtcgagaattgcctattatatttattagtaaaatttagcgaaaaatcaaaattttctcacttgtattgcaaattttataactttgttgcaattgcgatcaatttgttgtggaaaagaaaaataaatcgattttatggcatttacagttgacaagattcccggttctaatctatttttaaacgcgttctaatacgaaaagctgcaattaataaaaataaaacctatttaacatcagttttgccggtaaaaatccaataaagacagaaggaaatttgtaataaaatagagcatatatgaaaatttcagaattttctatacgagtatgtaatggtcaatttaacgagctgatcttcactttgtttagttaaattcttgacctttttaaagggtggttgtatacatctagaaaatggaacaatcgaatgttgattactgcagaaaagatagaccgtattacgaaaaaaaatgaaaaataaa

SEQ ID NO: 53610 - DNA, 2943 bp, Heterodera glycines
  Genomic contig location: Contig_ID=SeqID_4211; Location=2320..5262; Strand=+
  SCN-specific regions: Sequence locations=1-62,85-539,567-1267,1289 -1977,1999-2060,2082-2392,2414-2446,2468-2589,2611-2639,2661 -2897,2925-2943
atgcaacttttgaggcaacaaaacatagagcggcgtaatgtaagcccactccggtcgccattcgaacaaaattttcgggaaaatgtgattgtaaacccgatccgtaatgaaaatcgaggacccaatcagcattttgcggatggatttggaggacaaccaaatcctaatgcccgtctccaagtttttcgacagcaacacgccgaaatcgatcgacattattcgagtgcttttcatgcaccggtgccgatgcgacaaacctgtcacggacaaattcaacaagctgcgtatatggagcaacacggtgcgcatcagcctatgctgctccagcaacaaaatatgcgaggagtgatgcatcatcagcagccaatggcggggagaaatgaatattttcctgaatattacggcggaagacatttgtatcccgacggcagagaacaaccaaactcggggaataatgaattaaaaatcggtaatatggaatatgtgctgaccatggaccgacttcccgagctaaatggcaatgagggaactgacaaaatgaaaagttttttcaaaaaattttcaaatgtcacggaagaatggccggaaaaaaaacggattaaagcgttggaatccgaagtcaatggacgggcagagcgtgcctttaatgctgcgcttaacacccagccctatcgtttcgattcaattcgacgggcaatgcaacaacagctcgaggacacggattgtcgcgaaatgagcgcattcgacgagttaatgagcggagtaaagcgaaagccaaacgaaagtctggacgcattagccgatcgaattcaaagtcttgtttcccgtgcgtacccgggcttgacgcaaaatttgtgcgatgattatgcaattcggcacctaatcagagcactgtcaaatcccgatctctcattaacgctcgaaatgtcgcgaaggccaggaatgtcgtacgatgaattcgttgcattggccgcacgcgctgagtcaattcagcgtgcaacaaaagtgcaggcgaccgaaaacagaagcaccgacaatcggaaccgaaacttttacacttcgaataacccgattagacagcaaagtggaggatacgaaagtaatccccagcaaacacgaaagggagttgtatgctataattgcaacgaaccaggccatatctcgcgtgaatgtcaaagcgtaaggggtcagcgaaacgtaaacaccggcgcagataggagtaggcaacaatttgcgacgggagcaaataacatttcactgcgaaacaatgcagacaatcagcggaatgccataagaacatatccggctgtaaaatcccaaaatttcctcaaacaaaattgcatagtgatgcaagaggacaaaccccccgatgcattttgccgaggagtgaaattgacatccgaaatttcgagtttcatcgaaaatgaacttggtgaagcaacgcagactgaaatgtctaaaggaaaggaccgggtcggaaaaattttggtgattaacgtagagacatacggcacccaaacggtagcaatgttagatgggggagcccaaatttcactgattggagcaggatttctgtatgaattgatcaaagaacgaggcttagacctcaagaaatcggacttctctcgaacgtcagcacgaattgccgatgtaaatgggcaacaattgaaatgttttggagtggtaacaattccgatcacacgaaaaggttgcagccaaataccgatctgctttcacataacaaccgcacaatttggctacgacttgcttcttggcaccaattcactttcaaaattaggatttcttctgtacgacacagcgaacaaagaaatgattgaatttgaggaaatatcccaaaatgatagcaattctgctcgggttattttttctacaaaaattcaaccccgctcaacccgcctcatcgaaattggtgttggtgatcagtggaatggaaaagatgtggtcatttctccccaaactgtgaaaggaaatgttaaagtggaagaatcagtgggaaaagttgaaaacggcaaagtggtcgcccaaatcacaaatttgtcggcatttttggcacaaatcgatgaaaaaacggaaattgcgaccgtagagtcagcagaaatcgttttcgacagtgaaaattcgattattcaggcggaaatttattcgccaattgcaaaaccgaattcggggaaccgaaatgttggcaatgactttaatgtcggcaaactttcggaaagccaaatgttggaattatcggagctcataagtggccacgccgaaatctttgctttttctgaagaagaactaagccaaaccgacttagtccagcacacgattgaaacgggcgatgcggccccgattaaatcgcaaatgcgacccgtcccttacgcttacagagaaaaaatttctgtgatgatccaggattatctaagtcgcggaataattcagccatcaaattccccttgggcttcaccgatcgtaattgtgcccaaaaaggatgggacacttcgtttctgtgtggattacaggaaactaaattctgtaacggttaaagatgcatttccgttaccgaatattgacaacacactcttggcattgggaggaaggagagtattttcaacattggattttatgtcgggctactggcagatcaaaatggatcataattccattgaaaaaacagctttttccacggaattcggactacacgaatttttggtactccctttcggcctttgtaatgccgttgcgacattccagcgatttatgacgcgccttttctccgattgccttaacaaattcgttttcatctatattgatgacattttgatcgcgtccgaatcatgggaacagcacaacaaacatctgaaagaggtgttcgaacggatccaaaacgctggtttaaaattaaaaaatcagcaaatgtcattttgcgtcaaatga

SEQ ID NO: 53611 - DNA, 1824 bp, Heterodera glycines
  Genomic contig location: Contig_ID=SeqID_4212; Location=57..1880; Strand=+
  SCN-specific regions: Sequence locations=1-107,130-177,215-505,527 -888,924-995,1036-1824
atgaaaattgttgcaacatccgaaccatttgaattggtttgcctcgacattttgtctatcggacccgcgcattcgtcatgcaaatacatattagtcgcggttgaccacttttcaaaatacctggtagcaacaccaatcccaaacaaaaacgcagacacaattgcgcgcgaatttgtaaaaaatgttgtcttaatttttgggacaccaaagaagattcacagtgatcgcggaaaagagtttgtgaatgaaactcttaacgaaattaccaaaattctacaaatggaaaagaccctcacttcgggatatgatccacaagcgaatggcgtaactgaaagagtgaatcagacaattttgggaatgctaaaacggtcaactgcgtcaaattgggagtgggatgaccgtcttccatttgttgtgttttcatacaatacaactccgtcagaaacgaccaacatttccccataccatcttttgtttggaaaaccggcaaattttccttcaaacatttccttaccagttaatccgttgtacacaattgatgtgaatggatacattcaattgttcagggaaaatatcgcgcatttggtcgaaaaggcgagggaacactccgaaaatgagcgccaaaaaatgaaaagttattatgataaacaggcaaaagtaactgccaacaaattcgtcgttggccaaagagtgatggtcatttttcccgggtccaacaaacgttctccgcaccataaactaatgtggaaccatttcggaccgtttaaaattacggaaattacggattcgacagcgtttgtaatccccgtcgacaagccgaacgatgtgccactgaaagtgccgattgagagaatgattagggtgcctgacggtgtccccgacactagtactcttccaaagggaaaaaacccttacaaaaatcagttgaatacaataatttgcttcgtcagcctaatttgtgaagaaaaagttgacaatggaaaagttggcggggtaggaaaaaaggaaaagttccaagaagttgaacaagaacaacttctggaaaaagaagtggaaaaaaatgccgaagttttcgatcaattcccgaaactaaagtcaaaagttggaggggaactcaattttggagcgaatgtgtgtcaattgaggacaattttttcctcagaaggtgtggaggacatggagatggacaccaccgaatttgccattacgtgggatttgcagtgtggaggacttggcccagaacatcgaaactgtgtgcagctaatcgcggctgatttggaccccgtgttggagagggccggttttggcttgaaggtgcccggagaattcaggacacggaaaaaagggaatcttgggcttaaggtcgttggaactccgttgaaagcacttctcgccacctttctgctgaagtccgatgccatttcttcctctgccgttggaaggaaattggcccaatcagtgatcggttcgcctgtcggatttgagctgattacgttcattggaagccgagaagatcaaatcaaaagcggcagaattccaaccgaagaagacttggagacaatccttcggaaatgggccgactgttgcgccgtgactcgtgccaaattgacaaaaagcggatttgggcgaattcacgtgccaatgccacaatcgatcgaagacttgccggacggtgaacgaaagccctgggctgaactgctcgagaagaccggcttcctgttggagaaagtgaaggcaacgtccgtcatgcgcaagcagcactttgtcacttcgccacgcatcattatgggcgactcaaatgctaagcaattggtagagcgttga

SEQ ID NO: 53612 - DNA, 1212 bp, Heterodera glycines
  Genomic contig location: Contig_ID=SeqID_4212; Location=2031..3242; Strand=+
  SCN-specific regions: Sequence locations=1-42,66-920,942-1063,1089 -1212
atggacaaattggggcgactggtgcagatgtgtgccacgttcccccatgtgaccttcttttggcttccgccgccattcgtccgtgatcgacaattcgaacacgaaacactgatcggaaaattgcgcgacttttttggccaaaagacgaagaacatccaattcgtggcaacaacgacgaatggccgttcgcttcttgagatttggcgctacggcaatggttacaacacggaccatgtctcgcctgagggagtgatgaaagagaagggactcaacatgttgaaggcgtggcttttgacgcaagtcaaggaatttccgggtgatcaggagttgggcattgagaagaagaagccggagagtggagagaagggaaaaggagcggggacggcagcagatcgacaacacggccgcaccgagccgcctccattccgacgcgacgggcccgtctttcgccgctcgaacagccgaccgttcgttcagcacccgtactcgcgcaccgccgttgatcgccaccctttccgcccctttcgcacgccgaatttgccgaatcccaatcgccgtcactttgatcgctgaggacatcgctcgttgcaagccgaggatgtgataattaaataatgacctcatttgacttttaaagttttaattaatttggcattttgtttatttttttgtgtctttcattttcattttatgttttttggctctcttcgcccggacttaaaaatttgtgatgcggattgtgtgtggtaattttaatggtacttttaattgttgtgttgtttaaatttaattgattgggattgctgtggctttaagtgattttaaaagtcttccttctcattcttctccttcgccccgttttggaattcggcaaaagagcagaggaggaccccggcaaaaaggcggctaattttacgacgttattttggatttttaaattctgttgaaaaggattaagaaagtcggtatcctttgctaaaaattattccaattccaaaaagcctaattataagtaaaacattaagcataaacaaaaccataatatttttttcacacaaacaatacaaaatcaaaacaacagaacaaaatttgagaaataagaatcatgaaaagtaaatctaaaaatatacagatacaaaagaaaatgctttttgctttacataatcatttacacaaacgaaaactaaattttctttatacaaataacaaaaa

SEQ ID NO: 53613 - DNA, 1234 bp, Heterodera glycines
  Genomic contig location: Contig_ID=SeqID_22910; Location=81..1314; Strand=-
  SCN-specific regions: Sequence locations=1-135,158-1234
atgccgtacatccatcaagtgcaagggttatggaacgtcaaatatcccggtgagtacaaaattttcatatttaacgattaccagatacgaccaatcaccaaatctgatgtcaccgactaccaattccccattcttctctaccacaacaacaaccactttgacggcatcaaaaccctgccaaaattttggaacaaacgctactattgcctctcctgtgaatcggcattcagcaataaaccacaacattcaatgaactgcacatcgctctgtcacggttgccgggaggtgggcgtcgactacccctgcgaagcccaacaaggctacttcaaaaaatgtttgcactgcaacaactatttctataacaacgactgctatgaacgccacctccacaaggatttgtgcaccaaatttcagcgttgcgaagattgtggggtaatttataatgttaaggttcacggaaatgtaggccaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcatacgattttgaggcgacacaggataaaaaagtaggtaataaattcgaacacgaggtaaactttgcagcggctaccatcatctgcaccgattgcattatcaatgggcgactggaacaaatcacttcagggaaaaaagtgccaaatttgcggtcctcaccgctcaatcaccttttcaccctttgactacacggagacaacagtcgaccaaaaaatcatcactcaacacccgctacgcgactttgtccaatggctactcttcgaccacaacaaaaaatttcccacggttgcctttgcacactttggggggcgctacgacatgacgatgatcatcaaggaggttttggcgcaaggaattcacaatccggacatcatcaaacaagggaaccgactctacgaactcaaaattaatcaaaatgaacatggaccgcttacaattcttcacgacagctacaaccttatgcccattaaattatctggcctcatcaaatcatttgggcttcatataaaagataaacaacattttccacacatgttcaacaaatcatcaaactatgacaacattctctcccatcttcctccacgtgaacaatactgtcctgatcaaatgaaaatccccgatcaacagaaataa

SEQ ID NO: 53614 - DNA, 507 bp, Heterodera glycines
  Genomic contig location: Contig_ID=SeqID_22912; Location=981..1487; Strand=+
  SCN-specific regions: Sequence locations=1-98,120-127,218-226,295 -308,484-507
  Gene Ontology: Biological process=N-linked glycosylation
atggcatttttaggcgaaagcaaaacattcaactggctcctctgctggtggtggactatcagtgccggcgccaaacaatcggaagaaaacgccaaatcaacaacagcaaaaaggaaacaacgaattgggaggagaaggaagagaaaatggggggaaaagagaggaaaagggaggagaaaaggagcagcagcggaagcagaggaaaaggaaaagaaagttgcagttgaacatcatcaaaaacaacaacaacaaaagcaagaagttcaagcagtacagcagcaacaacaaaagcaaattttggtgggaatggagatgaagatggataacagcaaaaatggagaaacaagggaagaggtggaaaaggaaggaaatagcattggggaaggaggagagacggaagagaaagagaggaaaaggaaaaggaaaaattcggcggaaggaagagaagaaagaggagagaatgaagcagaaaagagagaggaacagcagcaaattgacactttttaa

SEQ ID NO: 53615 - DNA, 271 bp, Heterodera glycines
  Genomic contig location: Contig_ID=SeqID_22919; Location=312..582; Strand=+
  SCN-specific regions: Sequence locations=1-1,23-271
atgccctcatcttcccgtgccataggtgcactgttttacgacccggcaaccgaccaaattgtggccgacggcacgacgacggcacaatttgaggcgcctgcggcggcagcgaacccacggcaaaaccctttggcggcacaccctgtgctaaatgccatcgagcatttgtccgccaaccaacggcagacaacggcacggacagatggacgagaagaggaaggcgaggacgaagtgcccggggcagaattttcggcacaatatttggcaactg

SEQ ID NO: 53616 - DNA, 496 bp, Heterodera glycines
  Genomic contig location: Contig_ID=SeqID_4213; Location=957..1452; Strand=-
  SCN-specific regions: Sequence locations=1-107,132-270,373-496
atgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggtaaaaatggacaactgctgcattgcagagtcagagaggggccacaaagagttcgcacagcatcgaatatttccttcattttaggcgtcattcttccccactgcacggctttcttcggtttaattacccaagtttgaggtacttggcgtatcctgcccataatatctgtggcatggaataaattttggaactgcgctgcctaacggcggtgcttaaaatccataacgtatgatgaggtgatttttttgatttttttattttgtttaaattccaaagtgaattcgaggcccaaaaatttattcataattcatgtggtaaaaaaatggattgaaattaaataaa

SEQ ID NO: 53617 - DNA, 71 bp, Heterodera glycines
  Genomic contig location: Contig_ID=SeqID_4213; Location=461..531; Strand=-
gtatcctgcccataatatctgtggcatggaataaattttggaactgcgctgcctaacggcggtgcttaaaa

SEQ ID NO: 53618 - DNA, 488 bp, Heterodera glycines
  Genomic contig location: Contig_ID=SeqID_4213; Location=1575..2062; Strand=-
  SCN-specific regions: Sequence locations=1-107,132-271,373-378,403 -408,430-488
atgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggcaaaaatggacaactgctgcattgggagagtcataaaggggacacaaagtgttcgcacagcatcgaatatttccttcattttaggcgtcattcttccccactgcacggctttcttcggtttaattacccaagtttgaggtacttggcgtatcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaa

SEQ ID NO: 53619 - DNA, 488 bp, Heterodera glycines
  Genomic contig location: Contig_ID=SeqID_4213; Location=2185..2672; Strand=-
  SCN-specific regions: Sequence locations=1-107,132-271,373-378,403 -408,430-488
atgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggtaaaaatggacaactgctgcattggcagagtcagagaggggccacaaagagttcgcacagcatcgaatatttccttcattttaggcgtcattcttccccactgcacggctttcttcggtttaattacccaagtttgaggtacttggcgtatcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaa

SEQ ID NO: 53620 - DNA, 488 bp, Heterodera glycines; identical to SEQ ID NO: 53619
  Genomic contig location: Contig_ID=SeqID_4213; Location=2795..3282; Strand=-
  SCN-specific regions: Sequence locations=1-107,132-271,373-378,403 -408,430-488

SEQ ID NO: 53621 - DNA, 877 bp, Heterodera glycines
  Genomic contig location: Contig_ID=SeqID_22920; Location=519..1395; Strand=-
  SCN-specific regions: Sequence locations=1-38,102-555,586-649,671-877
atgttcaacgacgcaacgacaagaaacgccgattcctccgaaaacgaagaagaaaatgatgacgaggatgaagacgatttcgacgaggacgacgatgatgaaccatccgacgagaagacgctgcgcgacattccgctcgacaaaattgacatttggtgcttcatgcgattgttcaaggacaaggacgaagatggacagggcgaccgcatgatttgtatcagcctggcccaggtggagttcaagcagtaccaggaggacaaccctaaccccatttgacactttgccgctttttttagcgcttcactgatgaatcgcattacattatgggagcgtcggacgctggtcaactgcccatggatgtgccgctgatctccatcaaccattgtctcgcggatttcatcaaaccggaagacattgaaggctcacgctgtgcacagtgcagcaacgcaacgccaccgccgtctgcgccaccaacgcttgtcaagcagctgatgttcactcaattgcccgacattttggtgatcattgatcacttattgattgatcatcgattagttatcccccttttttgcctcttccacagatcatttgcttcaagcgcttcatctatgaaccatttgatcaccgatacatcaaacagtgtgtgcccgtttcgttcccgttggacaacgaagatggacagggcgaccgcctgatttgtatcagcttggcccaggtggagtccaagcagtgccaggaggacaacatgacggtcgcacgcggtggtgggccgaagacaagcgttggatgcaaaaattttgtgagcgaaaaaagaatgaataacgaaattgaatttacggaaatttgttgtgaatattcgttgcaagtacatattaaa

SEQ ID NO: 53622 - DNA, 172 bp, Heterodera glycines
  Genomic contig location: Contig_ID=SeqID_22920; Location=1..172; Strand=-
  SCN-specific regions: Sequence locations=1-128,161-172
agctctcaccactagtccacgcaccatccccgaaagaacagcacgcagccacgggcaaaagccgcctgtttcacgcaacagcccggctgacccgacctttagagacaattcttttcccgaagtgacgaatctaatttgccgacttcccttacgctacattattctatcgact

SEQ ID NO: 53623 - DNA, 1535 bp, Heterodera glycines
  Genomic contig location: Contig_ID=SeqID_22921; Location=217..1751; Strand=+
  SCN-specific regions: Sequence locations=1-90,112-173,196-573,613 -620,649-738,776-793,815-936,965-968,1002-1009,1049-1068,1127 -1178,1208-1254,1281-1508,1531-1535
atgccaattattttgaattttcattttctattattcaattggatacatttgtttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagagaggacaaaaccctcgtattatatcgggattttatacatatttggtacatatttcggacttttttcttacatattttcatttttttacatatttgaggattttttacggaaatttttggaaattctcaaaaaaaatccaaaaatttcggcaaatttttcattttttttacatagctattctgagaatttttgaaaatttttagaaatttcttgtgaaaaaattaaaaaatctttttttaaatgtacccctccaaaaataatttttaaatgttaaaaggtgattttaaacattttggtcattttatggcattttgtgcctatttaacactttatgaaaaaaaattttccaaaaaataacaatttaaaaaaattttatttacatattttcgtacatattttgggcttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaattaaaaaatgtaattaattaattactttcttaattaggatggcactctgtttttgcgaaatttccaattacgaacttttgtcgtcccggaattttctacttcgaaatgaaagtgttcaaattgaaaaggtgttcattttgatgatttcttagcgttttatttataattttgaatttattttaacagttttgctgcgattggattcgccacgaaggaagtgccattggacgggtcaattggtcaaattttgaacagttacgggtaccgaagcgatggctcatttggctgtaatggcatcactcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaaattaaaatgaaaaaacaaattaa

SEQ ID NO: 53624 - DNA, 843 bp, Heterodera glycines
  Genomic contig location: Contig_ID=SeqID_22925; Location=557..1399; Strand=+
  SCN-specific regions: Sequence locations=1-17,53-53,152-198,367 -411,475-475,519-843
atgcaaaaaaatgctttaggacgcagcgatggaactgagcccaaatacgttgttgtctcaccggaaaaaagttccaattctgctgcaggtggagaaaaggaagcggaaggtgaacaagcacaagtaccagctgagcaacagccattaccaggtatttttgcaaaagcgccatatgaagtttcattaatgtgattaaatcagttgcgccagccgcggcggaagctgcttcagccgaaaacgcaccgaccgaaaatgcagcagctgtaccatcctcaggatattctggtggtgaaccggcacaggctcaagctgtagcagtacaaacagtagaacagcagcaagccgcttcagaatccgaacccactggttaaaattgatgttttctcgcttaaaaacattccgagactttaagccattggcacatccaacggcaacaacgagattaacgatgcaaacagcagcagcactgatcagcaaagcgatactgctgatcagccaaagcaacaacaaatggtggaacaaatacaatcgaagcagcggcaacgggtgcacgcgtcaaaggcactgacgccggcgcccggcacatggggatcaatgtgcaacagtgccgagttgcgacaaatgatggacagtcaaatggtgccgggcaatgccaacgcgtcaaagcgacgcatctatgaactgctcaaccgcaagcagttcacggaaggcgtcggcggtgcgcaacggttgctggacgtgatctgcgcgaacagcatgttcagctaccgaattgcaaccgatctgttttgtgagcacacaaaagcaaacgtcacttgttttgtgtaccaacaacagccgtag

SEQ ID NO: 53625 - DNA, 1587 bp, Heterodera glycines
  Genomic contig location: Contig_ID=SeqID_22925; Location=1..1587; Strand=-
  SCN-specific regions: Sequence locations=1-108,160-513,557-557,621 -665,834-880,979-979,1015-1059,1371-1403,1472-1484,1507-1527
tgtagatgctacaatttcgagttttttaacgggagaatcatgacaatacaattcatttgagttaaactctttaaagtacaattaacattctcgactatttttttggcaaaaaacaaatttatattaaatacgcaataataaataaaataaaactccattattttttttcatcgctcattgctctttccctacggctgttgttggtacacaaaacaagtgacgtttgcttttgtgtgctcacaaaacagatcggttgcaattcggtagctgaacatgctgttcgcgcagatcacgtccagcaaccgttgcgcaccgccgacgccttccgtgaactgcttgcggttgagcagttcatagatgcgtcgctttgacgcgttggcattgcccggcaccatttgactgtccatcatttgtcgcaactcggcactgttgcacattgatccccatgtgccgggcgccggcgtcagtgcctttgacgcgtgcacccgttgccgctgcttcgattgtatttgttccaccatttgttgttgctttggctgatcagcagtatcgctttgctgatcagtgctgctgctgtttgcatcgttaatctcgttgttgccgttggatgtgccaatggcttaaagtctcggaatgtttttaagcgagaaaacatcaattttaaccagtgggttcggattctgaagcggcttgctgctgttctactgtttgtactgctacagcttgagcctgtgccggttcaccaccagaatatcctgaggatggtacagctgctgcattttcggtcggtgcgttttcggctgaagcagcttccgccgcggctggcgcaactgatttaatcacattaatgaaacttcatatggcgcttttgcaaaaatacctggtaatggctgttgctcagctggtacttgtgcttgttcaccttccgcttccttttctccacctgcagcagaattggaacttttttccggtgagacaacaacgtatttgggctcagttccatcgctgcgtcctaaagcatttttttgcatttattaagcagctttatttaaaaagcaaccttcaatgtttgagacgtctcccccaccaccgcaaccaccactacagccgcttccaacatcacagccaccactacaacctcctccacaaccgctcccacatccccctccacaaccgtctccacatccccctccgcagccgcctccactaccgcaccctccgccgcaaccgcatccgcaaccaccacacccaccgccacatccacctccgctgccacaacctccgcaaccgcctccatcaccgcaccctccactgcatcctcctccaccaccacacccgcctccgcaaccgcatccgcctccacagccacctacacatccgcctccaccactacaccctccgaaaccgcctccaccaccacaaccgcctccaccgccgcaccctccgccgcaaccaccaccaccgccgccacaccctcctccgcaaccgcctccacctccgccgccaaacaatccaagtccactgaatccaccgcaccctccaccacaaccgcctccaccaccgcaccctccgccgcaaccaccacca

SEQ ID NO: 53626 - DNA, 1557 bp, Heterodera glycines
  Genomic contig location: Contig_ID=SeqID_22926; Location=218..1774; Strand=-
  SCN-specific regions: Sequence locations=1-526,549-601,623-1191,1213 -1557
atgcaagttgccaaagtgccagagaaacggcaggcgaacaagaattgctgccgttgtggagctgccgatcattggggcagcgaatgccgattcattggagcgaaatgccgaaagtgcaaattcacagggcacattgagaagcaatgtgaaaatgtgcagcaatggcgtttgaagaacaaaggaaaaaggtttggaaacaaacgaattggacatttgcaaatcggtatggtaaatccgaagaacgaggcaaattcgctgaggaccaaaattcggttcaaccaaaagccaatcgcatttgcactcgacactggatcggatgtgaatgtcattgatgaagactcacatgtggaggctgggagcccaccgatcgaaaagtgcagagaaattggaagagccttcgatggaacgccaattcggttcatcggaaaaggcttcggcacatttgaatttggaggaattttgatcgaaaatgaaccattttacgtggccaagcgtggttcgcttaatttgttgagccgccaaacaatggacaaatttggatttttggatggcattaagcagcggatcagcgagcatgtgataaattcctgcagagccaccgatcaaattggaaagcacattttggaattaaggaaagaatttccgggtgttttcgaagatgcactaggccattgcatcaaagaaaaggcacaactcaaactgaaggaaggagtcgcgccaatttaccgaaaggccagaccggtgccgcatcattcaaaagaagtcatcgaacgtgaattggaccggctggaaggcctcggaatcattcgaaaagtcgaacatttggattgggccgcacccattttggtggtgaaaaaggcggatgggaatgcccgcctttgcatcgattattcaacagggttgaatgatgcattaatcgactaccaacacccgctcccaattcctgaagatatttttgcgacgttaaatggaggacaattcttttcgcagattgacctcaaagacgcgtacttccaggtggaattggatgaggactcgaagaaattgtgcggactttcaacacacaaaggcaatttcgccatggaacgtttaccgttcggcgtaaaatcggcgccaagcatttttcagtctattatggacaaaatgctcgcaggcttgaattttgccacggcttatttggacgatattatcgtcgcaagccgatcattcactgatcacattcagcatttaaaagatgtgttcaaccggctgcagtcatacggattccgtgtcaaaatgacgaagtgctcatttttccatgaggaaattaagtaccttggattcgtcatcgacaaaaacggacgcaggccggacgcatcaaagattaaggcaattactgaaatgcctgcgccaacgaatctttctacattgcggtcctttctgggaatggtaaaccattaccagcaatttgtgcaaaacatgcggttcgtcagaaaaccgctcgacgacatgctgaagaaggacgcggaatcgaattgggtagaaaattgccgcaaagcatttgaaaaattgaagtaa

SEQ ID NO: 53627 - DNA, 1850 bp, Heterodera glycines
  Genomic contig location: Contig_ID=SeqID_22927; Location=265..2114; Strand=+
  SCN-specific regions: Sequence locations=1-805,827-1073,1095 -1492,1514-1850
cggcggttggggacccgaaacggcaatttgttatgctaaccgatgcaagcaaaattggtttgtcggctattctttgccaatcagacgaattgggtcagctaagaccaatttactttgcgtcaagacagtgcaatcagcatgaatctcgttattgccccaccgagctcgaagcattagcaatccgattcggtaccaaaaaatatgctcagtttatcacaatgataccaacaagagtgataactgatcaccgtgcacttgtccctatgtttaagagcaaaaaagagacgggtaatagccgagttgataagtggctgctagcaatgaattcccgttttattctacaagtcgaataccaaccaggcaaaatgaatataatccggatcttttgtcccggtcaaaaacgctgttaaaatcggagaatgctgaaaactgaagagtctgacaaaatcgcatttataggccaaattagagaaatacagttagcggaacacgccaaagaaattgaaaatgagcatagaaaagactgggcccaaaaatcaaagaaaagtgaattagggtttgtttatgattttttggataaacgtgtcttgccgaatgatattcgtgaccgccaaaaattgatgtcttatctacacaattataccttaatcgagggattgcttttccgaagtggcaaggaggggaaactacaattgttcgtaccacgagaattccgtgaaaagatgataagagagagacactccggtacttgtgctggacacctcagcggaattaaaatttttcgacaactatccgagctttacttttggccaaatatgttcggagattgcataagagcagcacttcgatgtcgagtttgcgcacacgctcgcaaaccacggtcaaatgctccgtcctttaaatgcaattgagacttcagaaccgttagagttggtatgtatcaacattttgtcaattgggccagcaaattcgtcgaaccattatattttggttacgattgaccatttttcaaaatatttggttgtgaatcccattccgaacaaaaacgctgaaaccgtggcacaaaattttgtaaaaaatttcattttagtgctaggggcgccaaaaaagattcatagcgacaaaggcaaggaatttgtaaacgaaacactgactgaaatttcaaaagttcttaaaattgaaaaatcgaccacttcgggttacgaccctcaggctaatggtgttacagaacgtgcaaatcaaacgattttgggaatgcttaggcgttcgacttattctgcctgggagtgggatgaaagacttccattcattgtttttgcttacaattcaaccccatcagaaattacgaaaaaacgactgagagaagtgtttttcaattgagggcaattgattttttaggcggtacggacgaagcaatggaaaccgaacagcagaaaggaaaggcaaacattgaggaggacacaatttatgtgctgggagaagatgaagccgaaacgccaaaagtgatttcctggagcacgtgttgcactggtgatcagcacaaagactgcgcggaccttttaatggctgatctggatgctgttttggaccgttctggaatggggcttctcaaaatcgacaatccgctgaaggccctgctcgccaatttcctgctcaagtcagaagcggtgaaatcaggatcggccggaaagaagctgattttgcaaattttggaggcagaagtcagttgggagttagccacttactgcagttcgagagaagacgacgtaaaaagtggcgcatttccgtcggaatcggacgtggaaaagacattggaagtgtgggcacgagcactgccaaatcgtgaatga

SEQ ID NO: 53628 - DNA, 502 bp, Heterodera glycines
  Genomic contig location: Contig_ID=SeqID_22928; Location=60..561; Strand=-
  SCN-specific regions: Sequence locations=1-502
atgtcttctggttctagtggtcccgaagaaggtgaaattggggccgaactctttgcaaatgaagcctttgaagaagcagaggaaccagctggtcttgtccaattttttcgagcagaaagcaagcgtggccgagagttaatcagaagcggcggttttgaatatgcctttgaagcggacagcggacttcaagaaggtgcaaaccttggaattttttgtccaaaccccaaattagggatcgaattttggcactgtatcaatcgccccccgtattgccctgggagagtgcatgtcagttcagcttggcaccacgataatcaggggcgtgcttacaaattggggcgaattgttggaagagatcacaatcatccagttaagcacgaatctgtcagagatgcccaaaaaattctaaaggaaaacgcagaggccgataatccaattcccgcaagggatgctgtgactcaggcacgagcacaaatgcctgcagatgtccgagccggacaag

SEQ ID NO: 53629 - DNA, 393 bp, Heterodera glycines
  Genomic contig location: Contig_ID=SeqID_22929; Location=190..582; Strand=-
  SCN-specific regions: Sequence locations=1-88,123-393
atgccgcaaactgtggtggtggaaaatttgtcggaagaaagctttttgcccgaggaagactacagtgtttatgtgaaaggggaaacggtaattaattaattattcaactaattaatcaattatgctttaatcacggcgaaatttaaccgcccaattaaataattttcacccattaattattgttgaaaatttcataaaaaattgttcagatcacttcgaaaatgatctttgaggacagtgcccgagtacaggtaaaaaaaatggcattttggcattgtgtcatgccaaatataaattcaaccattaaaaaattggtgaaatttcagtgcagccaaaagagcgtgtcaatttttgtgcagacggacaaagccatctacaagccgggcacaaccg

SEQ ID NO: 53630 - DNA, 776 bp, Heterodera glycines
  Genomic contig location: Contig_ID=SeqID_4214; Location=25..800; Strand=+
  SCN-specific regions: Sequence locations=1-71,94-352,374-776
  Gene Ontology: Mol. function=aminopeptidase activity; Cellular component=cytoplasm; Biological process=peptide metabolism
atggacatgttcctctacgacacacaaccagctgtacgcaattaagcgaagaaaaagcatcggtttgaccaccccaattattttttaaatttagactttgtccggactgaacgaagaattcatttccggcgctcggctggacaatttggtctccacgtacaccgccatcaaaggacttgtcgaaagtttggaggacaccgaagcttttgatacggacccaaatgtgcgaatggtcgcctgttttgacaacgaagaggtgggtgtagacaagaatcttaatttcgcatcatcgacaccgaaaagttccgtaatttgatttgtctctgataaatgctgcatccggacagagtttgcgggaaaacgacggggtgggacgacctgctccgccgccggttctcccgccgtccccccccccccactcccgggtcgtttcctccccgaaaaactttttaaagaaattttttttaaattttcgtggtgaaacaatgtaggggaaatgaattgcacccgtatccggggaatgggtttggacttggaaaggggcggggtgattggtgggtagagcaacccgtggaagcgaataaattttcctccgtttttaggttggcagtcgcagtgcccagggggcccagtcgcactgtttcgagtggttgctgcgccgcgttttgtcctccgtcgaccacccaaccgcctttgagtgttccatcggccgttccttcatggtcagcgctgaccaagcccactcggtgcatccgaactatgcacacaaacacgag

SEQ ID NO: 53631 - DNA, 831 bp, Heterodera glycines
  Genomic contig location: Contig_ID=SeqID_4215; Location=1066..1896; Strand=-
  SCN-specific regions: Sequence locations=1-290,312-627,650-831
  Gene Ontology: Mol. function=electron transporter activity; Biological process=nucleotide-sugar metabolism
aatttaaactgaatgtgatctccccctgattggcaattagcccacgtggtcccggcactgatccacaagtgctttttggccaagcgcgacggcggccctttggtggttgccggctcgggcaaaccgttgcggcaattcatttactcgttggacctcggccgtctctttgtgtgggcaatccgcgaatacgaggtggagtgttgtattattttctttgtaaggcttcattaaattccaatttccctgtcggaacctgtcgcaccgccggacccccctaaaaattacctcaaatttttaaatttatccaaaaacaggacgtggaacccatcattctgtccgttgacccttccgacgaagtgacaatcactgatgtggtcaccgccattgtcaaagcaatgcaatttaaggtgaaataatgtgtaatcaattaattgctgctcgagaatctcggttcttaaatcgagaaatttctcgagtcctttgggtctggcctgactttcgactatttactgacttttcttacaaaccctaaaggtagctttttcctaaaattttaattttcttaaaaaagctgcttaaaatcgcaatcgtccgtcgtatggcccttgctatggagatactccttttatttgtgtgtgttttatgttttcctcctccacttttcagggcgaagtcattttcgacacgaccaaggcggacggacagtacaaaaagacctcgtcaaatgccaaactgcgcgcccggctgcccgacttcaaattcacacccttcgaacgtgccattgcggagtctgtgcaatggttcgaggccaattacgagaaggcgcgcaaa

SEQ ID NO: 53632 - DNA, 1223 bp, Heterodera glycines
  Genomic contig location: Contig_ID=SeqID_4216; Location=1..1223; Strand=-
  SCN-specific regions: Sequence locations=1-216,238-427,457-839,862 -868,898-1031,1053-1131,1153-1223
  Gene Ontology: Mol. function=racemase and epimerase activity, acting on carbohydrates and derivatives; Biological process=L-fucose biosynthesis
gcggcaattcgtgtgctcgtgacgggtggcaccggactggtcgggtcggcaattcaacaggtgctcgtggcgacgggttgtagggatgccgaaatggcacgccaggcctctcaatgatggcaaaatgacaagcctggttgaggagggcacttccattcccccgccctccgtattaattttgtcgttgaattttgaatttgccaaaggtggtgacggaggaagagcagcaacagaagccccagcggctgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggtgagacagtgccaaaaagaaagaaagaaatcccacataccgtatccatttgggtttactgtattttttgaaagggatgtctcaatcataggtgggatgtttgttctatttcagaaaaccgtatcttaattaccatatgtcttcccgaaggcgatctgtcaaaatgttctccaatgctgccatgagactgacgtggaacggtgcgtttcgtgcctttccacgtgcattttccccgacaaaacgccgtacccaattgacgagacaatggcacgtgaaaaacagtgcagaaataaataatcatgtgtttattaaagagcaattaaatccctgataattagggctgtgcattgtatcgactaaaaggaatttgacaaagtaaaattcctcataaaaatatatctcataaccatgactggaaaagttggattttccaaaaatcatacgtgggtgaaaaatttaaacattttatatgctttatgttccaaagttaaaaaaacttgactggcaatttttgcaatttttagtccatacaatgtgccaactacatgatcattataatgaattatgattaattagtgatcattatggaataattatacacacagaaatactttatttttaaatgtttagcttattgttatacattttcaggtgtacaatggaccgccgcatgacagcaattttggctattcgtacgccccacgaatgatcggtgggttggccatgatcagctaaataagtcgaatttccaataaactaacagatgtgctcaaccgcggatatgctcaggagcacaatcgaaag

SEQ ID NO: 53633 - DNA, 2852 bp, Heterodera glycines
  Genomic contig location: Contig_ID=SeqID_4216; Location=1687..4538; Strand=-
  SCN-specific regions: Sequence locations=1-858,888-1024,1046 -1202,1224-1240,1267-1269,1680-1721,1770-1936,1963-1980,2024 -2666,2688-2852
  Gene Ontology: Mol. function=racemase and epimerase activity, acting on carbohydrates and derivatives; Biological process=nucleotide -sugar metabolism
gcaattcgtgtgctcgtgacgggtggcaccggactggtcgggtcggcaattcgacaggtgctcgtggcgacgggttgtagggatgccgaaatggcacgccaggcctctcaatgatggcaaaatgacaagcctggctgaagatggcacttccatcccccgcccccccatatttattttgtcgttgaattttgaatttgccaaaggtggtgacggaggaggagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggtgagacagtgccaaaaagaaaaagaaatcccacataccgtatccatttgggtttactgtattttttgaaagggatgtctcaatcatgggtgggatgttctattaaagaaaactgtatcttaattaccatatgtcttcccgaaggcgatctgtcaaaatgttctccaatgctgccatgagactgacgtggaacggtgcgtttcgtgcctttccacgtgcattttccccgacaaaacgccgtacccaattgacgagacaatggcacgtgaaaaacagtgcagaaataaataatcatgtgttttttaaagagcaattaaatccctgataattagggctgtgcattgtatggactaaaaggaatttgacaaagtaaaattcctcataaaaatatatctcataaccatgactggaaaagttggatttccaaaaatcatacgtgggtgaaaaatttaaacattttatatgctttatgttccaaagttaaaaaaacttgactggcaatttttgcaatttttagtccatacaatgtgccaactacatgatcattataatgaattatgatgattaattagtgatcattatggaataattatacacacagaaatactttatttttaaatgtttagcttattgttatacattttcaggtgtacaatggaccgccgcatgacagcaattttggctattcgtacgccaaacgaatgatcggtgagttgcaatgatcagctaaatgaaatccttcaaattcgcattaaacaaacagatgtgctcaaccgcggatatgctcaggagcacaatcgaaagtgcatcgaataaaaaattactgtcttttatttttaattgaataattaaactttctctctcttccccccccctctctctctctcccttcatttgctctctctttattccgttctctctcttccctctctctctctcccttcatttgctccctctttatcccgttctctctcttccctctctctctctctctctctcccttcatttgctctctctttattccgttctctctcttccctctctctctcccttcatttgctctctctctcttccctctctctccgctctctctctctctcctctctctctctctctctctcccttcatttgcactctctttatcccgttctctctcttccctctctctctctcccttcatttgctctctctttattccgttctctctcttccctctctctccgctctctctctctctctctcctctctctctctctctctctcggtcatttttggctcatctattctttctttatcggactcgcactctctctctttttctctctatcctctctccctccccactccctctctaataattaccataattggtttgattctcgacatttttccaatgctcaaaccaaatgggcatgggcacatgcttttccaaaggtacacttcggcagtgccgtgcaatatatttggaccgcgtgacaattacaatttggagaacggtaaaaaacagacaaaaaatgtacacagaattattattttttaattctgaacatttcttacattccggcagaattttcagtgttttaaatttgtcattaatattttaaatttaaactgaatgtgatctccccctgattggcaattagcccacgtggtcccggcactgatccacaagtgctttttggccaagcgcgacggcggccctttggtggttgccggctcgggcaaaccgttgcggcaattcatttactcgttggacctcggccgtctctttgtgtgggcaatccgcgaatacgaggtggagtgttatgtttttgtatatgatgattaatcattgggaatatattaaatcgtcaatgtcgagactggactttaatgagcacatttcgtatggatatgagggaccaaagagcaattgtattcccacttctgaaattattttttcggctacggccttggcaaaattattacctaaaaattgtcacacatctcttaattaggataatagatcaactaatgatctattaattttacttgtggtaacttttcaaaaccaaacaggacgtgacaccaatcattttctgcgttgaccctgccgacgaagtgaccatcgccgatttggtcgacgccattgtcaaggcaatgcaatttaaagtgagagccgagaataatcgtacggcacttggaattactcgaacatctctcgagaattctttttttttcatttttcaataaattttggcacatttcatctcttcctcctccacttttcagggcgaagtcattttcgacacgaccaaggcggacggacagtacaaaaagacctcgtcaaatgccaaactgcgcgcccggctgcccgacttcaaattcacatccttcgaacgtgccattgcggagtctgtgcaatggttcgaggccaattacgagaaggcgcgcaaa

SEQ ID NO: 53634 - DNA, 1216 bp, Heterodera glycines
  misc_feature (1186)..(1186): n is a, c, g, or t
  Genomic contig location: Contig_ID=SeqID_22931; Location=351..1566; Strand=+
  SCN-specific regions: Sequence locations=1-1216
ctcgatggatctcagcgaatatgccaaaagtgtcagctcaatttgggatgtgatcggtgagcattggtcagaaattgtcaaaacattcattaattgtgcccaatttgattgtccatttttacccttttaaactttgtttcgataacttcattacagtagcaaacgatattttgaactgtagcgataccgtattcccttcagatgctcccgcttcgttggtcaaccgacggtaattcttttctttctttcactttttgccaattttcgccttttctttttgcccatttctttttgctcagttcccgcattgaataccaacttcgaattcgtcgtaaaacgttgttctacaccgttgtgctgatcattcccacgggtttgtccgatttaattggtgcaaaatgccaaaaactgaaaatacaaaaaactaaaattgaaaattccttttatttttgacagttctaatggcctttctcagcatggccgtgttctttctgccgaccgactcgggcgagaaaatgacattggtcaaatctatttgattaaatagtcaattggagggtccttagttggccaattgtcctttcccttgtccttagttggccaattgtccttgctggtgtccttagttggccaattgtccttgcaggtgtccttagttggccaattgtccttgcaggtgtccttagttggccaattgtccttgcaggtgtccttagttggccaattgtcctttcccttgtccttagttggccaattgtccttgcccttgtccttagttggccaattgtccttgcccttgtccttagttggcaaattgtccttgctggtgtccttagttggccaattgtccttgcaggtgtccttagttggtcaattgtccttgctggtgtccttagttggccaattgtccttgctggtgtccttagttggctaattgtctttgctggtgtccttagttggccaattgtccttgctggtgtccttagttggccaattgtccttgcaggtgtccttagttggccaattgtccttgcaggtgtccttagttggccaattgtccttgctggtgtccttagttggccaattgtccttgctggtgtccttagttggctaattgtctttgctggtgtccttagttggccaattgtccttgctggtgtccttagttggccaattgtccttgcangtgtccttagttggccaattgtccttgctg

SEQ ID NO: 53635 - DNA, 419 bp, Heterodera glycines
  Genomic contig location: Contig_ID=SeqID_22931; Location=793..1211; Strand=-
  SCN-specific regions: Sequence locations=1-419
gacacctgcaaggacaattggccaactaaggacaccagcaaggacaatttgccaactaaggacaagggcaaggacaattggccaactaaggacaagggcaaggacaattggccaactaaggacaagggaaaggacaattggccaactaaggacacctgcaaggacaattggccaactaaggacacctgcaaggacaattggccaactaaggacacctgcaaggacaattggccaactaaggacaccagcaaggacaattggccaactaaggacaagggaaaggacaattggccaactaaggaccctccaattgactatttaatcaaatagatttgaccaatgtcattttctcgcccgagtcggtcggcagaaagaacacggccatgctgagaaaggccattagaactgtcaaaaataaa

SEQ ID NO: 53636 - DNA, 80 bp, Heterodera glycines; identical to SEQ ID NO: 51817
  Genomic contig location: Contig_ID=SeqID_22933; Location=404..483; Strand=-
  SCN-specific regions: Sequence locations=69-80

SEQ ID NO: 53637 - DNA, 80 bp, Heterodera glycines; identical to SEQ ID NO: 51817
  Genomic contig location: Contig_ID=SeqID_22933; Location=1015..1094; Strand=-
  SCN-specific regions: Sequence locations=69-80

SEQ ID NO: 53638 - DNA, 624 bp, Heterodera glycines
  Genomic contig location: Contig_ID=SeqID_22935; Location=261..884; Strand=-
  SCN-specific regions: Sequence locations=1-624
gggcagcgcgaggccgaactgttcggtctccgacacattggcgacggcacaccgttggagcagaagcgagtggagcaagcggcgaatgacaacaacgccggagacgaagcgcaaactctggcgaacagtgcggagacgacgagcgaaaagcgcgaagcgatgcacgactggctgaacaccttcctgccgctgcttcatgccaacaaattggacacgcaatgtgccaaccagccccagtccgagtcgacgcggttgttcatggcgttgaaggcgcaggacgacgcgagggagggcaacgacgacggaactgctgctgctccgcatgaattgttgttggccaagcagcgaacgacggtggaggaggagagcagcgagttccgcttaagaatggggtgcgttgctttgatcttgactgtgcttgtttgtccgagtaaagtcgggaaatatgatatgccgccaatatcaaaagggctcgaaggaagaattatgctcctgtattaggtttttcatgataaaataagcatttatttgtcctatgtccaccatttttagccttgtgctcgatgatttcacttgtaagggttcggccaagacggtctcggagaagcggacgatgaaagacgg

SEQ ID NO: 53639 - DNA, 1268 bp, Heterodera glycines
  Genomic contig location: Contig_ID=SeqID_22937; Location=351..1618; Strand=+
  SCN-specific regions: Sequence locations=1-280,323-1268
atgcaagcaacaatggttcgcacagtcggtgccatgacacgtcaacatttttacgattatctgcatggaatcaagacaatgatagggaagctgcagagagaaacaacagaaatgatgaatgctgtaaatgcgccgctcaacctcctcaattatgatgcagaaatttatgttccgcgaatcatcgattggtggaatgacgaaaaatttgcgaggcagtggaaattcaaggcgtttattttcggatcagcagggcattacaagccattgtttaaatatggggcggatgactacgatgtgtcaattctgttgtactttgatgagggacactttaatggcgtgcagaaaaatggcaatttgtttggaaagccgtattgcttgagttgtgaagggacttatgatcgaccaaaacggcactccaaaagttgcaaagcccgctgcataaaatggtataaaaaatgtaataacaaaaaatccctattttattagctcacaaatgggaccaattttcccatgtaagccaatcgatgggtttcgtcaaaaatgcagcgactgcaacaaaatgttcttcaaccaagcctgctaccaacaccatctttcgttaaacttttgtaaaacgagcaaggaatgcaaacattgcggtgtggtgtgggacttgaacaacaatacaaaaaatggaagagaggtaggttttgttttttcatcaaatttttttgctttaaggaattgttttttttaagggtcacaaatgcaacgaaagatggtgtgaaaattgtcaaatttttcatgaatttgagcgaggctgctttataagaccgcttgaaccgaaccacaagaaggaaacaatgggatggcgtctggttacttttgacttggaaacacacaacacacgcctatcgacccggattttccgaaaaaaacggaagcatcaagtcaatttcatgaccgcaaaagtcgcgtgtccggattgtatttcatcagggagatggaaagagagtttgcgtggcaaattctgcaacgtttgtggctatcaccgaacagtcacattcagccagatgccttttcatgagacaacagtcgacaaacaaaatattgaccgtcaccctttggttgcatttgtgaaatggatactttacaagctgccaaaacaatacgacactattgcttactcacattttggagggcgattcgacatggtcttggtctttcgagaattattattggaaggattcaacccttcaatgattaaaaagggaaatcgattgttttag

SEQ ID NO: 53640 - DNA, 269 bp, Heterodera glycines
  Genomic contig location: Contig_ID=SeqID_22937; Location=1689..1957; Strand=+
  SCN-specific regions: Sequence locations=1-269
atgaacccaaatgtgactttccgagactcatggaacttgattccggggccctgggcatcgatggtcccaattggtcgggttttgaatgtgcaggacaagcccttttttcctcacctggcaaaccggcctgaaaaattacggatgcgatctcttccctacaaagctgactacttggcagacggaatgaacatcgcaaagagaaaagaattcgacaaatggtatccagagaacagaaatgcaccctttctgcttgatgaatcattggccag

SEQ ID NO: 53641 - DNA, 886 bp, Heterodera glycines
  Genomic contig location: Contig_ID=SeqID_22938; Location=106..991; Strand=+
  SCN-specific regions: Sequence locations=1-577,599-886
atgacaaaaagatccgccggggcagatggaaaagctgatcgggctgcatacaccactccacacaacggaattgatccaatacggcactgtattactatcgcttcagcatgtatgcggcattttcggacaaaccacttgaaaccagcacacttggctctcgtaccagaaaagggatatgacagtttcggggataatcaaagcgatttggcactcaattttatggagtggtatgcggaaaagtttgatgttcaaattcaaaatgcatattcagccaatggcgaaaaaaggtagaatttgtcgaaaatacaaaaaatgggcactaattttaagggttggaaatttccgtcttgatggatggattgaatctcagcaaaaggggctcgagatccatgggtgcatttggcacgcatgttccaactgttatccggatgataacgaagtgctgccttgcggcaaaacagcagggcgaattcgcgagaaaaacaaacgacgaatggaaatcattttggaacaagtcccaaacgttgagattttttggcaatgcgagattgagacaatgttggcaaaggacaagcaaatgaggaaaaaattcgacgaatataccggtgacgggggaccaatcgatatccgggcatcattcatgggaggaagaactggggctctgaagctttttcacgaggcagcggaagggcagaaaatcagctattatgacgtcacaagcctctaccctttcataaagtctattaattttcgttttttcctttatcaattttttcagttttacaacggattacccaattggtcatcccactcttcacgtcccgtgtgaagaagttgattggcgacggccagaggacaatccatacccattggccattctcaaagt

SEQ ID NO: 53642 - DNA, 837 bp, Heterodera glycines
  Genomic contig location: Contig_ID=SeqID_22939; Location=1108..1944; Strand=-
  SCN-specific regions: Sequence locations=1-275,297-503,525-837
atgtgcctgcctgaccacgattcagcaaaaatctattgccaatgccgagatatcaaacttgaaccagcactcgccgatcctgagaagcgcctgccaattcagctcaaaaacttgcttattcgaaacgaaaagcgggatatttttgccgaaatcacctacgcgccaattcagttgtccattcaattcgaggggcttcgaatcgccacggaagaggacctaacaaaatgccatgccatgtccaagggtcttttcggatgctattcgtgccacaatggagcttatctccatttgcaatgccacaccgactttggctccgcacttggctacgttcgttgttcggatggcacagaattcacagccctctgccacaaaacaccagaagttttgaatgccagcctgtcattcaaccgtgccgaggtcgacatcaattgtaccattgaatgcagtggaggacggaacccattcgtgattaatggtcatctccgctatgtgccaaaacacttccaaacacctaatgaaggaagctcatttgcctcgaaggccaaacccagcaactcatgcctaatttggtgcccagattggaacttcgacttttccgatgtcttttggtacttcttcgggctacaaaatgctcttcgaaccattggaatcatcactctggccctcttcatcgtctatgtccttttgcgttgcaaccctgcccttcgatcttggagagccataagccgaatcgtccttttgttccttgctctttggcctacgactgattcttctgcagcgggagggctgagccatctactcagcattcaaaattcagcaccaaagctgcagttttaa

SEQ ID NO: 53643 - DNA, 479 bp, Heterodera glycines
  Genomic contig location: Contig_ID=SeqID_22940; Location=453..931; Strand=-
  SCN-specific regions: Sequence locations=1-88,131-214,264-398,441-479
atgcggggttaatcccgcgggaatccgtcccgtaaaaaaatttgagttggacctgcaaatttgaaatttcggtctctaattttaatgcattaattatatcttttgttttaattttataatttattttaaagcttttgccagcgcataaaccgattttgagggtttcatccgatgtgttcgacgcaatgtttcgatttgatgagcaaaaaagttgaaaaaataatttataataattttattttttaatataaatttttaatattgtcagaagaggatgaaaaccctattgaaatcccggacgtggacattgaagcgtttaaaacgatgttgaactttatttatacggacaatttgaacgcagtgaacggaaacaatgccatcgatgtgctttatgacggtaaaaaaaagaaaaaaataaataattatttttagtattttatgatttacgacagggatggagctgattatacaatattaaa

SEQ ID NO: 53644 - DNA, 1385 bp, Heterodera glycines
  Genomic contig location: Contig_ID=SeqID_4217; Location=240..1624; Strand=+
  SCN-specific regions: Sequence locations=1-14,37-819,841-1343,1374 -1385
atgaaccgacggtaatgagttttaaaaattacaaacttcatttaactactgttttcccgcattttcagttggctgtgcagcgacatttggatgaacattctgccgttttttggtcgtcaccaactcggcctcaaattggcactgatttcgccacgtttcgacattttagtggacaaacatttcgatggccaatcacaatggacacttttgcgaccaatcaaaattcgcaaaaacaaaaccatcgcttcgccagaattatgtgtgcttagggctgccaattacgcaaattttccattgccagaatatccgttacccagcaaaattcgctttgattgccttgcgataaagtaattgaaattcaagcattttgtttgacagaagtattcacctcttttcaggtacattgattattctgtgctcgcatttatccgtgccaatcagcaaatttgggacaaaggcaccaagttgcgtttgttgctaccatgtacttcaccaacaacaaatgtcgagccagtttgggataccttcgtcagtcaaatttggcccatttttgcgacaaacattcgccatttgacatttcgaaattctacttatttgaccaaattgcttcatctcatttcgccgatcattctcaccaatctcaccaaattggattcaatcggtgttggttcttttaaaccagaccaaattgatgaagatttcgacgggccaaatgcaactccaactgctggccaagtgttgtccgaatggttgcacgttccgacaaaagatggacgaccgaagcgattgttttgctattttcatccgtcaggaaacactcaatggatcaacagtttcaaagaagtgagttgcccatttccgttggattgattgaaatttgtttttgattgctattcattatccattttttagctatttctccgtgccacttcttctgtctgctacaaaattttcatcagaactaaagcgacatttgagccatttgaattggtgaatgaacggaccaacgaaaagctgacaatgccgaaaccaaaagaagagaaattggccaagcaatggattatgaagagatgtgcaattggggagacggcggcggttcaatgggaggacaatacggacaatttgaacgatgtcacattttgtcttcaaaaagttgaagtttgcattgggtgagcaaaaaagtgcattttttcttttattgaatttgaattttgcgcttaatttaggccagtatctccaccaccgacagaagaagcgggacaaagcgtcgaaaaggagggacaaagcagcgaaaaagagggacaaagcagcgaaaaagggacgtcttctgacaaatgagcgacggacagaacaacaaaaacaacagtgatcagcagaagaagaaa

SEQ ID NO: 53645 - DNA, 532 bp, Heterodera glycines
  Genomic contig location: Contig_ID=SeqID_4219; Location=626..1157; Strand=-
  SCN-specific regions: Sequence locations=1-391,413-532
atgtcaactttatgctttgcgatgccaaacgatgcactgggtgagcaacagggatggcacggaattcgaccccctaaaaagctttggacgtcgaaattccgatttctgaaaaaatttggaagtcgaaattccaattcccaaaaaggtgtcaatctgaagctcttgatgagacaaaccgatctagggcttaaagtagttgatcagaagaaatccacaaagaaaaccctttactttacaatagccaaaaaacagttgatttcgtttaagtaattcaaattgcgccgaatttttaggcctttgtctccaccagcggcaaaacagcgaaaatggtgtctaattatgtgagagtgactactcgacttttgaagaacagacagttgaggacattcacattttatttatataattataagaaatacttcccgaagggccaatggaagtgaatataaaattatttcttatcttggatcatcccaggtttccaaaagcattgagcttgtgtatgttcttttttataatgctataaaataaa

SEQ ID NO: 53646 - DNA, 2222 bp, Heterodera glycines
  Genomic contig location: Contig_ID=SeqID_4219; Location=1587..3808; Strand=-
  SCN-specific regions: Sequence locations=1-267,290-434,457-710,733 -1637,1659-1735,1757-2222
atggcatcgcccgtcgaaaaaagaaacgaattttccggcgccgttatctcttctagcattagtgaaaatcagcagcaatcgctgggttcatttgtaaaaacatcttttggaacacgacggcattggtaacactgaacataaagcaactaaaaattgccaaggaggggaggcagtaaaaacttgaaaagtggcgattttgtggcaattagtgcgtgttttacatagaaaaactaagttttgagattgagcaattcaaaaacttatgccacagagattacaaattttatttccatatctatgttaccacttttttgcacaaaacaataaccatttttttggtttttgacaaaatttaaaaatttatttgacctcagtaccgagaaaatatattttttaatgtttttactcatcaaaaagtcagaaaatatacttttcccctgtcattttcatctggcaaccctggttttaaaagtaccaaaatacgtgctcagtgattctccaatgtgctgctcataattaggaaatccaattaggtatatggaaatccatatttttttcctggactgtgggaggcctgaaacgcatgaaaaacatgtttttagcttggtttgaagcttctaggatggatttctatatccatattttccatatttcgcgatttatgtccatatttgtccatattttggcattattatccatattctatgtccatattttgacatttttccaaaaaacctctattagaaccgcccctatcaactaaattcgtctttttgagcccctaaagacaagaaaattttcaaaaaataattttttagcaaaattttcttgaaaatcttaacaaattaaattttctcaaaagtggttaatttatgtcaaaaataagcaaaaaagcgaaaaattcgccatacgggttgatttatcattaacatgagtaaatttttgctttatcgtatgttttttcttctttttaatgacctatttaagcatttgtgaaagttttactttacatttaatgaatttgaagaaattttgtaaaatttacccctcaatttggaaaaatttatgtccatattttgcaattttatctccatattttgagattttcgtaattttatatccatatttctcgattttatatccatatttttggcatccctatttattgcagtttgcttaagaaattaaaaaaaaaattgcggaaataaattcaaaatctggaatcgtgccatttctatggcttttgtttgttgttccgtcgcttgcaactagagaccggagcaggaccggatcatgcgcaggattttgccgggttccagtccgcaatcccgcattttttgaaaaagcgggatttgcaggatttacgggattaatcctgccggatccggaatagctaagtaattctctaccattttttttgcgtgtttcagttgggtgtgcaacgatgtttggatggacattttgcccctttttgaccatgcccaactcggcctcaaattggcactgatttcgccacgtttcgatgttttagtggacgcccatttcaatggcaaaagcgaattgacaattttgagacaaatcacaattcaaaagttcaaaggaccaaaagcgaaactgtctgaatggatcgatgacaaatgggtggcatttcctttgccggaccgtccgctgcccacaaaattcgttttaggaaccttcggattgagtaattcaaacataaagggaagaaaatcactcctttttcaccatttttcaggaaccccgaccattctgtgctcgcatttctccgtgccaatcagcaaatttttgaaaaagccaccaatttatgtttgtctgtttcttcatgcttccatgattgcctttcattattcgtcgacaataatgtccagccgatttgggatgtttttgcctgtgaaatttggccgatttttgcgccaaacattcgccgctttaactttcgcgatggtgatcatttggacaatttgcgtcgccgcatttcgccaacaattctcaccgatctcaaccaattgaattcaatcaattctggtgatctgttgcccgatggcatcgctgatgatgggccaaatgcaactgctggccaagcattggccaaatggttgcacactccgcgaaatgatggccaaccgaagcgattgcgttgcggtggtggttatatgtcaaaaactgaatttgtcaacattttcaaagaggtatggccatag

SEQ ID NO: 53647 - DNA, 974 bp, Heterodera glycines
  Genomic contig location: Contig_ID=SeqID_22951; Location=17..990; Strand=+
  SCN-specific regions: Sequence locations=1-389,413-432,489-522,544 -669,704-974
  Gene Ontology: Biological process=growth
gtgaccatggacaccatcatcgacgcaatttgcgcctccaaattgcccgtgtcgcgcattctgtgcgaccagatccgctcggtgggcaagtcgatgctgctggtcgggccggtcgagtcgtccaaatcgcggacaaagtgagtggttttgtgtggcataatggttcatttggttgtctaatgtgaaaaattaagggtgagggttagcaaaaaaaatcaaaaaatgatgcattttgctggatttttgaaccataaaatttgaatgttttgtaagctagtcgtgccaggccgttaaaaaaaataaaattttgtcggttggttaaaagttttgaattttggcggtgaattgggagtagtccggcggtaccaacaaacgggagcagctcgtttcccccccccccccccccccgccgttaaatcttagtaattcaccataaaaatttctcaaaaaattttttcttagaattttcctatgaaaaaactttctaagatttttttcttgaaaaatttctaagttagcaaatttttttttacaaaatttctcgggggggggggggaaacgtagtgcacccccaacaagctgccttcagatatttgctatcctattatgcataaatcgtgttctaatttttgcgccttttttcattgaaaatagcataagaagcaggtttaaaaaactgacaggaaatggatttttgaaaaaatcacaattcttcaaatagtgctttataatattaattttggtttgggttaagccccgctccccaataatttattatctgcggggtcgtcacttaaacctaatttcaattaaattgcccaattttttaggttcaacaattcattggtgattgccgaagtgttgggcattgaggcggcacggggctcaatcatttccgaaattttggccataatgggaaaacacggcatcgagttggacagacagcacgtgttggccgatttgatgatttatcg

SEQ ID NO: 53648 - DNA, 1066 bp, Heterodera glycines
  Genomic contig location: Contig_ID=SeqID_22952; Location=1006..2071; Strand=+
  SCN-specific regions: Sequence locations=1-173,195-370,392-560,583 -601,627-862,893-938,968-1066
atgacttctcgactgcttgagcttgttcaagcacgaaaagacaacttgtttcctggttctcgtcatgccgaagctggacgaatccaaaaagaggcttggtcgactgttactgaaactttgaattccgaatttccgatcgacgttcccgcgggtggtctgaaggtacaacaagtgcaaacaagatggaaaaatcttcgtcaggccggaaaagaagaagcgcaaaaaataaaaaagtaaaatcattttgaattattcttatgtgcatcggaacactaggcaccgccttggaacgggtggaggaccgcaatcatcggtttctgacacttcgaaaaaagttattgacatgtttggcacatctgctgcttttgccggagtgccaggcggcggggagactagcactgcccgtggtgatattttgcaaatggaaagtgattacctcggtgccgacccatttgttcccggaaaaattttcgaggaagacgacaaggaaattattgaaatgtcgagaatgccaattacgccgttaatcatcaaaaaggcattaaaaacacttcatttataaaaatttagaagagaaaattgataattaattacatttgtcaatttattttattatataataaaaaggcacccgacaggcacgctatgactctccagcttttggccgtggaacaccgatttctcgtgggtcgtcacgccctccttcttcccgtccatcatcatctgacattgcggagcttcaattgaaagtgcttcaaggcgatctcgaacgaattgagcttcaaaaacagctgtgcgaagatgcaaaacaatttttgaaggaaggaagagacttttttgcaaaaggagcaaaattttatgacgagaaaaagggggaaggggaggggtaatgagcgatcagtatttttgatcagaatttatggtgcattttaaacaccaataataattatttttgataattttttatcatctataataacataaattgagatgtcgtttgcctgttttattccacccgcagggcaagattttgaaagcaggcggttgcgtggtgtcttgctgggta

SEQ ID NO: 53649 - DNA, 475 bp, Heterodera glycines
  Genomic contig location: Contig_ID=SeqID_22953; Location=384..858; Strand=-
  SCN-specific regions: Sequence locations=1-106,128-376,398-475
atggttcactatccaaaggacgtttttaaagaagtctcagacttatgctcgaaaaacagagaagaccgagcggctgtgtatggtgtcttagaagaaaattttggtctaaaaattataagattaattaactaataaaaattcattgtccagaaattggtatcattcgcatctgttggtgcagccaattttgagcctgaccatgtggaacatctgatcaaggaaggacacagatgtgccagcggttgtccaatgcgaaatgcacccatttcttcagcgagaagatctacttgattactgtaaaagcaaaggcatttttttgcaggtaaaaactagggggtaggtagtacacgatcgctatttatcagtagggcgaggattttattggtgaaaagtccaaaatagggacctaaataggggcaaaaaattcgcgaaataggggcgaaaaagtttgaaatgtaggggtgaaattattaaa

SEQ ID NO: 53650 - DNA, 101 bp, Heterodera glycines
  Genomic contig location: Contig_ID=SeqID_22953; Location=1808..1908; Strand=+
  SCN-specific regions: Sequence locations=1-101
atgtgccaatgcagtgactgcggagctgaaaagcaattgggtcatttggagaaggaatgcatcccatacaaaaagtcgttggagcatttgtttgcgccggc

SEQ ID NO: 53651 - DNA, 835 bp, Heterodera glycines
  Genomic contig location: Contig_ID=SeqID_22954; Location=372..1206; Strand=+
  SCN-specific regions: Sequence locations=1-159,181-388,419-471,493 -553,576-613,636-835
  Gene Ontology: Mol. function=heat shock protein activity; Cellular component=plasma membrane; Biological process=response to stress
atggttgagcgtacggtatgggaatggcagaaggtgaacacaatgaagcccatttggatgcgaaagccggcggaagtggaggaagatgagtacaaggagttctacaagtcaatcaccaaggactttgacgagccattggtcagtcagtcacagttttcgaaaaaccgggaaaataatttttgtcacaaatttatttgttgcccgttttttaaggcccatgtgcacttcattgccgaaggtgaggtctccttcaagtccctgctgtacgtgccgaaaacactggccactgacgcattccaaaactatggcaaaacggaggacaacatcaaggtgggttgaagggggggacggggaaacccaaatgaaatttcaattttaaatacaaacctattttaaaatgattattttaattaaaattctatcaatagcacacggcaaaaataaaatttttatgcccaaaaatccacattttgtctaaattttacattttttcccatgattctatttcctggcttggttttcatgcatttgtccttgaatccgtataaactgggtccatggtgtccttaactttatcaatttttaacaccccccccccccaaattttcagctgtacgttcgccgtgtgttcatcaccgacgacttccaagacatgttgcccaagtatttggcattcattcgtggtctcgtcgactcggacgatttgccgctgaatgtgtcgcgtgaaatgttgcagcagcacaaactgttgaaagtgatcaagaagaagttggtgcgcaaggtgttggacatgctgaagaagatttcgcccgaaaagttcgacgagttttggaag

SEQ ID NO: 53652 - DNA, 2359 bp, Heterodera glycines
  Genomic contig location: Contig_ID=SeqID_4220; Location=1442..3800; Strand=-
  SCN-specific regions: Sequence locations=1-254,286-457,481-548,593 -918,940-1623,1645-2359
atgcaagaagcctgtgcagaaatgtcaaacctcaagcggctacagcactacttcgcgatgctgcttgcgcacgcccatccgtccaaccctcaggcgctgttcgacgagttcctcgacgagatgaacccgccgacggctgcaaaccacccgggagctgtgccaaagtctgccgaagtccgcgcggctgaggtgatgctcaaccttgagtattacttaaactgcatggcaacgaacaccaagtgagtaaacttggcataataaatttcatatttaaaatattttaaagggacgttgggctcaaaggactaccagtgggctacgactttcaacatcaggcacagctcctggaggaggacaacatcttggacagcttctacggggacgatgctgggcaacgccgcaaaccaccccagcaagttgccgttgaacagattggacgcctcaacacagaccaacgggccgcctttgacgcgatctcaacatcaattcttggcgggtgcgaccagaagttgttcttcctcgaaggcgcgggcggatgcggtaacggcttatttatttttaaaaatataatttattttataatattattttaggcaagacgtacttctacaacacgctgatcaagtggtgcatcgcaggcaaacctccctttgatggaaacgccaacgcacagtgggtacgcaatcaagtactgcagcgggacacagttgtcgccgccgccagcaccgggatcgccgctctgttgctgatcggcggaggaacggcacacaggcacttctacgtgccaaacgacgtgtcgcaggagacgccgccgatgttgaacttcgagtcggcaaaagcggagcaactgcgccacgcacaactgatcatcattgatgtaaacaaaaacataagttgcttttcgttcatgataacaattttaggagatcagtatgttgtccaacaccgtgctcgactacatcgaccggctgttgcgagacgtttgtgcaaatgccacaccgttcggcaacaaagtggtggtgttgagcggcgactggcggcaactgactcccgtagtcgagcatggaactcgtgaggaccaagtgggtacgtcgatcaagatgggagcgctctttcgtctgttcaaaaaaatcaggtaatttgtcaactttgttttttacaaacatatttatgttttagcctaacgatcaacatgcggacggcacagggagaacaatctttgcgcgactggctacaggaaatcggcaatggaatacaccgcgtgggtacggacacccaaggcttcaccaaccaacttcgcattccgccggaactcctcgtggacgacctcgaccacaccatacatttctgcttccctgaagcaatgttcgacgacccgctggccaacgcggacgcaatagcacacaacgccatcctctgtccgactaacaacgacgtgcagcacatcaatgaggtggcgcttggcagaatgagcgggtgcggaagggaattcctatcgatcgacgagcctcttgagccaaacgacgagatgcacaatttccgcaccgacttcaacatggaggcggtgcacaacgaaatgccatccggaatgccgccgcacaaattgaccatcaaagtgaactattttttgttttaatcatttttaacctattaatccaggtgggtacgcccgtgatgctgatccgcaatttggacgtcacccagggactgtgcaacggaacacgacttcaagtgatgcgcacttcggagaacaacctgttctgccggattctcaccggaccacgagcgggtgcgcagaacataatcgccattccacaaattcaattcgaatatggccgcgcacgacaccaccgtgggctacgcttccgccgtctgcagtttcccgtccgcctttgctttgctatgaccataaacaaggtgaaatacagattatttaaggattgaaataaataagcacaaaaaattaaaggcacaaggacagacgctgcagcggatggcgctcgtactcaacggccgtcaatgcttttcgcatggacaagtgtacgtcgccatgtccagggtcacgcagatggacggcatcagggtgtacgcgccgttctgccaaagtgggtacggaacgcacatcgagaacgtggtttaccacgaactgttggacttggagacgcagcagtcgaggacaccgaatcgtggactgatggacgtggacaatgacccggacgcagcaataccggacgtgggcccaagagtaccggacgtggctaatgacccggacgtggaacgagataatggacacgcagcgggtgcgcacgatcaagaaccaaatgatcttgatagttcttttgatgatttttttgattga

SEQ ID NO: 53653 - DNA, 808 bp, Heterodera glycines
  Genomic contig location: Contig_ID=SeqID_22956; Location=332..1139; Strand=+
  SCN-specific regions: Sequence locations=1-73,95-344,385-808
atgacaaacccaacattgaatgataatcaaagaaaagagaggacttgtgaagaatttttggatagaattaaacccaatattggatttttgcttcgtttagtcggtctcaattcgaccaaagacttagaccgaataaaggcacaggccgaggagcttgaggctctactcttaactgaaaaaggacaaatctcggataatttggcacacactgttcatgcacttagtggacaacggttcggaaaccgacagactgaacaaaacagagaatccaattatcggggaccaccttttgtttcggaagctaatgcgacaccactcaatgaccgttttgccccgcgtaatttcgacaataacaacagaaataacaacggcaataataataaccgaacacaattcaggcgtaaccagagaccgaacgacagaaggccaaacttttgtcgcaacagacggtctcaatttatcaacaatagacctgacccacaaccaaacagaggcagaaatgggcgcaatgctaattatggcactgtcaattcagttgatgctatcccatcaaatgtttctgtcctcgattccgaccaattaattcgcgccattgctaatttaggcataatgaaccaacagccgcccttgggcaattcagtcaaaagagaagatgctaatgcattgaatgcaattacaactgttaaaagtaaaccaaaaatcgagaccaaaggaattatgaatgactcaaaaaactgcgaaattccagtcattgattcaaaaaatattaaaccaccttcaccccaattgaaagcttcaagctgggagg

SEQ ID NO: 53654 - DNA, 137 bp, Heterodera glycines
  misc_feature (126)..(126): n is a, c, g, or t
  Genomic contig location: Contig_ID=SeqID_22956; Location=1..137; Strand=-
  SCN-specific regions: Sequence locations=1-137
caattaatgacattttaaatcgagcaactttctcatcctcattccaatttcgtcctacagctccaacataatcagtaaaccactcagcccattcatcaaaagcgatcaccgaatcttcaccaaatnacctctaagtg

SEQ ID NO: 53655 - DNA, 681 bp, Heterodera glycines
  Genomic contig location: Contig_ID=SeqID_22957; Location=655..1335; Strand=+
  SCN-specific regions: Sequence locations=1-305,327-381,428-583,607-681
atgctaattgcatttatgagaaatggtcagcaaatgcaaatcagtgagtattcaaaacaaaaatatgagatacaccttggctttatatattatatgagaatgaattggaaatgtgacaaaattgtgggtgaatttgaagaatttgaacggacagaatgccaaaaatatcgaaaatatttggacattttgtacgaatatttgttcagagaatatctcggaatccccacagtgaagccaatttttgtatttaaagacaaaattgaaattaatgggccaataatttatgcggtgaattgtttggccagaatttcgcaattttattttataaaatgggagggacgactttatgaatataaattaaacgaattgttcaattatcaatttgaaccaaaattattgaataatgagaagagattgaattatgatgaacaaaaattgtcaattaatgaaatgattttggaattggcaattgacacagcgaatgattggcaaacaaatgaaagtttggacgaaataattaaacaaaattgtggagataaatttgaagtgaatttggaggaaatgctcaaaaaagcggatgaatgggaagaagaaaatgaagaaggatggagtgccaatgaaataaattatggcaagcataggataattgtgggatcgaaattcgatgataaatggaaatgg

SEQ ID NO: 53656 - DNA, 1485 bp, Heterodera glycines
  Genomic contig location: Contig_ID=SeqID_22958; Location=1..1485; Strand=-
  SCN-specific regions: Sequence locations=1-198,220-371,413-473,516 -620,649-993,1016-1031,1053-1084,1106-1292,1357-1445,1467-1485
ctactggccaatatttgttcaggcattctgaacatcatcggcggttgcagctggtggcaaatttgggtgtacctgttggtcagcctgcagcagattccgcacgccatgttcaacctcagcgtggtgtacatgatgtaccaggtgggaccaattggggcagcagcacaacaaaaacttggaaaaaacgccaaatttgtgtttcccttttcaatttattttaatttttgaggttttgctctttataaaccggtcgacaaaaggaagactacgcctgttagccgaaccaaaaaattactcctaaaattaatcttcaacaaatttttttccatttttggggtgggaattccatggtcgcttattcctccctcccgaaaaatttaaaaaactgaattattttttattttttaaattacttggtgctttttttcaaataaaaaatgcaattaagatttttacaaacccgatttctttccaaaaaaattctttttttttaatttcaaaatttaaatttttttctggttccatcgaaatttagcgtatctcaaaattttcggatttgaaaatttgttggctacccttccgctccctttctgctgatcaaacgaacactgattgttgctattttataaaacccaaacaaaaacagatcctccaacaaaatcattgttgagttgtgtagccggaccactggtgcaaagtgccgggactgaacgcctccggcgccgccaatgcgtcgggcgcgccgtaccaatgggacgtgacggacacacttgccggctcggtggtgtacccgcggacgcgcaacaaacagcgggacatgctcaacttccactcccagtgccactactatgaccgaggtgggtggcacgacgggggcgagccgttcaaccaaccccctccctccccgttatttcctccctcgaaaattttgtgttttgaaaaacttcagcgatttttttttgatgaactactaagttttttcaaaaaaattattttaaaaatcgctgaaaatgtttcaaagttttaacttgaattttcttattaagaaatttgctaaaaattttttttggaaaatttctgtttgaaatttttaaaaaaaatttttggggaacgacctgttccaggtgccacatccttccccccttccaaagaatttaattttcattttgtattgtttgtccaggtgatcaccgttatgtccagttgagatggatgctcttggaggaggggctaggggcgcagaacggacagcgaggagagtgaggacattcgagaaggcaccgaagggtgatagagagagagggggagacagagactaagagagagagagtaacagagagcgattgagagagagaggcagttgaaagtgaaaattagcacacaaatgagtctcaaatattggtattgacaataaacagagcgtcagaagccccgaaacataggcacagcagaaagggggagacacatatttggagagagagagag

SEQ ID NO: 53657 - DNA, 125 bp, Heterodera glycines
  Genomic contig location: Contig_ID=SeqID_22959; Location=1004..1128; Strand=+
  SCN-specific regions: Sequence locations=1-125
aatattcctactataaacatggtcaatggaagattggaatgatgaagggacacagcaaaatgtggagagaacgccgtgaagaaatcttacgctgggacccaaatgccgacctgtggaaatattag

SEQ ID NO: 53658 - DNA, 85 bp, Heterodera glycines
  Genomic contig location: Contig_ID=SeqID_22959; Location=1310..1394; Strand=+
  SCN-specific regions: Sequence locations=1-85
gttcaccaatgcttccgctgacaccagcaaaaagattcgtctccaaaaagcattgtgtcgattcaattcgatggctctctctcca

SEQ ID NO: 53659 - DNA, 244 bp, Heterodera glycines
  Genomic contig location: Contig_ID=SeqID_22961; Location=1033..1276; Strand=+
  SCN-specific regions: Sequence locations=1-115,181-244
atggccacccattgggtggaggccaaagcggcaacgccgctgtccccacttttcctctgctttctgtcctcaacaatgttggtaaaacagaccaacgggggcgaacagcatcatctataaaataacaaaaataaattcaacaaataattaataatattttttcaaaaaataaattatttagggagatggatttgtaattgttatctttccagcggtaattgctctctgtatttttgtttattga

SEQ ID NO: 53660 - DNA, 306 bp, Heterodera glycines
  Genomic contig location: Contig_ID=SeqID_22961; Location=361..666; Strand=-
  SCN-specific regions: Sequence locations=1-11,67-306
aagcatctttcaaaatttatttattttttaatgaaatagaattatttttcttaaaaaaaattaaaagttggcgtggaaaggagccgaatctcctccaaaatattttccgttcataaccactgacaatgagacaagaacttgacaaaaacggaactgtcaaaattttcttaaatggaataaatattcttaaattaatttccccccccccccccgaacaattgagcacggcgtttacctgctgtccttttgtactgcgatttgctgaccaatcgctgcttttcttctcgtcggcgcgttcttctactg

SEQ ID NO: 53661 - DNA, 408 bp, Heterodera glycines
  Genomic contig location: Contig_ID=SeqID_22962; Location=25..432; Strand=-
  SCN-specific regions: Sequence locations=1-408
atgcaaatcctggacctttgcgatgttgaagcgcttcctattacacagtaccgaatgggaaaactgggcacccgcccacgtccgatgaagttggttcttccgacccgtgctcatgttcggaaatgtctcctcatggcgcgcaaaaaggactctgcactgagaacgcaaatgccaaatgtcttccttcgcgaatcgttgacaggagaagaactgaagaagcgaagtgatgcgattaagctgtgctcactgctcaacaaaaacccgaggttctctgttcgtgggacttttgtcgtttacgccacctttcatgtgttgttgaagacccaaatccccatatttcgcaatgacaattcatttgatgggctttctgccctcaacattgatctcaatgaccccgctctttcataa

SEQ ID NO: 53662 - DNA, 2025 bp, Heterodera glycines
  Genomic contig location: Contig_ID=SeqID_22963; Location=243..2267; Strand=-
  SCN-specific regions: Sequence locations=1-148,170-1054,1076 -1612,1634-1860,1882-2025
atgcccgcaccgatcgacaaaagcaccctccgatcatttttaggcgctttgaattattatggcagatttgtcaaatgcatgcgtgagttgcgtgcaccgctcgaccgactcctccaaaaggacgtagcttggaattggacttctgaacagcaaaatgcttttgaaaaagcaaaagaaatgatgacatccgatttattgctgacccactacgacccggcacgcccaatcgtcgtatcagcagatgcgtccaaagatggaatcggtgccacattaagccacacattccccgacaaaaaggaaaaagcggtggaacacgcagcctgcactctaacagcagcgcagcaaaattacagccaaattgaaaaagaggcattggccattgtgttcgccgttcagaaatttcaccgcatggtgtacggcagaaaatttattttgcaaacggaccacaagcctttattggcaatttttggctccaaaaagggcattccgatctatgccgcgagccgcctccagcgctggtccatggttttggcgaattacgattttgaaattcgctacgtaaacaccacatcatttggccaagccgacgttctgtcacggcttattgccaattattcgcgtccagaggaagacatcctgatagcaaacatctgtgccgatacagattgctacattaattctgttttcgaaaacagaatggatcagctccccgtgacaacagtcgaaattacagcagaaatggccaatgatcaaccacttcaaacggttcttcaatttttgagaaatggatggccagcaaaagtcgctgattctgaaattagtccatattttccaaaacgggacaaaatttttgaagtggacaattgcctattgtatgaggatcgagtgatcatcccaacatcgctccgcagtcggatcctaaaggcattgcacatcgctcacccaggcattgtgcgcatgaaagcacttgctcgatgccacgtgtattggccgggaatggactcagcgatcgaaaaagttgtgagcacttgcgaagagtgtcaattgggccagaaaaaccccaccaaagcacctctttcaccatggccaacgacggacaaagtctttcagcgtgtccacatcgattttgcaggcccctgctcagatggtcaccaatatttaattctgatcgactcattttcaaagtggccagaagtttaccgaatgaacacaatttctgcctatgccaccgtatttgtactccgatcaatcatttttcggctcggaatcccagaagaaattgtttccgacaatgggacccaatttcgatctgccgaattcgccacattttgtaaagaatttggaattaagcatactttcactccgccatttcatcctcaatcgaatggccaagtcgaacgcttcgttgacaccttcaagcgttcgatgaagaaaatgtcaaaaagcgaaaaggattggatcgaaaagatgctattctcctacagaaccactccacacgtcgccttgaatggattttcgcccgatcaattatttttcggcagaaaattacgcacaaaattgtcgctcgtccatccgaaaggagaaaaagccgaaaattttgatcaaaactcattcaaaaagggacagacaaaatacaccgacaaaatggcgcgaaattttgatcggaaacatgggacaaaagtgatcaatttttccccaaacgatcatgtccttctgatcaattatcggaacaacaagacggaatggctccaaggaaaagttgttgagaggcttcacaaatcgcccacatatcgtgtttatgtgcctgttctgcgtcgactcgttcatcggcacgcaaatcagctaaggcgacgacatcttttggaagacgaagccgaagaagaggcacctcaagtcgaacagccgccgccggttgtcgaaccgcctcgtcagccccaacaaattcagccagccaattacccgttgaaagtccgccgatcgagccgtatcaagaaacccacacaattttactctccatcgagatga

SEQ ID NO: 53663 - DNA, 397 bp, Heterodera glycines
  Genomic contig location: Contig_ID=SeqID_22963; Location=1979..2375; Strand=+
  SCN-specific regions: Sequence locations=1-120,142-397
cggggaatgtgtggcttaatgtggcaccgattccatctttggacgcatctgctgatacgacgattgggcgtgccgggtcgtagtgggtcagcaataaatcggatgtcatcatttcttttgctttttcaaaagcattttgctgttcagaagtccaattccaagctacgtccttttggaggagtcggtcgagcggtgcacgcaactcacgcatgcatttgacaaatctgccataataattcaaagcgcctaaaaatgatcggagggtgcttttgtcgatcggtgcgggcattttccgaattgcgtctgaacgcgacgggtcaggacgaattccgtttgctgacacaatatgcccaaggaacaaaagttcgggctgcaaaaatttgcatttgtcgagttg

SEQ ID NO: 53664 - DNA, 762 bp, Heterodera glycines
  Genomic contig location: Contig_ID=SeqID_22965; Location=1003..1764; Strand=+
  SCN-specific regions: Sequence locations=1-417,439-557,588-762
atggcaaaagtcgcaaaccgaaaacgaaatgagcgccgaattcgtgccgtccaagacttggcgcggcacctcaaccaccgaatgaaccgccaccgccgttggcagcgcgacggaaaacgggacccatcggaggaacggcacatccgaatgaccgccgaacgttatgctgatcagctctctcgcctgggagatgaccacattcaccgactgcagcaccaattcccgcaactccccaacccccgccggcgacgatcagaggtggggggcaatctgaaagggggaaagtcccagccaaaattggcatcgatggtggtacgcctgccccagggagagttgctcccttcaaaggatgtcggcggcgcagcaccgggcgcatcggactcccatggccgaaacgagaacgaagaggaaggccgtgagaaggccgagaaggaaagaggcagccgcccgcgggtgctccctccgcctggggacagttttggagaattgctggagaaagaggcgaaagctcgggccgaagtggccgagctcgaagcccgggcaaagaaggcaaaaatggagagggaggaggaggaacagaaactgaaatcggcgaaggaagcgcgccttcgggacttggaaacccaagccgacgacttgcgccaaatgttgggcgatgcgagctggccgtggtcgagaggcaaagacgggaaaaatgggggaggcggtggctccccgcgctgggaaagcggtgggcatgccagcagtgccgatggaggatga

SEQ ID NO: 53665 - DNA, 1222 bp, Heterodera glycines
  Genomic contig location: Contig_ID=SeqID_4223; Location=246..1467; Strand=+
  SCN-specific regions: Sequence locations=1-266,288-463,485-660,830 -1009,1031-1142,1172-1222
atgacaacatccgacaatgattcttatgaatcgtgcattactattgcagaagatccaacagaattagcagcacatgacaatgataaaattaaacaaacaaagcactcagcagaaaatgaggagaacaaatgtttagcaaaattagtgagttttattttttgataaaattaaatttgacgtggggcaaatccccgactcttacgttgaaaatccagtttttggggtttacttgacattttgaagaaccaaggcactaaatgctcgatcccaaatcccaacccaatttctagggtccacaaccaccaaagacttggaacctctcgatttttcgggatttcgtgaattttcctaataattttcccgacggcatttatgaccccggcatgaattcggccccaaaagtattcaacagggacgcacttgaattccttccaaatctcgattttggacctcagaatcccccttttctgtggtcttttcagttaatgaaacactaaatcacctattttccgagggtccacgaccatcaataaatgccttgtaaattcttaattttcttggatttcttgaatttttttataatttcccgacatctctgacccccggaatgcgtgcggcctcactggatcacgagggatgcactcaatttttaatattataattccactctatttttaattattttaattccactccatttttaattattttaatttcactccatttttcattattttaattccactccatttttaattattttaatttcacttcatttttcattattttaatttcactccatttttaattattttaattcattttttttccaattttttaggaaaacgttttgagcaatgccacagcaactgatgagtcagtgtccagctcgtccttcacaaattccatctcggcagcatccatcaattcaaggacagcacttggtgtgaaaaacaacaacaatggcatcaacaccaccaattcaacatcgtcggcattatcatcatcatctgctgctggtggtgctgctactgcttctgttcggcaccaccaacaacgtaatcgtgtcctctcatttcatctaaatggcactgtggtacatcgacggaggccaaatagtgcaagcaaaaatcccattcatgtaataaaaatttttatttgaattttttaacttgtttcggtatcattttaatagcgattagtctgttctctctatttacaa

SEQ ID NO: 53666 - DNA, 689 bp, Heterodera glycines
  Genomic contig location: Contig_ID=SeqID_4223; Location=2216..2904; Strand=+
  SCN-specific regions: Sequence locations=1-24,46-141,167-689
atgatcaccacggatgacgacgacaaaaacaacaacaataatgatttggtggacacaactcgtgagaatgcttttgacatgttgttacgcttttgtgaaacgccggcggacgttgcctttctcaggagccatcctgatcagtaataatttaaaaaaatataatattgtaatggtagtgaacactgatcagtgggtctgaccaaaaaagagctgaaaatctataaagttttggtcctttttacagattttttccttacgaatttgttggctatagttaattgtagagttgagcgggaccgggacctgaacacggacaactgagtacaactgattaccgaagtcccgggtttgaccgggaccgggactagtcccgggtttttcccggttttcccagccaaaaattcccggtttttcaacccgaaaaggtcccggtcccgggtttgcccaaaattcccggtcccgctcaactctagttaattgtcaattcgatacaaagatcagaaaaaaaattgtgtcacacctctgctggtgatgatcgcgactgatcattccgagtatcgacattgtgatttcgaccattttttgagaggggagggggttggaaatttagggttccagtccatttttttcatatcaacaatttgttcactgttcattttaatgttacttttcttatttaattataatca

SEQ ID NO: 53667 - DNA, 1744 bp, Heterodera glycines
  Genomic contig location: Contig_ID=SeqID_4224; Location=483..2226; Strand=-
  SCN-specific regions: Sequence locations=1-29,51-403,463-495,518 -707,784-961,983-1453,1475-1681,1703-1716,1738-1744
atgaatctgttaccgcatttccttatttttggttgcctttcaatttttgcgtcggcatttttgcctcaaaagggcataaatcgcaacgacaaaagcactgcatggcacgcatttcatgcagatgtgcgcgatgaagtcgccatcgccaatgcgtcgcggatttttaagccaattgaaaatgaggaagaggccgaagagattttgggccgcgatcgtgggattagatgtggccaaacggcaacgaacagagtaaaaaaaataataataatctacggatacagttattttttctccgtaattattacaaattttgaaaaaatggaaacaattattttaacacagctggataaaaagactcctaacaaattaactacataaattttttcatttaataaccagtgacaaaaataaattataaattcaaaaaatgtgcaataataaaacttttttaaattttaattactgtactcgcaggtggagtacggtcaacagtcaccaaatgaggaatggccatgggtcgcaagtgtccaattggagtgtgtgacgaagcggacaaaccaaatcgagcttcttcaattgtgtactggcgttttaattggggaaaagcatttggtgaccgctgctcattgcctttatttgcctgccgaaacattcatgaaatgcaaagacaatcaaattcaaggagagtttgacgagggcacaaggtgttttaaatttttaaaaatattacatttttcactaataatcaaaacttatatattttcataaatattttttaattttcagtttccttgtcaccaacaagtatgttaaagtaacattaggcggtggtgattttcggaattcgtcaaagcttggcatcaagcgcttcttcaaactgcaaactttcaggcagcacgaactgaacgacgacatttcgattctcgaggtaattaagaaagatatagatcattaatgagttaattcatttgttcatttcttagcttcaacacccagtgtccgtgagcaccaaaatcaacaaaatttgtatgcccgctacgtacaatccacggactggccaagttgcttacatggccggatacggcgacacttttgggggtcagttataatttaattaagcaattttggaccaattacaaaatcccaattattctgaaaattcaatcttttaattcaaaaaaactcagtcgttaatatgccgttattgcaattttcatattttgatatttagctcgtgaaaacagctcggaccatctgaaagaaacaacggccctgcgcgaagacctcattacaatccgtgtcaacaaaccatgcccgacaaatttgatatgtacaacaaataaagcgcgacaaactacagtggtagaccaacctgagcatcaattaaccttaaataatcaatttaaacacaataattaccttgaaatgataaaaaaatgatttaaaaattcggaaataatttattttttaatttcaaaaggacgattctggtgcaccattgatgcgacaacttgccgatgggcgttgggcacttattggaatcgtaaaagggcatagggaggagtgccaatcgaagtgtaaggaatgatcaaaatacattgaatttaatttaaaaaatgaatttaaacaattagtttttaactccgtacaaaattttggttttgtgaaatcaaaaaatgcaaaacctttaatgttttcattatttctaattgattttttgaaatcattcactttttaaaataaa

SEQ ID NO: 53668 - DNA, 1733 bp, Heterodera glycines
  Genomic contig location: Contig_ID=SeqID_22967; Location=31..1763; Strand=+
  SCN-specific regions: Sequence locations=1-72,94-442,465-537,562 -1105,1127-1252,1274-1688,1711-1733
  Gene Ontology: Mol. function=ATP binding; Cellular component =cytoplasm; Biological process=protein biosynthesis
acagacacccggactgggacaatcggactttgctcgaatggttctccgaaaagagatggaccgacgaagataattttccacccttttctgagaagcacttgcaaattattgaccaagccgttgccgaaatgaaactgctcattcgatatgcgcaactttttggcagtgatccgtcgcgcattgtcttccagccgtcgctggcacgcggcttggattactacacgggcatcatttttgaagttgtgatgaaaggtcacattatataactttaacggaaaggacaactgggcgttgaatgcacttcactttccccaagtcgtttctctactgaaaatgatctaatccgtgtttttggctataactcatttcaatgcccaaaatgaacgaatttagtatcatttgaaatctgagctttttcggccatcaaaatttcaattgtaaattatgttaaaaaataaaacctattattcacggaacaggacaaaattgcgccgccggaatttcgccggccgaattttaccgccaacatttttttaattcttgaaaattttcaagaaaaaatcttattgtaaggaaattttttagattttttctagaaaattcgtttaaaacttttttcctaagattttttttttcttgaaaaattgctattttaagtccaatatatctttttaagaattcggtggcgaaatttggggtgcgtccatttttcaatggtagtaaaaaatattgtttaaattggtatgttttagacagtgccggttcgttggcagttggttcagttgcggcagggggacgatatgacaaattggttggcatgttcacggacatgggcagaaataaggacgatggaggggtggcgacagccccaaagaagcggccggaagtgccatgtgttggcatttcgtttgggattgaacgacttttcaccataatggagctgaaggcacgcgcggattcggtaattaaggacgaacagtgcattttatcatgttccgacaattgcgccttggatatttgcgtccatcccaaaaatcggttacaaatgcatgtttttttcaatccgacatagcataataagccgaagtaacaggaaaaaattaatcataatttaaagctttttacaccactttttggattggtgtgttggtgcaaatgcggttaacccatttattccatcccccgaatgtcgttaattgttgcagaatgcggtgaaagtttcgcccactcaagtgtatgtggcatcggtttcggtagcaaaggaagagacagacaaaatgttggaacaacgaatgcgactgtgtgctcagctttggaatgcagagatccgtgcagaaactggttaaaattagctgttatatcggcagggtgatcatttttccatctatcgttagcatttccatggtatttcggcagcgccaactttgaaatgctataacttttctctctgttagtcgtctttagcaaactcatttaaatgtctgtcaattttccttttagttcggactttgcctttgaaatggccaccctgattgtcttacataaatcattttggttatttaggttataaggccaacgtaaaatttttacaacaaattaaattttgtgagactcaacaaatccggtggatgcttatcctcgggccggaagaaattgctaaaaattcggtaaaattgcgttacatcccggccaaagacaaaggagaggaggttcgattgggaattggaaagtaa

SEQ ID NO: 53669 - DNA, 1166 bp, Heterodera glycines
  Genomic contig location: Contig_ID=SeqID_22968; Location=668..1833; Strand=-
  SCN-specific regions: Sequence locations=1-214,291-355,385-774,796 -820,843-1084
atgggctttattgacaaaacaaacggcaacacgtttgttttttatgtgtcaaatttttgttgtaattactgttttgtgtcataattttattatgtttaaaatatctgaattaataaaacccagattagacctgtaataagccttattcttgacattatcttttgattcttggttttttaaattctgttcctgtttattttaaatctccattcacaaatttaaaaaaaaagtaatatggatttattaaatattaacaaatgaaaaattttaatttgtttttttaattattacacaattctagcactttcccaatgaatcaccgacttccgattaacttttattccatttcaccaccaatttaacataataaattattcaaaatcatttaaaaatttgggtatagataaaaatttacttttactttcaatgtgctagggacataaatttgttacttaatataaaaaatacgactaattttctgtaaagcttgttaatcttaagaaacttcctaatattctttttttttggtcaaatgattacttttatattataaacatcctcgcactttctaccaatttaaaaggtttgaaagttcagtgaaaatttattagaatatcttacattaataaattgttttttttaattcagcacttaaatgtcggaatagtgaatcaattgatgggcaaagttttgctgatgaaagtattgtggaatactgctccaattctactgagagcaagcattttccagacagctgcggagctgttgtgtgaattgaacggaaatctaaaattggagggaatttagggtttactcattatttttggtaattttataattgatttatgataaatatttttgggaaacaagaagtgaattttcgattaatagcatcgaattctattaaatcaccttttagacaaagataagcattattatacgagcgaacagtgtgtcaacaaagtgatttggaaacttttttgcaataccacagaaatgaaaaaaactgttcaaacggcaacaaaactcgttgaaaaaaaggcttgtcgttgttcttcgaaaggcaattggtaaatcggaaaggataattatttgtaaatgtattaaatttctatttttatttaattatgaattaaagatgatattaattaatatgaattaataaa

SEQ ID NO: 53670 - DNA, 1209 bp, Heterodera glycines
  misc_feature (1164)..(1164): n is a, c, g, or t
  Genomic contig location: Contig_ID=SeqID_22970; Location=32..1240; Strand=-
  SCN-specific regions: Sequence locations=1-670,694-1078,1100-1209
atgactgttaagtcatcagacggaaaaggcaaacataaagtttggggtgcgatattcgtatgtgctctcacgaggatgattcatttggaattagtcacggatatgactgcgaaaagatttttgttggccttcacgagatttgtcagacgatggaagattcctcagagaattgtgtctgacaatggcactaacttcgtgttaggcaacaaagccttaaccgaaattgttcaacaaagcattaaagagaaggagcattggctcaaagttttaaaggacgaggaagtgcagaatttttcgaatcaacaaaaaattgaatgggtttttatttcgccttttgccccttggagaggagggcaatatgagcgtatgattgggactgttaagtaccacttaaaaagggaaataagaaataaactcctcagttttgaggaattatggactttgttttcagaggtggagagaatagtcaatgagagaccaatcacttacacttcccaatctgaagttattcagcccctaagacctattgatctaattttacccaacattggtaacaatagattggaaataaacactagatctgttgagaactcagacaatgattatattttggaaaattcaaacactgctaatgtagtgcaaagataccagaaggcaatgaatatggctgaaaaattttggcaaaattggaaagattcctatttattgggtctaagggaacgtcatcaagggaacaaacacacgccaggaaaagcaccaaaacttggggacgtggtgatcatttctgaaccacaaactccaagaaattgttggaaattggggaaaatagaagaaattttatcacaacgaaccgcaagagtcagaatttcggaaaaatcaattattgaacgtgctattaagcacttatatcccttagagttagccgaaaatgccaataattctgactctggcattaaacaacaggaacacagttttgtgaaacaaattcattataattgggcaaagggacttcctcaaaataaggcgcttgttaaggcaaattccccaaatcactacaaatgggcaaaacaaccaccgaaaataataaatgatataactaatgtgacatgtatttcagaaatgaacagagacttcgatgccgtgtctcttgattgtgaagagatnggaagagatctcgaggacgaaacaaggaagaagaatcgaggatga

SEQ ID NO: 53671 - DNA, 291 bp, Heterodera glycines
  Genomic contig location: Contig_ID=SeqID_22972; Location=71..361; Strand=-
  SCN-specific regions: Sequence locations=1-243,265-291
caggacctaaagaagcacattgcgcccaaaattgaccggctgtttctcgtcagttcgttggacaaaaactgcagtggcgtcatcgttttcgccaagtgagtcgaaatttgactgaatagcaaatgccagttttgaacaaaaacaaatttaatgtcactgagaagtgcccggggggggggcggttgagaattcgaataatttttggtgccacacccaaaaccaggagccaggtcaagcagttggagataaaggcccaactgcaaaatgacgccctgctttaccgttaccgag

SEQ ID NO: 53672 - DNA, 209 bp, Heterodera glycines
  Genomic contig location: Contig_ID=SeqID_22973; Location=81..289; Strand=-
  SCN-specific regions: Sequence locations=1-209
atgggtaatgaacaaagtcagtccagagaagaacggcctcgaaaattgcctaaacaaaacaacggcgaaccaaacgaaaatattgtacgaattaatcgaacggaaatgccagaggaatttcaagctgttcttttatctgacaatgttgttcagcaagtaatgaaaagtggccaaaatacgactaatgacctgcggacacgcgaactcga

SEQ ID NO: 53673 - DNA, 1079 bp, Heterodera glycines
  Genomic contig location: Contig_ID=SeqID_22974; Location=643..1721; Strand=-
  SCN-specific regions: Sequence locations=1-588,611-1007,1031-1057
atgcgcagaaaaaatatgttaatccatataatttacaaccctaataatgatgaaactccaataaattctgtcgaaatcaatatttcgaaaaattttgccgcaactattgaaaattgcaataaatttgatgaagaattccatttatcggacgatattatgaccaaaaatttaatgatcgattgggttcacaatgttttggtcccagttttacgccctggagaacaatcattattgttggtggatagttggaatggttggaatgattttcgactcccggataatgttaattaaaagtaaagcaaatcccaaaacatgcaactggaatatgccaaccattggatgtttacattttccggtagttttgttgccaaaaataaaataaaaaatagttttagaatttggaagcaatttaccagaaaaataacggaatttgtaatgatttatgatgtgaaaataaatttgcacgacagggataacattattaaattacaatcgttaatccataaccagtttcaagccgaacgttttaatggatggattaattttgcctggagaaaagccggttattacggggacgagcctttgccaaatttttgtcatcctgttaaattttgctttgaagtgccaaaaaatgacatatgtcagaaattaaattgtgaaaattttattttattacggtgtgcttatacttcattggaattttccagtacgggtttgtccgtgaaaatttgaaaaatatttccaaaattgcccattttctctagaaaaaatttcctaacccactatggatttcgaaaatttccccaattttcagtgtattttgggtgtcccggtcactaggaaggagtgatctggtcaaattggtgtaagagacttttttgatcagcatcaaaagttatacatgcatgaattatttcaagtttttaaatgaactataagatagtttttcaggtttgagtcaagaattttttgtggcactgtatttctctcacaaaaatgcaatttgtttgggaaatattaaaataataatcgaaattataattatggtaacaaagctaattaatagattaaaaatttaa

SEQ ID NO: 53674 - DNA, 766 bp, Heterodera glycines
  Genomic contig location: Contig_ID=SeqID_22975; Location=873..1638; Strand=-
  SCN-specific regions: Sequence locations=1-766
atggctttgtgcaacggcgagcccccgtccaagaggtcatcccgcaccgtgtcgtcccctattgaagacccggcgcctcatctccaattgctgtacccagcaatggcaccgactcctcccattgtcaacacttcagctgctactcctttcgtcaacaatcagtacaacgacagcaatgacaactataataccatcccgatggacgaggacgatgatgatggttggtttgttgttgccatgaacatttgggtgcacttcagttcccccctcgaattttttttcaaaaaaaaattattagaacatttttagaaaaaaatcgctgaaaatttttcaaaaatttttattgttttttgaattgaaattcaatgctaattgcatttcatggcctttgattattcacatttttctttataattccaattaggtataatattgtaatttttaagacattcaagtgctggaagtcctaccacgccgaccgcctccacccataatgccaatgccatccactccgcctttgcctgttacgcaacctggcatgatgaatggaagtttcactttgccgccttaccacaaagcactggaacataattagggagcgctttgctttatgcgccatttaatgcaacatcaaactcaatttcttttcttttgattccggacaacaatctaatttctattgaatctcattctccaatttcgaaaaccctctccatttttgtttttttccgtgaataggaagtgagtggtgtaccgagcaaataaa

SEQ ID NO: 53675 - DNA, 3160 bp, Heterodera glycines
  Genomic contig location: Contig_ID=SeqID_4225; Location=725..3884; Strand=-
  SCN-specific regions: Sequence locations=1-80,103-117,139-217,239 -438,461-517,539-701,723-747,770-1418,1440-1639,1662-1852,1875 -2412,2438-2580,2602-2637,2659-2859,2881-2908,2936-3160
ggtgcccaaatccatcccaatttgcttaatttcaccccatttatcccctcagattggtcttttgcttatgcaacgggttattttactttctggaaaaaatggccccggatgctgtaaaacagcatttgctccctttgatttacaattctctcaccggcgacaatgtcagagtccaggcaggttttcagttaatcaatttgaaaagaaacctaacattggttttttattcccacaaaattctaggagttgacccttatagaagtgccgaacattgtcaaatttgtcgaccgagagcaaatgcgaactcaattgatccccaaactcatccgtcttatgctcgagtcaaaggacctttccgtaaaatcgcaattactttttctaaaattcatttttcgtttttattttactttcaaaacttcgaaaaaatgctttataatattagctttttatttttaatcacttgtaaagagtttgacattataagttgattgttttgcaataatggggggggggagagaaatattattttcttattttagattcgtgtccaaacaatggtttgtctggccaaattgcttccccacatggagccttggatggtcactgatcagctgttgcccgctttaccgaaaataaccagcaaagacccgagtgttttgatggcagtgctgggcatttacaaaattgttcacgaaaacaccaaattcgggatcaacaaagagcaatgttagggagggcaaaattgggaaaatttaaaaaatttatttttcatcaacaaaaatataattactaattgatgaaagctgattttgtgtccaaggtgctcggagtgtgctaccttatcttatttccaccgcagtcgagcccactctgaacctccaacagttcggccagtacatggaactggtccatcaactgatccgacgggtcgaaaccgagcaaaggcattgtttggagcagctgagtgccagtcaggaggaacaaaggtggacggagaggagccactcgcatttgttattgaagcgattgttttcatttaaggaaaatcactgactttgcggactttctgaatgcccaatcgaatgaaatgaacaaaaccaatcagagcgaagtcgatttgggcgacttggcacgagcattgagcggcacatcggcaaatgatggcatctgcaacagaacaacggacaaaagggacagtgggacgacagaaaacagtggcgaaacaatggcaaaggtatgggggggggggactcggattgatgttcaaacgcaacaaaagccttacgatgagaaaaaacgggggattaaacgagttgctccgactatataactcttttttattcttatccgaaattatgtcgcggcgaaatttcggcggcgaaattttgtcccatcccctaattgtgtgccattcatttttaattcgaactttttagggagcactttcactcgatgaaaaacggcgcattgtggcagagaaaaacggccaagtggtcgaaatggaaaaaacattgacggcgtcgaaaaacgctccgttcgaccccttttcgctgtcttctctctcttcccgccagtcggttcaacaacgtccgcagagttcgctcgaagcttcgaatcgcatggaacttttactctccgaattcttgcccacaacttcatctcattccgtatcagttgaccaacaacaaaatcagcaactgccccacatttcacaatcggcctcatttgccgccttcccaacaattcctcagccgaatagcagtgctaatcccgtacagaaaagaggtaaaggggagaagcggcaaaattaaattagcagacaaagagaaacgaactaacggaagagcacaaattcatattttaggaatggttgagacacggccatcgacagcaccgaaagacccatttgatgcccttgaccaattagtgatgaccgtgaagaggacagaaacaaattggacagaaggggcagcgagaaatggtggcatagcacagaacaaagggcaaccaatgaaagacccttttgagcactttctccgctgacaaattgccgttcatttgttttattattccatttaattgtttgtcatcatttatgtttctttctttttgtgtgatattctctttcatatgtgtaaaaaaggctatacaacaggggatggaattcgtacgtgaatggcaaatacgttttaaaaaaaagcacatgcggtgaaacgagtaaaatggtcagtggaagcaaaaaataaacccattatggcaacaaaaaaaaccgattaagtaaactacatttttcatatacctatttttttgcgttcttgaattttagaaatttccattataactgttttttgatctgatcaatggcagtgattgcgaatgtttcaacgaaatggacattttctctcttgcgattgttctttgtgcaaattgcgctgaaacctttgaagaatcctacaaaaaacgtggggtcatgggagttcgtacaatggagtttcgtacaaaagccggttcgtacaacgtttcaattttgcgtttcgtacaataatcaaatttaaaaaaaataagtgacacataatttcatcaaaataacaaaaataaagcaaattataaataagttttgagctaatgattatcaaaaataacaatagtaataactagggccgcgacttttagtgactaaaaatccggaaatagttaactaaaatagtgtcgaaaaagtgccaaaaaaagtgacaaaatagtgaaaaaagtccgaaatagtgacataatttttagccaaaaattgagcaaaaaataatttttattcactggttgcagctgcaaatgagctacatttccgttataaaattctcttagcaaatattgacattttttaaatcaaaaattttgtcaagaaaaaaatttgggggaagaatttttgaaaaattttccaattcttagtggtgtattttaaaaaaaatttttggtcgattcttaggggtgtattttttgattttattgcatttttgttaataaattttccaaaaaatgtcgaaatagtgaaaaatagtgacaaaacgccaaaaaagtgatttctagtgacgaaaaatgacgtccaaaggaaaaaattttatcccttactctatactaagtgagaggaagctccgcccctttttgtgtt

SEQ ID NO: 53676 - DNA, 318 bp, Heterodera glycines
  Genomic contig location: Contig_ID=SeqID_4226; Location=775..1092; Strand=+
  SCN-specific regions: Sequence locations=1-318
atggacccgcagcaacttcaacaattgcttaatgcactgcaacaaatggtcacaaatgccgcaccgcaaaacgccgcaccagcaaatttgagcaatgccaatttggcaagctctattgatgctcggctttcagcattccattacaatccggaggtcggcaccacatttgaaagttggttcaaacggtttgggaaattgatcgaggacgacggaagcacactgccggaggcctcaaaagtgcgccttctcctcggcaaactcggagaggaggagtacagcaaatatcgggacacgatcagcccaacccagccggaccaa

SEQ ID NO: 53677 - DNA, 150 bp, Heterodera glycines
  Genomic contig location: Contig_ID=SeqID_4226; Location=1168..1317; Strand=-
  SCN-specific regions: Sequence locations=1-34,56-150
agattggggaaatgtcataaaaataggtaattggaaaaggaagggaaattttggatgaataggatgatggacggccagaaggcctgggatgggacaaaaaggcgaaaaacaaaaatggttaaaattacgaatggcagattccacacattc

SEQ ID NO: 53678 - DNA, 3269 bp, Heterodera glycines
  Genomic contig location: Contig_ID=SeqID_4227; Location=1206..4474; Strand=+
  SCN-specific regions: Sequence locations=1-184,207-949,972-2465,2487 -2649,2672-3269
atgacgacaaatttgcctcaaggcaaagaagctcaaaatagtgggtcagattttgatccgatttacttttcgcctgaggagaaccaaaaatgggcgaatttgctggtcaggatgagagcattcgagcaggctgtgtgccgacaatttcgtcaaattgaaacccaatttgttcaaatttcgagtcaaattcaaatttcaaacactgttgatcgtgtccgagaattagagtcttctctgagggaactcgagaatacaatggaaatggacacatttcagactcaggaaaaaatgattgatgttgaacaagaagttggtaaagtgaatatgagaatggattatcaggaaaggctgactaaagtgcgtttcgggaaaataattgaaaaaatgaaggccgaagtgagcaaagttttagagagtcttgacactctccaggcaagagttcaaattttggaatatgaacaggacgaggaaattggtcgaacaatgtggatggaggatgggcattcagaggaacatgcccaattgccgaccaatcaggaagaaaacggagaaaataatcaagtgcaggaagaatgtgaaataatgatttcagacccatttttgggcgggatatcgccattggaggggtacgacggaaacccaagtgtttcattttcgcgatgggtggcccgttttgaggatatgctaactttgtacccgcagtatacggaaacgcaaaaattaagcagattacggattttgcttaagggccaagcgagggccgaattcgaagcaatggaaccccctcccacgagtttatccgttgctttaggccatttaaagagtaaatttgagaatgagaatacccgctctatagcaagacaggcaatggctagctgtaggcaagcgcccggagagcgcgtttatgagtttgccaatcgcttaagtgaagcggtcagaactgcgttggcgggagaaaaagaggaaataataagaaaacgtctttttgaggaatttttggagaaattaacgccggaattgcaattcgaagtgaaatccggcaggccatcaagctactccaacgcttacgaacttgctcagcattttgagctacttttggccacaaaaagggccaatcacgtctcagttgctgattcagttgccgaattatctcataaagtcgaagcgctgactattcatcagcagccaattcccaacagaaggggtagcgaaagacgcgcctgctattactgtaaacgccccggacacatagtaaaggattgcagagataaaagaagggacgaagagcgcagatatcggggagatcaaagggatggccataaatattttggaggagaaaggcgatggagtcgagagagaaattttagagacaatcgcaattttgcccccaggggaaggggccaaagggatggaaggatccatcgcacacccaccccttatggtgaagaaaatggccagaattttgaaagtgcgagaagacattcgcctgggcggcgagtaagctttggcgggagagttggagccgcaagaattgcgagtccactttttctggcactaattatggtcatatcgctttttggtcgtaattcagcgaccagtcaaatggctagtccaatgatatgccatccggactcaccagcgagtttgtggtctattccggtggacccgatttgtcccacttggtcgccaacagagataccggtcacaatgaaattgtctgtctatcgattgaacacaatacagtataaaactgcggcgacagcttgtaaatgcataaagacaaaaatttctaggagaattggattttttggtgggcgatatgaggaggtggcaacaagcccaattgaaatgcctacggcaacatgccggaaaatgagagaaaatggagaatcgcctgcgggacaattagtacagataaatgggatttttagggcaacccaaaattcgttagaagttgggtggagaaattggccagcggcgatgttttggagatcaacggaagtgagcaattgttatgcatatgaaactgttgtgttcacacgacacggaatggagggacttaacacaccaacaaatgattgtcccacctgtgcttatcagtccggaagttgccgctgtccacaaatcagcttaatttggaaaccggacttaactcaacggtgtgcttatgtaaagattgccgagtggcaaggagaatattcctcacgcatatggacagcggaaagtggggattttgccctaacatttgtaaatatctctgagaaaacggacaccaatggaaatgactttgtgatctctgatcagacattcgctgtacccaaagtggaatttgttgaaatgttaagaaaaagtgaacaggcaaatacaaaactaagaaagaaaaggtcacatgcatttattaatggggttagacgtgaatatgtaataaatgagacggataccactgtaaaatggcttgagccggatcaagaaacaaaggagttggaaaaagttgggctggtgtattcctcgcagctggcagcacagcttacagcgttaagtgtcaaagttacagcaaatacacaaaaattgtttgctgaaacagtgcataaaatatgcactagcctccgatttctcgccgatcagacgttgactttggcggaggcaaatccaacacttttggcccggtttttcctagcaaacccttatttaacggcacgattggtgacaaaagatatgttggaaatcagaccatgttttgcagtaaatgagagggaactgcattttcattggcaaaatggaagatgttttgagagacttccggttacatttcggctttttggaagctatgaaaaaacgaaacatggatttttagacccaaaaacgctaattatacactcaaatgcgagagaaaatagttgcaaagatttccgatacttatatgtgcagacaaaagggacacattctcagtatgaccaaataactggggatgttaaagaaatttcttcggaatcgatacattatctctcacgtcaaggaaaaatcgatttcccagaaatgccaatccaatttttcagaaataaagtgatcgcaaatttgtccgtgttgtactcaccggataattttgcggaaacaattgaggttgctaaaatagcacaagaaattgttcggttgaaccgaccgaatgcatgggaatttatttctgaaaagagtgatcatatggccacaaatattgtctcaaatggacttttctcattcctaaggggaggtttaatttcggccaaccaaat

SEQ ID NO: 53679 - DNA, 145 bp, Heterodera glycines
  Genomic contig location: Contig_ID=SeqID_4227; Location=439..583; Strand=-
  SCN-specific regions: Sequence locations=1-33,55-145
agattggggaaatgtcataaaaataggtaattggaaaaggaaggaaattttggatgaataggatgatggacggccagaaggcctgggatgggacaaaaaggcgaaaaacaaaaatggtttaaaattacgaatggcagattccaca

SEQ ID NO: 53680 - DNA, 1099 bp, Heterodera glycines; identical to SEQ ID NO: 4228
  misc_feature (93)..(93): n is a, c, g, or t
  Genomic contig location: Contig_ID=SeqID_4228; Location=1..1099; Strand=+
  SCN-specific regions: Sequence locations=1-769,791-913,935-1099

SEQ ID NO: 53681 - DNA, 921 bp, Heterodera glycines
  Genomic contig location: Contig_ID=SeqID_22977; Location=1..921; Strand=+
  SCN-specific regions: Sequence locations=1-125,252-406,441-463,485 -499,521-717,742-921
ccccctctgtgccgttgccatgctgtgcgcatggctttgctcacgatgactgtgatccaattgacgtgtcaaacaccgacccaaattatgggtacaaatacggacttatgctttgtcaacatgtctaaataaatttaaaattaatttttaagttaattttatttagttttattgaattttatttttttatttaaaatcttttaattatttttttattttaaaagttcttttttaattattattttttatttcctcacctttcagtccgtttcgtatcagctgcgtccctttcgcgcgtagtttggctgcaccgcatgaaaactgcgcattgggcccacgagagcaggcaaatttggtgtcaagctttttggacgccagtcaaatttacggtaattggagaaaaaagaataaaattattattttaattacttaattaaaaagccttataaatttttgttccaccataacaattataaattaacttaaaggaaagtgtaaagttctgttctcattttctttattttaggatcttttccggaaactctcggcaaattgctggccacgggcgattcgggaaaattgttgaactcaaaagtggccggagagaacgactatttaccattggcaagttttttcaaattacgaaaacttatatatgtatggcctaaagggtccaaaaatgttttatttgcaaaatcccctgggttcgactccgtcattaattaaattttaaattattttcttaacccccccccccccgcccaattttaggacccgcaaggtgaccactactgccaatcggagaatgggcggcgtaaatgctttcttagcggcagtgccgacgtgaatttgttgcccggcatcgcccttttgcacaccgtttggaaccgacagcacaacacagtgacggagaagctcaca

SEQ ID NO: 53682 - DNA, 831 bp, Heterodera glycines
  Genomic contig location: Contig_ID=SeqID_22979; Location=778..1608; Strand=-
  SCN-specific regions: Sequence locations=1-77,126-289,311-331,354 -395,430-453,475-831
atggatgtgcatgttcaaaaagctgctgaaaagattgctgctctgacacttgacctggcttatttagaagtagaatgttttttatttaataaaaaatatattaagtatttttattttgaaaaattctagcttaggacttacgtaaaagtagagggcagcggtaccgggaatttttgtaaaaagaaatttattggaaaattgcgcaaaatttttggaagcttactccgaaattgttaatagatatattctaatatactaaattttttgatttggatgttggcctttacctttttcatgtatttttacaaaataaaactctgattttatccaaatttagaaaatataaatattttgagtcagatgtaaatgaatgattttttttatttttactaaaatgtgtcattttagttatttttaaatttcaataaactgaaatatttcgagaaattcatttttatacgtaattcaaaaaccgggcttttcaaaatttccgggatccgaacctagaaacctcgtatttaccgtaccagccacggtcccgctgcactctacttgaaagtcatttaaattattcatagctaagaatagttattttattttagaatgtacaaatgattatcgacagaatcaagccatacttcatctatattcttgatccacacggctgctgtgctgaagctgactggaaaacgtttacaaagtactgtaaatccgaggtgtcaaaaccaatagatggcattaaggtatgtttattaaattgaatatgagccctaagatcattttgatgttaaatcagaaaaaatcaattgttatttttttgaggatctgtaa

SEQ ID NO: 53683 - DNA, 192 bp, Heterodera glycines
  Genomic contig location: Contig_ID=SeqID_22979; Location=1033..1224; Strand=+
  SCN-specific regions: Sequence locations=1-102,124-147,182-192
atgaataatttaaatgactttcaagtagagtgcagcgggaccgtggctggtacggtaaatacgaggtttctaggttcggatcccggaaattttgaaaagcccggtttttgaattacgtataaaaatgaatttctcgaaatatttcagtttattgaaatttaaaaataactaaaatgacacattttagtaaaa

SEQ ID NO: 53684 - DNA, 262 bp, Heterodera glycines
  Genomic contig location: Contig_ID=SeqID_22981; Location=1350..1611; Strand=+
  SCN-specific regions: Sequence locations=1-262
atggtactaacacgcaaaaaactgaaaaaataataaattgagtaattctggagtagaagcaagaagaaagcggaaggaatggcgccaggatcgggctcaaaaaggcggttcaacaccaaaaagtgatgaaattttgataaaaatttcatttcaattaaaaatcaagtttttacaggtcctcgacaaaccacagaagctccatcaacaaccggagagggaacatcgaccgagacaatgccatcgacttcgaatgctgagcccc

SEQ ID NO: 53685 - DNA, 859 bp, Heterodera glycines
  Genomic contig location: Contig_ID=SeqID_22983; Location=135..993; Strand=-
  SCN-specific regions: Sequence locations=1-74,97-597,622-681,718 -835,857-859
atgacagacaaaaatgatgacaaccgaaaaaagggttcttcttcccatggcgctggtggcgatgatgatgggcaaagaaaggaaaacaaactgaaagaatacaataaagcggctgcaaaatgtaacaaactcacaacacgggaagaatgtgaaaaattaaaaaaaaatgacatcaatttatgctattggaatccgaatgtacagtatccggatagacggattggccaatgcgagccatctcaatataccaagttagaatattcgaacgtgaagatagagaagaaccggaactgaaactgagaaacgacgaagctgcaaaaccatttgctttagacaccggcacaaaaagctgttaaggttgcataaaaattcaaatatttttcccagattcaccgcttcagaaacgccgaccttatttaaaaaagagacaatataatcttacattcaccttggaattttgaagaacccagtataggaatgaataattaaaatttcaaattgttcgatttggggttaataattcgatattgggcaaaacgaatgtcattttttaacgaaattattcaatattgaaacctcgaaacgggacaaaaattcaaaagaaaggaaattacacaaaaaaccatcaaatcaatcatttgattttttctcatgttttttttgcagatgaattttcaatagaaattaattaaaaaattcacaatattaaattaaattcgtgacgagaactgacgttcaaacgaaaaattttaaagcagaaatacgtttttttgagctcctttcttcacaataattgcgcaaaaaaatagttaaatcactagaaatcgtacccctacttaaaaacaagctaaataataaa

SEQ ID NO: 53686 - DNA, 561 bp, Heterodera glycines
  Genomic contig location: Contig_ID=SeqID_22984; Location=658..1218; Strand=+
  SCN-specific regions: Sequence locations=1-16,38-47,69-136,194 -226,257-517,541-561
atgtttaaattggctcaaaaattaccactattgattatcgagaaaaattattttatggaggtgtttttggttaattctttgttattttcgtaaaaattatttgtctctcgaaattttttttgtcgagttttgactacctttgtaaaaagtggttttaaaaatacttaacattaagataaattttttattttggtatcagaagaaagagcacacttcaatctataagaatcttatttttgtttatttttatctcacaattttccgtgtcaaaaggctcatggtaaatatggcaaccatgggtaggatggtggtagcatttctaaccaccaactcccgtcaaatgaccatgaactacgttcttattgacagggtaaaaaagagggtcatggtcatggttaaataaccaccaacttcgtggttgtttgaccaaagttcgtggtagctcttgttgaccgaggtttaccaccaacttcatggttatttaaccattaccaccttcttattgaccgggccctgatttttcactattttaaacaaatgcccccccggcctttttttaaa

SEQ ID NO: 53687 - DNA, 605 bp, Heterodera glycines
  misc_feature (275)..(275): n is a, c, g, or t
  misc_feature (444)..(444): n is a, c, g, or t
  Genomic contig location: Contig_ID=SeqID_22984; Location=1356..1960; Strand=-
  SCN-specific regions: Sequence locations=1-30,133-532,554-605
atggctgaaagcactgctgatttggtaggctaaattttaatcaaatttatcttttcaaataaaataaattaaaaacaaaaaaatacaataattttcattatattttttatatttaaaattacaaataaataagacatattttgtcattttgttgatagattttggcgttcaaccgatgtctcgacttcttctcgccccgtttttcaaactttttgttcgctggccacagaacattgttgtggaatttggcttgttccctctacgctttctattgngcttttttccttcgtccggctgtttacagtagcgtttattttggttctttttacaacccattcgcgggctaccgtactgacgagaagcacaggtcttcttccatcgacagggacagggagaaaaaaagcttttgattcaagttactgtaccaattacagtatgaccggnggttgcatgtggcgcataacatttgggtggcagtcctaagcccgggcattattttgatcttcgccgctaaactgtttttcgactcgcaaatgaatcacagacagtttggcgtcatcgtctcggaaatgagcgctattcagagaagggtttcgataattaaa

SEQ ID NO: 53688 - DNA, 203 bp, Heterodera glycines
  Genomic contig location: Contig_ID=SeqID_22988; Location=236..438; Strand=+
  SCN-specific regions: Sequence locations=1-134,169-203
gagcataaagaatcaattgacaacaacaaaatggtgggacaagaacagcaggacgaacagcgattgaccaacggaccaacggagccggagaaggaaataaccgatttgaaagcaaccggttggctcaataattaattttaaaatgaaagcaccaaatttttaaaataagccataagaaaacttaaaaagagggatttttgaaa

SEQ ID NO: 53689 - DNA, 1372 bp, Heterodera glycines
  Genomic contig location: Contig_ID=SeqID_22989; Location=102..1473; Strand=+
  SCN-specific regions: Sequence locations=1-46,88-110,139-555,577 -1012,1059-1198,1220-1283,1306-1372
atggcaggcgaatggctcacggcaacatgcaacacgaatatgtacgataatattttttttaatttatgaaaaataaagataaaaaatgtgtgattatcctttttttacagtatttttttattaacttaaaataataatcactaaaattctttgagaagagataaagtcgttttcgttcttaaatacattcaaatgatgccattcaaaattaaggttcacctacgaaattgcacctgtgttcagtctgatggagaaagaagttacgaagagaatggtaattttcatatttttttaaccagtttaaacatttattgattcaaggggatctgattggagaatttctcaaggccaatcaatgataaattcaggtggaactgatcggctggcaggggggcggtgatgccatcttttcgcccggcggtgccatcgccaatatgtacgcgatgaacgcggcacgccacttccattttccgcgtgcgaagccgctcggcatgacagccggattgcccaccctttgctgcttcacctccgaagatgtgggggatttaggcattattttagcaaaaataaacaattatcaattttgtgggatttataacagtatagaaattaataaactagtgtacattaattaattaactttcagagtcattattccatcaaaagtgccgcagctgtgctcggcattggcgcagacaattggtaaaattgtttttccaatgataccaattttgtctaggtttaaccattttaaaagttaggagtgccacatttattcattttccagcattgaacgggttcaaaaaaaggggtttaaaagcgttgctgcattttttgctttttctatcattttagcacctaagaaaacctacaaaagtgattttgtgtgttgttggctcagtgccttttgtcccatatttacctcaaaaaaatataattattgtttttgtggtaaactacaaactcttgaaaaatgaattccttcttaagaataaattctccgcttgttttcaaaataaataatattaatatacttttatcttttttactttttttatctctgtaaacaaaacacacttttttcagttttaatattcccgtggacagtcaggcccggatgaaccctgaggcgttggaagagtgcataattaaatgcaaagatgaagtgcttaatttttttgttaattattcaaaaaaagattttcaagtatttccttattaaaaatgtcaatttgattgacattatgacgggaatttttcaaaaaatagtcatataattctatattttgatttcaaaatgtataaattttctaaataagttttacttttaacaaaaaaaaaaaaattgaagataaaaggatatgaataacca

SEQ ID NO: 53690 - DNA, 2591 bp, Heterodera glycines
  Genomic contig location: Contig_ID=SeqID_472; Location=362..2952; Strand=+
  SCN-specific regions: Sequence locations=1-175,197-856,878-1563,1586 -1701,1723-1971,1993-2343,2365-2401,2423-2563,2586-2591
atggatcaattggcaagcggaattcctggtgttgttggctatatggacgacttcatcattgcttcaagcacagtgaacgagcatttttcaacaatttttaaattttttaagcgaattcaagaattcgggttccgaattcatatggacaaatgcaaatttttagttaaggaaatcaaatttttgggtcaaattgtttcgtccgatggtatccgtcctgatcaaaacagaacacgagcactgcaggaaatgccagcaccgacggacatcacaacactccgatcattcctcggggcaatcaattactatggaaagtacatcaaaaacatccatcaaatcagagcaccactggatgaattgctcaaacagggagtggaatggcaatggaatgaaaagcaccgcgaagcttttgaacaagcgaaatcaattcttttgtccgatttagccttaacgcattacgacccaaatttgccaattattgtcacagctgacgccagcaacaaaggaatcggcgcaacaatttctcaccgttttccggacggaaaagaaaaagtttttcaacatgctgcccgaacattgtcaaagacggaacagaattattcgcaaattgagaaagaaggacttggactcattttcgcaattcaaaaatttcaccaatacatttttggtcgaaaattcattttacgcactgatcaccgtccactgctggggatttttgggtccaaaaacggaatcccgattttttcagcgtctcgtctacagagatgggcactgattctactgaattacgacttcagcttggaattcgttcgcaccgacaacactggacaggcggatgtactgagtcgtttgatcagcgaacagcgcaattctgcagcaagcgaagacatggtcatcgctcagttgtgtgcagaaactgagtcggaagttgagcatcttttgaatgtgcagttggaacaacttccggtgacagtagacgaaattcaaacagcacaacaggacgacgaattgatcagggaagtgatcaaatttactcaaaacaaatggccaaaccatggcattaatcccgaaatcaaaccgtttttctcgggaaggcagaaattatcaattgtttcaggatgtttggtgtttaatggtcgatcggtcatacccccatcactcaggcaccgcgttttgaaggcacttcacttggcacatccaggaatcgttcgcatgaaaaatctcgcgcgaactcttgtgtactggccttcgatcgattccgacatcgaagaaatcgtgcgaaaatgccgccaatgtcaagaagcagcaaaacaaccgcaaaaacaaccgctacaaccatggccaacaacaacacaagttttccaacgtgttcacattgacttggcaggaccttgtagtgatggaaacacgtatttggtaattgtagactcattttcgcggtggcccgaagtgtttatgcttcgccacacgtcatcacaacatgttattgaacaattacaatggctttttgaccgatttggcattccgaaaacgctagtttcggataatggtcctcaattcagttcatcccattttaaagatttttgtgacagtaacggcatttgtcatctcttttcgccaccataccacgcacagtcaaacggagcagccgaaaagtttgttgatttcttcaaaagacagttgaagaaatgcagtggggataaaaattggttgaaacaatcacttttgtcttatcgctccatcccaattgcagttttaaacaatcgatcaccagcagaactgttcctcggccgaccactcaggaccaaactttcgctcatgaaaccggaacggccgaatccattcttccgaggcccgtatcaacaacgcatggcacaacagtttgataagaagcatggagcaaaaagggtagagtttaacatcggcgacaaggtgcaatttgtgaattaccgtgatggaaaaacattatggttatttggggaagttgtcaccaaaaaagggttaatttttggcattcgttccccacaaatcgcaaacagaattgtcactcgccatgcaaatgccatacgactcacacaagcattgggcactgatcaaacatggccaaattttgatgaagagcccaagaagaacaaatcacccgttcgagcaccacaaattcagcgaaatgtcacaccaacaccaccagccgaaagaaaccatgatcaatttgaacagaacgaagaagaacagaaccaacaacaaacaccagtgttgcggcgatcagaaagggttacaaaacgtgtccgtttcctgagtccaaggatgacgggacaacgacacaatattcgccagtgatcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattatttgttgtgtgtgaaa

SEQ ID NO: 53691 - DNA, 529 bp, Heterodera glycines
  Genomic contig location: Contig_ID=SeqID_472; Location=3052..3580; Strand=+
  SCN-specific regions: Sequence locations=1-55,88-261,291-455,477-529
atgaccaacagcaaactaatccatctcaacaacgggaaggtatctgcgataattgaaaatattttaattatttttatttaattattaggtaataaccagcagtcaaacagcagcgccctcaagaaatgaaattttttttcaattattatttgtttcaggtgctcagcagtaacgcaacctgactctttaaagcattaaaacggaaaaaggaaaagccgaaaaagaaatcataacgctataaataatagactaattaaaagcatttaaatttataatttttttattattatgacagtaaccactggccttagttctatttttcataaatatttatcgcataaaaacccgataattaagtaagaaatttgttttaacaaaacaaatatttttttataaagcattagagaaattttctaatccatgtgcaaaaaaaaaagagcttttcgagtgccctcccctaaaaattttttctgggtactgtttcctatgatttttttatcaatacattttgtgcaattttggccattta

SEQ ID NO: 53692 - DNA, 529 bp, Heterodera glycines
  Genomic contig location: Contig_ID=SeqID_472; Location=4537..5065; Strand=+
  SCN-specific regions: Sequence locations=1-55,88-261,291-367,395 -455,477-529
atgaccaacagcaaactaatccatctcaacaacgggaaggtatctgcgataattgaaaatattttaattatttttatttaattattaggtaataaccagcagtcaaacagcagcgccctcaagaaatgaaattttttttcaattattatttgtttcaggtgctcagcagtaacgcaacctgactctttaaagcattaaaacggaaaaaggaaaagccgaaaaagaaatcataacgctataaataatagactaattaaaagcatttaaatttataatttttttattattatgacagtaaccactggccttagttctatttttcataaatatttatcgcataaaaacccgataattaagtacgaaatttgttttaacaaaacaaatattttttataaagcattagagaaattttctaatccgatgtgcaaaaaaaaaagagcttttcgagtgccctcccctaaaaattttttctgggtactgtttcctatgatttttttatcaatacattttgtgcaattttggccattta

SEQ ID NO: 53693 - DNA, 1366 bp, Heterodera glycines
  Genomic contig location: Contig_ID=SeqID_4229; Location=1087..2452; Strand=-
  SCN-specific regions: Sequence locations=1-296,318-461,498-576,675 -898,920-1188,1210-1366
  Gene Ontology: Mol. function=specific transcriptional repressor activity; Cellular component=nucleus; Biological process=DNA repair
atgcaaaagggtgacaaagactggcagccatctttgggctccatcttagaactacagtttttatcgacaaataatggtggtcttggtgttccaattgagggaattacgtcgccctatttttatttacgaaaagccggctcatattttaccgcccacactgagaattctgacctttatagtgtgaatttattgtgcccttcaagcggaactgacaatgttggcataactatatggtacttttagtgggggaggggggtctttttatgacaatgtattttcaggtattcgattccggcggcagattttttgaaatttaaaaatctgctctcaaccttttttgttaaagaattcacaaatgatccggaatatttgcggaataagtcaattttggtgaaccctaatatcatccgtgaaaataggatccgatgtatccgaactgtgagttatcaataaagataagattttaagaaaaatatatttttacatagtgtttagtaatttttggtatctaaaacatttttttttgaatattttttcgaagcttgtgactagcaaaaacattatcatagtgattggaaattattttttttaaagaaattttataaccatatcagtttaatatataaaatattatccctaattttattataataaaaaacgtttatattttattaggttcagcgtgctggtgagggtataataactctcccgggttctgtgcattttgggttttcaacggtgagaaaaaaaactttgagccaaaattttttgatatatattagggattaaattgtgctgttgcgtacaattttggtccaccgtcttggattccatatggaattgattctaaaccatgctctggcgtctatacatatgcatttatagaggcatttgagctagcaaaactttatgtgcttaaatgtgaagatggtgacaccgctcgagcagcagaattatggaacaccaagtataaaaacatattgaactatgggcatgggttcgatcctatctacccaaactgtcgcccgactatcaccgaatctaatgacatcataccgagaaagtatgtactattgtccgggatttggtttagaagtgaaggattaatcgagaaagaaacgggaattcggcgtggcattagatatcgttgtattaattataattgtagggcctcttcaacttatgatctttccactttattgtttacaaatactaatcccgcccatcagccggttgagcataattttgaacctaatcgatccttgattaatttaccatattatgtactattttaaatttttttgtttgatttttcttgcaatttagttgccgatgttctgtttattcttttctattaaataataaa

SEQ ID NO: 53694 - DNA, 588 bp, Heterodera glycines
  Genomic contig location: Contig_ID=SeqID_4230; Location=1615..2202; Strand=-
  SCN-specific regions: Sequence locations=1-210,302-588
atgtgtgattacgactctattgtcggcgccaaaacgatcaccccaagctctgatgatttgggctcaaatattgattatttttttgataacatcatatcgctaaatgtctggtcgcgacttatcggtgttattcgttttcgcataccggaatcatttcaacttcctatatgcagaattacaaaccgaaaccgtgttcttgttcggtttgtcttaaaaatatcaaatatttttttatgtttgtttattaccaaataatttcttatatttgttttaatatcaaataatttcttatattttttaagtcaatgccaattaaaaaagcgcgcttctggattttatcatcaaaacgttttatcagaggagtacaaaacgattgctgattacaagcaaaatacacagtggccatgtctggaaaccgatcaatatgaaaagtgtggtctatttgttaacttataattttaagcaggaaattatcaatggacatttttttgtggagtttgaaaaaaaaagttttttaattcattttttttttgtttggttaactgacaaccccagctatataggttagcatttaaacaggataataaa

SEQ ID NO: 53695 - DNA, 2906 bp, Heterodera glycines
  Genomic contig location: Contig_ID=SeqID_4231; Location=2524..5429; Strand=+
  SCN-specific regions: Sequence locations=1-52,74-76,100-223,245 -254,283-420,442-735,773-890,912-925,971-1385,1407-1450,1472 -1501,1549-1598,1628-1899,1922-2484,2510-2699,2728-2757,2780-2906
atgttccgttataacgtgcaaaattcaaagaattcaattggaaaaggtaataaatttattccaaaatcatcatttctattaaatttaattttaatttaaggtcatgccactaagaaaaacttaattttggtgccagacattgaaattggcgcgttcaaaacgatgctaagatttatttatacgaagagttttgatggattggatgccaataatttgttagaagttttaaaagctggtgaaaatttatgattgggattttaaataaattactatttaattatagctgacaaatataacatcagtggcctggtaaaagaatgtgccaacttttgtgccaaagtttcaattaaaaagttgccaaatgtatttgtggcttttgaacaggctttgttgctgaatatggaggtgaggaaagaattttaattattaaactcattattcatgtatctaaaattattcttcattactgacaaaaaatttacgggtgttcgttttttcaaaaattcaagacaattttcataaattttttgtccagttattttatttttatagagttgtacgcgaccgggacctgatactgaaagaacgtacaactgagtacctacgtcccggttttgaccgggaccgggaaaagtctcgggtttttccctgttttgccagccaaaaattcccggtttttcaacccgaaaagtactggtcccggttttctatggtacgatccccgacgagttaaagtaataattatataattttttataatatttttatttttgggatttttctctccgttgtttgcactacattgatcgaaatatcagtgctttgatcaaatcagaatcctttttgcaaattgatcaaaatttgttgtgtgaaattctcgaaagagatgagctgagaagcagtgaaatcgaaatttggaatgcggtaaattaaatattataaattacaattatttattttctaaaattaaggcactccgttggtccgacgaacagtgccgtcaaaaaggcatcgaatgttccgctgaaaatcgaggcaaaattcttgacccagttttgtccaacattcgttttccactcataccaaaagaggattttacaaaaagcgttggtaatgaataatattttgatgattagagagtttgctatcttgaaaatgcttgaacctggcttggattccttgttggacctggacctgtaatggttccaagtctggattaagggcttttcataattataccgtatttcctcgaataaacccccttcaaaatggggttatactcgagggtggggctttaatgttcaacccttttttacaaaattgcaatgtttttatgcaaatttttccaatagcaaatttttattagtctttgaaataggccaaaatttttgctacaatttaaatcttaacctgaaatttttaaattaaaaagatttttcattttttggcaccttggaaatttaggcgaatgcttgaaaattcataattcacttcgaaatggatcaattaaagtgcaaaaaagcattaaaaatagagaaaaatctggagaatttatactttttttaaggattttctagcttaaaatgaagaagttagctgataataaattttggaaaaattcgtttttcggaaaataattaaatcactgttatgaaaaggtatttttgaaagaaatatacgaaaaaaaatctgcaattttttccactataagattgcctttatttcttatcgaatcggaatcatatttttattttgcactaattataattctaataacctaattccatagacttaaaatttaaaagaccgtatgtcgtttttttaatattacaatgccccaggtcaaggccaaacttaattgatgactcattttatgaatgaattaattgtctaattaattatccatttcaatcaaatttcagttccaactggtgtgttaacaattgaagaagtgatcagcgtgtatcagcattattcccatccaaagtttgatgtccctgggcttatcaaattgaaatttcccacccatcaacgctacaaaaacggagaaaaaattgagatggaaattgaaaaagtgtccgaatttgcggtggaggaggtgggaagtgagcgattcagcgatgccatggatattgggggatttccatggaaaataatggcacaaattgaaacgaaatacaaaagcaatgagaaatggttgggcttttacctttccaacgatggccctaaaaaaggtagaaaaaaagtcattttcgtaaatctgtcagggaaaaacaaaaaaaatattatttcttactcattgttttaagcggaggaatacatttactaaattcttttttccagaggtttttaaatattatttaaatcattcgaactaaataaatgattatgtaaagaattttctacaaaaataaaaattcaaaaattaaaaatgcatgtgaaaaggactagtaaacttaataagtactgctttaaatataatgctaattttattaaatatttatttattgtgcagaaaattggtcttgtaaaagttcggcaacacttcgaattgtttcacaaaagaatggaacggaggatttaattggaacattcattgaccgcatttttaataaggaatgtagcagtcatggattttattatttcattagttttgcggtgagtgggattcaaataaatttaataaacttcctatcttgaaattaaaatttttaaaattttaaaaaagaaagtgacaaaaaaatgaatagaaatttttgaaattttttggttataacttgtaaatttttttctagattttaaaaaattaaataagataggatttgataggatatgtaatgcatcgtttaataccaatttttattaatttaactaaatttaagctaagttatggtttcttattagca

SEQ ID NO: 53696 - DNA, 203 bp, Heterodera glycines
  Genomic contig location: Contig_ID=SeqID_22992; Location=1234..1436; Strand=+
  SCN-specific regions: Sequence locations=1-203
atgaatccgccaacttttgctcctttccgtctcctccgacaacatttcgaccgattggctgtcattttgctcaattcgcccccggcagcggtcgttccctgcggcgattttgcatttccggccgattgggccaaaatttggaacagtgccaacattcgcttgtgcaccgatggggcggcaaatcatttgatgaaactgtgcag

SEQ ID NO: 53697 - DNA, 663 bp, Heterodera glycines
  Genomic contig location: Contig_ID=SeqID_22995; Location=207..869; Strand=+
  SCN-specific regions: Sequence locations=1-140,162-631,653-663
atgtgcatgtgtgctgtcgcagaatgcccgtgccgcccaaccccaacgtggtaactgagggcgcaagtgaaacaaatctgaaaatttttttgaaaattttttttcggatttttcgaacccccctgagccgctgccgaacacggacctgccgccgccgctgcaaaccgagcagccgattgagtccatcacttttcggcctccggtggacgagctcacttgcccggtcggttggagtgcgtacgaggaccaaagggttagccgcataatggaaaaacggaaatttttggaaaaattttttcacaaaattttcagggtgctcaccatttttgccaagatgcactggacatgacatgccctcatggttagaatacaatgttttttgtattattattgtatcactgcttatcaaatccctctgacatagttttttaatgataatcgaacatcatggattcaatggatcagcaatatgaggcataaatatactcttgtatatgcatattaaccaagggatataatgtatctggtatacaaaccataaatatacccgaaatcgattgtaaaggagtaatatacgccaaaacaagtaaatttgtatgtagccataaagatgtgtcataatataccccagataattaatacaatacaagaataatccatgga

SEQ ID NO: 53698 - DNA, 105 bp, Heterodera glycines
  Genomic contig location: Contig_ID=SeqID_22996; Location=48..152; Strand=+
  SCN-specific regions: Sequence locations=1-105
tgtccatttggggtactcgaacatttatggggagcaaaaatccaacgcagaattaaagtacaggctatagggaagctactcccgaaggattcggtctccccataa

SEQ ID NO: 53699 - DNA, 825 bp, Heterodera glycines
  misc_feature (7)..(7): n is a, c, g, or t
  misc_feature (52)..(52): n is a, c, g, or t
  Genomic contig location: Contig_ID=SeqID_23000; Location=1358..2182; Strand=-
  SCN-specific regions: Sequence locations=1-147,169-252,274-315,337 -432,454-825
atgaatntactaatcactgttgtacctcttttaatcacttttgtacgttttntaatcacttttgtaccgcttctaatcactgttgtaccacttttaatcacttttgtacctcttctaatcactgttgtacctcttttaatcacttttgtacgttttttaatcacttttgtaccgcttctaatcactgttgtaccacttttaatcacttttgtacctcttctaatcactgttgtacctcttttaatcacttttgtacgttttttaatcacttttgtaccgcttctaatcactgttgtacctcttttaatcacttttgtacgttttttaatcacttttgtaccgcttctaatcactgttgtacctcttttaatcacagttgtacctcttcagatcactcttctaatcactgttgcacctcttgtaatcacttttgtacgttttttaatcacttttgtaccgcttctaatcactgttgtaccacttttaatcacttttgtacctcttctaatcactgttgtacctcatctaattacttttgtacctcttttaatcaccattgtaccgcttctaatcactgttgtaccacttttaatcacttttgtacctcttctaatcactgttgtacctcttttaatcacttttgtacctcttctaataacttttgcacctcttctaatcactgctacacctcttctaatcactgctgtacctcttctaatcactcttctaatcgctgttgtacctcttctaatcactcttctaatcgctgttgtacctcttctaatcactgttacacctcttctatcacttttgtacctcttctaa

SEQ ID NO: 53700 - DNA, 2222 bp, Heterodera glycines; identical to SEQ ID NO: 23000
  misc_feature (2131)..(2131): n is a, c, g, or t
  misc_feature (2176)..(2176): n is a, c, g, or t
  Genomic contig location: Contig_ID=SeqID_23000; Location=1..2222; Strand=+
  SCN-specific regions: Sequence locations=1-500,530-922,944-1027,1049 -1090,1112-1729,1751-1846,1868-1909,1931-2014,2036-2180

SEQ ID NO: 53701 - DNA, 1073 bp, Heterodera glycines
  Genomic contig location: Contig_ID=SeqID_23001; Location=275..1347; Strand=+
  SCN-specific regions: Sequence locations=1-86,108-109,132-349,371-1073
atggaaaacccgtgccaaaagccatcaaaagtattggcagaaatccgtgcaaacaccaaggacgaaacctttgtttccatgggcactgacctcgcactggtggcagtaatgagaaggtttttctcttttgatacgtgtattcctctttcactcttatttcaaaatttttaggcagaaaaggaagatttacggcaacatggaccgtgtcaaccctttgagtgttgtcttacccgatgccctgcttattaaggatggcgaaagcacattgttgtatgacagccgagcgcatcgccaaggagaatcggatgtggtcttggtctttgcacacccgaagttaagttcattcatttcatgttcaatttttcgcttttgttttcagctgttggacgttttgaagcgggcgaagaaaatttcagttgatggaacattcaaagtgtcaccagccgcatggacgcagtgtttcgtgatcggcgcttttgtcaaccggcggctcgcattatgtgtgcatgctctgttgcctggaaagcaacgaaaatactacgaagaggcgctcaatgcggtcaaagcggtgatggcacccagcaccccagcacatagtaagtgatcatttctcctaactttatttcatcccaaaatgtaagtcatcagtgactttgaaaccgcaacgattcgggccatgcgagaaacgtttccagcggcccaattgacgggatgtctattccacatgagccaggcagttttcagaaaatggcgcgaaatgggcttggcggaattgtatgccaacgacgaaggagcaattgatcggagatgcattggacgaggcggagtacaacaccgacgaagacgtcatgaacatcctttcactgctgagtctgcagatgcaaggatatgtgggtggcctgcgtgcacgaggggctcaacacgaacatgaggaccgtgaatgattgatcgctttataccattggcaaaaacccttgtcttattccgcacaagtgattggattttaaacctcaatttccgtggttttcaacattttcatttgattcgaactattatttttgatgtttattata

SEQ ID NO: 53702 - DNA, 132 bp, Heterodera glycines
  Genomic contig location: Contig_ID=SeqID_23001; Location=2144..2275; Strand=+
  SCN-specific regions: Sequence locations=1-132
ggaagctattttacatgaattaagacaacaacaaaaaaattatgtctggtaaagtgcattagtacccgcttccttttggtttctaattcgccaacactcggaggaatgccaaagaaaagaccttctcttgcg

SEQ ID NO: 53703 - DNA, 331 bp, Heterodera glycines
  Genomic contig location: Contig_ID=SeqID_23001; Location=1524..1854; Strand=-
  SCN-specific regions: Sequence locations=1-331
atgtctggtaaagtcagggctcggatctgttctaaatttatcagaaatgttctgatttgaagggtgttgtgttacgcctcccctcgattcgtctactcaacgattcgtctattcaacgattcgtctactcgacgattcgtctacccagccaaaaagtgacgattcgtctactcagcaaaaactcaacgattcgtctattcaacgattcgtctactcgacgattcgtctacccagccaaaaagtgacgattcgtctactcagcaaaaaagcaacgattcgtctattcaacgattcgtctactcgacgattcgtctacccagccaaaaagtga

SEQ ID NO: 53704 - DNA, 1273 bp, Heterodera glycines
  Genomic contig location: Contig_ID=SeqID_4232; Location=264..1536; Strand=+
  SCN-specific regions: Sequence locations=1-337,359-421,443-664,686 -727,749-1273
atgaagacacgtctgttggtcggtaagcttggtgcgcaagaatacgcgcggttcacggagagcattctcccgcaaaaaccaacagacctatcatacaatgtcacagtaagcaagttaaagagtctattttgcggcatcaatcaatgaggaccgagccaagaacacggacatcaagtttgagcggctcgtcgaggaatgctgctccattttgtcgctcaggagtgccgccgctgcactcaaacatcctggtcacgggtggcaggccaattcaatttcagttaagccgcagcgtgagaaggagcgacaaggacgacagcgacagttcagcacatcctcgcaatcagggcatttcaatgaaggacggacgcgcagtcaatcagtaaatggccgccaatcatcaaagccgcgtccgccttttccatgcaaaacctgtggaggaaatcattggaacaacgagtgcagaaacaaacgtggaggaagtcagcgcaacaacgaatgtaacaacaaacgatcgcaaaagtgcttcaactgcaatcgagtcggacattttgcacgcgagtgccgaagcaaaaagcaggcaaacagcaatgactcgatgtccgtcatgaatgtgtccgacgacactgacggatggatcaccgtggattgcctcatcaatggcaggctggtttcattggtggcagacacagccgcccgaaaaaccatcatccaaacgcccatttgggagaaattgggaaaacccaaatttaaaacgggcaaaactttcggaaaatcatattcagggcataatttcgaattaattggttcatttgattgtacagttgagttcgcaggcattaaattggagttggaatgttttgtggcaccaacgggagcactcaatctttttggtcttccgtggattcgcgcatttgaattggcactgcaacgtccaatcgccacaacacttcaaattgtccaaccagaaccagcattcatggccatggcgtcgtccgcagacctggccagcaaactcaagcgaaaatttcccgaagttttcagctcagaacttggccattgtaccaaaatgcgtgcgcatttgtacttaaagccggaagcgaagccgattttctgccgccctcgtccggtaccgcatggcgccatcgatgccatcgacacggaattggatcgtttgttggcgattggggccattaaacaaattgattacagccgttgggcagctccgattgtggcgagtgaaaaagaagtcgggcgacgtccgagtctgcattga

SEQ ID NO: 53705 - DNA, 47 bp, Heterodera glycines
  Genomic contig location: Contig_ID=SeqID_4233; Location=122..168; Strand=-
  SCN-specific regions: Sequence locations=1-47
atgccaatgggccccgccaaaggacaattattgttcctccgattggg

SEQ ID NO: 53706 - DNA, 869 bp, Heterodera glycines
  misc_feature (840)..(840): n is a, c, g, or t
  Genomic contig location: Contig_ID=SeqID_4234; Location=96..964; Strand=-
  SCN-specific regions: Sequence locations=1-434,456-770,792-869
  Gene Ontology: Mol. function=enzyme activator activity; Cellular component=extracellular matrix; Biological process=proteolysis and peptidolysis
atgtgccccggcaatttgtcaccactttttgcgcttcttctgttggcattgtcgctaaatgccaatgttttgtctgcccatgaggacactttgctggacgaaatggagccggtgaaggaggacgacgcaggcgaatatctgacgaaattcggatacacaacgccctcccaactgaacgtgaagacggacggaatggcgggcgatctgtccaacgttttcgaaatggcagtcaaagcattccaagagattgcgcatttgcccgtcacgggcgtattggacatcaaaacacgcaagaaaatggcggagccgcgctgtggcatgccggacggagtggaaatgctgacagagggcggcggagcggcatttaaatggaagaagacggacttaacatgtgagtgatttggtgaggcgcgacagcaacagagatgagaccgcccctaattaattaattaattgaccaatttgcagacactttccacaacttttcgcccgatcttcccagaaatacagcgaggtaactattaaattggtgctgatcagatcagcccagaaacggcacctcattctctcatcccaagggaggcgatcagaaaggcctttggcatttggggggcagtgactccgctgaacttcagagaagtgcccacgtcgcaacaggcggacatcaacatcaaatttgctagcggaatgcatgacgacccctggcctttcgacaaaagaggtgccttggcatttttgcagttcgacgtcccctccccgtcccattcctcaggaggagtgctcgcccatgccacgatgccgcccagcggaatgttacactttgacgaggccgaaaattgngtgtacatggacgcggagaagatcagaac

SEQ ID NO: 53707 - DNA, 806 bp, Heterodera glycines
  Genomic contig location: Contig_ID=SeqID_4234; Location=1110..1915; Strand=+
  SCN-specific regions: Sequence locations=1-145,185-313,335-341,364 -666,689-734,757-806
atgattgatcggttgcgtggcatccgtccaaattcagcggagagagaggacaatcagtcaaacgaaactcattcattcaacccgcgcatcgaacgtaagtttaggtcgagaagagaagtgggggaattgtttttaatgtcgtaagaaaaaataaaataattgtaaacaattaataaattttattgaaatgggtgaattagatccaaagtccggcccacacattgctggccctacaaacaaagccaaacttcacaaggcccactcttaatttagacaattaacgcacttaatttattgggctccaggacaaggaccaatcagaataatggaaaaagattaacatattatattattattattattgggccatcatgtgcttattccaaacaaataggtgttcttgaaatttaatttcttttgcacccaaggataagtagaagggaagtttcagtctaaagcctgcatttccatcgaatggacattcttccaatgtaggaacatggcccataggtagggcgggtcagctctccgccagaagaagtccgcgcggttgactgttcggggggggggagggctttgggccccgcagtcaaccgcctgtggcactcgtcggactgcttcctccgccgctccgtcctccgtctcgtagtatttgagttataatgaaatttgaaaatcttaaacttttgtcttatacgtcaaactgcttaccattcgcttagaaaaaaatcctccttttcaaaaacttttttaaaaacaaatttgttcagtttagttagaaatgaagagagttatggctgatcaaa

SEQ ID NO: 53708 - DNA, 135 bp, Heterodera glycines
  Genomic contig location: Contig_ID=SeqID_4235; Location=4023..4157; Strand=+
  SCN-specific regions: Sequence locations=1-135
atgggaacgaatgttcatctgcggaggaaaccgactgctgggaaattggaggccggaaaaggcgttggaaatggccagagaaacggaggacggcgaagagaatcagtcgcagcagaaaacgaacagcggaagaaa

SEQ ID NO: 53709 - DNA, 76 bp, Heterodera glycines
  Genomic contig location: Contig_ID=SeqID_23002; Location=970..1045; Strand=+
  SCN-specific regions: Sequence locations=1-76
agttactggtgttagcatcatagcggtgcttttccttgtctttttgatgcccttgcaaaatctggtgcgcttctga

SEQ ID NO: 53710 - DNA, 2186 bp, Heterodera glycines
  Genomic contig location: Contig_ID=SeqID_23007; Location=626..2811; Strand=-
  SCN-specific regions: Sequence locations=1-751,779-876,905-943,1008 -1262,1291-1561,1592-1951,1981-2186
  Gene Ontology: Mol. function=transcription factor activity; Biological process=regulation of transcription, DNA-dependent
gacatatatgacgaggtgttggacaagttgcccgaagtgtcctcggatgaggacactccgcccgaccacaatttcatcaatgtcctttcgttggatggcggtggcatccgtgggctggtcatcattcaggttggtgtgaacacaatgccgttctgtttcgtcatggggggggggtgggtcaaccaaaatttttgcgaagggtctcggccatgtaaatcgacgaccttttttgcttttcaaaagcacttttttgcggcgcgcttttttcaagaaattttgcgaaaaggggggccggcggtttatagccaaatttaattcccctctttcccttctctacgaccccccccccccacctcttaagccggccccacctcgatgcgaaggggatccctcattttgggggctgctcccgatcagggattgaaaaatgtagggttgaacccgattttgacaaaggcgcaaatgtcgggacacgattgttagaacgattagggtgaaaaaaaagatttttttttgagtttttgggactctgccaccggtccttcttcatataattaaaaatgttctcacaaaaccacggcattcaaatcggtaatgctaattccgtcatattttcagcttctgatctgtgttgagcgcatcatgggcgagccgattttcccctactttgattgggttggcggcacttccaccggtgccatggtcactgccgggctcgcaatgggccaaacactgcaccaaattcagcgggttttattttatttattttttattatttccatttttatcgcattgacaattcaacatgtttttgcaataattcaaaatctaaatttatttatccaagcagagaattttgtctgtccatcttacatgaaaaaaaaaattttttttttttttttttggtgtttttaaacacttcttattattattttttacgctgaaaaatataaatttttggaattaaaaaaactcaaaaaaatttagattttttaatttttattttactgatttttgtgtgtttgcatttgcagctgtacttgcgcttcaaagacatggtgttcgacaaccgtaggccgcacaacacgcaggtgctggagaagttcattcgccaggagatgggggccgagacaatgttcagcgacctcaaatggccaaggttgcttcggtgttcccaaaatgtgtcagggacatagcatcgccgaaaaaaatctcggaaaaaaatccttggaatttttttttttgaaaaatatgtgtcgttgaaagcaaaaattttttgtaaaatttcttgaaaatatcttcttttttttttaaatttcggggacgttgccgaaaaatatttatatgggaagataaaatttgaaaatttaaattatttcctcatttaaaaaaaaaattccagacttatgttcaccaccacgcgggccgagttcttcccggttcagctggagctgatgcgcaactacaaactgccgacaaatgacgaggagaatgaggagctcggctaccggacgcccgacgatttgttgctgtggaaagtgttgaggcgttcatcggcgggtaaaaaaaaaaaaaatttttttaataaattcgcgaaaaattttcagcacctacctattttgccagtgtggacaacaaatacattgatggaggtgggtgaacagtggtgctttgattgttgttgttgtattaatcggtggacaattaaaatgcatttggtgacaagaaaaaagcggtttttcgaaatttaaatgatgaatttctgttttttgaatttttttggttgattttaatgaaattccatcccattataatatgtggtttttctttccataaccctcactcattttttgtcaggcattattgcgaacaacccgtcattggaactgctccaggaaatcaatttttggacagcttcacaagtacaaggtaaaacaccaataacaacagctaaataaatttttttaaaattttttttttcgttttttcagaattttcccaatgccgtgaacgttggatgctttctcagcattggcaccggtgtcattccgcccactccattgaaggtttttttttaaaaacaaagtgtcattaattcgaatgcaatttccagcccacttatatcgaagttgcgcaaaactggatcgcccaaccgctcacctcaataaacgccttttggaccatcg

SEQ ID NO: 53711 - DNA, 680 bp, Heterodera glycines
  Genomic contig location: Contig_ID=SeqID_23007; Location=720..1399; Strand=+
  SCN-specific regions: Sequence locations=1-112,142-501,532-680
  Gene Ontology: Mol. function=transcription factor activity; Biological process=regulation of transcription, DNA-dependent
atgacactttgtttttaaaaaaaaaccttcaatggagtgggcggaatgacaccggtgccaatgctgagaaagcatccaacgttcacggcattgggaaaattctgaaaaaacgaaaaaaaaaattttaaaaaaatttatttagctgttgttattggtgttttaccttgtacttgtgaagctgtccaaaaattgatttcctggagcagttccaatgacgggttgttcgcaataatgcctgacaaaaaatgagtgagggttatggaaagaaaaaccacatattataatgggatggaatttcattaaaatcaaccaaaaaaattcaaaaaacagaaattcatcatttaaatttcgaaaaaccgcttttttcttgtcaccaaatgcattttaattgtccaccgattaatacaacaacaacaatcaaagcaccactgttcacccacctccatcaatgtatttgttgtccacactggcaaaataggtaggtgctgaaaatttttcgcgaatttattaaaaaaattttttttttttttacccgccgatgaacgcctcaacactttccacagcaacaaatcgtcgggcgtccggtagccgagctcctcattctcctcgtcatttgtcggcagtttgtagttgcgcatcagctccagctgaaccgggaagaactcggcccgcgtggtggt

SEQ ID NO: 53712 - DNA, 174 bp, Heterodera glycines
  Genomic contig location: Contig_ID=SeqID_23008; Location=1614..1787; Strand=+
  SCN-specific regions: Sequence locations=1-174
atgcacaccggttcaaataatcggattggcattcggtcggggagtgccggtgagacattcatcccctttaaaaatgataatattttttcactaatttcagcatcttctgcatcagcgggtgctgtaagtgatgagcagttccgttcgtccttcgaggcggtgccaaatgttcgg

SEQ ID NO: 53713 - DNA, 788 bp, Heterodera glycines
  Genomic contig location: Contig_ID=SeqID_23011; Location=1456..2243; Strand=+
  SCN-specific regions: Sequence locations=1-178,250-264,286-286,332 -420,451-788
atgcagcttttcgtaagaaatctcgtcgggaaaacaattgtcgtcgagactgatcagcagttcggcactgtccgatcgatcaaagaacaaatcgagtaaattgaaggcatcccaacggatgatcagattttggtcagtaatatacaaatcacttcaaaaatttaagcagaaaaactcgaaataattctaattttttaaattattaagtaaaaaacatttacttatttgattttactattaatataattacgatttatttttcgatttttattcttccattttgtgcaattttatttaattttttaaataaaaaatgaaaaataataattttgattttggtttttttaaagtaaaaacacttacttatttgcttttactattaatataattacgatttcgattttttcttcaattttgaggaaatttatttaattttttgaatataaaaatgccaaaaaaagaataatttagatttttgctggacacattctgcacgatgaccagcagttggccagcaattgttcttcttcttctgctggcgatttgtcctctggcagttccattcatttgtctcttcggcttaatggcggcggttcgtacgatcgatgcgacccaaaattggtgcaattggccaaatgttttcgatgggataagctgatttgcaggtacacaaaatgggtattttaatattcaaaatggcttgtggcgcttggccagacaatagagtgccgacggaactttggccaattccgtcccaccaggggagagcatcatttaactatttttaa

SEQ ID NO: 53714 - DNA, 1318 bp, Heterodera glycines
  Genomic contig location: Contig_ID=SeqID_4236; Location=174..1491; Strand=-
  SCN-specific regions: Sequence locations=1-186,217-415,449-459,481 -593,617-625,647-674,696-787,817-1318
actaaaaacaataccaagggggcttcatacggattggcaatgtcattgagcgtaagcccagctggaagaacattcattgggcgtatgcccagtgggaagggaagtcattgggcgtatgcccagtgggaagggaaatcattgggtgttttagagttcttttgatatggtattttaatcacatgaatatttttcaatattttaaattacatttaaaatcgttgtgctcttcacattaaaaatatctgttgcaaaattcttgttgtattaaaaatcaaagccgttttcgtgctcggatggggaacgattaaaaaaaatgtcgtaaaagggaaaaattattgaatatcacaccgcacaaaggttgcgttttatgttttttaatttctcaagacagcaaatttttatagggaatgaaacatttccaatgtttcttatgcaaaataaaaaatgaaagacatgtttcttatgcaaaataaaaaatgaaggacatttagcagggcgtgtctctatcacatttgattgttttctttttttatggcttgtgtcgtcataagattacacctatgaatctggatataaaatagcgaccactcgctcaaattttattgttttgtaattccaaaaacccaatgaatagtttcatgttaaatgtttcaatagcttccattctgatttttaaaatataatcgtatttagatataatgaattctagccccaattatttatcaatccgtaaaagcaaaggatgtgtcttagaacacgagggactatatgaaagtatagatttttctttttttcaaaaataatttataaaattaaggagccgaaacgtttaaatcacataaaagttcatcttattttgaagttcaaattttaaacagcagagggttagtgagtatttcgatattatgaatttcttattttaagacctatatgtgtggggtatgcaccaaagggccttcgaaaggaccaaactgtgggatgggccgacaacacatatggagttgactcaacaggccaaatttttaacaatggaaaggaatccgaatatgtagcaccattttcaaagggagataaaataggagttttccacaacaaaagagagaattgcctttcatattttttgaacggtgatttgctaggtgcgtgttagataatttttttgtgattgtaatatttattttaaggccaaaataaacaattcatcgcggattcaaacagtgggctgtggcctgccgtaacactacggcacccaggcgatcgtgtggaattccgggtcgattctgaattgggtcaaatgccgggaggactttggaaatga

SEQ ID NO: 53715 - DNA, 2938 bp, Heterodera glycines
  Genomic contig location: Contig_ID=SeqID_4237; Location=438..3375; Strand=-
  SCN-specific regions: Sequence locations=1-215,242-389,411-862,886 -1336,1359-1392,1414-2426,2448-2542,2564-2797,2819-2938
atgtctcgtttctgccctctcgttgaaaccaaggaattgggacgcctttccgctccgaaggggaaatttagtgagtttgaaatcactttaaattcagcacaagatttgcaaatctttaacttttgtttaggcctattttactcccttgaattcgcacgaaattaccgattgattggaaaggagataacggaagacaagtttcgttatctcatgaaaacagagaaaaaacaaagagaaatggctgtcaaattgatggaaaaggccgggataagcggggaggaaaaaacttttggtctacaacacctcggtctcatccagaacttttgggacaaggaatacccggaaatgtttcgcatagtggcatttgacatggtaaaaaaattacgcactttgaaaaaacatttaattttccagagatcgggaatcaaacctattttcaagggagaaggaattcgtaaaaatgaagtatgtgtgataaaagatggagaccactgggacggaatgaaatcggttacgcaattcttctgtgttcgaaacttttgtgtcagctgtgaagtgacacgcgaaaggccggagagacatcgattggaatgtaaggaaagatgcaagaagtgctgtagaatggggttcgggtttccatgtgcggatgtgtgtgctgggatttattgcgcggaatgtaatcgcaacttctacaatacggaatgttttgagtctcacaagaagactgcttgtagggagtacaaaaaatgcgaaaagtgtggagagacacacaacacaaggaacaaacacacatgtggggagaaattctgccgaatttgtaaaatttatcatccaaagcggggctgtttcatccagaagttaaaaattcgttcaacgaggaaatacagaattgttgcatatgaccttgagacaacattgtataacggagtccatgcaccgaatctcgtttgcgcggcgttgacatgcagtgagtgcgttggagagaaaaggaaatgtgagatttgtgaggaaccgaggatgctgacttggtcggcagcaaatgtggaggatcctattggcggatttatcgattggattatgggcttcaaacaatttgaaacggttgcttttgctcattatgctggacggttcgactcacatttcgtccttcgtgtgctgacagaaagggggcttaacaccgaactgatgatggcggatctgaagatctatcagataaaggcaaagggtgtgtactttcgggatttctggttgctcagccaaaacaaattggcggatcttccaaagaccttagggctgagcatcccggcaaagttgtactttcctcataagtacaataaaaatgagaattttgggaagagattgtcacacctgccgccttttgatgattacaatccaaatgctatgaaggaggaggaatatgagaagtttgaaggatggtataacgagaattttgagaccgaatttgagctaggttagagaaagtgtgttttaaataaaattttgtatttttttaggagaacagcttaaggtttactgtgaaaacgatgtggaaatactgatggaggcaattctgaagttccggcaattgtttttggatattactgacgggatggatgtgttgaaggacagtgtcacaattgctggggtcgtgatgaggatattcaggacgaaattcttgaaggacaggcacattccgatcatgccggagggaggatatgaaagggctgataatcagagcaaaattgccgtgaagtattttgaatggttggcgcaccgggaaggcataagggtcagacatgcggaaaatggtggggagattaaattcggtgacctcaaagttgattgcgtcattggtggtcagaaaagaataattgagtttcaggttttcaaaaataaaagtcatccgttaatgtgagttctttaaggggtgtgcataccatgggtgcaaaaattgttttttgccctgggctgttggaccgaatggtttatgcatggaagagaattacagaaggacagagatgcggatggaagtattgagagaaatgtgtaaaaacttctcggtggaggaagtttgggtttgccaatttccaacagttattgattattgattgaacaaatttaggaatgtgaggtgaaagcggaattgaagaaaaataaggagatgaagaggttctttgaaagtgtgccggataagggaccgattaatccgagggatgcttacgcaggaggacgaacaatgcctttttgcttgtatgcaaaggctacggaagcagtttagatttcgatgtttgatattatcagtttgtacccctttgtgaattatggtaaaaatccgcttgcatttttaatattgccattcacttaagacactccttatcccgttggtgtcccaaaaattgtggtgagcaggaattttaatgtgaattggacggtgcccgacgatgtgccctatgatggactgctaaaggtgaaggtcatccccccgaaggaactgctgtaccccctcctccctgtgcacattgatgaaatgctcctcttcccaaattgtggtatttgtgcgagaaaggccaagaacgagtttgttacgacgaaggacgtgaaaaaatgtaaccatcgaccagagcagagggcatttttggggacgttcacttcgattgaactgcggaaggccttggagttaggatatagggttgttggcttctatcgggcatatcactttgagcaatttgacagtcaactgttcaaaggatatgtgcggatgtttttgaagataaaggtttaggcatccgggtggccagcagaagtgaaaagtgaggaggaaaagagagaattcatcgaaatgtataatgcaaagtacaacatttccttgaattatgacaagattgtctctaaccctggtcttcgaatgatagcaaaattggtgagaaaaacaaataaa

SEQ ID NO: 53716 - DNA, 2025 bp, Heterodera glycines
  Genomic contig location: Contig_ID=SeqID_23016; Location=533..2557; Strand=-
  SCN-specific regions: Sequence locations=1-18,55-228,304-374,408 -987,1009-1061,1085-1157,1179-1413,1435-1553,1611-2025
  Gene Ontology: Mol. function=acetylcholine receptor activity; Cellular component=nicotinic acetylcholine-gated receptor-channel complex; Biological process=synaptic transmission
tttttggggccaaatttgttttaattaatcattaatagaataataataaattttcagcgttcccttctgacgttgaagagcgtctgatcgccgatctgttccgtggctataatcatctgatccgtccggtgccaaatgtttcgtcgacgccgttggaaattcgcttttcgttggcactcactttgctaattaatgtggacgagaaaaaccaggcacaaattgagaatcaaataattaattaacattaattaaattaattttattattttttaattatttaaaaaatttaaataaaatatttttcagattatgcaaacgaacgtttggccaacaatgcgatggattgactaccaaatgcaatggtccaacattccattttaaaaatataattattttaaatttaatttccaacaggaatccgcttgaatacggaaacattcgcacaattcgcgtccctcccgacaaagtttggctgcccgacatcgttctgtgagtcatgagttaaataatggtttaaaattgagtgttaagcttcaacaatgctgatgggaactatgaagtttgtaagtgtcattttgctacttattgtccatttgatcagtatcagttcattttccctcactaatttctcttttcctctgatcagtcctctccctacctcattttccctaatgattttcttcattcctttgatcagtcccctccctccctctgatcactgatataattatttttccctcactgatcttcttcttatcattccccttcctccctctaattatttttccctcactgatttcctcttttatctgatcagtcccttttctgtctctgatctgatcaccgctctcatgctttccccccccccccccaattagccttttattccaatgtcgtggtggagcacaacggggaaatgttgtgggttccgccggccatatacaaatcctcgtgcatcatcgacgtcgagtttttcccgttcgatgaacaaatttgtgcaatgattttcggatcgtggactttcaacaaagacgaagtgaccaaaaccatcaattatttggcaaatgatcaaatggggacaaaattgaaggaaatttggatttaatcaggacggactacaaaacttaaaaattaataatgcgattaattatgtaaataatctgtttgattaactttctggctcattgcggtttggtcatttaggtgatcatcagctatttgaacaataagcgtcaagcggagctcaacgattactcggagagcggaatttgggacataatggaagtgccggggcaactgatccatcagaaaagcaaaattgcatatcaaatcaaaatcagacggtgggaaatgaatgatcagcgagagcaaaataataaaaatgaatttgaaaattcaaataaaaacacattttcccatttaaggaaaactctcttctataccgtaatcctgatcatccctaccgtactgatggctttcctttcgatgctcgttttttatttgccagccgaagctgacgaaaaaatcactttggtccggcatttgcatcaaacatttataaaatttaaattatgttttaaatcatttaaaaaattaattttaattaatttgctctcatttgctaattaggcaattagcattctgttggcccttgtcgttttcttctgttggtctccaaaattttgcctccgacttccgacacaattcctctgattgccaaataccttttgatgacttttggtaattggcttacaattagcttaattaatacgcctttgactcacatcagtgatgaacatcatcaccattttggtcacggtcatcatcattaacatttatttccgtggccccaccactcacacaatgcccgaatgggtgagtaatgtgtgccattgccatcttttgccgaatcaaactcatttttcattcgaatttttaaatttactgtgccaggttcgtaccgtattcctgcgctatttgcccatttttctgatgatgaatcggccgcggaatgatccgtccgaa

SEQ ID NO: 53717 - DNA, 281 bp, Heterodera glycines
  Genomic contig location: Contig_ID=SeqID_23017; Location=154..434; Strand=-
  SCN-specific regions: Sequence locations=1-84
atgagggacgaaggcatgcaatgggtggggcaaatggaaacaattaggtaattattcattaattatccatttttggcatttaactaaaatatttgaatattaaaaaataaaagttaaaacttttaaattacaataattgaataaaataataaaaaaagtgaataacaaattctttctatcaaaatatcattataattttataaaataatattttacataaatattaatattaaaagtataaaatttaatccttttagattatattaattgtataaaataaa

SEQ ID NO: 53718 - DNA, 157 bp, Heterodera glycines
  Genomic contig location: Contig_ID=SeqID_23018; Location=979..1135; Strand=+
  SCN-specific regions: Sequence locations=1-157
atgcaccaacaacaaccgtcgtcatcctcggcagctcacaatggaccacaggtgccgggagcggaagaacaaagaacggcatcattaactgtgccgacacggccaacggatggtcaacaacaacaccaacagcagaatgctgtcgaaataattaatg

SEQ ID NO: 53719 - DNA, 750 bp, Heterodera glycines
  Genomic contig location: Contig_ID=SeqID_23021; Location=93..842; Strand=+
  SCN-specific regions: Sequence locations=1-540,577-750
atggcaaaagtcgcaaaccaaaaacgaaatgagcgccgaattcgtgccgtccaagacttggcgcggcacctcaaccaccgaatgaaccgccatcgccgtgggcagcgcgacggaaaacgggacccgtcagaggaacggcacatccgaatgaccaccgaacgttatgcggatcagctctctcgcctgggagatgaccacattcaccgactgcagcaccaattcccgcaactccccaacccccgccggcgtcgatcagaggtggggggcaatctgaaagggggaaagtcccagccaaaattggcatcaatggtggtacgcccgccccagggagagttgctcccttcaaaggatgtcggcggcgcagcaccgggcgcatcgaactcccatggccgaaacgagaacgaagaggaaggccgagaaggaaagaggcagccgcccgagggtgctccctccgccgggggacagttttggagaattgctgaagaaagaggcgaaagctcgggccgaagtggccgagctcgaagcccgggcaaagaaggcgaaaatggagagggaggaggaggaacagaaactgaaatcggcgaaggaagcgcgccttcgggacttggaaacccaagccgacgacttgcgccaaatgttgggcaatgcgagctggccgtggtcgaggggcaaagacgggaaaaatggggaggcggtggctccccgcgctgggaaagcggtagccatgccagcagtgccgatggaggatga

SEQ ID NO: 53720 - DNA, 547 bp, Heterodera glycines
  Genomic contig location: Contig_ID=SeqID_23023; Location=825..1371; Strand=-
  SCN-specific regions: Sequence locations=1-4,31-121,156-497
atgatgccactgctgctgctgttgctgcggacggtgctgacactgcttggtgccctggccctcgtgttgcaaccattgtgggctcgtcaaactttggtaaaaaactaaaacaaaaaactatgccaaacatattttttgaaattttgtgacattttcttaacaaatttctactatataaaatttacccaaattttcccatttttttttaatttgactcaaaatcaaaaaaatttcattttttttaaaacctaaaatttgcagttttttttaatttccgagaagaatgtgtatagcatgcctctcccctttggtgatagtttttttcccttttttatattgcattttccccaaggttttcggtccgcccaccgcgacttggaggcccaacttttgctggtgacggacaacgacgcgttgagggagcaaattgctgaggtagcaaaaatcagtacaaaagcacagaaataggtgcacttgggaccaaggagcagtttttcataaattttttcaaatttatttttagaattttgagaaaaaaaataataaa

SEQ ID NO: 53721 - DNA, 156 bp, Heterodera glycines
  Genomic contig location: Contig_ID=SeqID_23023; Location=292..447; Strand=-
  SCN-specific regions: Sequence locations=1-156
ggccaatctgttccgattttcattcccccaaactgctcaatgcgttgtgtaataatggcgatctaaagattagcctgccttagtttacacttaattagcttattcattctcatctcattgtgccatttttgtattgcaataaaaattcatgtaatt

SEQ ID NO: 53722 - DNA, 244 bp, Heterodera glycines
  Genomic contig location: Contig_ID=SeqID_23023; Location=1578..1821; Strand=-
  SCN-specific regions: Sequence locations=1-72,100-244
atgtacgaacactacgcgttggacttcgtccgtcgcgctgtgcaggcgaaccaaacaggtgatttactacaaacagaagcagcagcagaaggccacatggtctttcaaccaaccatttaaatagatggatttctataaaattgtgaatttgaaaattcaattttaaaaaatttcttttttgtttctgtttgaatattcatattttccagttcacgttactcgagaacaatgtcgaaatgtgtga

SEQ ID NO: 53723 - DNA, 358 bp, Heterodera glycines
  Genomic contig location: Contig_ID=SeqID_23023; Location=2060..2417; Strand=-
  SCN-specific regions: Sequence locations=1-358
atgggcctgttcaacgtgaaccaggaagttgagttgttcagcaaattgttcagcagctgcaccacaaccagcagcgtaagtacaaaaaaaaatggaaaaattctaaattttgggtaaaatttccgaggagcgaaattttaatttttcccaattttttctaaattttcttttttatttccagcaaaatggcgacgacgacctccgccggctggagttcacgctgatctccgcctacttcaacctgttcgacccgtacgccgacctcattctgcacaagtgccgcgacccgttcaaaattgtgttcgcgtcgccacaggtgttttttgattgcaattttcaattggcccaatcaaattga

SEQ ID NO: 53724 - DNA, 7071 bp, Heterodera glycines
  misc_feature (863)..(863): n is a, c, g, or t
  misc_feature (4246)..(4246): n is a, c, g, or t
  misc_feature (4265)..(4265): n is a, c, g, or t
  Genomic contig location: Contig_ID=SeqID_4239; Location=338..7408; Strand=+
  SCN-specific regions: Sequence locations=1-169,191-335,358-413,437 -440,462-638,660-1234,1256-1388,1412-1494,1516-1797,1820-1974,1996 -2094,2130-2323,2345-2389,2421-2541,2612-2858,2880-2920,2943 -3120,3151-3296,3318-3880,...
  SCN-specific regions: Sequence locations=...3902-4225,4275-4692,4714 -4976,5000-5044,5066-5116,5138-5388,5419-5558,5581-5878,5907 -6130,6157-6282,6304-6343,6366-6727,6907-7071
  Gene Ontology: Mol. function=glutamate-cysteine ligase activity; Cellular component=intracellular; Biological process=glutathione biosynthesis
atgggccttttgacgttgggcactccgctgagttggcccagaatagttgagcatctccagtacatcaaggtgagcgaacagagaacggccgagttgacagaatgtgttccccatggattgtaatttgttcccgaacctttctgggccatatttccagaattgttaataatttttgtttggtttttggggttgaaatcatgaatgattttggggttattcccacacattcttggcaaaattttcgtgtttattgcatcgttctgacgctttttaggttgtccatttttcggcgttatccccggtaattttggcttttttagttgtttccccgacaatttggggccattttcggggttagactctcaactcttaatgacaccactcttcatggaatattgaattcgctcttaatgaaattttatttttttaaaattttccaggcccacggcatcgaccagttcattgcgttgtatcatcgtgtcaagggacgcgagcgggaccagttgcgatggggtgatgagattgagtacacaatcgtaaaatttgatgacgaacacaaaaaggttggagggaggggggggggggggtacgattttcgaaaaaatggcatcccccaccaattacacaggtctagggatacaaatttttggtggttttttctgtggcttcgtttttatgttcttttacaattagtccttaccctaatccattttcaaaaaacaaaaatgatgtatggaattggaaaaatttttttttttttgcttgcataaataaacgatcaaattgtgtcttccaaatagcaatagtttggcgcatttgttaactttattcaacgcgacatttgcaaaaaaaaaacacaaatntttgccattaaacaaaaaaatctataaaaatttatgaatttttttttggggggggaccttctccccccttcccccctcatttaaaatgattgcttttcattttcctattctaaaatttaacaattgtggttgatgaactgaactccttgccaaggtccgtgtctcgttgcgtgccaaggacttgctggacgcgctgatggccagtgaggacgtgaaccggtcgttgggcgaggagaaccgcagtctgtggcgcccggaatttgccgcttacatggtggagggcacgcccggcacaccgtacggcggtgagtcatcagagtcggtggtggcgggtgtgaggccattacccaaaaatcgggtgtttttccccttccgaggtccctttccccaaagttttcaaaaaaaaaaaactttttaatttttggtgcgaaaacgaactgttcccatccgaaaacatctctctctctccatattgttgtcggtctcaattttatctttattttcaaatttgggacatttgtagattttgtttcaatattttgaaggggatggataccctttccgagggttgctgaattcagattcaggatttcgaggggtttttgagcctccgggtccgagagcagcttgtccccgaattttttaaaattttgaacatcgtttggttgcaaatacttactaattcatcatgaaatattgagataaatcgctagagagatttttctggtttttttttcttgaaattttcataaaaaaatgattatgaaaaattcctatttcgaaaattttcaaaaaatttctggacctaacaagggaaacttgtgtgatgtgtagtaccccgcttattattaggcatttccccatagaaatttggcatatttttttaaattgtcgttccatggcaaattacacgttgtccctccccattttgtcgtcctgtcccatgcccttctttcatcatcattctgtctgtgtcaggtctgatgtcctgcttcaacattgtggagtacaacatgcgcttgcgctacgacgacgtgtccgcactgttgcggcccaacgagtcgctgctgtccatcagtttcccggcacttggcgcgcccgacttcaccgacccgccggcggtgccgcgcccgactcatccggacagtgtgggccattcagtgttctacccggacgaggccatctacagcgggtcattattactgcttggcggggcggtggaggggacttattattagaaatttgaatatttttctgattaattttgcccaataaaatttgaaaaaacggaggcataaaaatttgaataaatttcgattattctgctaatttagttcatcaattgcagaaatttttggcatgacggatacatttttatataaattttacatttcgaatttggatatttttgagtaaattttcaccggttccaaaaagtatcataaacttacattcagttgtaaataatttcttaaaattttcgaaaattatatttgtttttccatgttcggaaaagcttttaattaatgcttattttaaaaaatttcaaataattttggaattttcaggcacccccgttttcgcaaccttgtcaggaacatccggggccgacgtggcgaaaaagtggccataaatgtgccgatttttcgcgaccagaacacgccatcgccatttaccgtatataatattttgaaaatttgaattaaaacatttaattttaaggcaaaaaaataataatcaaaatttatcgaaaaattgcatttttaaggagacctttgaaaacgccgaagcttcacgggctgcacttcccgaccacatttacatggaccacatgggcttcggaatgggtaaatccttttttcaacttaataatggtggagcaggaccaaatatttttcatggaaatttagcagattgtttcagaacacctagttttcaaaaaggctatttgttggcgacgtttcgccgttttactgaaatttcgtaaagcattttctgattttccggggttttattaaattgacacattgaaaaaacgcgttttttaaatttagtaaatttccgaatttttccaggcctttgctgtctgcagatgacctttcaggcggtcaatgtgatggaggcgcgttggctgtacgaccaattgaccccgattacggtagagtactgttttgtagtggatacaagtgtaaacctgcttatttatactggttattgtattacattttaagcccatcatggtggcgctgagcgcgggtaaaatttttttttattattattaaattttgttacaaaaaaagtccatttccatttttaaaaaaagtttgatttgcattttggacgtgcgaaattcccaggattttgtctcggaggagatatcgccccaaggcgaaattcaaattttcgaaaaataaaactcctttcccttttgccaaaaaatgttatttttaatgtctaaattttttccggtttagttgataaatgataatttactaacaattataaatatgcttatttttctgtccgtttgttcagcaacgcccattttccgctcctatttgtccgatgtggactcgcgttggcccatcatttcagcggttcatttcgaaaaaattccaaaaaaaaaaaatttttttgccagagtgtcgacgaccgtacgccgtttgagcgcggtttggtgtccagcgccagcgatgggtacagcaaattccacgccatcccgaagagtcgctatgacagcaccgactgttacatttacccatgctcggcccagtacaacgacatccaactgcagtatgacgagcagttgtaccagcagctgatcgccggtgggtcccagaaaagcgaagtgatcagggagatcactcactggatcagcgagcattattgtgattgggaatttgctctgatcaaacaaactgatcagagtggacaaatgggaatgaccactggggtcctaacaatttttttaattattcaacgaatttaccattgtatttcatatagttttctgcgaaaattttaattttcctcattctattaagacgtttgtttgaaattttaacaaatttactttgtcgagaaaaatttcaaaaaatttggtcggatagcgttaatttctttttttgccatcatcaatttgacccattttatgggattagaaatttatttcatgatctaattaaatgctttttcaggcagtgttgacgaacacctggcacggttggcttcatttttttgatagggcacgggaaactcgagccgctcctaaccggggacaggacaaaacgtcgccgcgaatttttttaattttagaaaaaaatcacgaaaaactgtctaaaattttagtacttacaattagcataataaaaaaatttaaaaanaattcaaaaaaaatatatntaaaaaattcaaggaaataaaaaaattttgcggcgacgtaatgtcccggcaacgttttggggttcactatgctaaccgccacattttttgaatttgatttttcttttttggcgcattgccaccacttttgtctctctcttacattcattttgccccactgttctgttcagtcacattgcgcacatgttcatccgcgacccgttgcaggtgttcgaggaacgcattgagcaggacgaccaaaagtccacggaacacttcgagaccatccagtcctccaactggatgaacatgcgcttcaaaccgccccctccggacgacccaaacattggctggcgcgtcgaattccgacccaccgaagtacgcgttggtgttgttgcaattttcccggcggcgtctatcggcaccgccggaccacccgtcaccccttccccaaaagttttttggaaaacacgccgcaaaaaaaagtgtggctgaatagcaaaaaaaagtcggagaaagaaaagtttggaccttcgtatgaaaaatcggtcccgagacaccccctctggcccaatcgtccgtcgtacagcccttggtctgagacaccccttgtatatgtatgtctgagattatcagtaacagcaattaatctagaaaacatttgttaaatgtgaaatactatggatttgaaaattccgggaacattttttagggacaaaaaaattttcggcttcttcccctctctcccccttcccgtttttttttgtggggcataggcttgggctttttttttggttcttaatataaaaattgcttttaagctgcatttacaattagtaataaaaaaaattgccaaataaatgtgccgtttagaaaaattttccgcaatttttcttccccgaatttccctcccccccccccaatttcacaggttcaactgacgcattttgagaacgcggcctactgctgcttcctcgtgctgctcacccgcgtgatcgtctcatatcgacgtaattattgctcatttttatcattaccactaatgaatcccaaaatcttcgtttatggtcaaaaacccgggtacaaaatggtggactgaaatttaaaaatttccaaattttttttgagggttttcttctgtttcatttaaattttttcaaatatttaaattttagagtcatttataattgtttataattaagctgttcgttcattaaagcgtatgttttatggcattttcaccaaaaaaaaagccaaaattttcgcaaaaacagtgacaaatgccaaaaaaaatcaatgttcctttcccctctccgcttttcagtcacttttctcatcccaatttcgttggtcaccgagaacatgcagcgcgctgtgcgccgtgatgcgatcagcacgcaaaagttgcacttccgcaaaacgctggcccattgttggcacacgccggagggcaaaccgtgccccgaggggcgcccgccggccgagccggagcccgagccgtacgataacaacgtggccgagatgagcattgacgagattgtgaacggtggggtgggcagttgagttcgggaaatcacgccgcataaattttttttgggaatttggcaatttttctttacctcgcccaattcgacaaaaaaaaaatttttttttgaaatttttccagggctttttcgttttttttttgaaatttggcaaattttgttttgaataacacgcctgggtcttcaaaatttccatattttcttttttgcacagggaacaccgattttcccggcctcgtgccgctgatgcttcagtttctgaactcggccgacgtcgacgtggacactcggtgagtgaatcatctgatgcactacagttccacctgcatcgtttttgaaaaattgaaaaattttttgggggtttttctgtaaaaaataaaaaaagaataactgattttttaaaattctctttcaaaagttgtaaaaaatgaaagatttttaaaaaaaatcttttactaggtaaaactaaaaaattagctttgaattttttttcaattgttggctttttgttgttaactaactcatttttagttgcactgtcagccagtacctgtcatttatccaggtatatatatttgtttacaacattgaaatttatttgaaatttttcatttttttcagaagcgcgctcggggagaaatttggacgaccgccaaatggatgcgtgaatgtaaaatacatcaattaacaaacatgcaattagctaatatattcaattacaaatacttgttttcagttgtccaccagcatccgacgtacaaaaaggactcgcacgtgccggacgagtgcatttacgacatgatgaagacggtgagtgaatgagccgattgtgcaggttgcactgggttatttctcgataactttctctgtattttccctttacctctccctccttccctcactcactccatttctcaacctttttttccctcatccctcctctctctctatctctctctctctttacaattttccttctctctctctctctttacaattttccttctctcactctctctctctttactatcttccttctctctttctctctctctctcttacaattttccttctctcactctctctcttattttttctctctattcctctctccctctgacttatcatgtacctactaacaacacattcagatggacaagatttcgcgcggggagcactgcgagaagttgttaggctgtttcaagacgaagacggaacagcgtatcccatccgctgtgaagcgtgccgaggaggagatgaccatgctgatcgcacggcggaaa

SEQ ID NO: 53725 - DNA, 575 bp, Heterodera glycines
  Genomic contig location: Contig_ID=SeqID_4240; Location=373..947; Strand=+
  SCN-specific regions: Sequence locations=1-80,102-168,190-435,457 -536,559-575
atggcagatgcatccccgccgtcctgccccaataaggtgggttttgaagaattgcaggatcgttagatttggtcgacacagaaaaaagttgtagtccaaaacttgggctggcaccgaaccgtcctgttccgtgaacggaccaggccgttttcgcgccagcgcagtttttgaactataacttttttcattgtcaaccaaatccaactttcttgctatcattcgatagccctatatttcctctattagcttgcaaaattgcgaaaaatttggttaagcttcaaaaaagttatgggcagaaaacttcaaaaaactggttttcgaaacatttttggccggaacttttttgaaccttaatgaaaattttcacaattttgcaggcaaatataggatatttagggctatcgaatgataccaagaaagttggatttggttgacaatgaaaaaagttatagttcaaaaactgcgctggatcgaaaacgaccccgacccttccgtgaaaattcactattttggcgttctgtcactattttttttcattattttggcattttttggaatttctctataaaaatgca

SEQ ID NO: 53726 - DNA, 333 bp, Heterodera glycines
  Genomic contig location: Contig_ID=SeqID_23024; Location=88..420; Strand=+
  SCN-specific regions: Sequence locations=1-333
  Gene Ontology: Mol. function=structural constituent of cuticle; Cellular component=extracellular; Biological process=cuticle biosynthesis (sensu Nematoda)
atgggtgattttgttcttttagcccaccctatccaaggaccaccggtttgttttgcgatttcgccattgaattgtccgctttatccgattcgaactgccacctcccctattcagggcgcatacggaatccccggagagcctggcgagagcggcactccgggaacgcccggattgcccggcgagcaaggcctgcagggataccctggcgacgacggtttcccaggcattgcaggcaaaccgggatctcccggggagcttgggccgcctggcgaccagggcaagcagggcgggtgcgatcactgctcaccgccacggacagcgccgggctattga

SEQ ID NO: 53727 - DNA, 1263 bp, Heterodera glycines
  Genomic contig location: Contig_ID=SeqID_23025; Location=760..2022; Strand=+
  SCN-specific regions: Sequence locations=1-12,35-96,118-130,197 -303,325-377,399-418,459-589,633-720,765-786,854-981,1018-1028,1065 -1263
  Gene Ontology: Mol. function=zinc ion binding; Biological process=one- carbon compound metabolism
atgaatcgccaaatgtttttattcttatttttgttgactattgtccaatcgaattttgaatttgttcgtgaaagtgaaggctggagcgcctcggacaacaacataaattcaatttttccacaaaatatcgtaaatttatttgtttaattaattcatttatttaaaaaaaaaacaaatattaattttctttaaaaatgtgaaattacaggcgaatgaatttggcaccacaaaaaatcgtcgagcggctgaaatgaattttggcaaagatgccgaaaaacagcataaacaccacaatcatcatggtaaaagttatccaaaaattttaaattgagattaattaaaaatttcaagaggcttggggctatgatgaccatgacgggcctcataagtggggaaaacaggttggaaattctaattgaaaattttaatttcttttttaaaatttaatttttttttaacacagtgtcaacacggcacgcgccaatcgcccatcgacattcgaacatcaaatgttgtgaaataaattaattattgcttttttttgggacttttgagcaaaaatcctccccccccccctcctccctttccgaatataaaaaaatgatgaaatttaatcaaaattaaaaaaaaatctcatcaatttaattttgacatttaaagaaagctcgaaatttctactatttaaatgattaattcgttcttagcaaatttcctgttagcaattttacttttttaagaaaatttaaaaattctgcagcaaaaacgaattttatgcttttctcatacataaaaataataaataaataataaatctaattatttatacattttaattattttaaaataaattaatgaaaaacacctaaaaataataattgtagttggaatttgccaccatcaatgagctccaatttgtgaattatgacgtgtctggcgctgttgaaatcaaaaacaatgggcacacaggtaaaaaaaaaagtcaaaaatttattaaaatttaaattattgaaatttaatggcacattgggataaaaaagatatttaaaaataaaatttaatttattgcaaatttaagttgttgtaagcggcttcgaaaagtggcaaaaccggcaacggccttacatttacgggggcggtctgaacggcaaatatttgttggcccaattccatttccattgggccgcggaccatgacgacggcagtgagcacaccgtgaacgcattacactatccaattgaagtgagaaatttggaattattttaa

SEQ ID NO: 53728 - DNA, 772 bp, Heterodera glycines
  Genomic contig location: Contig_ID=SeqID_23026; Location=481..1252; Strand=-
  SCN-specific regions: Sequence locations=1-146,168-187,209-235,257 -413,550-668,730-772
atgaaaatccgaaagtgagtgtttaaaaaattgcaaaatgatgaaaattagtggttcaagcattctccacctccgcttgtagaaatttgtttaaaaaaagtcaatcgaatttttaattttaaaaatcattaagttccacttgcgccggaaaaaattggttgtttggacctgctggacatgggtattctgggaaaatccaagaaaatccagcaggtctaggaaaaaccaaggttagtaaataaaataaaataaattagacctggttccatgaaactaaatcattattgtcaaggtcgaaatctaatttatatttaatagtgatgtataaaattttgatcagtaatttacagtttttccattttcgataattctctttcgatttgtccctaattttttcgctatttttgagttaattttattccattcttttgttgaatattttcttcctttttgcttaattttctcttttattttataatatttaccaattatttctctttttttgagttcatttcgtttttcttcttctttctcttcccatttttctccaaatatttcgtcaaatgatttctgttgtaatttttatttgttgaatcaatttggtcaattttaatgacccaaaatattataattggaattaataataggcagagtttcattttcttcacaatttttcaaaaaaatttataatatatttcttataaaaatgttattttattaattatatttgcatttttaaaatgtgcctttctactgatttcttgtaaataaa

SEQ ID NO: 53729 - DNA, 858 bp, Heterodera glycines
  Genomic contig location: Contig_ID=SeqID_23027; Location=836..1693; Strand=-
  SCN-specific regions: Sequence locations=1-858
atgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccgcacattgacacgtgcgacgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaatagatgcccaaggccgagccaaagtgctgaatattgtagctactaatatgctcaagttacaataa

SEQ ID NO: 53730 - DNA, 431 bp, Heterodera glycines
  Genomic contig location: Contig_ID=SeqID_23028; Location=233..663; Strand=-
  SCN-specific regions: Sequence locations=1-83,123-213,253-431
atggcatttgatgaagaaaaacccgtggatttgcttgttcatccaattcttcccacaattttgcgcatgttaaaaggcattggaattttttaatgaaatttgtaaaaattatataaaaaattccactgattcctcttagaaaaacagaatacctgccacaaaattggacgtaacatgaaaatgcctcgtgaaataatcaaaatacggtagtgcataaaatatattttccataaattttatttaaataaaattcacattttagctccaaatctgccgaacacataaccatgttgggtgttcttgaagattaatgataattcctttatcctcatttgaaatctcatattgatatattttttaatccatatattgaatttatttgttttattttgaactttattgaaattgtttttgttttaagaaataataaa

SEQ ID NO: 53731 - DNA, 484 bp, Heterodera glycines
  Genomic contig location: Contig_ID=SeqID_23029; Location=1774..2257; Strand=+
  SCN-specific regions: Sequence locations=1-165,188-484
atggcaatcgtgtatactgaattcactcgggaaggtatagatacgtggttgttttatgctaaattttgaaattcaagaaattgacgaagctattgaggaagcagttttgaaagtgaaaggaggaactgagagagatggcatgcgcgccgccttggaaacgattgtgagcagccctcatctgctgttgaacgatgtggcagcgcgtcacaacatcgactacagaaaagtttctaagtacagaaacagatttaatgtaagtgcttccatgaaataacttcgatataatgtttgggatttagaagattttgtcggaaatgcgggaacagcaacagaggggttcaggagatagccggcatggagtaaacaaataattaatctattggaacaagattaattataggatgatgcgcaacccgcgcgcgagactgaacaccattatggtgattatgagagcgagattctcggatacttcaaaaggcgtcag

SEQ ID NO: 53732 - DNA, 1113 bp, Heterodera glycines
  misc_feature (37)..(37): n is a, c, g, or t
  misc_feature (984)..(984): n is a, c, g, or t
  misc_feature (999)..(999): n is a, c, g, or t
  misc_feature (1011)..(1011): n is a, c, g, or t
  Genomic contig location: Contig_ID=SeqID_23030; Location=1..1113; Strand=-
  SCN-specific regions: Sequence locations=1-665,688-838,860-1092
ttcataaaaatttaatttggccaatttccaatgttgnccacttaagcaaattctgcgcagtcgtctcatttgggtggtgtggctaaatgcatttgccgacctcttctcgggcgtctttctgctcatgtacattcccagctacctgaactacggtaaaaactgacgggtgttactgtacggacaaaaatagccaatgctaaacagacacaaaatcgaacaaatccttcttggttcgaatattggtttatctaccgtagtcccttcgcacaccgtctctcacttctcagttgctattttccatacttattaccgtatccctaattttggttttagtgttgcactacggtatcgaaaagacgggctttctgggcgcattgccttccctttcgcacattccgctcaaatttctgtttggctactgtagcgaccaattcaagtgcgtaatacgtacagtatggcgatgaataaccattattgattgccaactgtatcccctcccgcgccgccccaatttgtgccgcttttcgcaggtgccttcccgagcgtaccaagctgattctgttcaacaccatcgccgtcggagtgccggccattgcctatttggccattggcttcgttcccgtggaccggccgatgtggacagtgctgattttcaccgccattctgatgctgctgtccaccgccgggggcggcttttataaatgcggcactctttgctcgaggcaaaaaaaatgattgaaaaatgaatgtgaattttattcaaatgccatcgccgtcatgttcaggcagtactcgcactttgtggtggccaacatccaattcgtgaagagtttgacgcttttcgtgggccccgccctgctttggctgttcgttgaggatgaaactgatcgagatcagtggcgaaaggtgttcattctgttggccgtaatgctgatcgtggtgagagtttctttgactgcctgcactcatttgttgagagaaggncttacgagagtcttnccccccttcccnctccccttcctcgtccatttttgtcaatagaactttcaatattttgcaaaattttggcataatcattgttagatgaaatttaaaaaatatttgacagttaat

SEQ ID NO: 53733 - DNA, 1304 bp, Heterodera glycines
  Genomic contig location: Contig_ID=SeqID_23031; Location=1..1304; Strand=-
  SCN-specific regions: Sequence locations=1-180,205-1304
gaaaagatttggttgcatgcctttgtcagatatttcattttgcttctgagttggctctgtctgacctcaatttcgtccaacatgttggcactgaatttcacattgatttgcatgggttcggtgccgaccaatggcaccgatctaagcggtgccgaagtgggcgaaataatcaaaaaatgcatttttatttttaaaaataaattaccattttcagcaacactccgtcgcttacactccgcagcagaaaaaccaattgatgtaagcagcagaagaatgatttcacacttatgagcatgccttggcacttttcaggtgggccgttgcggttggctcaatgctcggcactttccccttctcctggctgtacacccgtttcggcgcccgtttcgtgctgttcggtgccggattggcatctgccattgccactgcgctgattccaattgcgacatcgttcagtttcaacctgtttttggcacttcgctttgtgcaggcaaaaaaaaacatagaataaatttggaaaccgaatggaaagccatcccatttgggcggctaaaatttctcgaaattaaatcgaatatgtccgactcacagtattaaggatacgataccgatcaaatttccccctcccccaattattgtctgaatttctccgcaattcttcaatcactcttttcccacttttccagggcatttcctatgcagctgactttgccgccatgggcatgatttgttcccggtgggccagcctgaagcagaacgcgctgttcatttccgtgctgacctgctactcgcccctgtccaccaccatcaccaaccccatctccggcatggttggcacactcttcaaaagcgctttttaatcagcttacctaccggactttggcatttcccctaccggactttggcatttcccctaccgtattttggcatttcccctaccgtactttggcatttaccctaccgtattctggcattttccctaccgtactttggcatttcccctaccgtattttggcatttccactctaatcccctaccgtactttggcatttcccctctaatcccctaccatactttggcatttcccctaccggactttggcatttcccctaccgttctttggcatttcccctatcgtactttggcatttcccctaccgtactttggcatttcctctatcgtactttggcatttcccctaccgtattttggcatttcccctaccgtactttggcatttaccctaccgtattctggcattttccctaccatactttggcatttcccctctaatcccctaccatac

SEQ ID NO: 53734 - DNA, 250 bp, Heterodera glycines
  Genomic contig location: Contig_ID=SeqID_23033; Location=26..275; Strand=-
  SCN-specific regions: Sequence locations=1-80,122-250
  Gene Ontology: Mol. function=DNA-directed RNA polymerase activity; Cellular component=DNA-directed RNA polymerase III complex; Biological process=growth
atgacactgaaaacctttcactttgctggcgttgcgtccatgaacatcacccaaggcgtgcccaggataaaagagtaagcaaaaaataaaaatatttttttggcatttttttaaaaatttacaaatttgtgtagaatcatcaacgcggtccgcttcatttcaacgcctatcatcaccgtggcattggccgatgagcgggacgaaaagttggcacgacgggtgaaggcacggattgagaagaccacattgg

SEQ ID NO: 53735 - DNA, 484 bp, Heterodera glycines
  Genomic contig location: Contig_ID=SeqID_23034; Location=285..768; Strand=-
  SCN-specific regions: Sequence locations=1-195,258-319,341-484
atggcggcgggggacggactgattttggtggtacaaccgaattaaaaaggtaaatctcccttggcacgcctttggcgtgcctttctaccgtatttctctaattgtcgccccgtctccattaatccccccgtcctttctgaggaggttgaacaataatcccccccgtctccatttatccccccgggcgataaatggaatttttatttttttgaaaaaatttctttttaaaattttaataaaaattaattcatttaaatcgaaactcatttactcgggccaggccgttttcgcgtgggccgtttcgcgtcttttttgaaccttaacaaaatttttccaaattttgtaggctaatagagaacacttagggctatcgaatgataccaagattattggatttggttgacaaagaaaaaagttaagttcaaaaactcgccccacgcgaaaacgaccccccccatttactagtatgtaaatatttaataaa

SEQ ID NO: 53736 - DNA, 1127 bp, Heterodera glycines
  Genomic contig location: Contig_ID=SeqID_23034; Location=931..2057; Strand=+
  SCN-specific regions: Sequence locations=1-198,222-224,246-293,436 -619,641-1127
atgtacccaaaattggtcgatcagattgcgggaggaattgccaaagcagtgcaaaaggccactgacagtcacgcctttcacgagttccccgattgcttatcattggcccacacggaccgactctccatcaaactgaacgctgctcacagtcaaatgtaacagtaatcattttttgagaggaaaaattagacgccgaggaaattaaaaaaaaattatattttcgaattaaaaatgtgaaaaatgtaggcaaaaaaaaaatatttacataaaatgctttagggactatccgtcagaaatttatttaaaaaaaagattattataaaatacataatgattaaaataatttgatatttataaaagtaataataactttttttttaaataaacataatttctataaaatagtaaatttaattaaatttttaaagaaatattgcaaaaaaaaaactgcaactttttttaaatcaaacagattttatgtagcaaggaagtttatcattgagtaaaaaataaaatacatttggctgacggattgtcctccatcactgaatcaatttgtaaagatacctttttatcccctccgccttttgcccccccccacctttttttgtcccatccgtttcccttttttacccttttcagacatcggtcgcttcatcgatcggctaatttgacacagctcgatgcgattagttttaaaattagaaatgaagagcaaaagaagaagttggtcatgacggcagaagtccaaaaggggaacgggctgctgttgaagaatgaggctggcaaagcggtgatgctcgtcagactttccactcacacggccgactcactcggcaaactgatgcacccgtcccaagcgacgctcttcaaggtgggcatggtaacattggcaagcagtgcaccagggatgggccaaattgaaaaataaaaagcgaaatgcgaaaagcgcaatttgcgaaactgaaaaatgcgaaatgaaaaaaaaagcgaaatgcgaaaagtcaaaatatgcgaaaatgcgaaaagcgaaatgcgaaaagcgaaattttttctacaaatttttaatagttaaaatcataaagcaaaaatcattttttaaaattttattccaaatttaaaaatca

SEQ ID NO: 53737 - DNA, 564 bp, Heterodera glycines
  Genomic contig location: Contig_ID=SeqID_4242; Location=436..999; Strand=-
  SCN-specific regions: Sequence locations=1-564
atgccgaaaacgccaaggcagcagagaatttgccagctgaagggaaccgacggcgtagcggtggtaattaccaatgtgcccgtgtcgtccatcactcatccgaacaatcgatcgaaaccgtacataaacacggacaaaaggccatcggaagagaagcaaatgccatatctgtatgcagaaaatgccaaccaaataagggcgcatcacaattacgcaacagaagagtcgggcaaatggatgatgttttttgagaaaggaagcgaattggacgaccattgggacatggcgaagcgattgtacaagtaaaaagagtggcagcgatggaagtgcgatcaattgatcaatcaataataaaacacacggacattcattgattgatagattgatcggcattttgaacgattatccgaacggtaattgtggtttataaaaccccaaaacattcagcgaagggaaattggacggcatcacgagcatgaaagtgtcaacggcattcgacaacccaagggccagcgacaacagaaaggtagcaaaaaatagcgaatggacggacaaaatggaggg

SEQ ID NO: 53738 - DNA, 517 bp, Heterodera glycines
  Genomic contig location: Contig_ID=SeqID_4242; Location=1435..1951; Strand=+
  SCN-specific regions: Sequence locations=1-146,168-238,264-438,463-517
atggatgagatatacaagagatcagtgggtataaatggcacgataaatgagagaagaaggattgattggcttgggattggacgaacggatggacaaatttatgaggggattgactcgtgagaaatagagaaatttaaattatgcacaaaattggaaactttgaatgctgcgaataacagcagaaaatttaaaatcacagaaaatccaaaatttttgaccaatttttttttaatggtagtaaaataaaattaaaaaaaaattaacctatatttaggaattggctgcccaaaactccaatcataagatgtgtatttttttaacggaaaacagaaaaaaacggacaaatcttaacgaaaaaagaatacggaaaacggaattccgccaatgccttgcgaagaatggcattcattgtacaaagattggagaacatatggaataaaataaaaaattggtgaaaaatgtgtcaatgcggggtgatggagaacagcagcagccgaatgtataaaagaaaatgcaa

SEQ ID NO: 53739 - DNA, 1559 bp, Heterodera glycines
  Genomic contig location: Contig_ID=SeqID_4244; Location=658..2216; Strand=-
  SCN-specific regions: Sequence locations=1-240,262-685,708-1059,1089 -1167,1205-1377,1405-1559
taagtgatgataatcattcgctgtttttcaattgtttcttcaagtggttcgtttgctagttgttttcaatgctcgaccatttccagcaggtttttaatttgtcccatggatttgggggtttctggcttttttcaatggaaaacaacccataaatctacaaaaataacagtcaaaaaattgaggaaagggagttttggagatcggaaaatcagattgtgtcattttatttttattatgcaactttattaatgttaatttctactttcccattttcggcgtttcttctgccaccaaaggcgggcaaaggtttcgactccgtgtccccctccccccgatccttcggcggaatttcgtgttgttccaacttcgtcagttataccgcccatctcgggcacggaaaatccgtcgcttggcagaggcgaggcgcggcggatttcatcggtgatttcatttcaacattttgagtcatttttcttcaatattccgcatgttttgatcttgactttatgtctaaacctgcaaattttgtggtttccattaccctaagtccctctacccaaattgacaatttttcaaaaccatcaattttctcaaaatttttttatttttacgttcccagggtgggaatctcccctccctttgttacgggcccactctaatccctaatacattgggccattgctgcattctccttcccggtcattttttgcccaatttagtccataattccctgttgactcccttccctttcgttgttcagctgatcaccgacaatttccgtgccgacgtcgtcgctcgtcgctaccgtttggaccgccttcggccgtccgattggctgctcgtctacaattaccgggtcggctcatggcttttcacggtcggccgttatgcgtttgcccttctctgcgtgatatttttaattgccgtcgatgatttcgtgcgcgtgggcagcggcaaattcacactccaaaagctcagagtgacacacaacgaactgattagggttggacctttggacactattcctccactcattgtcaaacagtagggaagcgagggaattttaaaagaaatttataaaattttaacaagtaagtaataaaaacttctttaaaaattcgtcccatattcggttcaaattctcttcaaattcttccaaaaattctcataaattttttgatatttattaaattaatgattttaagccttacaattagcgtgccattctttggtttaacaattactaaaatgacaattccatgaacagttgtataaatttctggtataaaaacaataattaattttgcattttttttgggttatgtaactcttggaatcttcttatttttgtaggaaaatcagtggcattttctgggcatttctcccccctcccctttttagcttggcatcgttggcaaattcttttgtgccattgctttgctcatttttttcctgctgctgcgcgtccggtcgctgtttttgctccgaatgtatgtgcacagaaaggagccgaaccgaatttgtgcgaccattgcgaagggagtgttctccaaaaaatt

SEQ ID NO: 53740 - DNA, 1515 bp, Heterodera glycines
  Genomic contig location: Contig_ID=SeqID_23035; Location=287..1801; Strand=-
  SCN-specific regions: Sequence locations=1-35,72-291,394-743,766-1482
atgcgactgatcgccgccgggacggcaccgacggcacagcaacaacaacaaccacaacagcttcagcaacagatcagctttggtgtacgaaaattatcaacaatttttttatcaatgtcatttaaatccgtatatcattttactgtttgatcactgtctgatcagtgccgaatctttgacagtttaaaattagttattgctggtgatcattgatcagcttatttgttagagagaaatatacgttgttcaagagtgatcataaaaaattgggcgagaaatttttaagccttcattaatttaaagaaaatctttttttttctaaattttaaaattttaaactgaaaagttaaatatttaatatttttatgtatttacattagatataaaaaaatagttgggaaaatattttggcataggcataagggctataagcctgcaaaattcataaaattttattgaatcaaaagtttttttttttgaaaatctaccattttgcaaagaaatttaaattattttgaacttactttttctttttttaaaaattgcttttttcatttttgtttaggaatttctcgaatttgtccgcgcggtgtttgcgctgcgcggccgcagcgaccaatgcgagcggaaacgaaaagccgactctcttctggtgggcggcactggcggcggtgcgtcggcaccaccgcaacaacgacgcggctccaccctcgtgcgtaaagcaacgattgtgcgcagtgcggtaaaaaataaattttaaaatttcagcgagatttttccggagagacaatgaaattcccctttatggacctgtactgatcactactgatctgccgaatattgatggatcaatctaaaattaatccccctcccctaattaatccctcctaaggcaatgtttgcgtcggcaatcaccgcgcccaccgctggccctgccattgcgcattttgggcgcgcgcggagttcgtccggcacggacggtgacgcaatggcacggacagcaagcgaacagcgcgcattggttctgtttaaagtgcgtgcggaaaattgaaagcctcgcgcggcttttgagtttgaaatattccgaaactcggccgaaaaacttaggccaaggcatcaaaaaaaacaagaaatttttaaaagcgagaccaacctaaactcctagagtttaggcccgatgtgcccctaaaaacagataaattctagaaactccaggaaattgtttgtagattaggagaaatcctaaaaaacctgggttttcagtcccttaattacctaattaggacaatcattatggtgtttttgtcaaattgcgctattatttggacagcaggaattggacacggatgagaaaggctttctgacgaccaacgattttgaacagtttttcgcctgccaacagaagccaatgatttttgtaagttgactaaatcaactgacaaatcagagcaaattttgacaaaacccttttgaaatgaactcatttaatttgtaaattataatattttaaataaa

SEQ ID NO: 53741 - DNA, 611 bp, Heterodera glycines
  Genomic contig location: Contig_ID=SeqID_23036; Location=124..734; Strand=-
  SCN-specific regions: Sequence locations=1-22,45-292,316-477,499-611
atggcaaaacatcaaaaagcgacgccgccaattggcactgagcaaaacggggaaaattcttttgccgccgtcgcttcatcaaattcaacaaattcgattgctgaatgtgccgacgattacgtggacagtcatgacaagccgtggaaattagtggccaaaatcaacgccggcaattgcgaaacactcgaacagcgaaaacatttgcacaaattttgtagcgaagtgagtcggcatttttgattggaaaaatgccgcacaatttgtggtaatggatataatgggcaaaagctggataatttatttatttttaaaattggcggatttttggccaatcaattagtcagcaattagttgcagcgaaacaataggcatttcaccgccagaaatttttggcgttggatcccaaaacgcggcgcgggacaaattgaaataactgtagtctcagaaaaaataaaaaaattttaggaaagaaagttttggttaaaattaaattttgttgtgtgttttgaaaaaccactatgttctgaaaatcaaattttgcttaatttcaagaaaaaacggaaaaattccttgaaaatgttttttttcagggaaacgaaatttttttttaa

SEQ ID NO: 53742 - DNA, 978 bp, Heterodera glycines
  Genomic contig location: Contig_ID=SeqID_23037; Location=24..1001; Strand=-
  SCN-specific regions: Sequence locations=1-18,40-385,407-767,789-978
atgagggcatctgatcagaccaaaaaagacaaaaacaaattatggacgacggacgaaaatcggagggaaaagaagcaaagtgacggtttgatggtgatcgatcacacattttcgtatgtagaatatacctaccgtatatgctctaattatagcccatgggggattatttttcaacctcctcagaaaagggggggggggataattggagactgcgggattaatagagactgggctataattagagcatatacggtatatcgcttttttattttgtttgttttcgatggctttttaagccttagatataaaaatatgtcaaattaataatccatttctttgaatggtttaattttaatattttccatgtatttttctacatttatttgattatttgcccaaatgttctcatctattgatttttgaatgtttacggtgcactattctgtgatttaaggccatattttaaagagaaaaaaatggaaaaaaacccattaaaatgggccaaaaatggggaaataaaaatggttcaaaaaattttaaaaaagagtaaatcaaagcaacattaaaaatgatggcttctgtaacgatatttcatttcgaattccttgataaaattctaacccaccacacaaataaatcacaaaaaaaattttttccacaattgaggggttcagaatttttttttcaaattttccaaacttttttagcattggcacattttttcatttccaattgaatggcttccaccgagttgaccagaatggagcgggaggcgaagccgcagatcaaaattgcccattatattctgcgcgacacgctcggcgtcggcacgttcggcaaagtgaaaggtcagcagacgtgccgaatttcacgccctaccctgccgctgtgacaacaatcattgttggcacagtgccgaaatatggggaatttgatactttggcaagactgtcgatgtgtatagatggtagtccctaa

SEQ ID NO: 53743 - DNA, 287 bp, Heterodera glycines
  Genomic contig location: Contig_ID=SeqID_23039; Location=129..415; Strand=+
  SCN-specific regions: Sequence locations=1-126,151-287
attttctaagaaaaaataggagttttgggggcgcggcggtgccgataatcgccgcccggcgaaaaaaatggaaattttgatcatttataaacagtttttcactgaaaattagccaatttataggtaaaattttgaaaaattttatgggaattcaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctg

SEQ ID NO: 53744 - DNA, 892 bp, Heterodera glycines
  Genomic contig location: Contig_ID=SeqID_23040; Location=107..998; Strand=-
  SCN-specific regions: Sequence locations=1-387,409-459,481-644,666-892
atggcgcaaccgaacactccaaccgctgaagttggtgggggaaaggggtggggggggctgaatatggaattggggtgcactctgctctcggcttgaaataccctaccttgcaccttttggtttgcaataatgcataagaatgtgtgttgtctaaaatatgtatcaaacgattcctgtcttgtgcctgtaactttgtatcaaattgtcgccggccacccagacttagctttcacaaatggcattttgccaactaaatctaaatcggattattcgccaattattctaaaatgatgtttttgctggatgaaaatgtaaatacatggttcctattcgttcttcgatgacaaaattatatgtccttgaaaagtatcgttcgaaaaaacattattttattaaaaccaatttttaaatacctaaaagttatcctaagcctaagtaggccgtttttacggtattgtgttttctaagaatttttattccaaaaatcatgaaaattatgtaaatttttttaatttacagccctattgaccagaattcggaatcgtccgattttgtataattggctacctgtccgcgtccatgacgcataattcattttaaatcaatttttcccttattccggtccgctgatatcatggatatttttgaaaattatagctttaaaaactctcctttgatttttgaaaatgtatcatctccctcaccaagcaaagagtgacaaaacatatcgccaaaaatgactatattgttttttaatcgctaacattgaacaatatttgtgaatatgcaatttttcctcaaattatttgtttaatattggactaaatgttatttttttacatgtatccactttaaggtctttaaatttcaaacactaactagtgtcaataaa

SEQ ID NO: 53745 - DNA, 379 bp, Heterodera glycines
  Genomic contig location: Contig_ID=SeqID_23040; Location=1260..1638; Strand=-
  SCN-specific regions: Sequence locations=1-379
atgtacatcgatgaaaaggcggtggcaacggcaacaaccaatttaaaaaaaggtcggacgatgccgccgcgagcagcggaaacgggaacatttgtcaccgaccgggtcggcgccgttggtaataacttttctcttaattttgtctttttcgtcattttttgtttgttactcaaaatttattttttgatcaataatgcgtttttttgttattttgaagctaagtgtaataatttattaacttcgtaaacggtctcttccagtttttgcattttttagcacaacattgagtcagacaatgcaaaaacggcgaatttgattgtactacaatatgttgttggtcgacactcagaaatgattttatgcgttcaatgctaataaa

SEQ ID NO: 53746 - DNA, 1317 bp, Heterodera glycines
  misc_feature (228)..(228): n is a, c, g, or t
  Genomic contig location: Contig_ID=SeqID_23042; Location=446..1762; Strand=+
  SCN-specific regions: Sequence locations=1-358,380-659,681-857,883 -1317
atgaaggaaagatggccccataacaacagtcatccctccagtggtggatgtggtctagtggctaagacaacggatccacgtaaggggccccgagcggcggttcaaatccggccttccaccccaatttttcgcctaaataatactgctccgttttagtgtttaggattctcgaccaaaagaatttaaatttaggcccggaattttgaaatgaacgagaccgaaaccagngagtttagaaatggaccgggacgggggtttatcgagacaaaaaaaacccatttgttagcggcctagtccaggatggtttgcttgcgcgccgggcccccggacccatccaggctgaggtttgttgtaattcaaactttttagaatgaaaatacctaataatagacagtatgttgaacaagagaagggtccgtatcgttttggcgccgacgttttggcgccagggtcgttttggcgccgacgttttggcgccaagccataataaaaaaaagaaaaacacccaaatttaaaaattttcgaaaaattttgtaaaacaagaaaaaaaacgtatttttcgcgaaggtaatactgccgatggttgttggttgcccccctttttgaagaaaatttttttgttttcaaaagtcacaagtactattcaattaaaggaataataaatattttttcaatttttaagatcatcaaacgcgctcgacacgaagtcaatgcaccacctgctgtccctcaaaacattgaacaactgattgttcctccggcttaccggacatatgaaccaactgatgggaacgaagagcagttcctgttgggtgactctggtgtgtttttcgagcccggaaacgaaaacccacaacggtaattgttaaaaggaatgtttagattcaactttttttcaaggattctgctgtttgggcgcgaatctttcggccggtgggctgatcgaatgaaagaatgtttcggagacggcacattctcattggcacctccaatgttctaccaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcttggtcgacattctcgcctgcctcgttcaaaatggacttcgagaccgctgcgcgcaacgccgctgttgccacgtttcctgcatgcgaaatcaaattttgcttcttccatttcgcgcggaatttgcaaaaaaaaatcaaggaacaaaatctctgggaggtca

SEQ ID NO: 53747 - DNA, 744 bp, Heterodera glycines
  Genomic contig location: Contig_ID=SeqID_23044; Location=294..1037; Strand=+
  SCN-specific regions: Sequence locations=1-114,142-744
tgatgtggttgacgccatgccaaaaccagtcaacgttacaaggccaattgttgtttctacgcgtcgccatcttaaagttgggcgtgcgcgaaaagaaaatgttgaacaattagaagatactgatgatgatgatgattatcaaaacccacggtcgtcaagttaaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaaaaaaaatgcagcatacaaagcgctatttgttagtccccaaagagatttatcagagtttggcagcaccgccaccatctgacggaacaccaattgggctggtccgtacccgaattaaacaaataaaaaatgatgacgccataaatgaggcggaaagggcagtcaaatatgagcaggaacttaagcgtctcaacaagctcacaaaggacgaagatgaacgtcccgtgggtgttaaattagaaaatttgagtgatgtggttgacgccatgccagaatcatccactgtcggatggtccattactaacggattgtccttccctgacggattgtgccctgacggattagccactgtcggatatccactggcggattgtccggacccctaa

SEQ ID NO: 53748 - DNA, 2355 bp, Heterodera glycines
  Genomic contig location: Contig_ID=SeqID_4245; Location=365..2719; Strand=-
  SCN-specific regions: Sequence locations=1-140,162-806,828-1030,1052 -1302,1325-1635,1658-1720,1745-1824,1878-1897,1924-2355
  Gene Ontology: Mol. function=sphingomyelin phosphodiesterase activity; Cellular component=extracellular; Biological process =ceramide biosynthesis
atggcatttcgtcgctcattcgatggcatttctcttcgaattggcacttttttgcttctcttcacaaattcagcacttcttctccaaccaccagcagcagtaaatggtgttgtctatgctcaaatggctttatttgcacattaaattgtttttgtctcccattcgcagcctttccgtggaaatgctatgggtgtcgcggcggtgtcgaactccttcgacttttatatgaggtggttttttcgctgatcagtgatcagtccgttcaattggctcatttacgccttcgaattttgatcggtccgtttgaatgaccattttgtagacaaatgcgacggccgaccgaattttgagtgttgccgattttgtgtgccgtcactttgcggactcggattcgttcgtgtgccatggcatcaccacgcagttccgggaagagttcctctacgtgctgggccgtctcgtgatcagtcccggccaactctgcgctttgttggtcaccgattgcggcacaccgttggacccattcggcacgaattggtcagtcagtcggtcggacagcggacggaacacgttgtcacaaacgtagtgataaccccattactgtaacctaccgtaaccataattgttgagggaaagagcaccataggctgtaattttaaaaactaacggttcatgatttcagaaatggaccgggacaggattaattaagtgtctgtaaatcccaccaactttcaattcggttgagcatattcgttatcaatggtatccgatcaaaaacattgcgaaatatttgctctaagccgaggaggaagagggaccattgaagctgatcaatcaatcacctcaacaccaaaggacagtgccgttaccgccaaaagtcaacggcatcaaaaagttgtctcggccgccggcagaaaatcacaccaccaccctcaatttgcttccgccggcacggcctttgcgcattttgcagttgagtgacctgcactttgaccgcaagtacgcgtccgggacggaggcggactgtgctgagccggtgtgctgtgtgaatgggactgagagggcatcgccaggttggcacccctcggagtgatcggccaacgaaattgacatgttgcatttgctttggtatttagggcagacaaaagttcgaattcccgcgggcaaatggggcacattggccaaatgtgacattccggtaagggaatgaattaagaaaaactgaatttccgaaaagttttttcgtgattttaagctgcgcacagtggagaatatgctggaacacatccaacgctctcacgaggcactcacatttatattttattttagtccaaaaaaggaaaagccgggaatttatttcccgaaactttcctcgagattcctaagcataagaaccctttgtctgcatataccggccggccaattcacaatcattttcagatcgattttgttttcctttccggcgattacatggaccaccgcgactggggtaaatgcgccaaaggactgctcgagattctcgggctccttctcagactttactttctttcggcaattccatccatgaatttctgccttttttgttagagtattcccgtgtgggccatttgtcccagttggatcaattgtccgcgttgctccgtcatcactttgacactgtgcccgtcttttggaccctcggcaaccacgagggtgtgccggtgaatgcattcgcaccccatttcgtgccggagcggttccggccccagtggatgtatcgcgcaatggttgacgcggtgcaacggaccgccgcgcgactgccaaaagaggcggagcgtagtgccctttagtaaaaataaataaagaaaatgaaattggaaatggaaaaataaaataaaaatggatcgcatatataataaaactatttttatacattttaaaagggtgtaaatggccaaattcccccttccctaacctttcagtcgtggctcttatatggtgccacttttgcccggaattcgactgatctcactgaacaacggatactgcgaaaagacgaacatgtgagtggtcgtatgctcattgtcagtgatcggcaatttatgatagattaacgagcgatcccattagcggggaacaaaccatcacttaacggagggggggggggggaatgtcgtcatctctcgtcgctctcaatctgtccgtcctctcattttgccacgctctctcgcgtctctcctattcttttatagtttggtttcgatcactgaccctcgctttctcttctgtcccaggttcatttacatcaatcagacggacccggacgggtcgctgagttggctggtcgaccaattatgggcagcagagaaagcggatgag

SEQ ID NO: 53749 - DNA, 984 bp, Heterodera glycines
  Genomic contig location: Contig_ID=SeqID_4247; Location=19..1002; Strand=+
  SCN-specific regions: Sequence locations=1-479,502-558,603-712,746 -790,821-897,924-984
atgccaccaaaaccatccggcaaaggggcgaagaaagcggtgaagtccaccaaagcggtgcgaacgggcgacaagaagaggcgtaaggctcgcaaggagtcgtactctgtgagttcggaattcgggggaattttcagtgccgagggtttcttttcaacagcgttttcggaaattatagttaaaaatggagaatataatgtaaaaaaggggaaccgaccacttcggcgcggaccatttcggcgccgattcaaataacttctttcattatcaaccaaattaaatatttttattatcattcgatagctcttgagattctctattagcctgcaaaatttcaaaaaatttcatctgttcacaaaaaagttatggccaaaaaactaactttttcttggctttttcggcgccgcgtgccataacttttttattgttgaatcattaatttctattttggcatgtaaatatagagcacacatagagctttcaaatgatgatggagaatataatgtaaaaaaagtacttacggtattcttgtccccttccaaggtgtacatctaccgcgtgctgaagcaggttcacccggacaccggcatctcctccaaggcgatgtccatcatgaactcgtaagacattttcaaaagttaacgatcactcatgaattttgcttgtcaggttcgtcaacgacgttttcgagcgcattgccgcggaagcctctcgtctggcccactacaacaagcgatcgaccatctcttcgcgcgaaatccaaacggccgtccgtctgattctgcctggcgagttggccaagcacgccgtgtcggaggggaccaaggcggtgacgaagtacacctcgtcaaagtgatgatgcgacggtgctggcgatgaaatgaaacccaaaattatcccaaacggccctctttagggccacaagcacccaaatggacggatatgtttttcgaaaaacttgcttttgcattttcttttgtttga
